(12) United States Patent
Rigoutsos

(10) Patent No.: US 11,578,366 B2
(45) Date of Patent: Feb. 14, 2023

(54) COMPOSITIONS AND METHODS OF USING RNA FRAGMENTS

(71) Applicant: THOMAS JEFFERSON UNIVERSITY, Philadelphia, PA (US)

(72) Inventor: Isidore Rigoutsos, Astoria, NY (US)

(73) Assignee: Thomas Jefferson University, Philadelphia, PA (US)

( * ) Notice: Subject to any disclaimer, the term of this patent is extended or adjusted under 35 U.S.C. 154(b) by 0 days.

(21) Appl. No.: 16/471,318

(22) PCT Filed: Dec. 22, 2017

(86) PCT No.: PCT/US2017/068261
§ 371 (c)(1),
(2) Date: Jun. 19, 2019

(87) PCT Pub. No.: WO2018/119421
PCT Pub. Date: Jun. 28, 2018

(65) Prior Publication Data
US 2020/0325537 A1    Oct. 15, 2020

Related U.S. Application Data

(60) Provisional application No. 62/498,368, filed on Dec. 22, 2016.

(51) Int. Cl.
*C12Q 1/6883* (2018.01)
*C12Q 1/686* (2018.01)

(52) U.S. Cl.
CPC ......... *C12Q 1/6883* (2013.01); *C12Q 1/686* (2013.01); *C12Q 2600/112* (2013.01); *C12Q 2600/178* (2013.01); *G01N 2800/168* (2013.01)

(58) Field of Classification Search
None
See application file for complete search history.

(56) References Cited

U.S. PATENT DOCUMENTS

2014/0235847 A1   8/2014  Sooknanan
2015/0176073 A1*  6/2015  Skog ................... C12Q 1/702
                                          506/2

FOREIGN PATENT DOCUMENTS

WO   2000027340 A2   5/2000
WO   2015153566 A1  10/2015

OTHER PUBLICATIONS

Rasmussen (Current Alzheimer Research 2015 vol. 12 984-989).*
Lambert (Non-coding RNA 2019 vol. 5 No. 16).*
Rosace (RNA Biology 2020 vol. 17, No. 8 pp. 1196-1213).*
International Search Report and Written Opinion, dated May 1, 2018, International Application No. PCT/US17/68261, 15 pages.
Love, et al., "Moderated estimation of fold change and dispersion of RNA-seq data with DESeq2", Genome Biology, 15:550 (Dec. 2014), 21 pages.

* cited by examiner

*Primary Examiner* — Amanda Haney
(74) *Attorney, Agent, or Firm* — Saul Ewing Arnstein & Lehr LLP; Kathryn Doyle; Justin Crotty

(57) ABSTRACT

The present invention includes a method for analyzing RNA fragments. In one aspect, the present invention includes a method of identifying a subject in need of therapeutic intervention to treat a disease or condition, disease recurrence, or disease progression comprises characterizing the identity of rRNA fragments. The invention also includes diagnosing, identifying or monitoring a disease or condition, and a method for identifying rRNA fragments. The invention also includes diagnosing, identifying or monitoring a glaucoma in a subject in need thereof by characterizing the identity of rRNA or tRNA fragments.

7 Claims, 17 Drawing Sheets

Specification includes a Sequence Listing.

>hg38_UsingFlankCoords_1_-_228634861_228634999_rRNA-5S_fullPlus_10_bases_BiPaddings (SEQ ID NO: 71881)

ctccttcagcGTCTACGGCCATACCACCCTGAACGCGCCCGATCTCGTCTGATCTCGGAAGCTA
AGCAGGGTCGGGCCTGGTTAGTACTTGGATGGGAGACCGCCTGGGAATACCGGGTGCTGTAGGC
Tttttctttgg

FIG. 2

>hg38_UsingFlankCoords_MT_+_638_1611_rRNA-12S_fullPlus_10_bases_BiPaddings (SEQ ID NO: 71882)

cccataaacaAATAGGTTTGGTCCTAGCCTTTCTATTAGCTCTTAGTAAGATTACACATGCAAG
CATCCCGTTCCAGTGAGTTCACCCTCTAAATCACCACGATCAAAAGGAACAAGCATCAAGCAC
GCAGCAATGCAGCTCAAAACGCTTAGCCTAGCCACACCCCACGGGAAACAGCAGTGATTAACC
TTTAGCAATAAACGAAAGTTTAACTAAGCTATACTAACCCCAGGGTTGGTCAATTTCGTGCCAG
CCACCGCGGTCACACGATTAACCCAAGTCAATAGAAGCCGGCGTAAAGAGTGTTTTAGATCACC
CCCTCCCCAATAAAGCTAAAACTCACCTGAGTTGTAAAAAACTCCAGTTGACACAAAATAGACT
ACGAAAGTGGCTTTAACATATCTGAACACACAATAGCTAAGACCCAAACTGGGATTAGATACCC
CACTATGCTTAGCCCTAAACCTCAACAGTTAAATCAACAAAACTGCTCGCCAGAACACTACGAG
CCACAGCTTAAAACTCAAAGGACCTGGCGGTGCTTCATATCCCTCTAGAGGAGCCTGTTCTGTA
ATCGATAAACCCCGATCAACCTCACCACCTCTTGCTCAGCCTATATACCGCCATCTTCAGCAAA
CCCTGATGAAGGCTACAAAGTAAGCGCAAGTACCCACGTAAAGACGTTAGGTCAAGGTGTAGCC
CATGAGGTGGCAAGAAATGGGCTACATTTTCTACCCCAGAAAACTACGATAGCCCTTATGAAAC
TTAAGGGTCGAAGGTGGATTTAGCAGTAAACTAAGAGTAGAGTGCTTAGTTGAACAGGGCCCTG
AAGCGCGTACACACCGCCCGTCACCCTCCTCAAGTATACTTCAAAGGACATTTAACTAAAACCC
CTACGCATTTATATAGAGGAGACAAGTCGTAACATGGTAAGTGTACTGGAAAGTGCACTTGGAC
GAACcagagtgtag

FIG. 3

>hg38_UsingFlankCoords_MT_+_1661_3239_rRNA-16S_fullPlus_10_bases_BiPaddings
(SEQ ID NO: 71883)

```
accgctctgaGCTAAACCTAGCCCCAAACCCACTCCACCTTACTACCAGACAACCTTAGCCAAA
CCATTTACCCAAATAAAGTATAGGCGATAGAAATTGAAACCTGGCGCAATAGATATAGTACCGC
AAGGGAAAGATGAAAAATTATAACCAAGCATAATATAGCAAGGACTAACCCCTATACCTTCTGC
ATAATGAATTAACTAGAAATAACTTTGCAAGGAGAGCCAAAGCTAAGACCCCCGAAACCAGACG
AGCTACCTAAGAACAGCTAAAAGAGCACACCCGTCTATGTAGCAAAATAGTGGGAAGATTTATA
GGTAGAGGCGACAAACCTACCGAGCCTGGTGATAGCTGGTTGTCCAAGATAGAATCTTAGTTCA
ACTTTAAATTTGCCCACAGAACCCTCTAAATCCCCTTGTAAATTTAACTGTTAGTCCAAAGAGG
AACAGCTCTTTGGACACTAGGAAAAAACCTTGTAGAGAGAGTAAAAAATTTAACACCCATAGTA
GGCCTAAAAGCAGCCACCAATTAAGAAAGCGTTCAAGCTCAACACCCACTACCTAAAAAATCCC
AAACATATAACTGAACTCCTCACACCCAATTGGACCAATCTATCACCCTATAGAAGAACTAATG
TTAGTATAAGTAACATGAAAACATTCTCCTCCGCATAAGCCTGCGTCAGATTAAAACACTGAAC
TGACAATTAACAGCCCAATATCTACAATCAACCAACAAGTCATTATTACCCTCACTGTCAACCC
AACACAGGCATGCTCATAAGGAAAGGTTAAAAAAAGTAAAAGGAACTCGGCAAATCTTACCCCG
CCTGTTTACCAAAAACATCACCTCTAGCATCACCAGTATTAGAGGCACCGCCTGCCCAGTGACA
CATGTTTAACGGCCGCGGTACCCTAACCGTGCAAAGGTAGCATAATCACTTGTTCCTTAAATAG
GGACCTGTATGAATGGCTCCACGAGGGTTCAGCTGTCTCTTACTTTTAACCAGTGAAATTGACC
TGCCCGTGAAGAGGCGGGCATAACACAGCAAGACGAGAAGACCCTATGGAGCTTTAATTTATTA
ATGCAAACAGTACCTAACAAACCCACAGGTCCTAAACTACCAAACCTGCATTAAAAATTTCGGT
TGGGGCGACCTCGGAGCAGAACCCAACCTCCGAGCAGTACATGCTAAGACTTCACCAGTCAAAG
CGAACTACTATACTCAATTGATCCAATAACTTGACCAACGGAACAAGTTACCCTAGGGATAACA
GCGCAATCCTATTCTAGAGTCCATATCAACAATAGGGTTTACGACCTCGATGTTGGATCAGGAC
ATCCCGATGGTGCAGCCGCTATTAAAGGTTCGTTTGTTCAACGATTAAAGTCCTACGTGATCTG
AGTTCAGACCGGAGTAATCCAGGTCGGTTTCTATCTACNTTCAAATTCCTCCCTGTACGAAAGG
ACAAGAGAAATAAGGCCTACTTCACAAAGCGCCTTCCCCCGTAAATGATATCATCTCAACTTAG
TATTATACCCACACCCACCCAAGAACAGGGTTTgttaagatgg
```

FIG. 4

>hg38_UsingFlankCoords_21_+_8423222_8456572_rRNA-45S_fullPlus_10000_bases_BiPaddings
(SEQ ID NO: 71884)

```
ccgccacctccctgggttcaagcgattctcctgcctcagcctcccgagtagctgggactacagg
tgcccgccaccacgcccagctaatctttatactttttaatagagacggggtttcaccgtgtcggc
ccggatggtctcgatctcttgacctcgtgacccgccgcctcggcctcccaaagtgctgggatg
acaggcgtgagccactgagcccggccttctcttgacgtttaaactatgaagtcagtccagagaa
acgcaataaatgtcaacggtgaggatggtgttgaggcagaagtaggaccacacttttcctatc
ttattcagttgataacaatatgacctaggtagtaatttcctatgtgcctacttatacacgagta
caaaagagtaaaacagagagactgctaaattaaagggtacgtgaagttcttcatagtaactccg
taaactggaacactgtcaaaaagcagcagctagtgaattgtttccatgtatttttctattatcc
aataagtgaactatgctattccttccagtctcccaagcacttcttgtccccatcaccacttcg
gtgctcgaagaaaagtaacaaatcaaggaacacaactaaagaaacacacacacaaaccaaaga
caactacagcgtctgcaaaagtttgctagaagactgaaactgttgagtataaggatctggtatt
ctacgatcatgagttcacttcagagtttgttcaagacatacgtttcgtaaggaaacatcttagt
tagaagttattcagcagtaggtaccatccctaagtattttcaccaaattcgtgacaataaaga
gctatctaaccagaaaaattagcgagtaccggcaccatccatagggctttgtctttacgcttca
ttagcacttaccatgccttacaatgtctaggattgaccctgatagcatttcgaaaacaagctaa
tgctttgtccagttcttcagtgaagacaagctcacgccctaatgcgctataggcataagcatca
tttggatccacttcgagagttctctggaagaattgaatcgcaatatcgtgttcccgttgcagac
cgaaacagttccctgcagcacaccaggcctctggctggcgaattttatccatgtctgtgaagt
ctttggacagaactgaaagagcaacctctttcggaggatgccaaagtgttgtagagtagatctc
catgccttcgactctgtaattctcaatcctcctaacctctgagaattgtctttcagcttgcgtg
gactctgaaagtttacaataggcccttccgatttggcacagtacccaaccggtattgcagtggt
gagaagctagatggctcaagatgctgatagcttctttgccgtggtaagaacacaaagctaaata
acctttccccctttcacgaagaaggctcatcaagccttccgctgctgcttttgtagattaaaa
gcctgaatctgaggcgcgattgtggctattttccttctgaaatgacggaagagtccaattttg
tcacttccaggctatcacttatgttcggtggagttattgctcctttattagttttacttttggt
tcttctgtttgggattttaggtggaaacttcattttaattttctcctattctcctcggttgtg
gagctgtcactagtcaagagtcgtgaatttcttcgaggcggtgcatttggggggagatgccatag
tggggctcaataccctgaggtgttgcccttgtcggcggaccagaactttgtgtttttgcaaggac
tggagttacctttcggctcttttcccctctgcgagaagacagacggtgttccggtttggccgatt
ctggcaacaggctttttgaaggggctccggtggatggcacgtcaatgacagacggtgtctcat
accagtgcagttttgtcaataggggtccgtctccgggacttggggtttctaatggcaaaatgcca
acacttggggttaatggactaacagctgctggtcctcctaataaacttcgaccagttttggtt
tatgttgaacctgtttagatcatatggaagttcctgttcccagtgggacagtatcaggtgaaag
gacagctgaatcgatagaagacactggggagtctgtattcaaggagtactttgaattggaagat
tctaaattccatccgtttcattcgacggtgtcctggggtgtttccgtaagaacggtctcgggct
gtctgtgacataaactaggacgaggtccaagtgttgtggcgcaacacttggacaggcagttgct
aaagctctctagagaggtgaatcaaaatgtttggtcaggatctggcttttccccctatttcac
atcatgattcaaagggacaccagaggaaaggatttcaacgaaggctcttttggtcacattctga
tcctttggtaagccgatctgtcttgcaatatacatgtcccgacgatggaagggggaagcgagct
gaatcaccaaactcaggaacgataatatcatcgtggcttttctgcttatgaaacactccacccg
ataagatttgatccccttctgcaagcttgctgagatcaacacaacatttcgcaagcaggcattt
gcattgcggggtagtacaactgtgtcctttcaagagtctatatgttttataggcctttcctgag
```

FIG. 5

```
cggtaagaacaggtcgccagtaagaacaaggcttcttctgagtgtacttctgcataaaggcgtt
ctgcgggggaaaccgcatctcggtaggcatagtggtttagtgcttgccatatagcagcctggac
gggtccctgcagcaccgccatcctcgaggctcaggcccactttctgcagtgccacaggcacccc
cccccccccatagcggctccggcccggccagcctcggctcatttaaaggcaccagccgccgtt
accggggatgggggagtccgagacagaatgacttctttatcctgctgactctggaaagcccgg
cgccttgtgatccattgcaaaccgagagtcacctcgtgtttagaacacggatccactcccaagt
tcagtgggggatgtgagggtgtggcaggtaggacgaaggactctcttccttctgattcggtc
tgcacagtggggcctaggctgggagctctctccgtgcggaccgctgactccctctaccttgggt
tccctcggccccaccctggaacgccgggccttggcagattctggcccttcctggcccttcagtc
gctgtcagaaaccccatctcatgctcggatgccccgagtgactgtggctcgcacctctccggaa
acattggaaatctctcctctacgcgcggccacctgaaaccacaggagctcgggacacacgtgct
ttcgggagagaatgctgagagtctcttgccgactctctcttgacttgagttcttcgtgggtgcg
tggttaagacgtagtgagaccagatgtattaactcaggccgggtgctggtggctcacgcctgta
acccccaacactttgggaggccgaggccgtaggatccctcgaggaatcgcctaaccctggggagg
ttgaggttgcagtgagtgagccatagttgtgtcactgtgctccagtctgggcgaaagacagaat
gaggccctgccacaggcaggcaggcaggcaggcaggcagaaagacaacagctgtattatgttct
tctcagggtaggaagcaaaaataacagaatacagcacttaattaattttttttttttcccttcgg
acggagtttcactcttggtgcccacgctggagtgcagtggcaccatctcggctcaccgcaacct
ccacctcccgcgttcaagcgattctcctgcctcagcctcctgagtagctgggattacagggagg
agccaccacacccagctgattttgtattgttagtagagacggcatttctccatgtgggtcaggc
tggtctcgaactggcgaccccagtggatctgcccgccccggcctcccaaagtgctgggtgaca
ggcgtgagccatcgtgactggccggctacgtttatttatttattttttaattattttactttt
ttttagttttccattttaatctatttatttatttacatttatttatttatttatttatttactt
atttatttattttcgagacagactctcgctctgctgcccaggctggagtgcagcggcgtgatct
cggctcactgcaagctccgcctcccgggttcacgccattctcctgcctcagcctcccaagtagc
tgggactacaggcgcccgccaccgtgcccggctaacttttgtatttgagtagagatggggtt
tcactgtggtagccaggatggtctcgatctcctgacccgtgatccgtccacctcggcctccca
aagtgctgggatgacaggcgtgagccaccgcccggcctatttatctatttattaactttgag
tccaggttatgaaaccagttagttttgtaattttttttttttttttttgagacgagg
tttcaccgtgttgccaaggcttggaccgagggatccaccggccctcggcctcccaaaagtgcgg
ggatgacaggcgcgagcctaccgcgcccggaccccccctttccccttccccgcttgtcttccc
gacagacagtttcacggcagagcgtttggctggcgtgcttaaactcattctaaatagaaatttg
ggacgtcagcttctggcctcacggactctgagccgaggagtcccctggtctgtctatcacagga
ccgtacacgtaaggaggagaaaaatcgtaacgttcaaagtcagtcatttgtgatacagaaata
cacggattcacccaaaacacagaaagcagtcttttagaaatggccttagccctggtgtccgtgc
cagtgattcttttcggtttggaccttgactgagaggattcccagtcggtctctcgtctctggac
ggaagttccagatgatccgatgggtgggggacttaggctgcgtcccccaggagccctggtcga
ttagttgtggggatcgccttggagggcgcggtgacccactgtgctgtgggagcctccatccttc
cccccacccctccccaggggatcccaattcattccgggctgacacgctcactggcaggcgtcg
ggcatcacctagcggtcactgttactctgaaaacggaggcctcacagaggaagggagcaccagg
ccgcctgcgcacagcctggggcaactgtgtcttctccaccgccccgccccacctccaagttc
ctccctccttgttgcctaggaaatcgccactttgacgaccgggtctgattgacctttgatcag
gcaaaaacgaacaaacagataaataaataaataacacaaaagtaactaactaaataaaataag
tcaatacaacccattacaatacaataagatacgatacgataggatgcgataggatacgatagga
```

FIG. 5 (Continued)

```
tacaatacaatacgatacgatacaatacaatacaatacaatacaatacaatacaatacaataca
atacaatacgccgggcgcggtggctcatgcctgtcatcccgtcactttgggatgccgaggtgga
cgcatcacctgaagtcgggagttggagacaagcccgaccaacatggagaaatcccgtctcaatt
gaaaatacaaaactagccgggcgcggtggcacatgcctataatcccagctgctaggaaggctga
ggcaggagaatcgcttgaacctgggaagcggaggttgcagtgagccgagattgcgccatcgcac
tccagtctgagcaacaagagcgaaactccgtctcaaaaataaatacataaataaatacatacat
acatacatacatacatacataaattaaaataaataaataaaataaaataaataaatgggc
cctgcgcggtggctcaagcctgtcatcccctcactttgggaggccaaggccggtggatcaagag
gcggtcagaccaacagggccagtatggtgaaacccgtctctactcacaatacacaacattagc
cgggcgctgtgctgtgctgtactgtctgtaatcccagctactcgggaggccgagctgaggcagg
agaatcgcttgaacctgggaggcggaggttgcagtgagccgagatcgcgccactgcaacccagc
ctgggcgacagagcgagactccgtctccaaaaaatgaaaatgaaaatgaaacgcaacaaaataa
ttaaaaagtgagtttctggggaaaagaagaaaagaaaaaagaaaaaaacaacaaaacagaaca
accccaccgtgacatacacgtacgcctctcgcctttcgaggcctcaaacacgttaggaattatg
cgtgatttctttttttaacttcattttatgttattatcatgattgatgtttcgagacggagtct
cggaggcccgccctccctggttgcccagacaaccccgggagacagaccctggctgggcccgatt
gttcttctccttggtcaggggtttccttgtctttcttcgtgtctttaacccgcgtggactcttc
cgctcgggtttgacagatggcagctccactttaggccttgttgttgttggggactttcctgatt
ctccccagatgtagtgaaagcaggtagatttgccttgcctggacttgcctggccttgccttttc
tttctttctttctttattactttctcttttcttcttcttcttcttcttcttcttcttcttcttcttcttcttcttctt
cttcttcttcttcttttttttttgagacagagtttcactcttgttgcccaggctagaggg
caatggtgcgatctcggctcaccgcaccctccgcctcccaggttcaagcgattctcctgcctca
gcctcctgattagctgggattacaggcatgggccaccgtgcctggctgatgtttgtacttttag
tagagacggtgttttttccatgttggtcaggctggtctcccactcccaacctcaggtggtccgcc
tgccttagcctcccaaagtgctgggatgacaggcgtgagccaccgcgcccagcctctctctctc
tctctctctctctctctctctctctctctcgctcgcttgcttgcttgctttcgtgctttctt
gctttcccgttttcttgctttctttctttctttcgtttcttcatgcttgctttcttgcttgct
tgcttgctttcgtgctttcttgctttcctgttttctttctttctttctttctttgtttctttc
ttgcttgctttcttgcttgcttgctttcgtgctttcttgttttctcgatttctttctttcttt
gtttctttcctgcttgctttcttgcttgattgctttcgtgctttcttgctttcttgttttcttt
ctttcttttgtttctttctttcttgcttccttgttttcttgctttcttgcttgcttgctttcgt
gctttcttgttttcttgctttctttcttttgtttctttcttgcttgctttcttgcttccttgtt
ttcttgctttcttgcttgcttgctttcgtgctttcttttcttgctttcttttctttctttcttt
cttttctttctttcttgctttcttttctttcattcattcattctttctttctttcctttcttt
ctttctttctttctatctttctttctttctttctttctgtttcgtccttttgagacagagtttc
actcttgtttccacggctagagtgcaatggcgcgatcttggctcaccgcaccttcgcctcccg
ggttcgagcgcttctcctgcctcagcctcccgattagcggggattacagggaggcaccccacg
cctggcttggctgatgtttgtgttttagtaggcacgccgtgtctctccatgttgctcaggctg
gtctccaactcccgacctcctgtgatgcgcccacctcggcctctcgaagtgctgggatgacggg
cgtgagccaccgtgcccggcctgttgactcatttcgcttttttatttctttcgtttccacgcgt
ttacttatatgtattaatgtaaacgtttctgtacgcttatatgcaaacaacgacaacgtgtatc
tctgcattgaatactcttgcgtatggtaaatacgtatcggttgtatggaaatagacttctgtat
gatagatgtaggtgtctgtgttatacaaataaatacacatcgctctataaagaagggatcgtcg
ataaagacgtttatttttacgtatgaaaagcgtcgtatttatgtgtgtaaatgaacgagcgtacg
```

FIG. 5 (Continued)

```
tagttatctctgttttctttcttcctctccttcgtgttttcttccttcctttcttcctttctc
tccttctttaggttttcttcctctcttcctttccttcttctctcttctgtccttttttcct
tcgtgctttatttctctttcgttccctgtgtttccttctttttcttcctctctgtttcttt
tcccttctttccttcgtttctttcctcattctttctctctttttcgtgtttctttccttcccgt
ctgtcttttaaaaatggagtgtttcagaagtttactttgtgtatctacgttttctaaattgtc
tctcttttctccattgtcttcctccctccctccctccctccctgctcccttccctccctc
cttcccttcgccatctgtctcttttccccactcccctcccccgtctgtctctgcgtggattc
cggaagagcctacccattctgcctctccgtgtgtctgcagcgacccgcgaccgagtccttgtgt
gttctttctccctccctcactccctccctccctccctgcttccgagaggcatctccaaac
acccacgcgccgtgggttgtcttctgactctgtcgcggtcgaggcagagacgcgttttgggcac
cgtttgtgtgggttggggcagaggggctgcgttttcggcctcgggaagagcttctcgactcac
ggtttcgctttcgcggtccacgggccgccctgccagccggatctgtctcgctgacgtccgcggc
ggttgtcgggctccatctggcggccgctttgagatcgtgctctcggcttccggagctgcggtgg
cagctgccgagggagggaccgtccccgctgtgagctaggcagagctccggaaagcccgcggtc
gtcagcccggctggcccggtggcgccagagctgtggcgcgtcgcttgtgagtcacagctctggc
gtgcaggtttatgtgggggagaggctgtcgctgcgcttctgggcccgcggcgggcgtggggctg
cccgggccggtcgaccagcgcgccgtagctcccgaggcccgagccgcgacccgcggggacccgc
cgcgcgtggcgcgggaggctggggacgcccttcccggcccggtcgcgggtccgcgctcatcctg
gccgtctgaggcggcggccgaattcgtttccgagtccccgtggggagccggggaccgtcccgcc
cccgtccccgggtgccggggagcggtccccgggccgggccgcggtccctctgccgcgatccttt
tctggcgagtccccgtgcggagtcggagagcgctccctgagcgcgcgtgcggcccgagaggtcg
cgcctggccggccttcggtccctcgtgtgtcccggtcgtaggaggggccggccgaaaatgcttc
cggctcccgctctggagacacgggccggccccctgcgtgtggcacgggcggccgggagggcgtc
cccggcccggcgctgctcccgcgtgtgtcctgggttgaccagagggccccgggcgctccgtgt
gtggctgcgatggtggcgttttggggacaggtgtccgtgtcgcgcgtcgcctgggccggcggc
gtggtcggtgacgcgacctcccggccccgggggaggtatatctttcgctccgagtcggcatttt
gggccgccgggttattGCTGACACGCTGTCCTCTGGCGACCTGTCGCTGGAGAGGTTGGGCCTC
CGGATGCGCGCGGGGCTCTGGCCTACCGGTGACCCGGCTAGCCGGCCGCGCTCCTGCTTGAGCC
GCCTGCCGGGGCCCGCGGGCCTGCTGTTCTCTCGCGCGTCCGAGCGTCCCGACTCCCGGTGCCG
GCCCGGGTCCGGGTCTCTGACCCACCCGGGGCGGCGGGGAAGGCGGCGAGGGCCACCGTGCCC
CCGTGCGCTCTCCGCTGCGGGCGCCCGGGGCGGCCGCGACAACCCCACCCCGCTGGCTCCGTGC
CGTGCGTGTCAGGCGTTCTCGTCTCCGCGGGGTTGTCCGCCGCCCCTTCCCCGGAGTGGGGGGT
TGGCCGGAGCCGATCGGCTCGCTGGCCGGCCGGCCGGCCTCCGCTCCCGGGGGGCTCTTCGTGA
TCGATGTGGTGACGTCGTGCTCTCCCGGGCCGGGTCCGAGCCGCGACGGGCGAGGGGCGGACGT
TCGTGGCGAACGGGACCGTCCTTCTCGCTCCGCCCCGCGGGGGTCCCCTCGTCTCTCCTCTCCC
CGCCCGCCGGCGGTGCGTGTGGGAAGGCGTGGGGTGCGGACCCCGGCCCGACCTCGCCGTCCCG
CCCGCCGCCTTCTGCGTCGCGGGCGGGCCGGCGGGTCCTCTGACGCGGCAGACAGCCCTCGC
TGTCGCCTCCAGTGGTTGTCGACTTGCGGGCGGCCCCCTCCGCGGCGGTGGGGGTGCCGTCCC
GCCGGCCCGTCGTGCTGCCCTCTCGGGGGGTTTGCGCGAGCGTCGGCTCCGCCTGGGCCCTTGC
GGTGCTCCTGGAGCGCTCCGGGTTGTCCCTCAGGTGCCCGAGGCCGAACGGTGGTGTGTCGTTC
CCGCCCCGGCGCCCCTCCTCCGGTCGCCGCCGCGGTGTCCGCGCGTGGGTCCTGAGGGAGCT
CGTCGGTGTGGGGTTCGAGGCGGTTTGAGTGAGACGAGACGAGACGCGCCCTCCCACGCGGGG
AAGGGCGCCCGCCTGCTCTCGGTGAGCGCACGTCCCGTGCTCCCCTCTGGCGGGTGCGCGCGGG
CCGTGTGAGCGATCGCGGTGGGTTCGGGCCGGTGTGACGCGTGCGCCGGCCGGCCGCCGAGGGG
```

FIG. 5 (Continued)

```
CTGCCGTTCTGCCTCCGACCGGTCGTGTGTGGGTTGACTTCGGAGGCGCTCTGCCTCGGAAGGA
AGGAGGTGGGTGGACGGGGGGGCCTGGTGGGGTTGCGCGCACGCGCGCACCGGCCGGGCCCCG
CCCTGAACGCGAACGCTCGAGGTGGCCGCGCGCAGGTGTTTCCTCGTACCGCAGGGCCCCCTCC
CTTCCCCAGGCGTCCCTCGGCGCCTCTGCGGGCCCGAGGAGGAGCGGCTGGCGGGTGGGGGGAG
TGTGACCCACCCTCGGTGAGAAAAGCCTTCTCTAGCGATCTGAGAGGCGTGCCTTGGGGGTACC
GGATCCCCCGGGCCGCCGCCTCTGTCTCTGCCTCCGTTATGGTAGCGCTGCCGTAGCGACCCGC
TCGCAGAGGACCCTCCTCCGCTTCCCCCTCGACGGGGTTGGGGGGGAGAAGCGAGGGTTCCGCC
GGCCACCGCGGTGGTGGCCGAGTGCGGCTCGTCGCCTACTGTGGCCCGCGCCTCCCCCTTCCGA
GTCGGGGGAGGATCCCGCCGGGCCGGGCCCGGCGTTCCCAGCGGGTTGGGACGCGGCGGCCGGC
GGGCGGTGGGTGTGCGCGCCCGGCGCTCTGTCCGGCGCGTGACCCCCTCCGCCGCGAGTCGGCT
CTCCGCCCGCTCCCGTGCCGAGTCGTGACCGGTGCCGACGACCGCGTTTGCGTGGCACGGGGTC
GGGCCCGCCTGGCCCTGGGAAAGCGTCCCACGGTGGGGCGCGCCGGTCTCCCGGAGCGGGACC
GGGTCGGAGGATGGACGAGAATCACGAGCGACGGTGGTGCGGGCGTGTCGGGTTCGTGGCTGCG
GTCGCTCCGGGCCCCCGGTGGCGGGGCCCCGGGGCTCGCGAGGCGGTTCTCGGTGGGGGCCGA
GGGCCGTCCGGCGTCCCAGGCGGGGCGCCGCGGGACCGCCCTCGTGTCTGTGGCGGTGGGATCC
CGCGGCCGTGTTTTCCTGGTGGCCCGGCCGTGCCTGAGGTTTCTCCCCGAGCCGCCGCCTCTGC
GGGCTCCCGGGTGCCCTTGCCCTCGCGGTCCCCGGCCCTCGCCCGTCTGTGCCCTCTTCCCCGC
CCGCCGCCCGCCGATCCTCTTCTTCCCCCCGAGCGGCTCACCGGCTTCACGTCCGTTGGTGGCC
CCGCCTGGGACCGAACCCGGCACCGCCTCGTGGGCGCCGCCGCCGGCCACTGATCGGCCCGGC
GTCCGCGTCCCCGGCGCGCGCCTTGGGGACCGGGTCGGTGGCGCCCCGCGTGGGGCCCGGTGG
GCTTCCCGGAGGGTTCCGGGGGTCGGCCTGCGGCGCGTGCGGGGGAGGAGACGGTTCCGGGGGA
CCGGCCGCGACTGCGGCGGCGGTGGTGGGGGCAGCCGCGGGGATCGCCGAGGGCCGGTCGGCCG
CCCCGGGTGCCGCGCGGTGCCGCCGGCGGCGGTGAGGCCCCGCGCGTGTGTCCCGGCCGCGGTC
GGCCGCGCTCGAGGGGTCCCCGTGGCGTCCCCTTCCCCGCCGGCCGCCTTTCTCGCGCCTTCCC
CGTCGCCCCGGCCTCGCCCGTGGTCTCTCGTCTTCTCCCGGCCCGCTCTTCCGAACCGGGTCGG
CGCGTCCCCGGGTGCGCCTCGCTTCCCGGGCCTGCCGCGGCCCTTCCCCGAGGCGTCCGTCCC
GGGCGTCGGCGTCGGGGAGAGCCCGTCCTCCCCGCGTGGCGTCGCCCCGTTCGGCGCGCGCGTG
CGCCCGAGCGCGGCCCGGTGGTCCCTGCCGGACAGGCGTTCGTGCGACGTGTGGCGTGGGTCGA
CCTCCGCCTTGCCGGTCGCTCGCCCTTTCCCGGGTCGGGGGGTGGGCCCGGGCCGGGCCTC
GGCCCCGGTCGCGGTCCCCCGTCCCGGGCGGGGCGGGCGCGCCGGCCGGCCTCGGTCGGCCCT
CCCTTGGCCGTCGTGTGGCGTGTGCCACCCCTGCGCCCGCGCCCGCCGGCGGGGCTCGGAGCCG
GGCTTCGGCCGGGCCCCGGGCCCTCGACCGGACCGGTGCGCGGCGCTGCGGCCGCACGGCGCG
ACTGTCCCCGGGCCGGGCACCGCGGTCCGCCTCTCGCTCGCCGCCCGGACGTCGGGGCCGCCCC
GCGGGGCGGGCGGAGCGCCGTCCCCGCCTCGCCGCCGCCCGCGGGCGCCGGCCGCGCGCGCG
CGCGTGGCCGCCGGTCCCTCCCGGCCGCCGGGCGCGGGTCGGGCCGTCCGCCTCCTCGCGGGCG
GGCGCGACGAAGAAGCGTCGCGGGTCTGTGGCGCGGGGCCCCGGTGGTCGTGTCGCGTGGGGGG
CGGGTGGTTGGGGCGTCCGGTTCGCCGCGCCCCGCCCCGGCCCACCGGTCCCGGCCGCCGCCC
CCGCGCCCGCTCGCTCCCTCCCGTCCGCCCGTCCGCGGCCCGTCCGTCCGTCCGTCGTCCTCCT
CGCTTGCGGGGCGCCGGGCCCGTCCTCGCGAGGCCCCCGGCCGGCCGTCCGGCCGCGTCGGGG
CCTCGCCGCGCTCTACCTTACC**TACCTGGTTGATCCTGCCAGTAGCATATGCTTGTCTCAAAGA
TTAAGCCATGCATGTCTGAGTACGCACGGCCGGTACAGTGAAACTGCGAATGGCTCATTAAATC
AGTTATGGTTCCTTTGGTCGCTCGCTCCTCTCCTACTTGGATAACTGTGGTAATTCTAGAGCTA
ATACATGCCGACGGGCGCTGACCCCCTTCGCGGGGGGATGCGTGCATTTATCAGATCAAAACC
AACCCGGTCAGCCCCTCTCCGGCCCCGGCCGGGGGCGGGCGCCGGCGGCTTTGGTGACTCTAG**
```

FIG. 5 (Continued)

```
ATAACCTCGGGCCGATCGCACGCCCCCGTGGCGGCGACGACCCATTCGAACGTCTGCCCTATC
AACTTTCGATGGTAGTCGCCGTGCCTACCATGGTGACCACGGGTGACGGGGAATCAGGGTTCGA
TTCCGGAGAGGGAGCCTGAGAAACGGCTACCACATCCAAGGAAGGCAGCAGGCGCGCAAATTAC
CCACTCCCGACCCGGGGAGGTAGTGACGAAAAATAACAATACAGGACTCTTTCGAGGCCCTGTA
ATTGGAATGAGTCCACTTTAAATCCTTTAACGAGGATCCATTGGAGGGCAAGTCTGGTGCCAGC
AGCCGCGGTAATTCCAGCTCCAATAGCGTATATTAAAGTTGCTGCAGTTAAAAAGCTCGTAGTT
GGATCTTGGGAGCGGGCGGGCGGTCCGCCGCGAGGCGAGCCACCGCCCGTCCCCGCCCCTTGCC
TCTCGGCGCCCCTCGATGCTCTTAGCTGAGTGTCCGCGGGGCCCGAAGCGTTTACTTTGAAA
AAATTAGAGTGTTCAAAGCAGGCCCGAGCCGCCTGGATACCGCAGCTAGGAATAATGGAATAGG
ACCGCGGTTCTATTTTGTTGGTTTTCGGAACTGAGGCCATGATTAAGAGGGACGGCCGGGGGCA
TTCGTATTGCGCCGCTAGAGGTGAAATTCTTGGACCGGCGCAAGACGGACCAGAGCGAAAGCAT
TTGCCAAGAATGTTTTCATTAATCAAGAACGAAAGTCGGAGGTTCGAAGACGATCAGATACCGT
CGTAGTTCCGACCATAAACGATGCCGACCGGCGATGCGGCGGCGTTATTCCCATGACCCGCCGG
GCAGCTTCCGGGAAACCAAAGTCTTTGGGTTCCGGGGGGAGTATGGTTGCAAAGCTGAAACTTA
AAGGAATTGACGGAAGGGCACCACCAGGAGTGGAGCCTGCGGCTTAATTTGACTCAACACGGGA
AACCTCACCCGGCCCGGACACGGACAGGATTGACAGATTGATAGCTCTTTCTCGATTCCGTGGG
TGGTGGTGCATGGCCGTTCTTAGTTGGTGGAGCGATTTGTCTGGTTAATTCCGATAACGAACGA
GACTCTGGCATGCTAACTAGTTACGCGACCCCCGAGCGGTCGGCGTCCCCAACTTCTTAGAGG
GACAAGTGGCGTTCAGCCACCCGAGATTGAGCAATAACAGGTCTGTGATGCCCTTAGATGTCCG
GGGCTGCACGCGCGCTACACTGACTGGCTCAGCGTGTGCCTACCCTACGCCGGCAGGCGCGGGT
AACCCGTTGAACCCCATTCGTGATGGGGATCGGGGATTGCAATTATTCCCCATGAACGAGGAAT
TCCCAGTAAGTGCGGGTCATAAGCTTGCGTTGATTAAGTCCCTGCCCTTTGTACACACCGCCCG
TCGCTACTACCGATTGGATGGTTTAGTGAGGCCCTCGGATCGGCCCCGCCGGGGTCGGCCCACG
GCCCTGGCGGAGCGCTGAGAAGACGGTCGAACTTGACTATCTAGAGGAAGTAAAAGTCGTAACA
AGGTTTCCGTAGGTGAACCTGCGGAAGGATCATTAACGGAGCCCGGAGGGCGAGGCCCGCGGCG
GCGCCGCCGCCGCGCGCTTCCCTCCGCACACCCACCCCCCACCGCGACGCGGCGCGTGCG
CGGGCGGGCCCGCGTGCCCGTTCGTTCGCTCGCTCGTTCGTTCGCCGCCCGGCCCCGCCGGCC
GCGAGAGCCGGAGAACTCGGGAGGGAGACGGGGGAGAGAGAGAGAGAGAGAGAAAGAGAAAGAA
GGGCGTGTCGTTGGTGTGCGCGTGTCGTGGGCCGGCGGGCGGCGGGGAGCGGTCCCCGGCCGC
GGCCCCGACGACGTGGGTGTCGGCGGGCGCGGGGCGGTTCTCGGCGGCGTCGCGGCGGGTCTG
GGGGGGTCTCGGTGCCCTCCTCCCCGCCGGGGCCCGTCGTCCGGCCCCGCCGCGCCGGCTCCCC
GTCTTCGGGGCCGGCCGGATTCCCGTCGCCTCCGCCGCGCCGCTCCGCGCCGCCGGGCACGGCC
CCGCTCGCTCTCCCCGGCCTTCCCGCTAGGGCGTCTCGAGGGTCGGGGCCGGACGCCGGTCCC
CTCCCCCGCCTCCTCGTCCGCCCCCGCCGTCCAGGTACCTAGCGCGTTCCGGCGCGGAGGTT
TAAAGACCCCTTGGGGGGATCGCCCGTCCGCCCGTGGGTCGGGGCGGTGGTGGGCCCGCGGGG
GAGTCCCGTCGGGAGGGCCCGGCCCCTCCCGCGCCTCCACCGCGGACTCCGCTCCCCGGCCGG
GGCCGCGCCGCCGCCGCCGCGGCGGCCGTCGGGTGGGGCTTTACCCGGCGGCCGTCGCGC
GCCTGCCGCGCGTGTGGCGTGCGCCCCGCGCCGTGGGGCGGGAACCCCGGGCGCCTGTGGGG
TGGTGTCCGCGCTCGCCCCGCGTGGGCGGCGCGCGCCTCCCCGTGGTGTGAAACCTTCCGACC
CCTCTCCGGAGTCCGGTCCCGTTTGCTGTCTCGTCTGGCCGGCCTGAGGCAACCCCCTCTCCTC
TTGGGCGGGGGGGGGGGACGTGCCGCGCCAGGAAGGGCCTCCTCCCGGTGCGTCGTCGGGAG
CGCCCTCGCCAAATCGACCTCGTACGACTCTTAGCGGTGGATCACTCGGCTCGTGCGTCGATGA
AGAACGCAGCTAGCTGCGAGAATTAATGTGAATTGCAGGACACATTGATCATCGACACTTCGAA
```

FIG. 5 (Continued)

CGCACTTGCGGCCCCGGGTTCCTCCCGGGGCTACGCCTGTCTGAGCGTCGCTTGCCGATCAATC
GCCCCCGGGGGTGCCTCCGGGCTCCTCGGGGTGCGCGGCTGGGGGTTCCCTCGCAGGGCCCGCC
GGGGGCCCTCCGTCCCCCTAAGCGCAGACCCGGCGGCGTCCGCCCTCCTCTTGCCGCCGCGCCC
GCCCCTTCCCCCTCCCCCCGCGGGCCCTGCGTGGTCACGCGTCGGGTGGCGGGGGGGAGAGGGG
GGCGCGCCCGGCTGAGAGAGACGGGGAGGGCGGCGCCGCCGCCGCCCGCGAAGACGGAGAGGGA
AAGAGAGAGCCGGCTCGGGCCGAGTTCCCGTGGCCGCCGCCTGCGGTCCGGGTTCCTCCCTCGG
GGGGCTCCCTCGCGCCGCGCGCGGCTCGGGGTTCGGGGTTCGTCGGCCCCGGCCGGGTGGAAGG
TCCCGTGCCCGTCGTCGTCGTCGTCGCGCGTCGTCGGCGGTGGGGGCGTGTTGCGTGCGGT
GTGGTGGTGGGGGAGGAGGAAGGCGGGTCCGGAAGGGGAAGGGTGCCGGCGGGGAGAGAGGGTC
GGGGGAGCGCGTCCCGGTCGCCGCGGTTCGCCGCCCGCCCCGGTGGCGGCCCGGCGTCCGGCC
GACCGCCGCTCCCGCGCCCCTCCTCCTCCCCGCCGCCCTCCTCCGAGGCCCCGCCCGTCCTCC
TCGCCCTCCCCGCGCGTACGCGCGCCCGCCCGCCCGGCTCGCCTCGCGGCGCGTCGGCCGGGGC
CGGGAGCCCGCCCCGCGGCCCGCCCGGCCGCGCCCGTGGCCGCGGCGCCGGGGTTCGCGTGTCC
CCGGCGGCGACCCGCGGGACGCCGCGGTGTCGTCCGCCGTCGCGCGCCCGCCTCCGGCTCGCGG
CCGCGCCGCGCCGCGCCGGGGCCCCGTCCCGAGCTTCCGCGTCGGGCGGGGCGGCTCCGCCGC
CGCGTCCTCGGACCCGTCCCCCCGACCTCCGCGGGGGAGACGGGTCGGGGCGTGCGGCGCCCGT
CCCGCCCCCGGCCCGTGCCCCTCCCTCCGGTCGTCCCGCTCCGGCGGGGCGGCGCGGGGGTGCC
GCCGGCCGCGCGCTCTCTCTCCCGTCGCCTCTCCCCCTCGCCGGGCCCGTCTCCCGACGGAGCG
TCGGGCGGGCGGTCGGGCCGGCGCGATTCCGTCCGTCCGTCCGCCGAGCGGCCCGTCCCCCTCC
GAGACGCGACCTCAGATCAGACGTGGCGACCCGCTGAATTTAAGCATATTAGTCAGCGGAGGAG
AAGAAACTAACCAGGATTCCCTCAGTAACGGCGAGTGAACAGGGAAGAGCCCAGCGCCGAATCC
CCGCCCCGCGGCGGGGCGCGGGACATGTGGCGTACGGAAGACCCGCTCCCCGGCGCCGCTCGTG
GGGGGCCCAAGTCCTTCTGATCGAGGCCCAGCCCGTGGACGGTGTGAGGCCGGTAGCGGCCCCC
GGCGCGCCGGGCCCGGGTCTTCCCGGAGTCGGGTTGCTTGGGAATGCAGCCCAAAGCGGGTGGT
AAACTCCATCTAAGGCTAAATACCGGCACGAGACCGATAGTCAACAAGTACCGTAAGGGAAAGT
TGAAAAGAACTTTGAAGAGAGAGTTCAAGAGGGCGTGAAACCGTTAAGAGGTAAACGGGTGGGG
TCCGCGCAGTCCGCCCGGAGGATTCAACCCGGCGGCGGGTCCGGCCGTGTCGGCGGCCCGGCGG
ATCTTTCCCGCCCCCCGTTCCTCCCGACCCCTCCACCCGCCCTCCCTTCCCCCGCCGCCCCTCC
TCCTCCTCCCCGGAGGGGGCGGGCTCCGGCGGGTGCGGGGGTGGGCGGGCGGGGCCGGGGTGG
GGTCGGCGGGGGACCGTCCCCCGACCGGCGACCGGCCGCCGCCGGGCGCATTTCCACCGCGGCG
GTGCGCCGCGACCGGCTCCGGGACGGCTGGGAAGGCCCGGCGGGGAAGGTGGCTCGGGGGGCCC
CGTCCGTCCGTCCGTCCGTCCTCCTCCTCCCCGTCTCCGCCCCCCGGCCCCGCGTCCTCCCTC
GGGAGGGCGCGCGGGTCGGGCGGCGGCGGCGGCGGCGGTGGCGGCGGCGGCGGCGGCGGCGGG
ACCGAAACCCCCCCGAGTGTTACAGCCCCCCGGCAGCAGCACTCGCCGAATCCCGGGGCCGA
GGGAGCGAGACCCGTCGCCGCGCTCTCCCCCCTCCCGGCGCCCACCCCCGCGGGGAATCCCCCG
CGAGGGGGTCTCCCCCGCGGGGGCGCGCCGGCGTCTCCTCGTGGGGGGCCGGGCCACCCCTC
CCACGGCGCGACCGCTCTCCCACCCCTCCTCCCCGCGCCCCGCCCCGGCGACGGGGGGGTGC
CGCGCGCGGGTCGGGGGCGGGGCGGACTGTCCCCAGTGCGCCCCGGGCGGGTCGCGCCGTCGG
GCCCGGGGGAGGTTCTCTCGGGGCCACGCGCGCGTCCCCCGAAGAGGGGGACGGCGGAGCGAGC
GCACGGGGTCGGCGGCGACGTCGGCTACCCACCCGACCCGTCTTGAAACACGGACCAAGGAGTC
TAACACGTGCGCGAGTCGGGGGCTCGCACGAAAGCCGCCGTGGCGCAATGAAGGTGAAGGCCGG
CGCGCTCGCCGGCCGAGGTGGGATCCCGAGGCCTCTCCAGTCCGCCGAGGGCGCACCACCGGCC
CGTCTCGCCCGCCGCGCCGGGGAGGTGGAGCACGAGCGCACGTGTTAGGACCCGAAAGATGGTG
AACTATGCCTGGGCAGGGCGAAGCCAGAGGAAACTCTGGTGGAGGTCCGTAGCGGTCCTGACGT

FIG. 5 (Continued)

```
GCAAATCGGTCGTCCGACCTGGGTATAGGGGCGAAAGACTAATCGAACCATCTAGTAGCTGGTT
CCCTCCGAAGTTTCCCTCAGGATAGCTGGCGCTCTCGCAGACCCGACGCACCCCGCCACGCAG
TTTTATCCGGTAAAGCGAATGATTAGAGGTCTTGGGGCCGAAACGATCTCAACCTATTCTCAAA
CTTTAAATGGGTAAGAAGCCCGGCTCGCTGGCGTGGAGCCGGGCGTGGAATGCGAGTGCCTAGT
GGGCCACTTTTGGTAAGCAGAACTGGCGCTGCGGGATGAACCGAACGCCGGTTAAGGCGCCCG
ATGCCGACGCTCATCAGACCCCAGAAAAGGTGTTGGTTGATATAGACAGCAGGACGGTGGCCAT
GGAAGTCGGAATCCGCTAAGGAGTGTGTAACAACTCACCTGCCGAATCAACTAGCCCTGAAAAT
GGATGGCGCTGGAGCGTCGGGCCCATACCCGGCCGTCGCCGGCAGTCGAGAGTGGACGGGAGCG
GCGGGGCGGCGCGCGCGCGCGCGTGTGGTGTGCGTCGGAGGGCGGCGGCGGCGGCGGCGGC
GGGGGTGTGGGGTCCTTCCCCCGCCCCCCCCCACGCCTCCTCCCCTCCTCCCGCCCACGCCC
CGCTCCCCGCCCCCGGAGCCCCGCGGACGCTACGCCGCGACGAGTAGGAGGGCCGCTGCGGTGA
GCCTTGAAGCCTAGGGCGCGGGCCCGGGTGGAGCCGCCGCAGGTGCAGATCTTGGTGGTAGTAG
CAAATATTCAAACGAGAACTTTGAAGGCCGAAGTGGAGAAGGGTTCCATGTGAACAGCAGTTGA
ACATGGGTCAGTCGGTCCTGAGAGATGGGCGAGCGCCGTTCCGAAGGGACGGGCGATGGCCTCC
GTTGCCCTCGGCCGATCGAAAGGGAGTCGGGTTCAGATCCCCGAATCCGGAGTGGCGGAGATGG
GCGCCGCGAGGCGTCCAGTGCGGTAACGCGACCGATCCCGGAGAAGCCGGCGGGAGCCCCGGGG
AGAGTTCTCTTTTCTTTGTGAAGGGCAGGGCGCCCTGGAATGGGTTCGCCCCGAGAGAGGGGCC
CGTGCCTTGGAAAGCGTCGCGGTTCCGGCGGCGTCCGGTGAGCTCTCGCTGGCCCTTGAAAATC
CGGGGGAGAGGGTGTAAATCTCGCGCCGGGCCGTACCCATATCCGCAGCAGGTCTCCAAGGTGA
ACAGCCTCTGGCATGTTGGAACAATGTAGGTAAGGGAAGTCGGCAAGCCGGATCCGTAACTTCG
GGATAAGGATTGGCTCTAAGGGCTGGGTCGGTCGGGCTGGGCGCGAAGCGGGGCTGGGCGCGC
GCCGCGGCTGGACGAGGCGCCGCCGCCCCCCCACGCCCGGGGCACCCCCTCGCGGCCCTCCC
CCGCCCCACCCCGCGCGCGCCGCTCGCTCCCTCCCCGCCCCGCGCCCTCTCTCTCTCTCTCC
CCCGCTCCCCGTCCTCCCCCCTCCCCGGGGGAGCGCCGCGTGGGGCGGCGGCGGGGGAGAAG
GGTCGGGGCGGCAGGGGCCGGCGGCGGCCCGCCGCGGGGCCCCGGCGGCGGGGGCACGGTCCCC
CGCGAGGGGGGCCCGGGCACCCGGGGGGCCGGCGGCGGCGGCGACTCTGGACGCGAGCCGGGCC
CTTCCCGTGGATCGCCCCAGCTGCGGCGGGCGTCGCGGCCGCCCCGGGGAGCCCGGCGGGCGC
CGGCGCGCCCCCCCCCCACCCCACGTCTCGTCGCGCGCGCGTCCGCTGGGGCGGGGAGCGGT
CGGGCGGCGGCGGTCGGCGGGCGGCGGGGCGGGGCGGTTCGTCCCCCGCCCTACCCCCCGGC
CCCGTCCGCCCCCCGTTCCCCCCTCCTCCTCGGCGCGCGGCGGCGGCGGCGGGCGGCGGAGGGG
CCGCGGGCCGGTCCCCCCGCCGGGTCCGCCCCGGGGCCGCGGTTCCGCGCGGCGCCTCGCCT
CGGCCGGCGCCTAGCAGCCGACTTAGAACTGGTGCGGACCAGGGGAATCCGACTGTTTAATTAA
AACAAAGCATCGCGAAGGCCCGCGGCGGGTGTTGACGCGATGTGATTTCTGCCCAGTGCTCTGA
ATGTCAAAGTGAAGAAATTCAATGAAGCGCGGGTAAACGGCGGGAGTAACTATGACTCTCTTAA
GGTAGCCAAATGCCTCGTCATCTAATTAGTGACGCGCATGAATGGATGAACGAGATTCCCACTG
TCCCTACCTACTATCCAGCGAAACCACAGCCAAGGGAACGGGCTTGGCGGAATCAGCGGGGAAA
GAAGACCCTGTTGAGCTTGACTCTAGTCTGGCACGGTGAAGAGACATGAGAGGTGTAGAATAAG
TGGGAGGCCCCGGCGCCCCCCGGTGTCCCGCGAGGGGCCCGGGCGGGGTCCGCCGGCCCT
GCGGGCCGCCGGTGAAATACCACTACTCTGATCGTTTTTTCACTGACCCGGTGAGGCGGGGGGG
CGAGCCCCGAGGGGCTCTCGCTTCTGGCGCCAAGCGCCCGGCCGCGCGCCGGCCGGGCGCGACC
CGCTCCGGGACAGTGCCAGGTGGGGAGTTTGACTGGGCGGTACACCTGTCAAACGGTAACGC
AGGTGTCCTAAGGCGAGCTCAGGGAGGACAGAAACCTCCCGTGGAGCAGAAGGGCAAAAGCTCG
CTTGATCTTGATTTTCAGTACGAATACAGACCGTGAAAGCGGGGCCTCACGATCCTTCTGACCT
TTTGGGTTTTAAGCAGGAGGTGTCAGAAAAGTTACCACAGGGATAACTGGCTTGTGGCGGCCAA
```

FIG. 5 (Continued)

GCGTTCATAGCGACGTCGCTTTTTGATCCTTCGATGTCGGCTCTTCCTATCATTGTGAAGCAGA
ATTCACCAAGCGTTGGATTGTTCACCCACTAATAGGGAACGTGAGCTGGGTTTAGACCGTCGTG
AGACAGGTTAGTTTTACCCTACTGATGATGTGTTGTTGCCATGGTAATCCTGCTCAGTACGAGA
GGAACCGCAGGTTCAGACATTTGGTGTATGTGCTTGGCTGAGGAGCCAATGGGGCGAAGCTACC
ATCTGTGGGATTATGACTGAACGCCTCTAAGTCAGAATCCCGCCCAGGCGGAACGATACGGCAG
CGCCGCGGAGCCTCGGTTGGCCTCGGATAGCCGGTCCCCCGCCTGTCCCCGCCGGCGGGCCGCC
CCCCCCTCCACGCGCCCCGCGCGCGCGGGAGGGCGCGTGCCCCGCCGCGCGCCGGGACCGGGGT
CCGGTGCGGAGTGCCCTTCGTCCTGGGAAACGGGGCGCGGCTGGAAAGGCGGCCGCCCCCTCGC
CCGTCACGCACCGCACGTTCGTGGGGAACCTGGCGCTAAACCATTCGTAGACGACCTGCTTCTG
GGTCGGGGTTTCGTACGTAGCAGAGCAGCTCCCTCGCTGCGATCTATTGAAAGTCAGCCCTCGA
CACAAGGGTTTGTCCGCGCGCGCGCGCGCGTGCGTGCGGGGGGCCCGGCGGGGCGTGCGCGT
CCGGCGCCGTCCGTCCTTCCGTTCGTCTTCCTCCCTCCCGGCCTCTCCCGCCGACCGCGGGCGT
GGTGGTGGGGGTGGGGGGGAGGGCGCGCGACCCCGGTCGGCGCGCCCCGCTTCTTCGGTTCCCG
CCTCCTCCCCGTTCACCGCCGGGGCGGCTCGTCCGCTCCGGGCCGGGACGGGGTCCGGGGAGCG
TGGTTTGGGAGCCGCGGAGGCGGCCGCGCCGAGCCGGGCCCGTGGCCCGCCGGTCCCCGTCCCG
GGGGTTGGCCGCGCGGGCCCCGGTGGGGCGGCCACCCGGGGTCCCGGCCCTCGCGcgtccttcc
tcctcgctcctccgcacgggtcgaccagcagaccgcgggtggtgggcggcgggcggcgaggccc
cacggggcgtccgcgcacccggccgacctccgctcgtgacctctcctcggtcgggcctccgggg
tcgaccgcctgccgcccgcgggcgtgagactcagccggcgtctcgccgtgtcccgggtcgaccg
gcgggccttctccaccgagcggcgtgtaggagtgcccgtcgggacgaaccgcaaccggagcgtc
cccgtctcggtcggcacctccggggtcgaccagctgccgcccgcgagctccggacttagccggc
gcctgcacgtgtcccgggtcgaccagcaggcggccgccggacgctgcggcgcaccgacgcgagg
gcgtcgattcccgttcgcgcgcccgcgacctccaccggcctcggcccgcggtggagctgggacc
acgcggaactccctctctcacatttttttcagccccaccgcgagtttgcgtccgcgggactttt
aagagggagtcactgctgccgtcagccagtaatgcttcctcctttttgcttttaggttttgtc
ttgcctttttttttttttttttcttctttctttctttctttctttctttctttctttctttc
tttctttctttgccgctctcgctctctcgctctctccctctctcgttttctttctctttctctt
tctctctctctctctctctctctctgtctctcgctctcgccctctctctctctctctttctc
tctgtctctctctgtctctctctctctctctctctctctctctctctctctctctctctctc
tctccctcccctccctccctctctccccttccttggtgccttctcggctcttgacacttagcc
gctgtctcgccgtgtcccgggtcgaccggcgggccttctccaccgagcggcgtgtaagagtgcc
cgtcgggacgagccggaccgccgcgtccccgtctcggtcggcacctccggggtcgaccagctg
ccgcccgcgagctccggacttagctggcgtctgcacgtgtcccgggtcgaccagcaggcggccg
ccggacgctgcggcgcaccgacgcgagggcgtcgattccggttcacgcgccggcgacctccacc
ggcctcggcccgcggtggagctgggaccacgcggaactccctcttctacatttttttcagcccc
accgcgagtttgcgtccgcgggacttttaagagggagtcactgctgccgtcagccagtaatgct
tcctcctttttgcttttaggttttgtcttgcctttttttttttttttttttttctttctttc
tttctttctttctttctttctttctttctttctttctctcgctctcgctctcgctctctc
cctcgctcgttttctttctctttctctttctctctctctctctctctctctctgtctctcgc
tctcgccctctctctctctctttctctctgtctctctctgtctctctctctctctctctctc
tctctctctctctctctctctctctccctcccctccctccctctctcccttccttg
gtgccttctcggctcttgacacttagccgctgtctcgccgtgtcccgggtcgaccggcgggcct
tctccaccgagcggcgtgtaagagtgcccgtcgggacgagccggaccgccgcgtccccgtctc
ggtcggcacctccggggtcgaccagctgccgcccgcgagctccggacttagctggcgtctgcac

FIG. 5 (Continued)

```
gtgtcccgggtcgaccagcaggcggccgccggacgctgcggcgcaccgacgcgagggcgtcgat
tccggttcacgcgccggcgacctccaccggcctcggcccgcggtggagctgggaccacgcggaa
ctccctcttctacattttttcagccccactgcgagtttgcgtccgcgggacttttaagaggga
gtcactgctgccgtcagccagtaatgcttcctccttttttgcttttggttttgccttgcgttt
tctttctttctttctttctttctttctttctttctttttctttctttctttctttctttctttct
ttctctctctctctctctctctgtctctctccctccctccctccttggtgccttctcggct
cgctgctgctgctgcctctgcctccacggttcaagcaaacagcaagttttctatttcgagtaaa
gacgtaatttcaccattttggccgggctggtctcgaactcccgacctagtgatccgcccgcctc
ggcctcccaaagactgctgggagtacagatgtgagccaccatgcccggccgattccttccttt
ttcaatcttatttttctgaacgctgccgtgtatgaacatacatctacacatacacacacacac
acacacacacacacacacacacacacacacacacacacacacccccgtagtgataaaactatg
taaatgatatttccataattaatacgtttatattatgttacttttaatggatgaatatgtatcg
aagcccccatttcatttacatacacgtgtatgtatatccttcctcccttccttcattcattattt
attaataattttcgtttatttattttcttttcttttggggccggcccgcctggtcttctgtctc
tgcgctctggtgacctcagcctcccaaatagctgggactacagggatctcttaagcccgggagg
gagaggttaacgtgggctgtgatcgcacacttccactccagcttacgtgggctgcggtggggtg
gggtgcagagaaaacgattgattgcgatctcaattgccttttagcttcattcataccctgttat
ttgctcgtttattctcatgggttcttctgtgtcattgtcacgttcatcgtttgcttgcctgctt
gcctgtttatttccttccttccttccttccttccttccttccttccttccctccttccttcctt
ccttccctcccttactggcagggtcttcctctgtctctgccgcccaggatcaccccaacctcaa
cgctttggaccgaccaaacggtcgttctgcctctgatccctcccatccccattacctgagacta
caggcgcgcaccaccacaccggctgacttttatgttgtttctcatgttttccgtaggtaggtat
gtgtgtgtgtgtgtgtgtgtgtgtgtgtgtgtgtgtgtgtgtgtgtgtatctatgtatgtatgt
atgtatgtgagtgagatgggtttcggggttctatcatgttgcccacgctggtctcgaactcctg
tcctcaagcaatccgcctgcctgcctcggccgcccacactgctgctattacaggcgtgagacgc
tgcgcctggctccttctacatttgcctgcctgcctgcctgcctgcctgcctgcctgcctgcctg
cctgcctatcaatcgtcttcttttagtacggatgtgctctcgctttattgtccatgctctggg
cacacgtggtctcttttcaaacttctatgattattattattgtaggcgtcatctcacgtgtcga
ggtgatctcgaacttttaggctccagagatcctcccgcatcggcctcccggagtgctgtgatga
cacgcgtgggcacggtacgctctggtcgtgtttgtcgtgggtcggttcttttccgttttaatac
ggggactgcgaacgaagaaaatttccagacgcatctcaccgatccgccttttcgttctttcttt
ttattctctttagacggagtttcactcttgtcgcccaggggtggagtacgatggcggctctcggc
tcaccgcaccctccgcctcccaggttcaagtgattctcctgcctcagccttcccgagtagctgg
aatgacagagatgagccatcgtgcccggctaattttctatttttactacagatggggtttctc
catcttggtcaggctggtcttcaacttccgaccgttggagaatcttaactttcttggtggtggt
tgttttccttttctttttttcttttcttttctttccttctcctccccccaccccccttg
tcgtcgtcctcctcctcctcctcctcctcctcctcctcctcctcctcctcctcctctttcattt
ctttcagctgggctctcctacgtgtgttgctctgttgctcacgctggtctcaaactcctggcct
tgacgcttctcccgtcacatccgccgtctggttgttgaaatgagcatctctcgtaaaatggaaa
agatgaaagaaataaacacgaagacggaaagcacggtgtgaacgtttctcttgccgtctcccgg
ggtgtaccttggacccggaaacacggagggagcttggctgagtgggttttcggtgccgaaacct
cccgagggcctccttccctctcccccttgtcccgcttctccccagccgaggctcccaccgcc
gccctggcattttccataggagaggtatgggagaggactgacacgccttccagatctatatcct
gccggacgtctctggctcggcgtgccccaccggctacctgccaccttccagggagctctgaggc
```

FIG. 5 (Continued)

```
ggatgcgacccccacccccccgtcacgtcccgctacccteccccggctggcctttgccgggcga
ccccaggggaaccgcgttgatgctgccttcggatcctccggcgaagacttccaccggatgcccc
gggtgggccggttgggatcagactggaccaccccggaccgtgctgttcttgggggtgggttgac
gtacagggtggactggcagccccagcattgtaaagggtgcgtgggtatggaaatgtcacctagg
atgccctccttccttcggtctgccttcagctgcctcaggcgtgaagacaacttcccatcggaa
cctcttctcttcctttctccagcacacagatgagacgcacgagagggagaaacagctcaatag
ataccgctgaccttcatttgtggaatcctcagtcatcgacacacaagacaggtgactaggcagg
gacacagatcaaacactatttccgggtcctcgtggtgggattggtctctctctctctctctctc
tctctctctctcgcacgcgcacgcgcgcacacacacacacaatttccatatctagttcacagag
cacactcacttccccttttcacagtacgcaggctgagtaaaacccgccccaccctccaccgtt
ggctgacgaaacccctctctacaattgatgaaaaagatgatctgggccgggcacgctagctca
cgcctgtcactccggcactttggaggccgaggcgggtggatcgcttggggccgggagttcgag
accaggctggccgacgtggcgaaaccccgtctctctgaaaaatagaacgattagccgggcctgg
tggcgtgggcttggaatcacgaccgctcgggagactggggcggcgacttgttccaaccgggga
ggccgaggttgcgatgagctgagatcgtgccgtggcgatgcggcctggatgacggagcgagacc
ccgtctcgagagaatcatgatgttattataagatgagttgtgcgcggtgatggccgcctgtagt
cgcggctactcgggaggctgagacgaggagaagatcacttgaggccccacaggtcgaggcttcg
gtcggccgtgacccactgtatcctgggcagtcaccggtcaaggagatatgccccttcccgttt
gcttttcttttcttcccttctcttttcttcttttttgcttctcttttcttctttctttctttct
ttctttctttcttttcttttctctcttccctcttcttcctgccttcctgcctttcttct
tttcttcttcctcccttcctcccttccttctttcctcccgcctcagcctcccaaagtgctggg
atgactggcggggaggcaccatgcctgcttggcccaaagagaccctcttggaaagtgagacgcag
agagcgccttccagtgatctcattgactgatttagagacggcatctcgctccgtcaccccggca
gtggtgccgtcgtaactcactccctgcagcgtggacgctcctggactcgagcgatccttccacc
tcagcctccagagtacagagcctgggaccgcgggcacgcgccactgtgcccacaccgtttttaa
ttgttttttttccccgagacagagtttcactctcgtggcctagactgcagtgcggtggcgcg
atcttggctcaccgcaacctctgcctcccggtttcaagcgattctcctgcatcggcctcctgag
tagccgggattgcgggcatgcgctgccacgtctggctgatttcgtattttagtggagacgggg
cttctccatgtcgatcggctggtttcgaactcccgacctcaggtgatccgccctccccggcct
ccggaagtgctgggatgacaggcgtgagccaccgcgcccggccttcatttttaaatgttttccc
acagacggggtctcatcatttctttgcaaccctcctgcccggcgtctcaaagtgctggcgtgac
gggcgtgagccactgcgcctggactccggggaatgactcacgaccaccatcgctctactgatcc
tttctttctttctttctttctttctttctttctttctttctttcttgatgaattatcttatgatttat
ttgtgtacttattttcagacggagtctcgctctgggcggggcgaggcgaggcgaggcacagcgc
atcgctttggaagccgcggcaacgcctttcaaagccccattcgtatgcacagagccttattccc
ttcctggagttggagctgatgccttccgtagccttgggcttctctccattcggaagctttgaca
ggcgcaacccacccagaggctggctgcggctgaggattagggggtgtgttggggctgaaaact
gggtcccctatttttgatacctcagccgacacatcccccgaccgccatcgcttgctcgccctct
gagatcccccgcctccaccgccttgcaggctcacctcttactttcatttcttcctttcttgcgt
ttgaggaggggtgcgggaatgagggtgtgtgtgggagggggtgcgggtggggacggagggg
agcgtcctaagggtcgatttagtgtcatgcctctttcaccaccaccaccaccgaagatgac
agcaaggatcggctaaataccgcgtgttctcatctagaagtgggaacttacagatgacagttct
tgcatgggcagaacgaggggaccggggacgcggaagtctgcttgagggaggaggggtggaagg
agagacagcttcaggaagaaaacaaaacacgaatactgtcggacacagcactgactacccgggt
```

FIG. 5 (Continued)

```
gatgaaatcatctgcacactgaacaccccgtcacaagtttacctatgtcacaatcttgcacat
gtatgcttgaacgacaaataaaagttagggggagaagagaggagagagagagagagagaga
cagagagagacagagagagagagaggagggagagagaaaacgaaacaccacctccttgacct
gagtcagggggtttctggccttttgggagaacgttcagcgacaatgcagtatttgggcccgttc
ttttttttttcttcttcttttctttcttttttttggactgagtctctctcgctctgtcacccag
gctgcggtgcggtggcgctctctcggctcactgaaacctctgcttcccgggttccagtgattct
tcttcggtagctgggattacaggcgcacaccatgacggccggctcatattcctattttcagtag
agacggggtttctccacgttggccacgctggtctcgaactcctgacctcaaatgatccgccttc
ctgggcctcccaaagtgctggaaacgacaggcctgagccgccgggatttcagcctttaaaagcg
cgggccctgccaccttttcgctgtggcccttacgctcagaatgacgtgtcctctctgccgtaggt
tgactccttgagtcccctaggccattgcactgtagcctgggcagcaagagccaaactccgtccc
ccacctccccgcgcacataataactaactaacaaactaactaactaactaaactaactaaata
aataaaatctctacacgtcacctctaagtgtgtgttcccgtgaggagtgatttctaagaaatgg
cactgtacactgaacgcagtggctcacgtctgtcatcccgaggtcaggagttcgagaccagccc
ggccaacgtggtgaaaccccgtctctactgaaaatacgaaatggagtcaggcgccgtggggca
ggcacctgtaaccccagctactcgggaggctggggtggaagaattgcttgaacctggcaggcgg
aggctgcagtgacccaagatcgcaccactgcactacagcctgggcgacagagtgagacccggtc
tccagataaatacgtacataaataaatacacacatacatacatacatacatacatacatacata
catacatacatccatgcatacagatatacaagaaagaaaaaagaaaagaaaagaaagagaaaa
tgaaagaaaaggcactgtattgctactgggctagggccttctctctgtctgtttctctctgttc
gtctctgtctttctctctgtgtctctttctctgtctgtctgtctctttctttctctctgtctct
gtctctgtctttgtctctctctctccctctctgcctgtctcactgtgtctgtcttctgtcttac
tctctttctctcccgtctgtctctctctctctctctccctccctgtttgtttctctctctccc
tccctgtctgtttctctctctctctttctgtctgtttctgtctctctctgtctgtctatgtctt
tctctgtctgtctctttctctgtctgtctgcctctctcttttcttttttctgtgtctctctgtcgg
tctctctctctctgtctgtctgtctgtctctctctctctctctctgtgcctatcttctgtctta
ctctctttctctgcctgtctgtctgtctctccctcccttttctgtttctctctctctctctct
ctctccccctctccctgtctgtttctctccgtctctctctctttctgtctgtttctcactgtct
ctctctgtccatctctctctctctgtctgtctctttcgttctctctgtctgtctgtctctct
ctctctctctctctctctctctttctgtctctcactctctgtgtgtatcttctgtcttactc
tccttctctgcctgtccgtctgtctgtctgtctgtctgtctctctctcccttctgtctctctc
tctctctgtccctctctctttctgtctgttcctctctctctctgtctctgtctttctctgtc
tgtctgcctctctctttctttctctttctgtgtctctctgtctctctctctgtgcctatcttct
gtcttactctctttctctgcctgcctgcctgtctgtctgtctgtctctctctgtctctctccct
gcctttctgtttctctctctctctccctctctctctccctctctcgctctctctgtcttctct
ctttctctctgtttctctgtctctctctgtccgtctctgtcttttctgtctgtctctctcttt
ctttctgtctgtctctgtctctgtctctctctctctctgcttgtctctctcactgtgtctgt
cctctgtcttactctccttctctgcctgtccgtctgtctgtctgtctctctctctctccctccc
tttctgtttctctctcgctctctctctctctctctctctctctctgcctgtttctctttctctc
tctgtctgtctctgtctttctctgtctgtctctttctctgtctgtctgtctccttctctctgtc
tccgtct
```

FIG. 5 (Continued)

Files listed on the CD filed with

| File Title | Reference ID |
|---|---|
| ALL_rRNA_seqs_1000GenomesProject@atleast10RPM_Population-Sex-Location_27November2016_ALL DATA | Table 10 |
| ALL_rRNA_seqs_1000GenomesProject@atleast10RPM_Population-Sex-Location_27November2016_in ≥20% of Pop-Sex-group sets | Table 11 |
| ALL_rRNA_seqs_BrainSamples@atleast1000reads_Location_27November2016_≥1000 reads in ≥1 dataset | Table 12 |
| ALL_rRNA_seqs_NormalBcells_and_CLL@atleast1000reads_Location_27November2016_≥1000 reads in ≥1 dataset | Table 13 |
| ALL_rRNA_seqs_NormalBcells_and_POAG@atleast10RPM_10December2016_xlsx_ALL DATA_PHILA-#1951575-v1-ALL_rRNA_seqs | Table 14 |
| ALL_rRNA_seqs_NormalBreast_and_TNBC@atleast10RPM_Location_27November2016_ALL DATA | Table 15 |
| ALL_rRNA_seqs_NormalBreast_and_TNBC@atleast10RPM_Location_27November2016_in ≥20% of Tissue-state sets | Table 16 |
| ALL_rRNA_seqs_PlateletSamples@atleast1000reads_Location_27November2016_≥1000 reads in ≥1 dataset | Table 17 |
| ALL_rRNA_seqs_ProstateSamples@atleast1000reads_Location_27November2016_≥1000 reads in ≥1 dataset | Table 18 |
| ALL_rRNA_seqs_TCGAProject@atleast10RPM_CancerType-Location_27November2016_ALL DATA | Table 19 |
| ALL_rRNA_seqs_TCGAProject@atleast10RPM_CancerType-Location_27November2016_in ≥20% of Cancer sets | Table 20 |
| ALL_rRNA_seqs_TCGAProject@atleast10RPM_CancerType-Location_27November2016_in ≥20% of Cancer sets-RESORTED | Table 21 |
| ALL_rRNA_seqs_POAG_exclusive_and_NOT_in_LCL_NOT_in_TCGA_NOT_inNormalandCLL_sequences_txt | Table 22 |
| ALL_NormalBcells_and_POAG_exclusive_transfer_RNA_fragments_10RPMormore_12December2016_txt | Table 23 |
| ALL_tRNA_seqs_exclusive_transfer_RNAs_10RPMormore_POAG_exclusive_and_NOT_in_LCL_NOT_in_TCGA_sequences_txt | Table 24 |

FIG. 6

| File Title | Reference ID |
|---|---|
| SAM_1000GenomesProject_CEU_vs_FIN_GBR_TSI@FDR_0_0_NegatSign | Table 25 |
| SAM_1000GenomesProject_CEU_vs_FIN_GBR_TSI@FDR_0_0_PositSign | Table 26 |
| SAM_1000GenomesProject_Men_CEU_YRI@FDR_0_0_NegatSign | Table 27 |
| SAM_1000GenomesProject_Men_CEU_YRI@FDR_0_0_PositSign | Table 28 |
| SAM_1000GenomesProject_Men_Women_CEU@FDR_0_0_NegatSign | Table 29 |
| SAM_1000GenomesProject_Men_Women_CEU@FDR_0_0_PositSign | Table 30 |
| SAM_1000GenomesProject_Men_Women_FIN@FDR_0_0_NegatSign | Table 31 |
| SAM_1000GenomesProject_Men_Women_FIN@FDR_0_0_PositSign | Table 32 |
| SAM_1000GenomesProject_Men_Women_GBR@FDR_0_0_NegatSign | Table 33 |
| SAM_1000GenomesProject_Men_Women_GBR@FDR_0_0_PositSign | Table 34 |
| SAM_1000GenomesProject_Men_Women_TSI@FDR_0_0_NegatSign | Table 35 |
| SAM_1000GenomesProject_Men_Women_TSI@FDR_0_0_PositSign | Table 36 |
| SAM_1000GenomesProject_Men_Women_YRI@FDR_0_0_NegatSign | Table 37 |
| SAM_1000GenomesProject_Men_Women_YRI@FDR_0_0_PositSign | Table 38 |
| SAM_1000GenomesProject_Women_CEU_YRI@FDR_0_0_NegatSign | Table 39 |
| SAM_1000GenomesProject_Women_CEU_YRI@FDR_0_0_PositSign | Table 40 |
| SAM_NormalBcells_and_CLL@FDR_0_0_NegatSign | Table 41 |
| SAM_NormalBcells_and_CLL@FDR_0_0_PositSign | Table 42 |
| SAM_NormalBcells_and_POAG@FDR_0_05_SAM_PositSign_txt | Table 43 |
| SAM_NormalBreast_and_TNBC@FDR_0_0_NegatSign | Table 44 |
| SAM_NormalBreast_and_TNBC@FDR_0_0_PositSign | Table 45 |
| SAM_TCGAProject_BRCA_vs_therest@FDR_0_0_NegatSign | Table 46 |
| SAM_TCGAProject_BRCA_vs_therest@FDR_0_0_PositSign | Table 47 |
| SAM_TCGAProject_PAAD_vs_therest@FDR_0_0_NegatSign | Table 48 |
| SAM_TCGAProject_PAAD_vs_therest@FDR_0_0_PositSign | Table 49 |
| SAM_TCGAProject_PRAD_vs_therest@FDR_0_0_NegatSign | Table 50 |
| SAM_TCGAProject_PRAD_vs_therest@FDR_0_0_PositSign | Table 51 |

FIG. 6 (Continued)

COMPOSITIONS AND METHODS OF USING RNA FRAGMENTS

CROSS-REFERENCE TO RELATED APPLICATIONS

The present application is a 35 U.S.C. § 371 national phase application from, and claims priority to, International Application No. PCT/US2017/068261, filed Dec. 22, 2017, and published under PCT Article 21(2) in English, which claims priority under 35 U.S.C. § 119(e) to U.S. Provisional Application No. 62/498,368, filed Dec. 22, 2016, all of which applications are incorporated herein by reference in their entireties.

BACKGROUND OF THE INVENTION

Ribosomal ribonucleic acids (rRNAs) are non-coding RNAs (ncRNAs). rRNAs are very important molecules that combine with proteins to form ribosomes. rRNAs constitute the predominant material within the ribosome, which is approximately 60% rRNA and 40% protein by weight. Within a ribosome, the rRNAs form two subunits, the large subunit (LSU) and small subunit (SSU).

Ribosomes are the complexes in which the translation from codons to amino acids occurs and protein synthesis takes place. rRNAs are present in all kingdoms of life (archaea, bacteria, and eukaryotes). Within a cell, rRNA molecules are very abundant, typically representing as much as 80% of the cell's total RNA content.

The nuclear genome of mammalian cells encodes 4 distinct types of rRNA molecules known as 5S, 5.8S, 18S and 28S, respectively. Additionally, there are two more rRNA molecules that are encoded by the mitochondrial genome and are known as 12S and 16S.

The typical nuclear genome contains many copies of the DNA template used to make rRNAs. These copies are generally organized as tandem repeats with each repeat generally comprising dozens of copies. In the human genome, hundreds of such repeats are known and can be found in several chromosomes. The only exceptions are 12S and 16S which have a single copy in the mitochondrial genome.

Three of the rRNAs that are found in the nuclear genome, namely 18S, 5.8S, and 28S, are organized as a single transcription unit that is known as 45S. Within 45S, the sequences encoding the three rRNAs are separated by 2 spacers. There are five clusters, each with 30-40 copies of 45S, on chromosomes 13, 14, 15, 21, and 22. The 45S unit is transcribed by RNA polymerase I. The 5S rRNA is transcribed by RNA polymerase III. And the 12S and 16S rRNAs are transcribed by the mitochondrial RNA polymerase gene (POLRMT).

In general, rRNA sequences are widely used for determining evolutionary relationships among organisms, since they are of ancient origin and are found in all known forms of life.

Recent reports have suggested that in other types of ncRNAs, such as transfer RNAs (tRNAs), specific fragments are functionally important for gene regulation or determining a disease state.

There is a need in the art to identify if specific fragments arise from an organism's RNA, particularly rRNA and tRNA, and to characterize the regulatory roles and functions of these RNA fragments (RFs) in diseased and healthy cells. This invention addresses this need.

SUMMARY OF THE INVENTION

The present invention relates to compositions and methods for analyzing RNA fragments.

In one aspect, the invention includes a method of identifying a subject in need of therapeutic intervention to treat a disease or condition, disease recurrence, or disease progression. The method of the invention comprises isolating fragments of rRNAs from a sample obtained from the subject; and characterizing the rRNA fragments and their relative abundance in the sample to identify a signature, wherein when the signature is indicative of a diagnosis of the disease, a treatment of the subject is recommended.

In another aspect, the invention includes a method of diagnosing, identifying or monitoring a cancer in a subject in need thereof. The method of the invention comprises isolating rRNA fragments from a cell obtained from the subject; quantifying the RNA fragments using a panel of oligonucleotides engineered to detect rRNA fragments or other method; analyzing levels of the rRNA fragments present in the cell; wherein a differential in the level of measured rRNA fragments as compared to a reference is indicative of a diagnosis or identification of a cancer in the subject; and providing a treatment regimen to the subject dependent on the differential in the level of measured rRNA fragments as compared to the reference.

In another aspect, the invention includes a method of determining the race and sex of a subject in need thereof. The method comprises isolating fragments of rRNAs from a sample obtained from the subject; characterizing the identity of the rRNA fragments and their relative abundance in the sample to identify a signature, wherein the signature is indicative of the race and sex of the subject; and recommending or providing a personalized treatment regimen or a disease prognosis to the subject based upon the subject's race and/or sex. In one embodiment, the signature indicative of the race and sex of the subject comprises at least one sequence selected from the group consisting of SEQ ID NOs: 1-28515.

In another aspect, the invention includes a method for identifying rRNA fragments comprising defining rRNA loci; sequencing a population of RNA fragments; and mapping the sequenced RNA fragments to at least one rRNA genomic loci.

In another aspect, the invention includes a kit for high-throughput analysis of rRNAs fragments in a sample from a subject in need thereof, the kit comprising a collection specially-designed qPCR assays for quantitating rRNA fragments, or panel of engineered oligonucleotides capable of hybridizing rRNA fragments, or other quantification method.

In yet another aspect, the invention includes a method of identifying a subject at risk for developing a glaucoma disorder or in need of therapeutic intervention to treat a glaucoma disorder. The method of the invention comprises isolating fragments of tRNAs from a sample obtained from the subject; and characterizing the tRNA fragments and their relative abundance in the sample to identify a signature, wherein when the signature is indicative of a prognosis for developing a glaucoma or a diagnosis for a glaucoma, a treatment of the subject is recommended.

In a further aspect, the invention includes a method of diagnosing, identifying or monitoring a glaucoma in a subject in need thereof. The method of the invention comprises isolating tRNA fragments from a cell obtained from the subject; quantitating tRNA fragments using a collection of specially-designed qPCR assays or a panel of engineered oligonucleotides capable of hybridizing tRNA fragments, or other quantification method; analyzing levels of the tRNA fragments present in the cell; wherein a differential in the level of measured tRNA fragments as compared to a reference is indicative of a diagnosis or identification of a cancer in the subject; and providing a treatment regimen to the subject dependent on the differential in the level of measured tRNA fragments as compared to the reference.

In some embodiments, the sample obtained from the subject is isolated from a cell, tissue or body fluid obtained from the subject. In some embodiments, the body fluid is selected from the group consisting of amniotic fluid, aqueous humour and vitreous humour, bile, blood serum, breast milk, cerebrospinal fluid, cerumen, chyle, chyme, endolymph and perilymph, exudates, feces, female ejaculate, gastric acid, gastric juice, lymph, mucus, pericardial fluid, peritoneal fluid, pleural fluid, pus, rheum, saliva, sebum, serous fluid, semen, smegma, sputum, synovial fluid, sweat, tears, urine, vaginal secretion, and vomit.

In some embodiments, isolating the rRNA fragments comprises isolating rRNA fragments with a length in the range of about 15 nucleotides to about 50 nucleotides.

In some embodiments, the signature indicative of a diagnosis of the disease comprises at least one sequence selected from the group consisting of SEQ ID NOs: 1-66149 and 70852-71358.

In some embodiments, characterizing the rRNA fragments comprises at least one assessment selected from the group consisting of sequencing the rRNA fragments, measuring overall abundance of one of the rRNA fragments mapped to the genome, measuring a relative abundance of the one rRNA fragment to a reference, assessing a length of the one rRNA fragment, identifying starting and ending points of the one rRNA fragment, identifying genomic origin of the one rRNA fragment, and identifying a terminal modification of the one rRNA fragment.

In some embodiments, the disease or condition, disease recurrence, or disease progression is selected from the group consisting of a cancer, a brain disease, a glaucoma and a genetically predisposed disease or condition.

In some embodiments, the cancer is selected from the group consisting of adrenocortical carcinoma, bladder urothelial carcinoma, breast invasive carcinoma, triple negative breast cancer, cervical squamous cell carcinoma and endocervical adenocarcinoma, cholangiocarcinoma, coadcolon adenocarcinoma, lymphoid neoplasm diffuse large b-cell lymphoma, esophageal carcinoma, head and neck squamous cell carcinoma, kidney chromophobe, kidney renal clear cell carcinoma, kidney renal papillary cell carcinoma, acute myeloid leukemia, brain lower grade glioma, liver hepatocellular carcinoma, lung adenocarcinoma, lung squamous cell carcinoma, mesothelioma, ovarian serous cystadenocarcinoma, pancreatic adenocarcinoma, pheochromocytoma and paraganglioma, prostate adenocarcinoma, rectum adenocarcinoma, sarcoma, skin cutaneous melanoma, stomach adenocarcinoma, testicular germ cell tumors, thyroid carcinoma, thymoma, uterine corpus endometrial carcinoma, uterine carcinosarcoma, and uveal melanoma, leukemia, chronic lymphocytic leukemia, and triple negative breast cancer.

In some embodiments, the glaucoma is a primary open angle glaucoma (POAG).

In other embodiments, the signature of the POAG comprises at least one sequence selected from the group consisting of SEQ ID NOs: 65474-66149 and 70852-71358.

In some embodiments, the brain disease is Alzheimer's disease.

In some embodiments, the rRNA genomic loci comprise mitochondrial rRNA sequences from the mitochondrial genome, nuclear rRNA sequences from the nuclear genome, and mitochondria rRNA sequences from the nuclear genome.

In some embodiments, characterizing the mapped rRNA fragments comprises at least one assessment selected from the group consisting of identifying one or more of the mapped RNA fragments in a population, measuring an overall abundance of one or more of the mapped RNA fragments, measuring a relative abundance of one or more of the mapped RNA fragments to a reference, assessing a length of one or more of the mapped RNA fragments, identifying starting and ending points of one or more of the mapped RNA fragments, and identifying genomic origin of one or more of the mapped RNA fragments.

In some embodiments, isolating the tRNA fragments comprises isolating tRNA fragments with a length in the range of about 15 nucleotides to about 50 nucleotides.

In some embodiments, the tRNA signature indicative of a prognosis for developing a glaucoma or a diagnosis for a glaucoma comprises at least one sequence selected from the group consisting of SEQ ID NOs: 66150-70851 and 71359-71880.

In some embodiments, characterizing the tRNA fragments comprises at least one assessment selected from the group consisting of sequencing the tRNA fragments, measuring overall abundance of one of the tRNA fragments mapped to the genome, measuring a relative abundance of the one tRNA fragment to a reference, assessing a length of the one tRNA fragment, identifying starting and ending points of the one tRNA fragment, identifying genomic origin of the one tRNA fragment, and identifying a terminal modification of the one tRNA fragment.

In other embodiments, the tRNA or rRNA signature distinguishes a normal state as compared to disease state or condition.

In yet other embodiments, the subject is a human.

BRIEF DESCRIPTION OF THE DRAWINGS

The following detailed description of preferred embodiments of the invention will be better understood when read in conjunction with the appended drawings. For the purpose of illustrating the invention, there are examples shown in the drawings embodiments of which are presently preferred. It should be understood, however, that the invention is not limited to the precise arrangements and instrumentalities of the embodiments shown in the drawings.

FIG. 2 is a list of the nuclear 5S rRNA sequence padded on both sides with additional sequences that are aimed at accounting for any sequence reads from sequencing that might extend past the actual natural boundaries of the rRNA. The padded sequences are shown in lower case letters. The actual 5S rRNA sequence is shown in upper case letters.

FIG. 3 is a list of the mitochondrial 12S rRNA sequence padded on both sides with additional sequences that are aimed at accounting for any sequence reads from sequencing that might extend past the actual natural boundaries of the rRNA. The padded sequences are shown in lower case letters. The actual 12S rRNA sequences is shown in upper case letters.

FIG. 4 is a list of the mitochondrial 16S rRNA sequence padded on both sides with additional sequences that are aimed at accounting for any sequence reads from sequencing that might extend past the actual natural boundaries of the rRNA. The padded sequences are shown in lower case letters. The actual 16 rRNA sequence is shown in upper case letters.

FIG. 5 is a list of the nuclear 45S pre-rRNA sequence padded on both sides with additional sequences that are aimed at accounting for any sequence reads from sequencing that might extend past the actual natural boundaries of the rRNA. The padded sequences are shown in lower case letters. The actual rRNA sequences are shown in boldface upper case letters and are underlined. Nucleotides shown normal upper case letters (not underlined) correspond to spacers or to other non-rRNA sequence of the 45S pre-RNA sequence.

FIG. 6 is a table listing the name and reference identifier for 42 tables (Table 10-Table 51) located on a compact disc (CD) submitted with the U.S. Provisional Patent Application No. 62/498,368, filed Dec. 22, 2016.

DETAILED DESCRIPTION OF THE INVENTION

Figure 1:
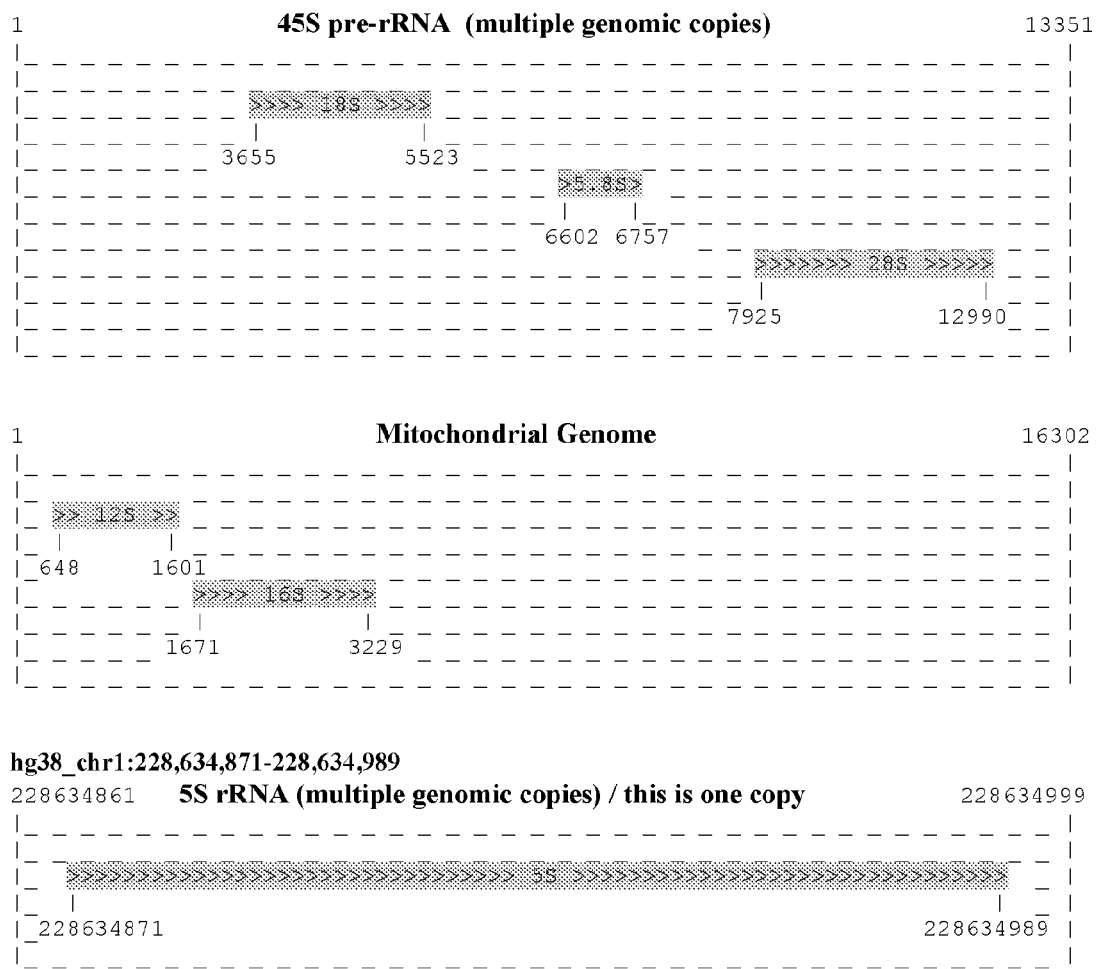
FIG. 1 is an illustration showing the genomic arrangement of the nuclear rRNA sequences: 18S, 5.8S, 28S and 5S and the mitochondrial rRNA sequences: 12S and 16S.

The full disclosures of the priority document U.S. Provisional Patent Application No. 62/231,935, filed Dec. 22, 2016, is incorporated by reference in its entireties herein.

Definitions

Unless defined otherwise, all technical and scientific terms used herein have the same meaning as commonly understood by one of ordinary skill in the art to which the invention pertains. Although any methods and materials similar or equivalent to those described herein may be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

As used herein, the articles "a" and "an" are used to refer to one or to more than one (i.e., to at least one) of the grammatical object of the article. By way of example, "an element" means one element or more than one element.

As used herein when referring to a measurable value such as an amount, a temporal duration, and the like, the term "about" is meant to encompass variations of ±20% or within 10%, 9%, 8%, 7%, 6%, 5%, 4%, 3%, 2%, 1%, 0.5%, 0.1%, 0.05%, or 0.01% of the specified value, as such variations are appropriate to perform the disclosed methods. Unless otherwise clear from context, all numerical values provided herein are modified by the term about.

"About" as used herein when referring to a measurable value such as an amount, a temporal duration, and the like, is meant to encompass variations of ±20% or ±10%, more preferably ±5%, even more preferably +1%, and still more preferably ±0.1% from the specified value, as such variations are appropriate to perform the disclosed methods.

By "alteration" is meant a change (increase or decrease) in the expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels.

By "complementary sequence" or "complement" is meant a nucleic acid base sequence that can form a double-stranded structure by matching base pairs to another polynucleotide sequence. Base pairing occurs through the formation of hydrogen bonds, which may be Watson-Crick, wooble, Hoogsteen or reversed Hoogsteen hydrogen bonding, between complementary nucleobases. For example, adenine and thymine are complementary nucleobases that pair through the formation of hydrogen bonds.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

The term "cancer" as used herein is defined as disease characterized by the rapid and uncontrolled growth of aberrant cells. Cancer cells can spread locally or through the bloodstream and lymphatic system to other parts of the body. Examples of various cancers include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like.

"Detect" refers to identifying the presence, absence or amount of the biomarker to be detected.

The phrase "differentially present" refers to differences in the quantity and/or the frequency of a biomarker present in a sample taken from subjects having a disease as compared to a control subject. A biomarker can be differentially present in terms of quantity, frequency or both. A polypeptide or polynucleotide is differentially present between two samples if the amount or frequency of the polypeptide or polynucleotide in one sample is statistically significantly different (either higher or lower) from the amount of the polypeptide or polynucleotide in the other sample, such as reference or control samples. Alternatively or additionally, a polypeptide or polynucleotide is differentially present between two sets of samples if the amount or frequency of the polypeptide or polynucleotide in samples of the first set, such as diseased subjects' samples, is statistically significantly (either higher or lower) from the amount of the polypeptide or polynucleotide in samples of the second set, such reference or control samples. A biomarker that is present in one sample, but undetectable in another sample is differentially present.

A "disease" is a state of health of an animal wherein the animal cannot maintain homeostasis, and wherein if the disease is not ameliorated then the animal's health continues to deteriorate. A "disease subtype" is a state of health of an animal wherein animals with the disease manifest different clinical features or symptoms. For example, Alzheimer's disease includes at least three subtypes, inflammatory, non-inflammatory, and cortical.

A "disorder" as used herein, is used interchangeably with "condition," and refers to a state of health in an animal, wherein the animal is able to maintain homeostasis, but in which the animal's state of health is less favorable than it would be in the absence of the disorder. Left untreated, a disorder does not necessarily cause a further decrease in the animal's state of health.

By "effective amount" is meant the amount required to reduce or improve at least one symptom of a disease relative to an untreated patient. The effective amount of active compound(s) used to practice the present invention for therapeutic treatment of a disease varies depending upon the manner of administration, the age, body weight, and general health of the subject.

As used herein "endogenous" refers to any material from or produced inside an organism, cell, tissue or system.

The term "expression" as used herein is defined as the transcription and/or translation of a particular nucleotide sequence driven by its promoter.

By "fragment" is meant a portion of a polynucleotide or nucleic acid molecule. This portion contains, preferably, at least 10%, 20%, 30%, 40%, 50%, 60%, 70%, 80%, 90%, 91%, 92%, 93%, 94%, 95%, 96%, 97%, 98%, or 99% of the entire length of the reference nucleic acids. A fragment may contain 10, 20, 30, 40, 50, 60, 70, 80, 90, or 100, 200, 300, 400, 500, 600, 700, 800, 900, 1000, 1500, 2000 or 2500 (and any integer value in between) nucleotides. The fragment, as applied to a nucleic acid molecule, refers to a subsequence of a larger nucleic acid. The fragment can be an autonomous and functional molecule. A fragment may contain modifications at neither, one or both of its termini. A modification can include but is not limited to a phosphate, a cyclic phosphate, a hydroxyl, and an amino acid. A "fragment" of a nucleic acid molecule may be at least about 15 nucleotides in length; for example, at least about 50 nucleotides to about 100 nucleotides; at least about 100 to about 500 nucleotides, at least about 500 to about 1000 nucleotides, at least about 1000 nucleotides to about 1500 nucleotides; or about 1500 nucleotides to about 2500 nucleotides; or about 2500 nucleotides (and any integer value in between).

"Similar" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are similar at that position. The percent of similarity between two sequences is a function of the number of matching or similar positions shared by the two sequences divided by the number of positions compared X 100. For example, if 6 of 10 of the positions in two sequences are matched or similar then the two sequences are 60% similar. By way of example, the DNA sequences ATTGCC and TATGGC share 50% similarity. Generally, a comparison is made when two sequences are aligned in a way that maximizes their similarity.

As used herein, the term "inhibit" is meant to refer to a decrease in biological state. For example, the term "inhibit" may be construed to refer to the ability to negatively affect the abundance, stability, activity or localization of a ncRNA or of a protein-coding messenger RNA (mRNA) or of a protein, wherein such inhibition of the ncRNA or mRNA may result in the modulation of a gene's abundance, of a protein's mRNA abundance, of the stability of a protein's mRNA, of the transcription of a protein-coding mRNA, of the localization of a protein-coding mRNA, of the stability of a protein-coding mRNA, of the translation of a protein-coding mRNA, of the stability of a protein polypeptide, of a protein's post-translational modifications, of a protein's activity, of a protein's signaling pathway, of a ncRNA's abundance, of a ncRNA's stability, of a ncRNA's transcription, of a ncRNA's localization, of a ncRNA's post-transcriptional modifications, of a ncRNA's activity, of a ncRNA's signaling pathway, of a protein's, or any combination thereof.

"Instructional material," as that term is used herein, includes a publication, a recording, a diagram, or any other medium of expression that may be used to communicate the usefulness of the compounds of the invention. In some instances, the instructional material may be part of a kit useful for effecting alleviating or treating the various diseases or conditions recited herein. Optionally, or alternately, the instructional material may describe one or more methods of alleviating the diseases or conditions in a cell or a tissue of a mammal. The instructional material of the kit may, for example, be affixed to a container that contains the compounds of the invention or be shipped together with a container that contains the compounds. Alternatively, the instructional material may be shipped separately from the container with the intention that the recipient uses the instructional material and the compound cooperatively. For example, the instructional material is for use of a kit; instructions for use of the compound; or instructions for use of a formulation of the compound.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "mitochondrial rRNAs" is used to refer to ribosomal RNAs encoded in the mitochondrial genome. The term "nuclear rRNAs" is used to refer to ribosomal RNAs encoded in the nuclear genome.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

By "isolated polynucleotide" is meant a nucleic acid (e.g., a DNA or an RNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a rRNA, cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

The term "oligonucleotide panel" or "panel of oligonucleotides" refers to a collection of one or more oligonucleotides that may be used to identify DNA (e.g. genomic segments comprising a specific sequence, DNA sequences bound by particular protein, etc.) or RNA (e.g. mRNAs, microRNAs, tRNAs, rRNAs etc.) or fragments thereof through hybridization of complementary regions between the oligonucleotides and the DNA or RNA. If the sought molecule is RNA, it is commonly converted to DNA through a reverse transcription step). The oligonucleotides may include complementary sequences to known DNA or known RNA sequences. The oligonucleotides may be engineered to be between about 5 nucleotides to about 40 nucleotides, or about 5 nucleotides to about 30 nucleotides, or about 5 nucleotides to about 20 nucleotides, or about 5 nucleotides to about 15 nucleotides in length. The term "oligonucleotide panel" or "panel of oligonucleotides" could also refer to a system and accompanying collection of reagents that, in addition to being able to hybridize to molecules containing a complementary sequence, can also ensure that the identified molecule's 3' terminus matches precisely the 3' terminus of the sought molecule, or that the identified molecule's 5' terminus matches precisely the 5' terminus of the sought molecule, or both: this ability is unlike what can be achieved by conventional assays such as e.g. Affymetrix chips and methods (e.g. "dumbbell-PCR") and systems (e.g. the Fireplex system of Firefly BioWorks) that can achieve this are now beginning to be available.

The term "operably linked" refers to functional linkage between a regulatory sequence and a heterologous nucleic acid sequence resulting in expression or changes in abundance of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein coding regions, in the same reading frame.

The term "overexpressed" tumor antigen or "overexpression" of the tumor antigen is intended to indicate an abnormally high level of expression of the tumor antigen in a cell from a disease area like a solid tumor within a specific tissue or organ of the patient relative to the level of expression in a normal cell from that tissue or organ. Patients having solid tumors or a hematological malignancy characterized by overexpression of the tumor antigen can be determined by standard assays known in the art. The term "underexpressed" tumor antigen or "underexpression" of the tumor antigen is completely analogous.

The term "overexpressed" tumor promoter or "overexpression" of the tumor promoter is intended to indicate an abnormally high level of expression of the tumor promoter RNA or protein in a cell from a disease area like a solid tumor within a specific tissue or organ of the patient relative to the level of expression in a normal cell from that tissue or organ. Patients having solid tumors or a hematological malignancy characterized by overexpression of the tumor promoter can be determined by standard assays known in the art. The term "underexpressed" tumor promoter or "underexpression" of the tumor promoter is completely analogous.

The term "overexpressed" tumor suppressor or "overexpression" of the tumor suppressor is intended to indicate an abnormally high level of abundance of the tumor suppressor RNA or protein in a cell from a specific area within a specific tissue or organ of an individual relative to the level of abundance under typical circumstances in a cell from that tissue or organ. Individuals having characteristic overexpression of the tumor suppressor can be determined by standard assays known in the art. The term "underexpressed" tumor suppressor or "underexpression" of the tumor suppressor is completely analogous.

The terms "patient," "subject," "individual," and the like are used interchangeably herein, and refer to a human or non-human mammal, or cells thereof whether in vitro or in situ, amenable to the methods described herein. Non-human mammals include, for example, livestock and pets, such as ovine, bovine, porcine, canine, feline and murine mammals. The term "subject" is intended to include living organisms in which an immune response can be elicited (e.g., mammals). Examples of subjects include humans, dogs, cats, mice, rats, and transgenic species thereof. In certain non-limiting embodiments, the patient, subject or individual is a human.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which may be hydrolyzed into the monomeric "nucleotides." The monomeric nucleotides may be hydrolyzed into nucleosides. As used herein polynucleotides include, but are not limited to, all nucleic acid sequences that are obtained by any means available in the art, including, without limitation, recombinant means, i.e., the cloning of nucleic acid sequences from a recombinant library or a cell genome, using ordinary cloning technology and PCR™, and the like, and by synthetic means. The following abbreviations for the commonly occurring nucleic acid bases are used. "A" refers to adenosine, "C" refers to cytosine, "G" refers to guanosine, "T" refers to thymidine, and "U" refers to uridine. The term "RNA" as used herein is defined as ribonucleic acid. The term "recombinant DNA" as used herein is defined as DNA produced by joining pieces of DNA from different sources.

As used herein, the terms "prevent," "preventing," "prevention," and the like refer to reducing the probability of developing a disease or condition in a subject, who does not have, but is at risk of or susceptible to developing a disease or condition.

As used herein, the term "promoter/regulatory sequence" means a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The terms "purified," or "biologically pure" refer to material that is free to varying degrees from components which normally accompany it as found in its native state. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

The term "race" refers to a taxonomic rank below the species level, a collection of genetically differentiated human populations defined by phenotype. White (Wh) is the National Health Institute/The Cancer Genome Atlas (NIH/TCGA) designation for a person with origins in any of the original peoples of the far Europe, the Middle East, or North Africa. Black or African American (B/Aa) is the NIH/TCGA designation for a person with origins in any of the black racial groups of Africa.

By "reduces" or "decreases" is meant a negative alteration of at least 10%, 25%, 50%, 75%, or 100%.

By "reference" is meant a standard or control. A "reference" is also a defined standard or control used as a basis for comparison.

As used herein, "relative abundance" refers to the ratio of the quantities of two or more molecules of interest (e.g. rRNAs, rRNA fragments, tRNAs, tRNA fragments, miRNAs, etc.) present in a sample. The relative abundance of two or more molecules of interest in a given sample may differ from the relative abundance of the same two or more molecules in a second sample.

The terms "rRNA fragment" or "rRF" are all used to refer to short non-coding RNAs generated from a rRNA locus. rRNA fragments have lengths that range from 10 to 50 or more nucleotides.

The terms "tRNA fragment" or "tRF" are all used to refer to short non-coding RNAs generated from a tRNA locus. tRNA fragments have lengths that range from 10 to 50 or more nucleotides.

As used herein, "sample" or "biological sample" refers to anything, which may contain the biomarker (e.g., polypeptide, polynucleotide, or fragment thereof) for which a biomarker assay is desired. The sample may be a biological sample, such as a biological fluid or a biological tissue or an isolated cell or a collection of isolated cells. In one embodiment, a biological sample is a tissue sample including pulmonary vascular cells. Such a sample may include diverse cells, proteins, and genetic material. Examples of biological tissues also include organs, tumors, lymph nodes, arteries and individual cell(s). Examples of biological fluids include urine, blood, plasma, serum, saliva, semen, stool, sputum, cerebral spinal fluid, tears, mucus, amniotic fluid or the like.

As used herein, the term "سensitivity" is the percentage of biomarker-detected subjects with a particular disease.

As used herein, "sample" or "biological sample" refers to anything, which may contain the biomarker (e.g., polypeptide, polynucleotide, or fragment thereof) for which a biomarker assay is desired. The sample may be a biological sample, such as a biological fluid or a biological tissue. In one embodiment, a biological sample is a tissue sample including pulmonary vascular cells. Such a sample may include diverse cells, proteins, and genetic material. Examples of biological tissues also include organs, tumors, lymph nodes, arteries and individual cell(s). Examples of biological fluids include urine, blood, plasma, serum, saliva, semen, stool, sputum, cerebral spinal fluid, tears, mucus, amniotic fluid or the like.

As used herein, the term "sensitivity" is the percentage of biomarker-detected subjects with a particular disease.

The terms "short RNA profile" or "RNA profile" or "rRNA profile" or "rRNA fragment profile" or "tRNA profile" or "tRNA fragment profile" are used interchangeably and refer to a genetic makeup of RNA molecules that are present in a sample, such as a cell, tissue, or subject. Optionally, the abundance of an RNA molecule that is part of an RNA profile may also be sought. Optionally, other attributes of an RNA molecule that is part of an RNA profile may also be sought and include but are not limited to a molecule's location within the genomic locus of origin, the molecule's starting point, the molecule's ending point, the molecule's length, the identity of the molecule's terminal modifications, etc. The RNA molecules that can be used to form such a profile can be miRNAs, miRNA isoforms, mRNAs, rRNAs, rRNA fragments, tRNAs, tRNA fragments, etc. as well as combinations thereof.

The term "signature" or "RNA signature" as used herein refers to a subset of an RNA profile and comprises the identity of one or more molecules that are selected from an RNA profile and optionally one or more of the attributes of the one or more molecules that are selected from the RNA profile.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison. The term "therapeutically effective amount" refers to the amount of the subject compound that will elicit the biological or medical response of a tissue, system, or subject that is being sought by the researcher, veterinarian, medical doctor or other clinician. The term "therapeutically effective amount" includes that amount of a compound that, when administered, is sufficient to prevent development of, or alleviate to some extent, one or more of the signs or symptoms of the disease or condition being treated. The therapeutically effective amount will vary depending on the compound, the disease and its severity and the age, weight, etc., of the subject to be treated.

The term "therapeutic" as used herein means a treatment and/or prophylaxis. A therapeutic effect is obtained by suppression, remission, or eradication of a disease state. As used herein, the terms "treat," treating," "treatment," and the like refer to reducing or improving a disease or condition and/or symptom associated therewith. It will be appreciated that, although not precluded, treating a disease or condition does not require that the disease, condition or symptoms associated therewith be completely ameliorated or eliminated.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

DESCRIPTION

The present invention includes methods and compositions of analyzing RNA fragments (i.e rRNA and tRNA Fragments).

rRNAs and tRNAs are ancient non-coding RNAs (ncR-NAs). As such, rRNAs and tRNAs are present in archaea, bacteria, and eukaryotes. rRNAs are key molecules in cells. Described herein, rRNA and tRNA loci produce fragments that are important for characterizing race, sex, age, disease prognosis, disease diagnosis, etc. The present invention utilizes rRNA and tRNA fragments profiling to identify subjects in need of therapeutic intervention.

In one aspect, the invention provides a method of identifying a subject in need of therapeutic intervention to treat a disease, disease progression, or disease recurrence. The method comprises isolating fragments of rRNAs or tRNAs from a sample obtained from the subject; characterizing the fragments of rRNAs or tRNAs and their relative abundance in the sample to identify a signature, wherein when the signature is indicative of a diagnosis of the disease (or of a disease subtype or of a disease recurrence), a treatment of the subject is recommended or provided. The recommended treatment may be personalized and depend on the subject's attributes. In one embodiment, these attributes may include the subject's sex, or the subject's race, or the subject's age, or a combination thereof. As such, it may be necessary to further characterize the fragments of rRNAs or tRNAs and their relative abundance in the sample to identify a signature, wherein when the signature can inform the subject's physician of the subject's sex, or race, or age and weigh in on the recommended or provided treatment.

In another aspect, a method of identifying a sample's tissue of origin to treat a disease or disease progression or disease recurrence in a subject is provided. In one embodiment the sample is a metastatic sample. The method comprises isolating RNA fragments (RFs) from a sample obtained from the subject; characterizing the identity of the RFs and their relative abundance in the samples to identify a signature, wherein the signature is indicative of the sample's tissue of origin, or the disease status of the tissue of origin; and recommending or providing a personalized treatment regimen or a disease prognosis to the subject dependent on the sample's tissue of origin, or the disease status of the tissue of origin, or the subject's sex, race or age.

rRNA/tRNA Fragments

Analysis of RNA fragment profiles or signatures in one or more cells can lead to the discovery of RNA signatures present in healthy cells or diseased cells. RNA signatures of one or more cells, or a tissue may be used to identify a diseased cell, disease progression, or disease recurrence in a subject. Thus, the subject may be identified as in need of therapeutic intervention to delay the onset of, reduce, improve, and/or treat a disease or condition, such as cancer, in a subject in need thereof.

In another aspect, the invention includes a method for identifying rRNA or tRNA fragments from sequenced reads, typically obtained through next generation sequencing approaches.

Various sequencing methodologies and platforms are known in the art. The choice of a platform may be based on the user's and experiment's requirements. In some embodiments, the sequencing method is a high throughput next-generation method. Non limiting, examples of massively parallel signature sequencing platforms are Illumina sequencing by synthesis (Illumina, san Diego Calif.), 454 pyrosequencing (Roche Diagnostics, Indianapolis Ind.), SOLiD sequencing (Life Technologies, Carlsbad, Calif.), Ion Torrent semiconductor sequencing (Life Technologies, Carlsbad, Calif.), Heliscope single molecule sequencing (Helicon Biosciences, Cambridge, Mass.), and Single molecule real time (SMRT) sequencing (Pacific Biosciences, Menlo Park, Calif.).

The method for identifying rRNA fragments of this invention comprises the steps of defining rRNA loci; mapping the sequenced reads to at least one rRNA or tRNA genomic locus comprising disregarding map locations that differ from the rRNA fragments by at least an insertion, deletion, or replacement of a nucleotide, optionally excluding rRNA or tRNA fragments that map to locations outside of the known rRNA or tRNA loci; mapping sequenced reads that may have been post-transcriptionally modified; and characterizing the remaining sequenced reads.

The human nuclear and human mitochondrial genomes comprise many rRNAs. It is known in the art that rRNA loci include the mitochondrial genome loci of mitochondrial rRNA sequences, and the nuclear genome loci of nuclear rRNA sequences. The nuclear genome also includes loci whose sequences resemble mitochondrial rRNA sequences.

The sequenced reads are further mapped to at least one rRNA genomic locus. Sequenced reads that differ from the map location by at least an insertion, deletion, or replacement of a nucleotide are optionally disregarded. Sequenced reads that map outside rRNA loci are optionally discarded to avoid erroneous results. Sequences reads that map inside rRNA loci (e.g. the 45S pre-rRNA) but outside the confines of rRNAs (e.g. in the spacers separating the rRNAs or in the sequence preceding the 18S rRNA or in the sequence following the 28S rRNA) may be optionally retained as they can improve the quality of the signature.

The identified RNA fragments of the invention (i.e. rRFs and/or tRFs) can be further assessed for one or more of, sequence of the RNA fragments, the overall abundance of the RNA fragments based on the number of sequenced reads that mapped to RNA loci, the relative abundance of an RNA fragment to a reference, the relative abundance of two RNA fragments with respect one another, the terminal modifications of an RNA fragment, the length of an RNA fragment, the starting and ending points of a RNA fragment, the genomic origin of an RNA fragment, and other analyses known in the art.

Also provided in this invention is a panel of engineered oligonucleotides comprising a mixture of oligonucleotides capable of hybridizing to RNA fragments. In some embodiments, these engineered oligonucleotides are about 5 to about 15 nucleotides (nts) in length and capable of hybridizing rRNA fragments and/or rRNAs, wherein the rRNA fragments are generally at least 15 nts in length and generally less than 60 nts in length. The panel may include one or more oligonucleotides that may be used to identify rRNA fragments or rRNAs through hybridization of complementary regions between the oligonucleotides and the rRNAs, or related techniques that are well known to those skilled in the art. The oligonucleotides may include complementary sequences to known rRNA sequences, such as rRNA fragments. The oligonucleotides may be engineered to be between about 5 nucleotides to about 40 nucleotides, or about 5 nucleotides to about 30 nucleotides, or about 5 nucleotides to about 20 nucleotides, or about 5 nucleotides to about 15 nucleotides in length. The panel may include engineered oligonucleotides that are specific to a cell type, tissue of interest, disease type, disease subtype, stage of disease, a patient's sex, a patient's population of origin, a patient's race or other aspect that may differentiate rRNA fragment signatures. The kits and oligonucleotide panel may also be used to identify agents that modulate disease, or progression of disease, or disease recurrence, in patient samples, and/or in in vitro or in vivo animal models for the disease at hand.

Alternate methods for quantifying the abundance levels of a select collection of ncRNAs that comprise the signature of interest, particularly rRNAs or tRNAs and/or rRNA or tRNAs fragments include: a set of specially designed TaqMan® assays, classical TaqMan® Gene Expression Assays, TaqMan® Low Density Array-micro fluidic cards (Applied Biosystems/Thermo-Fisher Scientific); a set of end-point specific assays such as dumbbell-PCR; a set of miR-ID assays (Somagenics, Inc.); or, other quantitative PCR (qPCR) systems known in the art.

The abundance levels of the ncRNAs that comprise the signature of interest, particularly rRNAs, tRNAs and/or rRFs or tRFs, may also be measured by other technologies known in the art, e.g. deep-sequencing technologies."

Diagnostics

Samples from subjects suffering from a disease or a condition have a specific rRNA fragment profile in the cell or cells that are diseased, including metastatic cancer cells. In other instances, the disease or a condition can affect the expression patterns of mRNAs and ncRNAs, including rRNAs, tRNAs, and miRNAs, in other cells or cell types that need not be part of the organ that is primarily associated with the disease or condition. In such cases, the sample need not originate from the organ and alternative sources of material can be used instead for examining a signature of interest.

Identifying the cellular origin or tissue origin of a cancer metastasis, or a propensity for a cell to metastasize by identifying a rRNA fragment profile associated with the cellular origin or tissue origin or a propensity to metastasize in a sample obtained from the subject allows recommending or offering the subject a personalized treatment. In one aspect, the invention includes a method of identifying a cell's tissue of origin to treat a disease or disease progression, or disease recurrence in a subject in need thereof comprising isolating fragments of rRNAs (or tRNAs) from a sample (e.g. a cell) obtained from the subject; characterizing the fragments of rRNA (or tRNA), which can include assessing one or more of, overall abundance, relative abundance, length of the fragment, starting and ending points of the fragment, terminal modifications, etc., in the sample to identify a signature, wherein the signature is indicative of the cell's tissue of origin, and/or disease status of the tissue of origin; and providing a treatment regimen to the subject dependent on the cell's tissue of origin and/or disease status of the tissue of origin.

Identifying the existence of a disease or condition by identifying a rRNA fragment profile associated with the disease or condition in a sample obtained from the subject allows recommending or offering the subject a personalized treatment. In one aspect, the invention includes a method of identifying a cell's rRNA fragment population to establish and treat the onset of a disease, or the state of the disease, or that disease has recurred in a subject in need thereof comprising isolating fragments of rRNAs from a sample (e.g. a cell) obtained from the subject; characterizing the fragments of rRNA, which can include assessing one or more of, overall abundance, relative abundance, length of the fragment, starting and ending points of the fragment, terminal modifications, etc., in the sample to identify a signature, wherein the signature is indicative of the presence of the disease, of the state of the disease, or of disease recurrence; and providing a treatment regimen to the subject dependent on the sampled cell's profile of rRNAs.

In another embodiment, characterizing the rRNA fragments that are present in the RNA profile can identify subjects in need of treatment.

In another embodiment, analyzing the length of rRNA fragments in a cell, tissue or body fluid is used to identify subjects in need of treatment. In another embodiment, analyzing the length of rRNA fragments in cell, tissue or body fluid is used to identify subjects with a disease subtype.

In yet another embodiment, the relative abundance of the RNA fragments that are present in the RNA profile can identify subjects in need of treatment. In another approach, diagnostic methods are used to assess RNA fragment profiles in a biological sample relative to a reference (e.g., rRNA fragment profile in a healthy cell or tissue or body fluid in a corresponding control sample). Examples of a body fluid may include, but are not limited to, amniotic fluid, aqueous humour and vitreous humour, bile, blood serum, breast milk, cerebrospinal fluid, cerumen, chyle, chyme, endolymph and perilymph, exudates, feces, female ejaculate, gastric acid, gastric juice, lymph, mucus, pericardial fluid, peritoneal fluid, pleural fluid, pus, rheum, saliva, sebum, serous fluid, semen, smegma, sputum, synovial fluid, sweat, tears, urine, vaginal secretion, and vomit.

In one embodiment, the sample, such as a cell or tissue or body fluid is obtained from the subject. In another embodiment, the cell or tissue or body fluid is isolated from the sample. In another embodiment, the cell or tissue is isolated from a body fluid. The sample may be a peripheral blood cell, a tumor cell, a circulating tumor cell, an exosome, a bone marrow cell, a breast cell, a lung cell, a pancreatic cell, or other cell of the body.

In another embodiment, a signature of rRNA (or tRNA) fragments or a presence or absence of specific rRNA (or tRNA) fragments are indicative a diagnosis of a disease or condition. In some embodiments, the signature of rRNA fragments distinguishes a normal state as compared to a disease state or a condition.

In one embodiment, the signature of rRNA fragment comprises at least one sequence listed in at least one table selected from the group consisting of: Tables 10-22, 52 and 53. In another embodiment, the signature of rRNA fragment comprises at least one sequence selected from the group consisting of SEQ ID NOs: 1-66149 and 70852-71358.

In a particular embodiment, the methods or assays described herein can comprise analyzing the presence or absence or the signature of RNA fragments in a disease or condition, disease recurrence, or disease progression selected from the group consisting of a cancer, a brain disease, a glaucoma, or a genetically predisposed disease or condition.

In one embodiment, the cancer is selected from the group consisting of adrenocortical carcinoma, bladder urothelial carcinoma, breast invasive carcinoma, triple negative breast cancer, cervical squamous cell carcinoma and endocervical adenocarcinoma, cholangiocarcinoma, coad-colon adenocarcinoma, lymphoid neoplasm diffuse large b-cell lymphoma, esophageal carcinoma, head and neck squamous cell carcinoma, kidney chromophobe, kidney renal clear cell carcinoma, kidney renal papillary cell carcinoma, acute myeloid leukemia, brain lower grade glioma, liver hepatocellular carcinoma, lung adenocarcinoma, lung squamous cell carcinoma, mesothelioma, ovarian serous cystadenocarcinoma, pancreatic adenocarcinoma, pheochromocytoma and paraganglioma, prostate adenocarcinoma, rectum adenocarcinoma, sarcoma, skin cutaneous melanoma, stomach adenocarcinoma, testicular germ cell tumors, thyroid carcinoma, thymoma, uterine corpus endometrial carcinoma, uterine carcinosarcoma, and uveal melanoma, leukemia, and chronic lymphocytic leukemia.

In another embodiment, the cancer is the subtype of breast cancer known as "triple negative."

In another embodiment, the cancer is chronic lymphocytic leukemia.

In another embodiment, the brain disease is Alzheimer's disease.

In another embodiment, the glaucoma is an open angle glaucoma.

In yet another embodiment, the methods or assays described herein can comprise detecting the presence or absence of one or more RNA fragments to distinguish B-cells between subjects of different race such as but not limited to B-cells from white people from B-cells from black people. Such an assessment may assist in offering or providing optimal personalized treatment.

In yet another embodiment, the methods or assays described herein can comprise detecting the presence or absence of one or more rRNA fragments to distinguish platelets from people with a propensity to clot or hemorrhage as listed in Table 17 (SEQ ID NOs: 62836-62914).

In yet another embodiment, the methods or assays described herein can comprise detecting rRNA fragments as signature for POAG, wherein the rRFs signature comprises at least one sequence selected from the group consisting of SEQ ID NOs: 65474-66149 and 70852-71358.

Measuring the abundance of fragments from transfer RNAs (tRNAs) also known as tRFs in a subject, or a sample from a subject, is also included in the invention. It is now known in the literature that tRFs are produced constitutively through fragmentation of precursor and mature tRNAs. In one embodiment, the invention includes a method of identifying a subject at risk for developing a glaucoma disorder or in need of therapeutic intervention to treat a glaucoma disorder. The method of the invention comprises isolating fragments of tRNAs from a sample obtained from the subject; and characterizing the tRNA fragments and their relative abundance in the sample to identify a signature, wherein when the signature is indicative of a prognosis for developing a glaucoma or a diagnosis for a glaucoma, a treatment of the subject is recommended. In some embodiments, characterizing the tRNA fragments comprises at least one assessment selected from the group consisting of sequencing the tRNA fragments, measuring overall abundance of one of the tRNA fragments mapped to the genome, measuring a relative abundance of the one tRNA fragment to a reference, assessing a length of the one tRNA fragment, identifying starting and ending points of the one tRNA fragment, identifying genomic origin of the one tRNA fragment, and identifying a terminal modification of the one tRNA fragment.

In another embodiment, the invention includes a method of diagnosing, identifying or monitoring a glaucoma in a subject in need thereof. The method comprises isolating tRNA fragments from a cell obtained from the subject; hybridizing the tRNA fragments to a panel of oligonucleotides engineered to detect tRNA fragments; analyzing levels of the tRNA fragments present in the cell; wherein a differential in the level of measured tRNA fragments as compared to a reference is indicative of a diagnosis or identification of a cancer in the subject; and providing a treatment regimen to the subject dependent on the differential in the level of measured tRNA fragments as compared to the reference.

In one embodiment, the signature of tRNA fragment comprises at least one sequence listed in at least one table selected from the group consisting of: Tables 23, 24, 54 and 55. In another embodiment, the signature of rRNA fragment comprises at least one sequence selected from the group consisting of SEQ ID NOs: 66150-70851 and 71359-71880.

In general, characterizing the rRNA or tRNA fragments of this invention identifies a signature that may be indicative of a diagnosis of a disease or condition, the onset of a disease or condition, or the recurrence of a disease or condition. The character of the rRNA or tRNA fragments in the sample may be compared with a reference, such as other rRNAs or tRNA present within the cell, a healthy cell or a diseased cell will yield a relative abundance of the rRNA or tRNA fragments to identify a signature. Alternatively, the abundance of two or more rRNA/rRNA fragments, two or more tRNAs/tRNA fragments, or at least one rRNA/rRNA fragment and at least one tRNA/tRNA fragment may be compared to identify a signature. Alternatively, the signature may be established by comparing the rRNA or tRNA fragments' locations within the genomic loci of origin, the starting and ending points of the fragments, the length of the fragment, and any other feature of the fragments as compared to other rRNA or tRNA fragments within the same sample or another sample or reference to distinguish a diseased state or condition, a propensity to develop a disease or condition, and/or the absence of a disease or condition. The skilled artisan will appreciate that the diagnostic can be adjusted to increase sensitivity or specificity of the assay. In general, any significant increase (e.g., at least about 10%, 15%, 30%, 50%, 60%, 75%, 80%, or 90%) in the level of a polynucleotide or polypeptide biomarker in the subject sample relative to a reference may be used to diagnose a diseased state, a propensity to develop a disease or condition, and/or the absence of a disease or condition.

Accordingly, an rRNA or tRNA fragment profile may be obtained from a sample from a subject and compared to a reference rRNA or tRNA fragment profile obtained from a reference cell or tissue or body fluid, so that it is possible to classify the subject as belonging to or not belonging to the reference population. The association may take into account the presence or absence of one or more rRNA or tRNA fragments in a test sample and the frequency of detection of the rRNA or tRNA fragments in a test sample compared to a control. The association may take into account both of such factors to facilitate a diagnosis of a disease or condition. The association may take into account both of such factors to guide recommending or offering a treatment. In one embodiment, the reference is the identity and abundance level of the rRNA or tRNA fragments present in a control sample, such as non-diseased cell, a cell obtained from a patient that does not have the disease or condition at issue or a propensity to develop such a disease or condition. In another embodiment, the reference is a baseline level of the rRNA or tRNA fragment presence and abundance in a biologic sample derived from the patient prior to, during, or after treatment for the disease or condition. In yet another embodiment, the reference is a standardized curve.

Methods of Use

In one aspect, the invention includes a method of identifying the race or sex of a subject in need of treatment. The method comprises isolating fragments of rRNAs from a sample obtained from the subject; characterizing the identity of the rRNA fragments and their relative abundance in the sample to identify a signature, wherein the signature is indicative of the race and sex of the subject; and recommending or providing a personalized treatment regimen or a disease prognosis to the subject based upon its race and sex. In some embodiments, the signature comprises at least one sequence listed in at least one table selected from the group consisting of Table 10, and Table 11 (SEQ ID NOs: 1-28515).

In another aspect, the method described herein includes diagnosing, identifying or monitoring the onset or recurrence of a disease or condition, such as a cancer, in a subject in need of therapeutic intervention. In one embodiment, the method includes isolating rRNA fragments from a cell, tissue or body fluid obtained from the subject; hybridizing the rRNA fragments to a panel of oligonucleotides engineered to detect rRNA fragments; analyzing an identity and levels of the rRNA fragments present in the cell; wherein a differential in the identity or measured rRNA fragments' levels to the reference is indicative of a diagnosis or identification of breast cancer in the subject; and providing a treatment regimen to the subject dependent on the differential in the identity and measured rRNA fragments' levels to the reference.

The non-coding RNAs of interest (rRNAs or tRNAs) may be isolated by a method known in the art or selected from the group consisting of size selection, amplification and sequencing.

In some embodiments, the size of the rRNA or tRNA fragments is in the range of about 10 nucleotides to about 60 nucleotides are isolated. The range of sizes may include, but are not limited to, from about 15 nucleotides to about 50 nucleotides, and from about 20 nucleotides to about 45 nucleotides. The size of the rRNAs fragments may be about 10 nucleotides, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or about 60 nucleotides.

The signature is an rRNA or tRNA fragment profile that comprises the identity, abundance and relative abundance of rRNA or tRNA fragments. The rRNA or tRNA fragments' location within the genomic loci of origin, the starting and ending points of the fragments, the length of the fragments, and any other feature of the fragments as compared to other rRNA or tRNA fragments within the same sample or another sample or reference may be included in the rRNA or tRNA fragment signature. In one embodiment, the signature is obtained by hybridization to a single oligonucleotide, or to a panel of oligonucleotides, such as those that comprise at least two or more oligonucleotides that selectively hybridize to the rRNA or tRNA fragments. To prepare the sample for characterization, the rRNAs, tRNAs, rRNA fragments or tRNA fragments may be amplified prior to the hybridization.

The therapeutic methods disclosed herein, including prophylactic treatment, to treat a disease or condition, such as a disease selected from the group consisting of a cancer, and genetically predisposed disease in a subject, include administering a therapeutically effective amount of an agent or therapeutic to a subject (e.g., animal, human) in need thereof, including a mammal, particularly a human. Such treatment is suitably administered to subjects, particularly humans, suffering from, having, susceptible to, or at risk for the disease or condition or a symptom thereof. The agent may be identified in a screening assay using signatures of rRNA fragments or relative abundances of rRNA fragments in in vitro or in vivo animal model for the disease or condition.

Monitoring

Methods of monitoring subjects that are at risk of developing a disease or condition, or are at risk of disease or condition recurrence, or who are receiving therapeutic intervention to reduce, improve, or treat a symptom of the disease or condition, such as breast cancer, are also useful in determining whether to administer treatment and in managing treatment. Provided are methods where the rRNA fragments are measured and characterized. In some cases, the rRNA fragments are measured and characterized as part of a routine course of action. In other cases, the rRNA fragments are measured and characterized before and again after subject management or treatment. In these cases, the methods are used to monitor the onset of a disease or condition, the recurrence of the disease or condition, the status of the disease or condition, or a propensity to develop such disease or condition, e.g., cancer, Alzheimer's disease, glaucoma, etc.

For example, characterization of rRNA fragments or signatures can be used to monitor a subject's response to certain treatments. Such characterization can be used to monitor for the presence or absence of the disease or condition. The changes in the relative abundance or rRNA signature delineated herein before treatment, during treatment, or following the conclusion of a treatment regimen may be indicative of the course of the disease or condition, progression of disease or condition, or response to treatment. In some embodiments, characterization of rRNA fragments or signatures may be assessed at one or more times (e.g., 2, 3, 4, 5). Analysis of the rRNA fragments is made, for example, using a size selection, sequencing, and amplification, or other standard method to determine the rRNA fragment profile. If desired, the rRNA fragment profile is compared to a reference to determine if any alteration in the rRNA fragment profile is present. Such monitoring may be useful, for example, in assessing the efficacy of a particular treatment in a patient. Therapeutics that normalize the rRNA fragment profile are taken as particularly useful.

Kits

Kits for diagnosing, identifying or monitoring a disease or condition, such as a cancer or a glaucoma, are included. In one aspect, the invention includes a panel of engineered oligonucleotides comprising a mixture of oligonucleotides that are about 5 to about 15 nucleotides (nts) in length and capable of hybridizing RNAs (e.g. rRNAs or tRNA) and RNA fragments, wherein the RNAs and RNA fragments are less than about 60 nts in length. In another aspect, the invention includes a kit for high-throughput analysis of RNA or RNA fragments in a sample comprising the panel of engineered oligonucleotides of this invention along with hybridization reagents and RNA isolation reagents. In another aspect, the invention includes a kit for high-throughput analysis of RNA or RNA fragments in a sample comprising a set of specially designed TaqMan® assays aimed at measuring the abundance of molecules mentioned in this invention. Alternatively, the kit could include: a specially designed TaqMan® Gene Expression Assays, TaqMan® Low Density Array-micro fluidic cards; a set of end-point specific assays such as dumbbell-PCR; a set of miR-ID assays. Other kits with variations on the components and oligonucleotide panels may be used in the context of the present invention. For example, the panel of engineered oligonucleotides or specially-designed kit may be specific to a cell type, disease type, stage of disease, or other aspect that may differentiate RNA fragment signatures. The kits and oligonucleotide panel may also be used to identify agents that modulate disease, or progression of disease in in vitro or in vivo animal models for the disease. In some embodiments, the subject in need thereof is a human.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", fourth edition (Sambrook, 2012); "Oligonucleotide Synthesis" (Gait, 1984); "Culture of Animal Cells" (Freshney, 2010); "Methods in Enzymology" "Handbook of Experimental Immunology" (Weir, 1997); "Gene Transfer Vectors for Mammalian Cells" (Miller and Calos, 1987); "Short Protocols in Molecular Biology" (Ausubel, 2002); "Polymerase Chain Reaction: Principles, Applications and Troubleshooting", (Babar, 2011); "Current Protocols in Immunology" (Coligan, 2002). These techniques are applicable to the production of the polynucleotides and polypeptides of the invention, and, as such, may be considered in making and practicing the invention. Particularly useful techniques for particular embodiments will be discussed in the sections that follow.

It is to be understood that wherever values and ranges are provided herein, all values and ranges encompassed by these values and ranges, are meant to be encompassed within the scope of the present invention. Moreover, all values that fall within these ranges, as well as the upper or lower limits of a range of values, are also contemplated by the present application.

The following examples further illustrate aspects of the present invention. However, they are in no way a limitation of the teachings or disclosure of the present invention as set forth herein.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

The Results of the experiments disclosed herein are now described.

The present invention described herein includes by reference several datasets of short RNA profiles. Collections of RNA fragments (rRNA and tRNA) were identified and analyzed for several datasets. The results of the analyses are summarized in 42 tables (Table 10-Table 51) on a compact disc (CD) created on Dec. 22, 2016 that were submitted with the Provisional Patent Application No. 62/498,368 and in tables 52-55. The details of these results are located in the files listed in FIG. 6 and below herein.

| | |
|---|---|
| ALL_rRNA_seqs.1000GenomesProject@atleast10RPM.Population-Sex-Location.27November2016_All | Table 10 |
| ALL_rRNA_seqs.1000GenomesProject@atleast10RPM.Population-Sex-Location.27November2016_more20percent | Table 11 |
| ALL_rRNA_seqs.BrainSamples@atleast1000reads.Location.27November2016 | Table 12 |
| ALL_rRNA_seqs.NormalBcells_and_CLL@atleast1000reads.Location.27November2016 | Table 13 |
| ALL_rRNA_seqs.NormalBcells_and_POAG@atleast10RPM.10December2016 | Table 14 |
| ALL_rRNA_seqs.NormalBcells_and_TNBC@atleast10RPM.Location.27November2016_All | Table 15 |
| ALL_rRNA_seqs.NormalBreast_and_TNBC@atleast10RPM.Location.27November2016_more20percent | Table 16 |
| ALL_rRNA_seqs.PlateletSamples@atleast1000reads.Location.27November2016 | Table 17 |
| ALL_rRNA_seqs.ProstateSamples@atleast1000reads.Location.27November2016 | Table 18 |
| ALL_rRNA_seqs.TCGAProject@atleast10RPM.CancerType-Location.27November2016_All | Table 19 |
| ALL_rRNA_seqs.TCGAProject@atleast10RPM.CancerType-Location.27November2016_more20percent | Table 20 |
| ALL_rRNA_seqs.TCGAProject@atleast10RPM.CancerType-Location.27November2016_more20percentResort | Table 21 |
| ALL_rRNA_seqs.POAG_exclusive.and.NOT_in_LCL.NOT_in_TCGA_NOT_inNormalandCLL.sequences.txt | Table 22 |
| ALL.NormalBcells_and_POAG.exclusive.transfer_RNA_Fragments.10RPMormore.12December2016.txt | Table 23 |
| ALL_tRNA_seqs.exclusive.transfer_RNAs.10RPMormore.POAG_exclusive.and.NOT_in_LCL.NOT_in_TCGA.sequences.txt | Table 24 |
| SAM.1000GenomesProject.CEU_vs_FIN_GBR_TSI@FDR=0.0_NegatSign | Table 25 |
| SAM.1000GenomesProject.CEU_vs_FIN_GBR_TSI@FDR=0.0_PositSign | Table 26 |
| SAM.1000GenomesProject.Men.CEU_YRI@FDR=0.0_NegatSign | Table 27 |
| SAM.1000GenomesProject.Men.CEU_YRI@FDR=0.0_PositSign | Table 28 |
| SAM.1000GenomesProject.Men_Women.CEU@FDR=0.0_NegatSign | Table 29 |
| SAM.1000GenomesProject.Men_Women.CEU@FDR=0.0_PositSign | Table 30 |
| SAM.1000GenomesProject.Men_Women.FIN@FDR=0.0_NegatSign | Table 31 |
| SAM.1000GenomesProject.Men_Women.FIN@FDR=0.0_PositSign | Table 32 |
| SAM.1000GenomesProject.Men_Women.GBR@FDR=0.0_NegatSign | Table 33 |
| SAM.1000GenomesProject.Men_Women.GBR@FDR=0.0_PositSign | Table 34 |
| SAM.1000GenomesProject.Men_Women.TSI@FDR=0.0_NegatSign | Table 35 |
| SAM.1000GenomesProject.Men_Women.TSI@FDR=0.0_PositSign | Table 36 |
| SAM.1000GenomesProject.Men_Women.YRI@FDR=0.0_NegatSign | Table 37 |
| SAM.1000GenomesProject.Men_Women.YRI@FDR=0.0_PositSign | Table 38 |
| SAM.1000GenomesProject.Women.CEU_YRI@FDR=0.0_NegatSign | Table 39 |
| SAM.1000GenomesProject.Women.CEU_YRI@FDR=0.0_PositSign | Table 40 |
| SAM.NormalBcells_and_CLL@FDR=0.0_NegatSign | Table 41 |
| SAM.NormalBcells_and_CLL@FDR=0.0_PositSign | Table 42 |
| SAM.NormalBcells_and_POAG@FDR=0.05_SAM.PositSign.txt | Table 43 |
| SAM.NormalBreast_and_TNBC@FDR=0.0_NegatSign | Table 44 |
| SAM.NormalBreast_and_TNBC@FDR=0.0_PositSign | Table 45 |
| SAM.TCGAProject.BRCA_vs_therest@FDR=0.0_NegatSign | Table 46 |
| SAM.TCGAProject.BRCA_vs_therest@FDR=0.0_PositSign | Table 47 |
| SAM.TCGAProject.PAAD_vs_therest@FDR=0.0_NegatSign | Table 48 |

| | |
|---|---|
| SAM.TCGAProject.PAAD_vs_therest@FDR=0.0_PositSign | Table 49 |
| SAM.TCGAProject.PRAD_vs_therest@FDR=0.0_NegatSign | Table 50 |
| SAM.TCGAProject.PRAD_vs_therest@FDR=0.0_PositSign | Table 51 |

Part of Tables 10, 12-18, 20, 22, 24 and 52-55 is also provided elsewhere herein (after Example 11, at the end of the Examples section).

Example 1: Genomic Arrangement and Sequences of rRNAs

The schematic in FIG. 1 shows the arrangement of the six rRNA sequences used herein within their genomic context.

Example of sequences used in this invention are listed in FIG. 2-FIG. 5. With the exception of the mitochondrial 12S and 16S, the remaining rRNAs (5S, 18S, 5.8S and 28S) have multiple genomic copies that are largely identical. In the sequences listed in FIG. 2-FIG. 5 (SEQ ID NO: 71881-71884), all rRNAs have been padded on both sides with additional sequences to account for sequencing reads that might extend past the natural boundaries of the rRNA. The degree of padding differs in each case. The padded sequences are shown in lower case letters. The actual rRNA sequences, or of the pre-rRNA in the case of 45S, are shown in upper case letters. In the case of 45S pre-RNA, spacer sequences are shown in black upper case letters whereas the actual rRNA sequences are shown in color (grey) upper case letters and underlined; the sequences preceding the 18S rRNA or following the 28S rRNA do not produce rRNA and are also shown in black upper case letters. The color (grey scale) used is the same as the color used in the Tables listed herein (Excel spreadsheets) to indicate the respective rRNA. In the case of 45S the three rRNAs shown in FIG. 5 appear in this order: 18S, 5.8S and 28S; on the other hand, in the Tables (Excel files) provided herein on a CD, which was submitted with the Provisional Patent Application No. 62/498,368, (filed Dec. 22, 2016), the grey scale color is used to highlight the entire 45S pre-RNA sequence, which includes the 18S, 5.8S and 28S rRNAs as well as sequences that do not produce rRNAs.

Example 2: Analysis of rRNAs

Adapter sequences were removed from the sequenced reads and the reads were quality trimmed and mapped on the sequences shown in FIGS. 2-5. Only reads that were at least 16 nts in length and mapped exactly on the studied sequences were considered in the present analysis.

A molecule's abundance was calculated in terms of Reads per Million (RPM) as follows: the number of reads supporting the presence of a specific molecule was normalized by dividing by the total number of sequenced reads that remained after adapter removal and quality trimming then multiplied by 1,000,000. Only molecules whose abundance was at least 10 RPM (stringent) were considered in the present analysis.

Datasets

The following datasets were analyzed 492 datasets from the 1000 Genomes Project (1KG) representing healthy men and women, from five human population groups (CEU, FIN, GBR, TSI, and YRI), and two races (White and Black). The datasets are publicly available and were obtained by sequencing immortalized B-cells (lymphoblastoid cell lines or LCL).

10274 datasets from The Cancer Genome Atlas (TCGA). The datasets are publicly available and were obtained by sequencing primary patient samples that represent 32 cancer types.

18 Triple Negative Breast Cancer (TNBC) samples and 21 normal breast samples from Wh and B/Aa subjects. The datasets were obtained and sequenced as part of ongoing projects. These datasets are not publicly available yet.

10 datasets generated by sequencing 5 B-cell enriched PBMC samples from healthy individuals and 5 PBMC samples from chronic lymphocytic leukemia (CLL) patients. The datasets are publicly available and were obtained and sequenced as part of earlier projects.

4 datasets from human brain. The datasets were generated by sequencing 2 normal brain samples and 2 brain samples from patients with Alzheimer's disease. The datasets are publicly available and were obtained and sequenced as part of earlier projects.

10 datasets generated by sequencing 10 platelet samples from healthy men. The datasets were obtained and sequenced as part of earlier projects. These datasets are not publicly available yet.

10 datasets generated by sequencing 5 normal prostate samples and 5 prostate cancer samples. The datasets are publicly available and were obtained and sequenced as part of earlier projects.

Overall Results

The analysis of the datasets listed above herein demonstrates that all 6 rRNAs give rise to multiple fragments. There is the formal possibility that these fragments might be degradation products. However, in recent years, multiple lines of evidence from investigations of miRNAs and tRNAs showed that the seemingly random products were in fact non-random.

Further investigation of the datasets used herein revealed the following:

all six rRNAs produce fragments of varying lengths;

these rRNA fragments (heretofore referred to as "rRFs") are produced in a constitutive manner and, thus, are not degradation products;

the levels and composition of rRFs depend on a person's sex;

the levels and composition of rRFs depend on a person's population origin;

the levels and composition of rRFs depend on a person's race;

the levels and composition of rRFs depend on tissue;

the levels and composition of rRFs depend on tissue state;

the levels and composition of rRFs depend on disease and disease subtype.

Clearly, the results of rRNAs analysis showed that rRNA fragments are constitutive and not degradation products, and that their levels depend on a person's sex, population, and race as well as on tissue, tissue state, disease, and disease subtype, and possibly other variables.

Example 3: Results from the 1000 Genomes Project 492 datasets from the 1KG project were analyzed. The datasets represent healthy men and women, from five human population groups: CEU (Utah residents of Northern and Western European descent), FIN (Finns), GBR (Brits and Scotts), TSI (Toscani Italians), and YRI (Yoruba Africans from the city of Ibadan). Within a population group, there was an even representation of men and women (~50% of each sex). Four of the population groups were White (see Definitions above)—CEU, FIN, GBR and TSI—and one was Black (YRI).

In the CD submitted with the Provisional Patent Application No. 62/498,368, (filed Dec. 22, 2016), Table 10 (SEQ ID NOs: 6525-28515) (ALL_rRNA_seqs.1000Genomes Project@atleast10RPM.Population-Sex-Location.27November2016) and Table 11 (SEQ ID NOs: 1-6524) (ALL_rRNA_seqs.1000GenomesProject@atleast10RPM.Population-Sex-Location.27November2016_more20percent) summarize the findings. The Excel file shows for each of the analyzed rRNAs the following information:

which rRFs are made from each rRNA sequence
where each rRF is located in the (padded) analyzed sequence
where each rRF is located within the corresponding rRNA sequence
the strand of the rRNA sequence from which each rRF is produced
the length of each rRF
the sequence of each rRF
the portion of the available datasets in which the rRF is present at an abundance of at least 10 RPM: specifically, the last portion for the following groups of datasets is reported herein below: CEU MALE, FIN MALE, GBR MALE, TSI MALE, YRI MALE, CEU FEMALE, FIN FEMALE, GBR FEMALE, TSI FEMALE, and YRI FEMALE.

For example a line that reads as illustrated in Table 1 below, is interpreted as follows:

Table 1.

the fragment is present at an abundance ≥10 RPM in 37.3% of the analyzed datasets from Males from the CEU population group 73.0% of the analyzed datasets from Males from the FIN population group 66.7% of the analyzed datasets from Males from the GBR population group 76.4% of the analyzed datasets from Males from the TSI population group 32.5% of the analyzed datasets from Males from the YRI population group 24.4% of the analyzed datasets from Females from the CEU population group 79.7% of the analyzed datasets from Females from the FIN population group 56.0% of the analyzed datasets from Females from the GBR population group 72.7% of the analyzed datasets from Females from the TSI population group 38.2% of the analyzed datasets from Females from the YRI population group.

Of note is the relative dearth (a ~1:2 ratio) of this fragment in CEU and YRI Males (light grey highlight) compared to FIN and TSI Males (dark grey highlight). An analogous comment can be made for CEU and YRI Females (light grey highlight) compared to FIN and TSI Females (dark grey highlight) as well.

Other Comments and Statistics:

a) Cells in the above mentioned tables have been color-coded (different intensity range in grey scale) to make it easier to visually identify groupings based on rRF lengths, in which population-sex combination is a fragment frequent, etc.

b) Table 11 (labeled "in ≥20% of Pop-Sex-group sets") lists the subset of rRFs that are present in at least 20% of the datasets in at least one of the shown combinations of Population-group+Sex.

c) There are 21991 distinct rRFs that appear with a normalized abundance of ≥10 RPM in at least one of the analyzed datasets (T: 553 arise from the 5S rRNA, 1734 arise from the 12S rRNA, 3055 arise from the 16S rRNA, and 16649 arise from the 45S rRNA.

TABLE 1

| | |
|---|---|
| 37.3% | CEU MALE |
| 73.0% | FIN MALE |
| 66.7% | GBR MALE |
| 76.4% | TSI MALE |
| 32.5% | YRI MALE |
| 24.4% | CEU FEMALE |
| 79.7% | FIN FEMALE |
| 56.0% | GBR FEMALE |
| 72.7% | TSI FEMALE |
| 38.2% | YRI FEMALE |
| Hg38\| 05S_plus 10_biPad | rRNA that was processed and contains the fragment (all rRNA sequences that we processed were padded) |
| + | Strand |
| 3 | From coordinate (local coordinate in actual rRNA) |
| 32 | To coordinate (local coordinate in actual rRNA) |
| 30 | Length fragment |
| CTACGGGCCATACCACCCTGAACGCGCCCGA | Sequences of fragment |
| 13 | From coordinate (local coordinate in padded rRNA) |
| 42 | to coordinate (local coordinate in padded rRNA) | there is a fragment that arises from the 5S rRNA and whose sequence is CTACGGCCATACCACCCTGAACGCGCCCGA (SEQ ID NO: 15)
the fragment's length is 30 nts;
the fragment spans locations 3 through 32 inclusive of the archetype 5S rRNA;

d) There are 6524 distinct rRFs that appear with a normalized abundance of ≥10 RPM in at least 20% of the datasets of a given Population-group+Sex combination: 212 arise from the 5S rRNA, 611 arise from the 12S rRNA, 1043 arise from the 16S rRNA, and 4658 arise from the 45S rRNA.

Individual rRFs are Present/Absent in a Sex-Specific Manner

As an example, the rRF with sequence AGGTGAAAT-TCTTGGAC (SEQ ID NO: 2485), from the 18S rRNA that spans locations 4611 through 4627 inclusive of the 45S pre-rRNA, is noted. This particular rRF is more frequent in females from the CEU Population-group compared to males from the same group at a ratio of nearly 2:1. This skewed representation is absent from the males:females comparisons in the remaining four Population-groups.

As a second example, the rRF with sequence GAAAGTCGGAGGTTCGAAGACGATC (SEQ ID NO: 2627), from the 18S rRNA that spans locations 4687 through 4711 inclusive of the 45S pre-rRNA, is noted. This particular rRF is more frequent in males from the CEU Population-group compared to females from the same group at a ratio of nearly 2.5:1. This skewed representation is also present in the GBR (2:1) and TSI (2:1) Population-groups but absent from the males:females comparisons in the remaining two Population-groups.

As a third example, the rRF with sequence AACTAGTTACGCGACC (SEQ ID NO: 3212), from the 18S rRNA that spans locations 5055 through 5070 inclusive of the 45S pre-rRNA, is noted. This particular rRF is more frequent in females from the CEU Population-group compared to males from the same group at a ratio of nearly 3:1. This skewed representation is absent from the males:females comparisons in the remaining four Population-groups.

Individual rRFs are Present/Absent in a Population-Group-Specific Manner

As an example, the rRF with sequence CCGCCCTACCCCCCCGGCCCCG (SEQ ID NO: 5336), from the 28S rRNA that spans locations 11359 through 11380 inclusive of the 45S pre-rRNA, is noted. This particular rRF is present in at least ½ of all datasets from the CEU Population-group with an abundance of ≥10 RPM whereas it is virtually absent from the remaining Wh (FIN, GBR, TSI) and B/Aa (YRI) Population-groups. This observation is true for both males and females.

Individual rRFs are Present/Absent in a Race-Specific Manner

As an example, the rRF with sequence AAACGCTTAGCCTAGCCACACCC (SEQ ID NO: 233), from the 12S rRNA where it spans locations 135 through 137 inclusive, is noted. This particular rRF is present in at least ⅔rds of all datasets involving one of the four Wh Population-groups (CEU, FIN, GBR, TSI) with an abundance of ≥10 RPM whereas it is virtually absent from the YRI Population-group. This observation is true for both males and females.

As a second example, the rRF with sequence CGGGCCGCCGGTGAAATACCACTAC (SEQ ID NO: 5844), from the 28S rRNA that spans locations 11954 through 11978 inclusive of the 45S pre-rRNA, is noted. This particular rRF is present in virtually all datasets from the B/Aa Population-group (YRI) with an abundance of ≥10 RPM whereas it is present in ~⅓rd or fewer of the datasets from the four Wh Population-groups (CEU, FIN, GBR, TSI). This observation is true for both males and females.

Combination of rRFs are Present/Absent in a Sex-Specific, Population-Group-Specific, or Race-Specific Manner From the above description, it should be understood that it is not only those rRFs that are present or absent from specific groups of individuals are useful. In fact, even if a collection of multiple rRFs is present in all e.g. Population-group+Sex combinations the relative abundance of these rRFs could still change in a manner that changes from each Population-group+Sex combination to the next, and thus can be used to determine a subject's e.g. Population-group+Sex combination. To examine this possibility, all rRFs that were identified in these 492 datasets were analyzed using the Significance Analysis of Microarrays (SAM) method variant that is applicable to RNA-seq datasets. For this analysis, the very strict False Discovery Rate (FDR) threshold of 0.0 was enforced. The following combinations were examined:

Sex-Comparison—Single Population-Group and, Thus, Single Race-Group
- Males vs Females from the CEU Population-group
- Males vs Females from the FIN Population-group
- Males vs Females from the GBR Population-group
- Males vs Females from the TSI Population-group
- Males vs Females from the YRI Population-group Population Group-Comparison—Both Sexes—Single Race-Group
- All CEU datasets (males and females) vs All remaining datasets (males and females) of the same race Race-Comparison—Single Sex-Group
- Males from the CEU Population-group (Wh) vs Males from the YRI Population-group (B/Aa)
- Females from the CEU Population-group (Wh) vs Females from the YRI Population-group (B/Aa)

In all of the above comparisons, specific combinations of rRFs were found that could clearly distinguish between the datasets that were being compared each time. Combinations of rRFs were found that were more abundant
- in females from a given Population-group;
- in males from a given Population-group;
- in a given Population-group vs. other Population-groups of the same Race-group;
- in males from a given Race-group; or,
- in females from a given Race-group.

In summary, it was found that these signatures comprised various combinations of 15072 unique rRFs: of these, 10832 appear only in one signature, i.e. they are relevant for exactly one of the above comparisons—this suggests an exquisite degree of context-specific expression. Clearly, many more unique rRFs are expected to be identified if signatures are sought for other combinations of datasets. Table 2 below lists the numbers of distinct rRFs that emerge from each comparison and the filenames of the files included in the CD submitted with the Provisional Patent Application No. 62/498,368, filed Dec. 22, 2016. Files whose filename ends in "NegatSign.txt" list rRFs whose abundance decreases in the second of the two groups being compared. Files whose filename ends in "PositSign.txt" list rRFs whose abundance increases in the second of the two groups being compared.

Table 2.

TABLE 2

| Number of rRFs in signature | Filename | Comparison |
|---|---|---|
| 38 | SAM.1000GenomesProject.Men_Women.CEU@FDR=0.0_PositSign.txt | Males vs Females-CEU Population-group (Table 30) |
| 60 | SAM.1000GenomesProject.Men_Women.FIN@FDR=0.0_PositSign.txt | Males vs Females-FIN Population-group (Table 32) |

TABLE 2-continued

| Number of rRFs in signature | Filename | Comparison |
|---|---|---|
| 29 | SAM.1000GenomesProject.Men_Women.GBR@FDR=0.0_PositSign.txt | Males vs Females-GBR Population-group (Table 34) |
| 11576 | SAM.1000GenomesProject.Men_Women.TSI@FDR=0.0_NegatSign.txt | Males vs Females-TSI Population-group (Table 35) |
| 46 | SAM.1000GenomesProject.Men_Women.YRI@FDR=0.0_PositSign.txt | Males vs Females-YRI Population-group (Table 38) |
| 1202 | SAM.1000GenomesProject.CEU_vs_FIN_GBR_TSI@FDR=0.0_NegatSign.txt | CEU (males and females) vs the remaining three Population-groups of the same race (FIN, GBR, TSI) (Table 25) |
| 144 | SAM.1000GenomesProject.CEU_vs_FIN_GBR_TSI@FDR=0.0_PositSign.txt | CEU (males and females) vs the remaining three Population-groups of the same race (FIN, GBR, TSI) (Table 26) |
| 2939 | SAM.1000GenomesProject.Men.CEU_YRI@FDR=0.0_NegatSign.txt | Males from the CEU Population-group (White) vs Males from the YRI Population-group (Black) (Table 27) |
| 3 | SAM.1000GenomesProject.Men.CEU_YRI@FDR=0.0_PositSign.txt | Males from the CEU Population-group (White) vs Males from the YRI Population-group (Black) (Table 28) |
| 4710 | SAM.1000GenomesProject.Women.CEU_YRI@FDR=0.0_NegatSign.txt | Females from the CEU Population-group (White) vs Females from the YRI Population-group (Black) (Table 39) |
| 34 | SAM.1000GenomesProject.Women.CEU_YRI@FDR=0.0_PositSign.txt | Females from the CEU Population-group (White) vs Females from the YRI Population-group (Black) (Table 40) |

Example 4: Results from the Cancer Genome Atlas TCGA 10274 datasets from the TCGA project were analyzed. The datasets represent 32 cancer types. The 32 cancers that were analyzed, together with their abbreviations, are listed below herein:

ACC-Adrenocortical carcinoma, BLCA-Bladder Urothelial Carcinoma, BRCA-Breast invasive carcinoma, CESC-Cervical squamous cell carcinoma and endocervical adenocarcinoma, CHOL-Cholangiocarcinoma, COAD-Colon adenocarcinoma, DLBC-Lymphoid Neoplasm Diffuse Large B-cell Lymphoma, ESCA-Esophageal carcinoma, HNSC-Head and Neck squamous cell carcinoma, KICH-Kidney Chromophobe, KIRC-Kidney renal clear cell carcinoma, KIRP-Kidney renal papillary cell carcinoma, LAML-Acute Myeloid Leukemia, LGG-Brain Lower Grade Glioma, LIHC-Liver hepatocellular carcinoma, LUAD-Lung adenocarcinoma, LUSC-Lung squamous cell carcinoma, MESO-Mesothelioma, OV-Ovarian serous cystadenocarcinoma, PAAD-Pancreatic adenocarcinoma, PCPG-Pheochromocytoma and Paraganglioma, PRAD-Prostate adenocarcinoma, READ-Rectum adenocarcinoma, SARC-Sarcoma, SKCM-Skin Cutaneous Melanoma, STAD-Stomach adenocarcinoma, TGCT-Testicular Germ Cell Tumors, THCA-Thyroid carcinoma, THYM-Thymoma, UCEC-Uterine Corpus Endometrial Carcinoma, UCS-Uterine Carcinosarcoma, and UVM-Uveal Melanoma. In all, 79 ACC, 386 BLCA, 1176 BRCA, 304 CESC, 44 CHOL, 395 COAD, 46 DLBC, 196 ESCA, 528 HNSC, 83 KICH, 519 KIRC, 291 KIRP, 191 LAML, 514 LGG, 403 LIHC, 480 LUAD, 461 LUSC, 82 MESO, 461 OV, 157 PAAD, 186 PCPG, 527 PRAD, 146 READ, 248 SARC, 410 SKCM, 479 STAD, 138 TGCT, 547 THCA, 124 THYM, 536 UCEC, 57 UCS, and 80 UVM datasets were analyzed.

In the CD submitted with the Provisional Patent Application No. 62/498,368, (filed Dec. 22, 2016) Table 19 (ALL_rRNA_seqs.TCGAProject@atleast10 RPM.CancerType-Location.27November2016), Table 20 (ALL_rRNA_seqs.TCGAProject@atleast10RPM.CancerType-Location.27November2016 more20percent) and Table 21 (ALL_rRNA_seqs.TCGAProject@atleast10RPM.CancerType-Location.27November2016_more20percentResort) summarize the findings. These tables show for each of the analyzed rRNAs (SEQ ID NOs: 28516-56828) the following information:

which rRFs are made from each rRNA sequence
where each rRF is located in the (padded) analyzed sequence
where each rRF is located within the corresponding rRNA sequence
the strand of the rRNA sequence from which each rRF is produced
the length of each rRF
the sequence of each rRF
the portion of the available datasets from each cancer type (out of the 32 cancer types mentioned above herein) in which the rRF is present at an abundance of at least 10 RPM: specifically. The 32 cancer types are listed in alphabetical order using their above-mentioned abbreviation.

For example a line that reads as illustrated in Table 3 below, is interpreted as follows:

Table 3.

TABLE 3

| | |
|---|---|
| 2.5% | ACC |
| 2.1% | BLCA |

TABLE 3-continued

| | |
|---|---|
| 0.9% | BRCA |
| 2.6% | CESC |
| | CHOL |
| 2.8% | COAD |
| 2.2% | DLBC |
| 1.0% | ESCA |
| 2.5% | HNSC |
| | KICH |
| 2.3% | KIRC |
| | KIRP |
| 1.6% | LAML |
| 0.2% | LGG |
| 1.0% | LIHC |
| 0.6% | LUAD |
| 7.6% | LUSC |
| | MESO |
| 79.0% | OV |
| | PAAD |
| | PCPG |
| 0.2% | PRAD |
| 2.1% | READ |
| 0.4% | SARC |
| 2.7% | SKCM |
| 1.0% | STAD |
| 1.4% | TGCT |
| | THCA |
| | THYM |
| 2.2% | UCEC |
| 5.3% | UCS |
| | UVM |
| Hg38\| 458_plus 10000_biPad | rRNA that was processed and contains the fragment (all rRNA sequences that we processed were padded) |
| + | Strand |
| 10815 | from coordinate (local coordinate in actual rRNA) |
| 10837 | to coordinate (local coordinate in actual rRNA) |
| 23 | length of fragment |
| TCTAAGGGCTGGGTCGGTCGGGC | Sequences of fragment |
| 20815 | from coordinate (local coordinate in padded rRNA) |
| 20837 | to coordinate (local coordinate in padded rRNA) | there is a fragment that arises from the 28S rRNA (45S pre-rRNA) and whose sequence is TCTAAGGGCTGGGTCGGTCGGGC (SEQ ID NO: 30186)

the fragment's length is 23 nts;

the fragment spans locations 10815 through 10837 inclusive of the 45S pre-rRNA sequence;

the fragment is present at an abundance ≥10 RPM in 79% (364 out of 461) of the OV-Ovarian serous cystadenocarcinoma samples analyzed (illustrated by a dark color of the cell);

the fragment is absent from virtually all other cancer types as indicated by the shown percentages (illustrated by a light/white color of the cell).

Other Results and Statistics:

a) Cells in the above-mentioned table have been color-coded (different intensity range in grey scale) to make it easier to visually identify groupings based on rRF lengths, in which cancer type is a fragment frequent etc.

b) Table 20 (in the Provisional Patent Application No. 62/498,368; labeled "in ≥20% of Cancer sets") lists the subset of rRFs that are present in at least 20% of the datasets in at least one of the 32 cancer types. The above OV-specific rRF is a characteristic such example.

c) Table 21 (in the Provisional Patent Application No. 62/498,368; labeled "in ≥20% of Cancer sets-Resorted") lists the same collection of rRFs as Table 20 but sorted in an order that highlights rRFs that are specific for various combinations of cancer types.

d) There are 25712 distinct rRFs that appear with a normalized abundance of ≥10 RPM in at least one of the analyzed datasets (SEQ ID NOs: 31117-56828; Table 19 in the Provisional Patent Application No. 62/498,368): 741 arise from the 5S rRNA, 553 arise from the 12S rRNA, 1115 arise from the 16S rRNA, and 23303 arise from the 45S rRNA.

e) There are 2601 distinct rRFs that appear with a normalized abundance of ≥10 RPM in at least 20% of the datasets of a given cancer type (one of 32) (SEQ ID NOs: 28516-31116; Table 20, in the Provisional Patent Application No. 62/498,368): 203 arise from the 5S rRNA, 4 arise from the 12S rRNA, 24 arise from the 16S rRNA, and 2370 arise from the 45S rRNA.

Individual rRFs are Present/Absent in a Cancer-Type-Specific Manner

As an example, the rRF with sequence GGCGCTCTCGCAGACCCGACGC (SEQ ID NO: 29799), from the 28S rRNA that spans locations 9612 through 9633 inclusive of the 45S pre-rRNA, is noted. This particular rRF is present at an abundance ≥10 RPM in 73.3% (140 out of 191) of the LAML-Acute Myeloid Leukemia samples analyzed yet absent from virtually all other TCGA cancer samples.

As a second example, the rRF with sequence CTTCGT-GATCGATGTGGTGACGT (SEQ ID NO: 28751), which spans locations 425 through 447 inclusive of the 45S pre-rRNA, is noted. This particular rRF is present at an abundance ≥10 RPM in 90.6% (125 out of 138) of the TGCT-Testicular Germ Cell Tumors samples analyzed yet absent from nearly all other TCGA cancer samples. NOTE: this last rRF deserves special mention because it arises from a portion of the 45S pre-RNA sequence that does not encode an rRNA. This suggests that in specific settings even regions of 45S pre-RNA that do not encode for one of 18S, 5.8S, or 28S could be differentially abundant.

As a third example, the rRF with sequence CGCTAAAC-CATTCGTAGACGACCTGCTTC (SEQ ID NO: 31054), from the 28S rRNA that spans locations 12282 through 12910 inclusive of the 45S pre-rRNA, is noted. This particular rRF is present at an abundance ≥10 RPM in 79.0% (364 out of 461) the OV-Ovarian serous cystadenocarcinoma samples analyzed, 48.4% (60 out of 124) of the THYM-Thymoma samples analyzed, 42.2% (173 out of 410) of the SKCM-Skin Cutaneous Melanoma samples analyzed, and in 98.8% (79 out of 80) of the UVM-Uveal Melanoma samples analyzed. The rRF is absent from most of the other TCGA cancer samples.

Combinations of rRFs are Present/Absent in a Cancer-Type-Specific Manner

From the above description, it should not be understood that only those rRFs that are present or absent from specific groups of cancer types are useful. In fact, even if a collection of multiple rRFs is present in all 32 cancer types the relative abundance of these rRFs could still change in a manner that changes from each cancer type to the next. One characteristic example is the group of 15 rRFs that arise from the 5' end of the 28S rRNA and (positions 7925 to 7954). These 15 rRFs are present at an abundance of ≥10 RPM in nearly every single one of the 10274 TCGA samples analyzed herein, and, as a result, these rRFs may carry no information. This idea is supported by the findings of specific examples of Cancer-type-specific signatures: rRFs from this specific region as well as rRFs from the remaining five rRNAs participate in the formation of Cancer-type-specific signatures.

To support this statement, all rRFs that were identified in these 10274 datasets were analyzed using the SAM method variant that is applicable to RNA-seq datasets (see above). For this analysis, the very strict FDR threshold of 0.0 was enforced.

The following combinations were examined:

Cancer-Type-Specific
- all samples from BRCA-Breast Invasive Carcinoma vs all other cancer types
- all samples from PAAD-Pancreatic adenocarcinoma vs all other cancer types
- all samples from PRAD-Prostate adenocarcinoma vs all other cancer types In all of the above comparisons, specific combinations of rRFs were found that could clearly distinguish between the datasets that were being compared each time. As already stated, the resulting signatures included rRFs that are present at an abundance of ≥10 RPM in most of the 10274 datasets.

In all, it was found that these signatures comprised various combinations of 2254 unique rRFs: of these, 1506 appear only in one signature, i.e. they are relevant for exactly one of the above Cancer-type comparisons—this suggests an exquisite degree of context-specific expression. Clearly, many more unique rRFs are expected to be identified if signatures are sought for other combinations of datasets. The below Table 4 lists the numbers of distinct rRFs that emerge from each comparison and the filename of the file that is attached. Files whose filename ends in "NegatSign.txt" list rRFs whose abundance decreases in the second of the two groups being compared. Files whose filename ends in "PositSign.txt" list rRFs whose abundance increases in the second of the two groups being compared (These files were included in the CD submitted with the Provisional Patent Application No. 62/498,368, filed Dec. 22, 2016).

Table 4.

TABLE 4

| Number of rRFs in signature | Filename | Comparison |
| --- | --- | --- |
| 371 | SAM.TCGAProject.BRCA_vs_therest@FDR=0.0_NegatSign.txt | Breast cancer datasets vs Datasets from all remaining cancer types (Table 46) |
| 932 | SAM.TCGAProject.BRCA_vs_therest@FDR=0.0_PositSign.txt | Breast cancer datasets vs Datasets from all remaining cancer types (Table 47) |
| 64 | SAM.TCGAProject.PAAD_vs_therest@FDR=0.0_NegatSign.txt | Pancreatic cancer datasets vs Datasets from all remaining cancer types (Table 48) |
| 202 | SAM.TCGAProject.PAAD_vs_therest@FDR=0.0_PositSign.txt | Pancreatic cancer datasets vs Datasets from all remaining cancer types (Table 49) |
| 1183 | SAM.TCGAProject.PRAD_vs_therest@FDR=0.0_NegatSign.txt | Prostate cancer datasets vs Datasets from all remaining cancer types (Table 50) |
| 328 | SAM.TCGAProject.PRAD_vs_therest@FDR=0.0_PositSign.txt | Prostate cancer datasets vs Datasets from all remaining cancer types (Table 51) |

Example 5: Triple Negative Breast Cancer 21 normal breast and 18 TNBC samples that were obtained independently as part of ongoing projects were analyzed. One of the normal samples was sequenced twice and, thus, there are 22 normal datasets. In all, 40 datasets were analyzed.

In the CD submitted with the Provisional Patent Application No. 62/498,368, (filed Dec. 22, 2016), Table 15 (SEQ ID NOs: 58257-61447) (ALL_rRNA_seqs.NormalBreast_and_TNBC@atleast10RPM.Location.27November-2016_All) and Table 16 (SEQ ID NOs: 56829-58256) (ALL_rRNA_seqs.NormalBreast_and_TNBC@atleast10RPM.Location.27November2016_more20percent) summarize the findings. For each of the analyzed rRNAs the following information is listed:

- which rRFs are made from each rRNA sequence
- where each rRF is located in the (padded) analyzed sequence
- where each rRF is located within the corresponding rRNA sequence
- the strand of the rRNA sequence from which each rRF is produced
- the length of each rRF
- the sequence of each rRF
- the portion of the available datasets from each cancer type in which the rRF is present at an abundance of at least 10 RPM: specifically, this question was addressed for each of the 32 cancer types mentioned above. The 32 cancer types are listed in alphabetical order using their above-mentioned abbreviation.

For example a line that reads as illustrated in Table 5 below, is interpreted as follows:
Table 5.

TABLE 5

| | | |
|---|---|---|
| 54.5% | portion of analyzed datasets (22 normal and 18 TNBC) that contain the respective fragment | Normal Breast |
| 22.2% | | Triple Negative Breast Cancer (TNBC) |
| Hg38\| 05S_plus 10_biPad | | rRNA that was processed and contains the fragment(all rRNA sequences that we processed were padded) |
| + | | Strand |
| 1 | | From coordinate (local coordinate in actual rRNA) |
| 24 | | To coordinate (local coordinate in actual rRNA) |
| 24 | | Length of fragment |
| GTCTACGGCCATACCACCCT-GAAC | | sequences of fragment |
| 11 | | from coordinate (local coordinate in padded rRNA) |
| 34 | | To coordinate (local coordinate in padded rRNA) | there is a fragment that arises from the 5S rRNA and whose sequence is GTGTACGGCCATACCACCCT-GAAC (SEQ ID NO: 56829);
the fragment's length is 24 nts;
the fragment spans locations 1 through 24 inclusive of the 5S pre-rRNA sequence that was analyzed;
the fragment is present at an abundance ≥10 RPM in 54.5% (12 out of 22) of the normal breast datasets;
the fragment is present at an abundance ≥10 RPM in 22.2% (4 out of 18) of the TNBC datasets.

Other Results and Statistics:
a) Cells in the above-mentioned table have been color-coded to make it easier to visually identify groupings based on rRF lengths, in which tissue-state (normal vs TNBC) is a fragment frequent etc.
b) Table 16 (labeled "in ≥20% of Tissue-state sets") lists the subset of rRFs that are present in at least 20% of either the normal or of the TNBC datasets.
c) There are 3191 distinct rRFs (Table 15) that appear with a normalized abundance of ≥10 RPM in at least one of the analyzed datasets: 164 arise from the 5S rRNA, 13 arise from the 12S rRNA, 49 arise from the 16S rRNA, and 2965 arise from the 45S rRNA.
d) There are 1428 distinct rRFs that appear with a normalized abundance of ≥10 RPM in at least 20% of the datasets of a tissue-state (normal or TNBC): 119 arise from the 5S rRNA, 4 arise from the 12S rRNA, 22 arise from the 16S rRNA, and 1283 arise from the 45S rRNA.

Combinations of rRFs are Present/Absent in a Tissue-State-Specific Manner

Similarly to what was done with the previous collections, all rRFs that were identified in these 40 datasets were analyzed using the SAM method variant that is applicable to RNA-seq datasets (see above). For this analysis, the very strict FDR threshold of 0.0 was enforced. Only the Normal breast vs TNBC combination was examined and revealed rRF signatures that were characteristic of tissue state and comprised various combinations of 75 unique rRFs. The below Table 6 lists the numbers of distinct rRFs that emerge from this comparison and the filename of the file that is attached. Files whose filename ends in "NegatSign.txt" list rRFs whose abundance decreases in the second of the two groups being compared. Files whose filename ends in "PositSign.txt" list rRFs whose abundance increases in the second of the two groups being compared (These files were included in the CD submitted with the Provisional Patent Application No. 62/498,368, filed Dec. 22, 2016).
Table 6.

TABLE 6

| # of rRFs in signature | Filename | Comparison |
|---|---|---|
| 10 | SAM.NormalBreast_and_TNBC@FDR=0.0_NegatSign.txt | Normal Breast datasets vs TNBC datasets (Table 44) |
| 65 | SAM.NormalBreast_and_TNBC@FDR=0.0_PositSign.txt | Normal Breast datasets vs TNBC datasets (Table 45) |

Example 6: Chronic Lymphocytic Leukemia (CLL)

5 normal B-cell-enriched samples and 5 samples from patients with CLL were analyzed. These samples were obtained independently as part of ongoing projects and were sequenced herein.

Only rRFs that were supported by 1000 or more reads in at least one of the analyzed datasets were kept. In the CD submitted with the Provisional Patent Application No. 62/498,368, (filed Dec. 22, 2016) Table 13 (ALL_rRNA_seqs.NormalBcellsandCLLSamples@atleast1000reads.Location. 27November2016) summarizes the findings. For each of the analyzed rRNAs the following information is listed:
- which rRFs are made from each rRNA sequence
- where each rRF is located in the (padded) analyzed sequence
- where each rRF is located within the corresponding rRNA sequence
- the strand of the rRNA sequence from which each rRF is produced
- the length of each rRF
- the sequence of each rRF The semantics and color coding are the same as in the previous tables.

Other Comments and Statistics:

There are 1270 distinct rRFs that appear with an abundance of ≥1000 reads in at least one of the analyzed datasets: 25 arise from the 5S rRNA, 11 arise from the 12S rRNA, 53 arise from the 16S rRNA, and 1181 arise from the 45S rRNA.

Combinations of rRFs are Present/Absent in a Tissue-State-Specific Manner

Similarly to what was done with the previous collections, all rRFs that were identified in these 10 datasets were analyzed using the SAM method variant that is applicable to RNA-seq datasets (see above). For this analysis, the very strict FDR threshold of 0.0 was enforced. Only the Normal B-cells vs CLL combination was examined and revealed rRF signatures that were characteristic of tissue state and comprised various combinations of 68 unique rRFs. The below Table 7 lists the numbers of distinct rRFs that emerge from this comparison and the filename of the file that is attached.

Files whose filename ends in "NegatSign.txt" list rRFs whose abundance decreases in the second of the two groups being compared. Files whose filename ends in "PositSign.txt" list rRFs whose abundance increases in the second of the two groups being compared (These files were included in the CD submitted with the Provisional Patent Application No. 62/498,368, filed Dec. 22, 2016).
Table 7.

TABLE 7

| # of rRFs in signature | Filename | Comparison |
|---|---|---|
| 65 | SAM.NormalBcells_and_CLL@FDR=0.0_NegatSign.txt | Normal B-cell datasets vs CLL datasets (Table 41) |
| 3 | SAM.NormalBcells_and_CLL@FDR=0.0_PositSign.txt | Normal B-cell datasets vs CLL datasets (Table 42) |

Example 7: Brain 2 normal brain samples and 2 samples from patients with Alzheimer's were analyzed. These samples were obtained independently as part of ongoing projects and were sequenced herein.

Only rRFs that were supported by 1000 or more reads in at least one of the analyzed datasets were kept. In the CD submitted with the Provisional Patent Application No. 62/498,368, (filed Dec. 22, 2016) Table 12 (SEQ ID NOs: 62718-63036) (ALL_rRNA_seqs.BrainSamples@atleast-1000reads.Location.27November2016) summarizes the findings. For each of the analyzed rRNAs the following information is listed:
- which rRFs are made from each rRNA sequence;
- where each rRF is located in the (padded) analyzed sequence;
- where each rRF is located within the corresponding rRNA sequence;
- the strand of the rRNA sequence from which each rRF is produced;
- the length of each rRF;
- the sequence of each rRF The semantics and color coding are the same as in the previous tables.

Other Comments and Statistics:

There are 319 distinct rRFs (Table 12) that appear with an abundance of ≥1000 reads in at least one of the analyzed datasets: 4 arise from the 5S rRNA, 12 arise from the 12S rRNA, 27 arise from the 16S rRNA, and 276 arise from the 45S rRNA.

Example 8: Platelets 10 platelet samples from healthy individuals, all of them males, were analyzed. These samples were obtained independently as part of ongoing projects and were sequenced herein.

Only rRFs that were supported by 1000 or more reads in at least one of the analyzed datasets were kept. In the CD submitted with the Provisional Patent Application No. 62/498,368, (filed Dec. 22, 2016) Table 17 (SEQ ID NOs: 63037-63115) (ALL_rRNA_seqs.PlateletSamples@atleast-1000reads.Location) summarizes the findings. For each of the analyzed rRNAs the following information is listed:
- which rRFs are made from each rRNA sequence
- where each rRF is located in the (padded) analyzed sequence
- where each rRF is located within the corresponding rRNA sequence
- the strand of the rRNA sequence from which each rRF is produced
- the length of each rRF
- the sequence of each rRF The semantics and color coding are the same as in the previous tables.

Other Comments and Statistics:

There are 79 distinct rRFs that appear with an abundance of ≥1000 reads in at least one of the analyzed datasets: 3 arise from the 5S rRNA, 1 arise from the 12S rRNA, 30 arise from the 16S rRNA, and 45 arise from the 45S rRNA.

Example 9: Prostate 5 normal prostate and 5 prostate cancer samples were analyzed. These samples were obtained independently as part of ongoing projects and were sequenced herein.

Only rRFs that were supported by 1000 or more reads in at least one of the analyzed datasets were kept. In the CD submitted with the Provisional Patent Application No. 62/498,368, (filed Dec. 22, 2016) Table 18 (ALL_rRNA_seqs.ProstateSamplesgatleast1000reads.Location) summarizes the findings. For each of the analyzed rRNAs the following information is listed:
- which rRFs are made from each rRNA sequence
- where each rRF is located in the (padded) analyzed sequence
- where each rRF is located within the corresponding rRNA sequence
- the strand of the rRNA sequence from which each rRF is produced
- the length of each rRF
- the sequence of each rRF The semantics and color coding are the same as in the previous tables.

Other Comments and Statistics:

There are 499 distinct rRFs that appear with an abundance of ≥1000 reads in at least one of the analyzed datasets: 3 arise from the 5S rRNA, 13 arise from the 12S rRNA, 32 arise from the 16S rRNA, and 451 arise from the 45S rRNA.

Example 10: Primary Open Angle Glaucoma Datasets in rRNA

The following collection was also analyzed
six datasets generated from the deep sequencing of RNA from B-cells of six individuals. The composition of the group had as follows:
a) two B/Aa women with primary open angle glaucoma (POAG)
b) two Wh women with POAG
c) one healthy B/Aa woman (used as control)
d) one healthy Wh woman (used as control)

Combinations of rRFs are Present/Absent in a Tissue-State-Specific Manner

The analysis of the above datasets made evident that all 6 rRNAs give rise to multiple fragments. In the CD submitted with the Provisional Patent Application No. 62/498,368, (filed Dec. 22, 2016) Table 14 (SEQ ID NOs: 63615-65473) ALL_rRNA_seqs.NormalBcells_and_POAG@atleast10-RPM.10December2016 summarizes some of the findings. The table shows for each of the analyzed rRNAs the following information:
- which rRFs are made from each rRNA sequence
- where each rRF is located in the (padded) analyzed sequence
- where each rRF is located within the corresponding rRNA sequence
- the strand of the rRNA sequence from which each rRF is produced
- the length of each rRF
- the sequence of each rRF
- how many of the datasets in which the rRF is present at an abundance of at least 10 RPM: specifically, this question was addressed for the following groups of datasets: B/Aa Open Angle Glaucoma Patients (Female), B/Aa Control (Female) Wh Open Angle Glaucoma Patients (Female), Wh Control (Female), where "B/Aa" is an abbreviation for "Black/African American" and "Wh" for "White."

For example a line that reads as illustrated in Table 8 below, is interpreted as follows:

Table 8.

TABLE 8

| B/Aa Open Angle Glaucoma Patients (Female) | B/Aa Control (Female) | Wh Open Angle Glaucoma Patients (Female) | Wh Control (Female) | rRNA that was processed and contains the fragment (all rRNA sequences that we processed were padded) | | strand |
|---|---|---|---|---|---|---|
| 2 | 0 | 2 | 0 | hg38\| 16S _plus10_BiPaddings | | + |
| from coor- dinate (local coor- dinate in actual rRNA) | to coor- dinate (local coor- dinate in actual rRNA) | length of frag- ment | | sequence of fragment | from coor- dinate (local coor- dinate in padded rRNA) | to coor- dinate (local coor- dinate in padded rRNA) |
| 496 | 520 | 25 | | CATAGTAGGCCTAAAAGCAGCCACC | 506 | 530 | there is a fragment that arises from the 16S rRNA and whose sequence is CATAGTAGGCCTAAAAGCA-GCCACC (SEQ ID NO: 64360)

the fragment's length is 25 nts the fragment spans locations 496 through 520 inclusive of the archetype 16S rRNA the fragment is present at an abundance ≥10 RPM in all four patients but in none of the controls.

Other Results and Statistics:

a) In the above-mentioned Excel file cells have been color-coded to make it easier to visually identify groupings based on rRF lengths, in which combination of samples is a fragment present, etc.

b) There are 1859 distinct rRFs (Table 14) that appear with a normalized abundance of ≥10 RPM in at least one of the analyzed datasets: 14 arise from the 5S rRNA, 545 arise from the 12S rRNA, 793 arise from the 16S rRNA, and 507 arise from the 45S rRNA.

c) There are 1205 rRFs (Table 22) that appear with a normalized abundance of ≥10 RPM exclusively in POAG samples but are not present in the control samples: 1028 of these 1205, or 85.3%, arise from mitochondrial rRNAs. This is particularly notable considering that mitochondrial processes have been linked to POAG.

Combinations of rRFs are Present/Absent in a Condition-Specific Manner a) When the 1205 rRFs that are exclusive to the POAG samples were compared with the 21,961 rRFs that appear with the same level of abundance (i.e., 10 RPM) in the 492 datasets generated from the B-cells of healthy individuals from the 1000 Genomes Project collection (see above herein) only 459 were found in common. This strongly indicates that the same type of cell (in this case a B-cell) produces rRFs in the POAG state that would not be produced by this cell in the "normal" state.

b) When the 1205 rRFs that are exclusive to the POAG samples were compared with the 590 rRFs that appear with the same level of abundance (i.e., 10 RPM) in the 5 datasets generated from the blood of the CLL patient collection (see above herein) only 76 were found in common. This strongly indicates, again, that the same type of cell (in this case a B-cell) produces rRFs in the POAG disease state that would not be produced by this cell in the CLL disease state.

c) When the 1205 rRFs that are exclusive to the POAG samples were compared with the 41085 rRFs that appear with the same level of abundance (i.e., 10 RPM)

in one or more of the 10274 datasets from TCGA (see above herein)

in one or more of the 492 datasets from the 1000 Genomes Project (see above herein)

in either the 5 control datasets or the 5 CLL datasets (see above herein)

It was found that 676 of these rRFs are unique to the POAG samples. This strongly indicates that these rRFs are likely unique to the POAG disease state as they do not seem to be produced by other cell types, normal and diseased. Of these 676 rRFs, 338 are present exclusively in the B/Aa POAG patients, 121 are present exclusively in the Wh POAG patients, and 217 are present in both the B/Aa and Wh POAG patients. This strongly indicates that there are many more rRFs that are dysregulated solely in the B/Aa POAG patients and are absent in the Wh POAG patients, which is in strong agreement with the fact that glaucoma is five times more frequent in B/Aa compared to Wh, and strikes earlier and progresses faster in B/Aa than in Wh. Additionally, of these 676 rRFs, 629 or 93.0% arise from mitochondrial rRNAs, a particularly notable result considering that mitochondrial processes have been linked to POAG. Table 22 (ALL_rRNA_seqs.POAG_exclusive.and.NOT_in_LCL.NOT_in_TCGA_NOT_in NormalandCLL.sequences.txt, provided in the CD submitted with the Provisional Patent Application No. 62/498,368, filed Dec. 22, 2016) lists these 676 sequences (SEQ ID NO: 65474-66149). These sequences are compelling candidates to serve as blood biomarkers for POAG.

d) From the above description, it should not be understood that only those rRFs that are present with a normalized abundance of ≥10 RPM in at least one of the analyzed datasets are useful. To examine this possibility, we identified all rRFs that arose from with a normalized abundance of ≥3 RPM (Of note: this is a lower threshold than 10 RPM) then analyzed them using the SAM method variant that is applicable to RNA-seq datasets (see also above). Specifically, the 2 control samples were compared against the 4 POAG samples. For this analysis, the very strict FDR threshold of 0.05 was enforced. Table 9 below lists the number of distinct rRFs that emerged from this comparison and the filename of the file that is attached. As mentioned above, files whose filename ends in "PositSign.txt" list rRFs whose abundance increases in the second of the two groups being compared.

Table 9.

TABLE 9

| Number of rRFs in signature | Filename | Comparison |
| --- | --- | --- |
| 271 | SAM.Normal_POAG@FDR=0.05_PositSign.txt (Table 46) | Female Controls vs Female Patients with POAG |

Some rRNA Fragments are Differentially Expressed Between Glaucoma Patients and Controls Additional Datasets 43 lymphoblastoid cell lines were obtained. These were generated from the peripheral B lymphocytes of 43 donors after transformation by the Epstein-Barr virus. Of the 43 donors, 10 were B/Aa and affected by primary open angle glaucoma (POAG)—referred to as group A1

11 were Wh and affected by POAG—referred to as group A2

11 were B/Aa and apparently healthy (served as controls)—referred to as group B1

11 were Wh and apparently healthy (served as controls)—referred to as group B2

Notably, all 43 donors were female and were selected on purpose.

All 43 datasets were deep sequenced. Subsequently, the rRFs that arose from each of the 6 rRNAs (i.e. 5S, 12S, 16S, 18S, 5.8S, and 28S) were enumerated and their support in terms of sequenced reads was determined.

Findings

DESeq (Love, Huber and Anders Genome Biology 2014) was used and the following comparisons were carried out: A1 vs B1 (i.e. POAG vs. control in B/Aa individuals, see Table 53) and A2 vs B2 (i.e. POAG vs. control in Wh individuals, see Table 53). We sub-selected only those rRFs whose abundance ranked them in the top 60%, had a fold change ≥2× and an FDR ≤0.05.

139 rRFS were found to be differentially expressed between A2 and B2 (i.e. POAG vs. control in Wh individuals). These sequences are listed in Table 52 (SEQ ID NOs: 70852-71219).

368 rRFs were found to be differentially expressed between A1 and B1 (i.e. POAG vs. control in B/Aa individuals). These sequences are listed in Table 53. (SEQ ID NOs: 71220-71358).

Only 23 of these rRFs were differentially expressed between POAG and controls, in both the Wh and B/Aa individuals.

Example 11: Primary Open Angle Glaucoma Datasets in tRNA

Combinations of tRFs are Present/Absent in a Condition-Specific Manner

In previous work, tRNAs encoded in both the nucleus and the mitochondria was reported to give rise to multiple tRFs that are constitutive and not degradation products. Also the levels of tRFs was shown to depend on a person's sex, population, and race as well as on tissue, tissue state, disease, and disease subtype. tRFs possibly depend on other variables too.

Results
1) In the CD submitted with the Provisional Patent Application No. 62/498,368, (filed Dec. 22, 2016) Table 23 (A tab-separated, plaintext file ALL.Normal-Bcells_and_POAG.exclusive.transfer_RNA_fragments.10RPMormore.12December2016.txt) summarizes our findings from the analysis of the above six datasets (SEQ ID NO: 66150-70573). The file lists consecutive rows with information that reads as follows:
Bld_Shrt_Nrml_BCells_|Femalekontrol|Wh|GM225-01|10RPMormore TCCCCGGCATCTCCACCA (SEQ ID NO: 66150) 371789 14357.5
Bld_ShrtNrml_BCells_|Femalekontrol|Wh|GM22501|10RPMormore TCCCCGGCACCTCCACCA (SEQ ID NO: 66151) 327537 12648.6 (etc.)
where
the first column is a composite string comprising six segments: whether this is a normal ("Bld_Shrt_Nrml_BCells_") or disease ("Bld_Shrt_POAG_BCells") sample; the sex of the individual that provided the sample; whether this is a normal ("control") or disease ("POAG") sample; the race of the patient ("Wh" or "B/Aa"—see above); the sample identifier (e.g., GM22501); and, the minimum RPM threshold used.
the second column lists the number of reads that the corresponding tRF received (e.g., 371789)
the last column lists the normalized abundance of the corresponding tRF in RPM.
2) There are 1316 distinct tRFs that appear with a normalized abundance of ≥10 RPM in at least one of the analyzed datasets: 603 arise from nuclearly-encoded tRNAs and 713 from mitochondrially-encoded tRNAs.
3) There are 530 tRFs that appear with a normalized abundance of ≥10 RPM exclusively in POAG samples but are not present in the control samples: 397 of these 530, or 78.9%, arise from mitochondrial rRNAs. This is particularly notable considering that mitochondrial processes have been linked to POAG.
4) When the 530 tRFs (Table 24) that are exclusive to the POAG samples were compared with the 1866 tRFs that appear with the same level of abundance (i.e., 10 RPM) in the 492 datasets generated from the B-cells of healthy individuals from the 1000 Genomes Project collection (Telonis et al, Oncotarget 2015) only 177 were found in common. This strongly indicates that the same type of cell (in this case a B-cell) produces tRFs in the POAG state that would not be produced by this cell in the "normal" state.
5) When the 530 tRFs that are exclusive to the POAG samples were compared with the 5160 tRFs that appear with the same level of abundance (i.e., 10 RPM)
in one or more of the 10274 datasets from The Cancer Genome Atlas (TCGA)
in one or more of the 492 datasets from the 1000 Genomes Project (see above)

278 of these tRFs were found unique to the POAG samples. This strongly indicates that these tRFs are likely unique to the POAG disease state as they do not seem to be produced by other cell types, normal and diseased. Of these 278 tRFs, 87 were present exclusively in the B/Aa POAG patients, 75 were present exclusively in the Wh POAG patients, and 116 were present in both the B/Aa and Wh POAG patients. Additionally, of these 278 tRFs, 195 or 70.1% arise from mitochondrial tRNAs, a particularly notable result considering that mitochondrial processes have been linked to POAG.

In the CD submitted with the Provisional Patent Application No. 62/498,368, (filed Dec. 22, 2016) Table 24 (ALL_tRNA_seqs.exclusive.transfer_RNAs.10RPMormore. POAG_exclusive.and.NOT_i n_LCL.NOT_in_TC-GA.sequences.txt) lists these 278 sequences (SEQ ID NO: 70574-70851). These tRNA fragment sequences are compelling candidates to serve as blood biomarkers for POAG.

Some tRNA Fragments are Differentially Expressed Between Glaucoma Patients and Controls Datasets Commercially 43 lymphoblastoid cell lines that were generated from the peripheral B lymphocytes of 43 donors after transformation by the Epstein-Barr virus. Of the 43 donors,
10 were B/Aa and affected by primary open angle glaucoma (POAG)—group A1
11 were Wh and affected by POAG—group A2
11 were B/Aa and apparently healthy (served as controls)—group B1
11 were Wh and apparently healthy (served as controls)—group B2 Of note: all 43 donors were selected to be female.

All 43 datasets were deep sequenced. Subsequently, we enumerated the tRFs that arose from each of the 610 nuclear and 22 mitochondrial tRNAs and determined their support in terms of sequenced reads.

Findings

DESeq (Love, Huber and Anders Genome Biology 2014) was used for this analysis, and the following comparisons carried out: A1 vs B1 (i.e. POAG vs. control in B/Aa individuals, Table 54) and A2 vs B2 (i.e. POAG vs. control in Wh individuals, Table 55). Only those rRFs whose abundance ranked them in the top 60%, had a fold change ≥2× and an FDR ≤0.05.

- 228 tRFs were found to be differentially expressed between A1 and B1 (i.e. POAG vs. control in B/Aa individuals). These sequences are listed in Table 54. (SEQ ID NOs: 71359-71586).
- 294 tRFS between A2 and B2 were differentially expressed (i.e. POAG vs. control in Wh individuals). Their sequences are included in table 55, SEQ ID NOs: 71587-71880).

Only 27 of these tRFs were differentially expressed between POAG and controls, in both the Wh and B/Aa individuals.

OTHER EMBODIMENTS

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

Lengthy table referenced here

US11578366-20230214-T00001

Please refer to the end of the specification for access instructions.

Lengthy table referenced here

US11578366-20230214-T00002

Please refer to the end of the specification for access instructions.

Lengthy table referenced here

US11578366-20230214-T00003

Please refer to the end of the specification for access instructions.

Lengthy table referenced here

US11578366-20230214-T00004

Please refer to the end of the specification for access instructions.

Lengthy table referenced here

US11578366-20230214-T00005

Please refer to the end of the specification for access instructions.

Lengthy table referenced here

US11578366-20230214-T00006

Please refer to the end of the specification for access instructions.

Lengthy table referenced here

US11578366-20230214-T00007

Please refer to the end of the specification for access instructions.

Lengthy table referenced here

US11578366-20230214-T00008

Please refer to the end of the specification for access instructions.

Lengthy table referenced here

US11578366-20230214-T00009

Please refer to the end of the specification for access instructions.

Lengthy table referenced here

US11578366-20230214-T00010

Please refer to the end of the specification for access instructions.

Lengthy table referenced here

US11578366-20230214-T00011

Please refer to the end of the specification for access instructions.

| Lengthy table referenced here | Lengthy table referenced here |
|---|---|
| US11578366-20230214-T00012 | US11578366-20230214-T00014 |
| Please refer to the end of the specification for access instructions. | Please refer to the end of the specification for access instructions. |

| Lengthy table referenced here | Lengthy table referenced here |
|---|---|
| US11578366-20230214-T00013 | US11578366-20230214-T00015 |
| Please refer to the end of the specification for access instructions. | Please refer to the end of the specification for access instructions. |

LENGTHY TABLES

The patent contains a lengthy table section. A copy of the table is available in electronic form from the USPTO web site (https://seqdata.uspto.gov/?pageRequest=docDetail&DocID=US11578366B2). An electronic copy of the table will also be available from the USPTO upon request and payment of the fee set forth in 37 CFR 1.19(b)(3).

SEQUENCE LISTING (71884 sequences)

SEQ ID NO: 1 - DNA, 20 bp, Homo sapiens
gtctacggccataccaccct

SEQ ID NO: 2 - DNA, 24 bp, Homo sapiens
gtctacggccataccaccctgaac

SEQ ID NO: 3 - DNA, 25 bp, Homo sapiens
gtctacggccataccaccctgaacg

SEQ ID NO: 4 - DNA, 26 bp, Homo sapiens
gtctacggccataccaccctgaacgc

SEQ ID NO: 5 - DNA, 27 bp, Homo sapiens
gtctacggccataccaccctgaacgcg

SEQ ID NO: 6 - DNA, 28 bp, Homo sapiens
gtctacggccataccaccctgaacgcgc

SEQ ID NO: 7 - DNA, 29 bp, Homo sapiens
gtctacggccataccaccctgaacgcgcc

SEQ ID NO: 8 - DNA, 30 bp, Homo sapiens
gtctacggccataccaccctgaacgcgccc

SEQ ID NO: 9 - DNA, 31 bp, Homo sapiens
gtctacggccataccaccctgaacgcgcccg

SEQ ID NO: 10 - DNA, 32 bp, Homo sapiens
gtctacggccataccaccctgaacgcgcccga

SEQ ID NO: 11 - DNA, 33 bp, Homo sapiens
gtctacggccataccaccctgaacgcgcccgat

SEQ ID NO: 12 - DNA, 31 bp, Homo sapiens
tctacggccataccaccctgaacgcgcccga

SEQ ID NO: 13 - DNA, 32 bp, Homo sapiens
tctacggccataccaccctgaacgcgcccgat

SEQ ID NO: 14 - DNA, 33 bp, Homo sapiens
tctacggccataccaccctgaacgcgcccgatc

SEQ ID NO: 15 - DNA, 30 bp, Homo sapiens
ctacggccataccaccctgaacgcgcccga

SEQ ID NO: 16 - DNA, 31 bp, Homo sapiens
ctacggccataccaccctgaacgcgcccgat

SEQ ID NO: 17 - DNA, 32 bp, Homo sapiens
ctacggccataccaccctgaacgcgcccgatc

SEQ ID NO: 18 - DNA, 28 bp, Homo sapiens
tacggccataccaccctgaacgcgcccg

SEQ ID NO: 19 - DNA, 29 bp, Homo sapiens
tacggccataccaccctgaacgcgcccga

SEQ ID NO: 20 - DNA, 30 bp, Homo sapiens
tacggccataccaccctgaacgcgcccgat

SEQ ID NO: 21 - DNA, 31 bp, Homo sapiens
tacggccataccaccctgaacgcgcccgatc

SEQ ID NO: 22 - DNA, 25 bp, Homo sapiens
acggccataccaccctgaacgcgcc

SEQ ID NO: 23 - DNA, 27 bp, Homo sapiens
acggccataccaccctgaacgcgcccg

SEQ ID NO: 24 - DNA, 28 bp, Homo sapiens
acggccataccaccctgaacgcgcccga

SEQ ID NO: 25 - DNA, 29 bp, Homo sapiens
acggccataccaccctgaacgcgcccgat

SEQ ID NO: 26 - DNA, 30 bp, Homo sapiens
acggccataccaccctgaacgcgcccgatc

SEQ ID NO: 27 - DNA, 31 bp, Homo sapiens
acggccataccaccctgaacgcgcccgatct

SEQ ID NO: 28 - DNA, 33 bp, Homo sapiens
acggccataccaccctgaacgcgcccgatctcg

SEQ ID NO: 29 - DNA, 27 bp, Homo sapiens
cggccataccaccctgaacgcgcccga

SEQ ID NO: 30 - DNA, 28 bp, Homo sapiens
cggccataccaccctgaacgcgcccgat

SEQ ID NO: 31 - DNA, 29 bp, Homo sapiens
ggccataccaccctgaacgcgcccgatct

SEQ ID NO: 32 - DNA, 22 bp, Homo sapiens
gccataccaccctgaacgcgcc

SEQ ID NO: 33 - DNA, 23 bp, Homo sapiens
gccataccaccctgaacgcgccc

SEQ ID NO: 34 - DNA, 24 bp, Homo sapiens
gccataccaccctgaacgcgcccg

SEQ ID NO: 35 - DNA, 25 bp, Homo sapiens
gccataccaccctgaacgcgcccga

SEQ ID NO: 36 - DNA, 26 bp, Homo sapiens
gccataccaccctgaacgcgcccgat

SEQ ID NO: 37 - DNA, 27 bp, Homo sapiens
gccataccaccctgaacgcgcccgatc

SEQ ID NO: 38 - DNA, 28 bp, Homo sapiens
gccataccaccctgaacgcgcccgatct

SEQ ID NO: 39 - DNA, 32 bp, Homo sapiens
gccataccaccctgaacgcgcccgatctcgtc

SEQ ID NO: 40 - DNA, 33 bp, Homo sapiens
gccataccaccctgaacgcgcccgatctcgtct

SEQ ID NO: 41 - DNA, 21 bp, Homo sapiens
ccataccaccctgaacgcgcc

SEQ ID NO: 42 - DNA, 24 bp, Homo sapiens
ccataccaccctgaacgcgcccga

SEQ ID NO: 43 - DNA, 25 bp, Homo sapiens
ccataccaccctgaacgcgcccgat

SEQ ID NO: 44 - DNA, 26 bp, Homo sapiens
ccataccaccctgaacgcgcccgatc

SEQ ID NO: 45 - DNA, 27 bp, Homo sapiens
ccataccaccctgaacgcgcccgatct

SEQ ID NO: 46 - DNA, 31 bp, Homo sapiens
ccataccaccctgaacgcgcccgatctcgtc

SEQ ID NO: 47 - DNA, 20 bp, Homo sapiens
cataccaccctgaacgcgcc

SEQ ID NO: 48 - DNA, 23 bp, Homo sapiens
cataccaccctgaacgcgcccga

SEQ ID NO: 49 - DNA, 24 bp, Homo sapiens
cataccaccctgaacgcgcccgat

SEQ ID NO: 50 - DNA, 26 bp, Homo sapiens
cataccaccctgaacgcgcccgatct

SEQ ID NO: 51 - DNA, 30 bp, Homo sapiens
cataccaccctgaacgcgcccgatctcgtc

SEQ ID NO: 52 - DNA, 19 bp, Homo sapiens
ataccaccctgaacgcgcc

SEQ ID NO: 53 - DNA, 20 bp, Homo sapiens
ataccaccctgaacgcgccc

SEQ ID NO: 54 - DNA, 21 bp, Homo sapiens
ataccaccctgaacgcgcccg

SEQ ID NO: 55 - DNA, 22 bp, Homo sapiens
ataccaccctgaacgcgcccga

SEQ ID NO: 56 - DNA, 23 bp, Homo sapiens
ataccaccctgaacgcgcccgat

SEQ ID NO: 57 - DNA, 24 bp, Homo sapiens
ataccaccctgaacgcgcccgatc

SEQ ID NO: 58 - DNA, 25 bp, Homo sapiens
ataccaccctgaacgcgcccgatct

SEQ ID NO: 59 - DNA, 28 bp, Homo sapiens
ataccaccctgaacgcgcccgatctcgt

SEQ ID NO: 60 - DNA, 29 bp, Homo sapiens
ataccaccctgaacgcgcccgatctcgtc

SEQ ID NO: 61 - DNA, 30 bp, Homo sapiens
ataccaccctgaacgcgcccgatctcgtct

SEQ ID NO: 62 - DNA, 18 bp, Homo sapiens
taccaccctgaacgcgcc

SEQ ID NO: 63 - DNA, 19 bp, Homo sapiens
taccaccctgaacgcgccc

SEQ ID NO: 64 - DNA, 20 bp, Homo sapiens
taccaccctgaacgcgcccg

SEQ ID NO: 65 - DNA, 21 bp, Homo sapiens
taccaccctgaacgcgcccga

SEQ ID NO: 66 - DNA, 22 bp, Homo sapiens
taccaccctgaacgcgcccgat

SEQ ID NO: 67 - DNA, 23 bp, Homo sapiens
taccaccctgaacgcgcccgatc

SEQ ID NO: 68 - DNA, 24 bp, Homo sapiens
taccaccctgaacgcgcccgatct

SEQ ID NO: 69 - DNA, 26 bp, Homo sapiens
taccaccctgaacgcgcccgatctcg

SEQ ID NO: 70 - DNA, 27 bp, Homo sapiens
taccaccctgaacgcgcccgatctcgt

SEQ ID NO: 71 - DNA, 28 bp, Homo sapiens
taccaccctgaacgcgcccgatctcgtc

SEQ ID NO: 72 - DNA, 29 bp, Homo sapiens
taccaccctgaacgcgcccgatctcgtct

SEQ ID NO: 73 - DNA, 17 bp, Homo sapiens
accaccctgaacgcgcc

SEQ ID NO: 74 - DNA, 18 bp, Homo sapiens
accaccctgaacgcgccc

SEQ ID NO: 75 - DNA, 19 bp, Homo sapiens
accaccctgaacgcgcccg

SEQ ID NO: 76 - DNA, 20 bp, Homo sapiens
accaccctgaacgcgcccga

SEQ ID NO: 77 - DNA, 21 bp, Homo sapiens
accaccctgaacgcgcccgat

SEQ ID NO: 78 - DNA, 22 bp, Homo sapiens
accaccctgaacgcgcccgatc

SEQ ID NO: 79 - DNA, 23 bp, Homo sapiens
accaccctgaacgcgcccgatct

SEQ ID NO: 80 - DNA, 25 bp, Homo sapiens
accaccctgaacgcgcccgatctcg

SEQ ID NO: 81 - DNA, 26 bp, Homo sapiens
accaccctgaacgcgcccgatctcgt

SEQ ID NO: 82 - DNA, 27 bp, Homo sapiens
accaccctgaacgcgcccgatctcgtc

SEQ ID NO: 83 - DNA, 16 bp, Homo sapiens
ccaccctgaacgcgcc

SEQ ID NO: 84 - DNA, 17 bp, Homo sapiens
ccaccctgaacgcgccc

SEQ ID NO: 85 - DNA, 18 bp, Homo sapiens
ccaccctgaacgcgcccg

SEQ ID NO: 86 - DNA, 19 bp, Homo sapiens
ccaccctgaacgcgcccga

SEQ ID NO: 87 - DNA, 20 bp, Homo sapiens
ccaccctgaacgcgcccgat

SEQ ID NO: 88 - DNA, 21 bp, Homo sapiens
ccaccctgaacgcgcccgatc

SEQ ID NO: 89 - DNA, 22 bp, Homo sapiens
ccaccctgaacgcgcccgatct

SEQ ID NO: 90 - DNA, 24 bp, Homo sapiens
ccaccctgaacgcgcccgatctcg

SEQ ID NO: 91 - DNA, 25 bp, Homo sapiens
ccaccctgaacgcgcccgatctcgt

SEQ ID NO: 92 - DNA, 26 bp, Homo sapiens
ccaccctgaacgcgcccgatctcgtc

SEQ ID NO: 93 - DNA, 16 bp, Homo sapiens
caccctgaacgcgccc

SEQ ID NO: 94 - DNA, 17 bp, Homo sapiens
caccctgaacgcgcccg

SEQ ID NO: 95 - DNA, 18 bp, Homo sapiens
caccctgaacgcgcccga

SEQ ID NO: 96 - DNA, 19 bp, Homo sapiens
caccctgaacgcgcccgat

SEQ ID NO: 97 - DNA, 20 bp, Homo sapiens
caccctgaacgcgcccgatc

SEQ ID NO: 98 - DNA, 21 bp, Homo sapiens
caccctgaacgcgcccgatct

SEQ ID NO: 99 - DNA, 23 bp, Homo sapiens
caccctgaacgcgcccgatctcg

SEQ ID NO: 100 - DNA, 24 bp, Homo sapiens
caccctgaacgcgcccgatctcgt

SEQ ID NO: 101 - DNA, 25 bp, Homo sapiens
caccctgaacgcgcccgatctcgtc

SEQ ID NO: 102 - DNA, 16 bp, Homo sapiens
accctgaacgcgcccg

SEQ ID NO: 103 - DNA, 17 bp, Homo sapiens
accctgaacgcgcccga

SEQ ID NO: 104 - DNA, 18 bp, Homo sapiens
accctgaacgcgcccgat

SEQ ID NO: 105 - DNA, 19 bp, Homo sapiens
accctgaacgcgcccgatc

SEQ ID NO: 106 - DNA, 20 bp, Homo sapiens
accctgaacgcgcccgatct

SEQ ID NO: 107 - DNA, 24 bp, Homo sapiens
accctgaacgcgcccgatctcgtc

SEQ ID NO: 108 - DNA, 16 bp, Homo sapiens
ccctgaacgcgcccga

SEQ ID NO: 109 - DNA, 17 bp, Homo sapiens
ccctgaacgcgcccgat

SEQ ID NO: 110 - DNA, 18 bp, Homo sapiens
ccctgaacgcgcccgatc

SEQ ID NO: 111 - DNA, 19 bp, Homo sapiens
ccctgaacgcgcccgatct

SEQ ID NO: 112 - DNA, 23 bp, Homo sapiens
ccctgaacgcgcccgatctcgtc

SEQ ID NO: 113 - DNA, 16 bp, Homo sapiens
cctgaacgcgcccgat

SEQ ID NO: 114 - DNA, 17 bp, Homo sapiens
cctgaacgcgcccgatc

SEQ ID NO: 115 - DNA, 18 bp, Homo sapiens
cctgaacgcgcccgatct

SEQ ID NO: 116 - DNA, 22 bp, Homo sapiens
cctgaacgcgcccgatctcgtc

SEQ ID NO: 117 - DNA, 16 bp, Homo sapiens
ctgaacgcgcccgatc

SEQ ID NO: 118 - DNA, 33 bp, Homo sapiens
ctgaacgcgcccgatctcgtctgatctcggaag

SEQ ID NO: 119 - DNA, 32 bp, Homo sapiens
tgaacgcgcccgatctcgtctgatctcggaag

SEQ ID NO: 120 - DNA, 31 bp, Homo sapiens
gaacgcgcccgatctcgtctgatctcggaag

SEQ ID NO: 121 - DNA, 30 bp, Homo sapiens
aacgcgcccgatctcgtctgatctcggaag

SEQ ID NO: 122 - DNA, 29 bp, Homo sapiens
acgcgcccgatctcgtctgatctcggaag

SEQ ID NO: 123 - DNA, 17 bp, Homo sapiens
cgcccgatctcgtctga

SEQ ID NO: 124 - DNA, 18 bp, Homo sapiens
cgcccgatctcgtctgat

SEQ ID NO: 125 - DNA, 22 bp, Homo sapiens
cgcccgatctcgtctgatctcg

SEQ ID NO: 126 - DNA, 28 bp, Homo sapiens
cgcccgatctcgtctgatctcggaagct

SEQ ID NO: 127 - DNA, 21 bp, Homo sapiens
gcccgatctcgtctgatctcg

SEQ ID NO: 128 - DNA, 24 bp, Homo sapiens
cgatctcgtctgatctcggaagct

SEQ ID NO: 129 - DNA, 16 bp, Homo sapiens
cgtctgatctcggaag

SEQ ID NO: 130 - DNA, 18 bp, Homo sapiens
cgtctgatctcggaagct

SEQ ID NO: 131 - DNA, 33 bp, Homo sapiens
cgtctgatctcggaagctaagcagggtcgggcc

SEQ ID NO: 132 - DNA, 33 bp, Homo sapiens
ctgatctcggaagctaagcagggtcgggcctgg

SEQ ID NO: 133 - DNA, 33 bp, Homo sapiens
gatctcggaagctaagcagggtcgggcctggtt

SEQ ID NO: 134 - DNA, 29 bp, Homo sapiens
atctcggaagctaagcagggtcgggcctg

SEQ ID NO: 135 - DNA, 30 bp, Homo sapiens
ctcggaagctaagcagggtcgggcctggtt

SEQ ID NO: 136 - DNA, 29 bp, Homo sapiens
tcggaagctaagcagggtcgggcctggtt

SEQ ID NO: 137 - DNA, 28 bp, Homo sapiens
cggaagctaagcagggtcgggcctggtt

SEQ ID NO: 138 - DNA, 27 bp, Homo sapiens
ggaagctaagcagggtcgggcctggtt

SEQ ID NO: 139 - DNA, 33 bp, Homo sapiens
ggaagctaagcagggtcgggcctggttagtact

SEQ ID NO: 140 - DNA, 25 bp, Homo sapiens
gaagctaagcagggtcgggcctggt

SEQ ID NO: 141 - DNA, 26 bp, Homo sapiens
gaagctaagcagggtcgggcctggtt

SEQ ID NO: 142 - DNA, 32 bp, Homo sapiens
gaagctaagcagggtcgggcctggttagtact

SEQ ID NO: 143 - DNA, 24 bp, Homo sapiens
agctaagcagggtcgggcctggtt

SEQ ID NO: 144 - DNA, 33 bp, Homo sapiens
gctaagcagggtcgggcctggttagtacttgga

SEQ ID NO: 145 - DNA, 32 bp, Homo sapiens
ctaagcagggtcgggcctggttagtacttgga

SEQ ID NO: 146 - DNA, 16 bp, Homo sapiens
aagcagggtcgggcct

SEQ ID NO: 147 - DNA, 20 bp, Homo sapiens
aagcagggtcgggcctggtt

SEQ ID NO: 148 - DNA, 26 bp, Homo sapiens
aagcagggtcgggcctggttagtact

SEQ ID NO: 149 - DNA, 30 bp, Homo sapiens
aagcagggtcgggcctggttagtacttgga

SEQ ID NO: 150 - DNA, 16 bp, Homo sapiens
agggtcgggcctggtt

SEQ ID NO: 151 - DNA, 33 bp, Homo sapiens
cgggcctggttagtacttggatgggagaccgcc

SEQ ID NO: 152 - DNA, 32 bp, Homo sapiens
gggcctggttagtacttggatgggagaccgcc

SEQ ID NO: 153 - DNA, 27 bp, Homo sapiens
tggttagtacttggatgggagaccgcc

SEQ ID NO: 154 - DNA, 25 bp, Homo sapiens
gttagtacttggatgggagaccgcc

SEQ ID NO: 155 - DNA, 24 bp, Homo sapiens
ttagtacttggatgggagaccgcc

SEQ ID NO: 156 - DNA, 23 bp, Homo sapiens
tagtacttggatgggagaccgcc

SEQ ID NO: 157 - DNA, 22 bp, Homo sapiens
agtacttggatgggagaccgcc

SEQ ID NO: 158 - DNA, 21 bp, Homo sapiens
gtacttggatgggagaccgcc

SEQ ID NO: 159 - DNA, 20 bp, Homo sapiens
tacttggatgggagaccgcc

SEQ ID NO: 160 - DNA, 19 bp, Homo sapiens
acttggatgggagaccgcc

SEQ ID NO: 161 - DNA, 19 bp, Homo sapiens
cttggatgggagaccgcct

SEQ ID NO: 162 - DNA, 17 bp, Homo sapiens
ttggatgggagaccgcc

SEQ ID NO: 163 - DNA, 18 bp, Homo sapiens
ttggatgggagaccgcct

SEQ ID NO: 164 - DNA, 16 bp, Homo sapiens
tggatgggagaccgcc

SEQ ID NO: 165 - DNA, 33 bp, Homo sapiens
gagaccgcctgggaataccgggtgctgtaggct

SEQ ID NO: 166 - DNA, 33 bp, Homo sapiens
agaccgcctgggaataccgggtgctgtaggctt

SEQ ID NO: 167 - DNA, 32 bp, Homo sapiens
gaccgcctgggaataccgggtgctgtaggctt

SEQ ID NO: 168 - DNA, 33 bp, Homo sapiens
gaccgcctgggaataccgggtgctgtaggcttt

SEQ ID NO: 169 - DNA, 31 bp, Homo sapiens
accgcctgggaataccgggtgctgtaggctt

SEQ ID NO: 170 - DNA, 29 bp, Homo sapiens
ccgcctgggaataccgggtgctgtaggct

SEQ ID NO: 171 - DNA, 30 bp, Homo sapiens
ccgcctgggaataccgggtgctgtaggctt

SEQ ID NO: 172 - DNA, 31 bp, Homo sapiens
ccgcctgggaataccgggtgctgtaggcttt

SEQ ID NO: 173 - DNA, 29 bp, Homo sapiens
cgcctgggaataccgggtgctgtaggctt

SEQ ID NO: 174 - DNA, 30 bp, Homo sapiens
cgcctgggaataccgggtgctgtaggcttt

SEQ ID NO: 175 - DNA, 28 bp, Homo sapiens
gcctgggaataccgggtgctgtaggctt

SEQ ID NO: 176 - DNA, 29 bp, Homo sapiens
gcctgggaataccgggtgctgtaggcttt

SEQ ID NO: 177 - DNA, 27 bp, Homo sapiens
cctgggaataccgggtgctgtaggctt

SEQ ID NO: 178 - DNA, 28 bp, Homo sapiens
cctgggaataccgggtgctgtaggcttt

SEQ ID NO: 179 - DNA, 26 bp, Homo sapiens
ctgggaataccgggtgctgtaggctt

SEQ ID NO: 180 - DNA, 27 bp, Homo sapiens
ctgggaataccgggtgctgtaggcttt

SEQ ID NO: 181 - DNA, 24 bp, Homo sapiens
tgggaataccgggtgctgtaggct

SEQ ID NO: 182 - DNA, 25 bp, Homo sapiens
tgggaataccgggtgctgtaggctt

SEQ ID NO: 183 - DNA, 26 bp, Homo sapiens
tgggaataccgggtgctgtaggcttt

SEQ ID NO: 184 - DNA, 23 bp, Homo sapiens
gggaataccgggtgctgtaggct

SEQ ID NO: 185 - DNA, 24 bp, Homo sapiens
gggaataccgggtgctgtaggctt

SEQ ID NO: 186 - DNA, 25 bp, Homo sapiens
gggaataccgggtgctgtaggcttt

SEQ ID NO: 187 - DNA, 22 bp, Homo sapiens
ggaataccgggtgctgtaggct

SEQ ID NO: 188 - DNA, 23 bp, Homo sapiens
ggaataccgggtgctgtaggctt

SEQ ID NO: 189 - DNA, 24 bp, Homo sapiens
ggaataccgggtgctgtaggcttt

SEQ ID NO: 190 - DNA, 21 bp, Homo sapiens
gaataccgggtgctgtaggct

SEQ ID NO: 191 - DNA, 22 bp, Homo sapiens
gaataccgggtgctgtaggctt

SEQ ID NO: 192 - DNA, 23 bp, Homo sapiens
gaataccgggtgctgtaggcttt

SEQ ID NO: 193 - DNA, 20 bp, Homo sapiens
aataccgggtgctgtaggct

SEQ ID NO: 194 - DNA, 21 bp, Homo sapiens
aataccgggtgctgtaggctt

SEQ ID NO: 195 - DNA, 22 bp, Homo sapiens
aataccgggtgctgtaggcttt

SEQ ID NO: 196 - DNA, 19 bp, Homo sapiens
ataccgggtgctgtaggct

SEQ ID NO: 197 - DNA, 20 bp, Homo sapiens
ataccgggtgctgtaggctt

SEQ ID NO: 198 - DNA, 21 bp, Homo sapiens
ataccgggtgctgtaggcttt

SEQ ID NO: 199 - DNA, 18 bp, Homo sapiens
taccgggtgctgtaggct

SEQ ID NO: 200 - DNA, 19 bp, Homo sapiens
taccgggtgctgtaggctt

SEQ ID NO: 201 - DNA, 20 bp, Homo sapiens
taccgggtgctgtaggcttt

SEQ ID NO: 202 - DNA, 16 bp, Homo sapiens
accgggtgctgtaggc

SEQ ID NO: 203 - DNA, 17 bp, Homo sapiens
accgggtgctgtaggct

SEQ ID NO: 204 - DNA, 18 bp, Homo sapiens
accgggtgctgtaggctt

SEQ ID NO: 205 - DNA, 19 bp, Homo sapiens
accgggtgctgtaggcttt

SEQ ID NO: 206 - DNA, 20 bp, Homo sapiens
accgggtgctgtaggctttt

SEQ ID NO: 207 - DNA, 16 bp, Homo sapiens
ccgggtgctgtaggct

SEQ ID NO: 208 - DNA, 17 bp, Homo sapiens
ccgggtgctgtaggctt

SEQ ID NO: 209 - DNA, 18 bp, Homo sapiens
ccgggtgctgtaggcttt

SEQ ID NO: 210 - DNA, 16 bp, Homo sapiens
cgggtgctgtaggctt

SEQ ID NO: 211 - DNA, 17 bp, Homo sapiens
cgggtgctgtaggcttt

SEQ ID NO: 212 - DNA, 16 bp, Homo sapiens
gggtgctgtaggcttt

SEQ ID NO: 213 - DNA, 30 bp, Homo sapiens
ataggtttggtcctagcctttctattagct

SEQ ID NO: 214 - DNA, 31 bp, Homo sapiens
ataggtttggtcctagcctttctattagctc

SEQ ID NO: 215 - DNA, 32 bp, Homo sapiens
ataggtttggtcctagcctttctattagctct

SEQ ID NO: 216 - DNA, 33 bp, Homo sapiens
ataggtttggtcctagcctttctattagctctt

SEQ ID NO: 217 - DNA, 33 bp, Homo sapiens
agcacgcagcaatgcagctcaaaacgcttagcc

SEQ ID NO: 218 - DNA, 33 bp, Homo sapiens
gcacgcagcaatgcagctcaaaacgcttagcct

SEQ ID NO: 219 - DNA, 27 bp, Homo sapiens
gctcaaaacgcttagcctagccacacc

SEQ ID NO: 220 - DNA, 28 bp, Homo sapiens
gctcaaaacgcttagcctagccacaccc

SEQ ID NO: 221 - DNA, 29 bp, Homo sapiens
gctcaaaacgcttagcctagccacacccc

SEQ ID NO: 222 - DNA, 30 bp, Homo sapiens
gctcaaaacgcttagcctagccacaccccc

SEQ ID NO: 223 - DNA, 19 bp, Homo sapiens
caaaacgcttagcctagcc

SEQ ID NO: 224 - DNA, 24 bp, Homo sapiens
caaaacgcttagcctagccacacc

SEQ ID NO: 225 - DNA, 25 bp, Homo sapiens
caaaacgcttagcctagccacaccc

SEQ ID NO: 226 - DNA, 26 bp, Homo sapiens
caaaacgcttagcctagccacacccc

SEQ ID NO: 227 - DNA, 27 bp, Homo sapiens
caaaacgcttagcctagccacaccccc

SEQ ID NO: 228 - DNA, 23 bp, Homo sapiens
aaaacgcttagcctagccacacc

SEQ ID NO: 229 - DNA, 24 bp, Homo sapiens
aaaacgcttagcctagccacaccc

SEQ ID NO: 230 - DNA, 25 bp, Homo sapiens
aaaacgcttagcctagccacacccc

SEQ ID NO: 231 - DNA, 17 bp, Homo sapiens
aaacgcttagcctagcc

SEQ ID NO: 232 - DNA, 22 bp, Homo sapiens
aaacgcttagcctagccacacc

SEQ ID NO: 233 - DNA, 23 bp, Homo sapiens
aaacgcttagcctagccacaccc

SEQ ID NO: 234 - DNA, 24 bp, Homo sapiens
aaacgcttagcctagccacacccc

SEQ ID NO: 235 - DNA, 25 bp, Homo sapiens
aaacgcttagcctagccacaccccc

SEQ ID NO: 236 - DNA, 21 bp, Homo sapiens
aacgcttagcctagccacacc

SEQ ID NO: 237 - DNA, 22 bp, Homo sapiens
aacgcttagcctagccacaccc

SEQ ID NO: 238 - DNA, 23 bp, Homo sapiens
aacgcttagcctagccacacccc

SEQ ID NO: 239 - DNA, 17 bp, Homo sapiens
cttagcctagccacacc

SEQ ID NO: 240 - DNA, 18 bp, Homo sapiens
cttagcctagccacaccc

SEQ ID NO: 241 - DNA, 19 bp, Homo sapiens
cttagcctagccacacccc

SEQ ID NO: 242 - DNA, 20 bp, Homo sapiens
cttagcctagccacaccccc

SEQ ID NO: 243 - DNA, 33 bp, Homo sapiens
tatactaaccccagggttggtcaatttcgtgcc

SEQ ID NO: 244 - DNA, 32 bp, Homo sapiens
atactaaccccagggttggtcaatttcgtgcc

SEQ ID NO: 245 - DNA, 16 bp, Homo sapiens
aaccccagggttggtc

SEQ ID NO: 246 - DNA, 24 bp, Homo sapiens
aaccccagggttggtcaatttcgt

SEQ ID NO: 247 - DNA, 23 bp, Homo sapiens
ccagggttggtcaatttcgtgcc

SEQ ID NO: 248 - DNA, 16 bp, Homo sapiens
cagggttggtcaattt

SEQ ID NO: 249 - DNA, 17 bp, Homo sapiens
cagggttggtcaatttc

SEQ ID NO: 250 - DNA, 18 bp, Homo sapiens
cagggttggtcaatttcg

SEQ ID NO: 251 - DNA, 22 bp, Homo sapiens
cagggttggtcaatttcgtgcc

SEQ ID NO: 252 - DNA, 17 bp, Homo sapiens
agggttggtcaatttcg

SEQ ID NO: 253 - DNA, 21 bp, Homo sapiens
agggttggtcaatttcgtgcc

SEQ ID NO: 254 - DNA, 20 bp, Homo sapiens
gggttggtcaatttcgtgcc

SEQ ID NO: 255 - DNA, 17 bp, Homo sapiens
atttcgtgccagccacc

SEQ ID NO: 256 - DNA, 19 bp, Homo sapiens
cgtgccagccaccgcggtc

SEQ ID NO: 257 - DNA, 31 bp, Homo sapiens
agccaccgcggtcacacgattaacccaagtc

SEQ ID NO: 258 - DNA, 33 bp, Homo sapiens
cggtcacacgattaacccaagtcaatagaagcc

SEQ ID NO: 259 - DNA, 28 bp, Homo sapiens
acacgattaacccaagtcaatagaagcc

SEQ ID NO: 260 - DNA, 31 bp, Homo sapiens
acacgattaacccaagtcaatagaagccggc

SEQ ID NO: 261 - DNA, 32 bp, Homo sapiens
acacgattaacccaagtcaatagaagccggcg

SEQ ID NO: 262 - DNA, 27 bp, Homo sapiens
cacgattaacccaagtcaatagaagcc

SEQ ID NO: 263 - DNA, 30 bp, Homo sapiens
cacgattaacccaagtcaatagaagccggc

SEQ ID NO: 264 - DNA, 23 bp, Homo sapiens
attaacccaagtcaatagaagcc

SEQ ID NO: 265 - DNA, 16 bp, Homo sapiens
caagtcaatagaagcc

SEQ ID NO: 266 - DNA, 19 bp, Homo sapiens
caagtcaatagaagccggc

SEQ ID NO: 267 - DNA, 18 bp, Homo sapiens
aagtcaatagaagccggc

SEQ ID NO: 268 - DNA, 16 bp, Homo sapiens
aatagaagccggcgta

SEQ ID NO: 269 - DNA, 17 bp, Homo sapiens
aatagaagccggcgtaa

SEQ ID NO: 270 - DNA, 18 bp, Homo sapiens
aatagaagccggcgtaaa

SEQ ID NO: 271 - DNA, 19 bp, Homo sapiens
aatagaagccggcgtaaag

SEQ ID NO: 272 - DNA, 32 bp, Homo sapiens
aatagaagccggcgtaaagagtgttttagatc

SEQ ID NO: 273 - DNA, 33 bp, Homo sapiens
aatagaagccggcgtaaagagtgttttagatca

SEQ ID NO: 274 - DNA, 31 bp, Homo sapiens
atagaagccggcgtaaagagtgttttagatc

SEQ ID NO: 275 - DNA, 33 bp, Homo sapiens
tagaagccggcgtaaagagtgttttagatcacc

SEQ ID NO: 276 - DNA, 32 bp, Homo sapiens
agaagccggcgtaaagagtgttttagatcacc

SEQ ID NO: 277 - DNA, 33 bp, Homo sapiens
agaagccggcgtaaagagtgttttagatcaccc

SEQ ID NO: 278 - DNA, 31 bp, Homo sapiens
gaagccggcgtaaagagtgttttagatcacc

SEQ ID NO: 279 - DNA, 32 bp, Homo sapiens
gaagccggcgtaaagagtgttttagatcaccc

SEQ ID NO: 280 - DNA, 33 bp, Homo sapiens
gaagccggcgtaaagagtgttttagatcacccc

SEQ ID NO: 281 - DNA, 30 bp, Homo sapiens
aagccggcgtaaagagtgttttagatcacc

SEQ ID NO: 282 - DNA, 31 bp, Homo sapiens
aagccggcgtaaagagtgttttagatcaccc

SEQ ID NO: 283 - DNA, 32 bp, Homo sapiens
aagccggcgtaaagagtgttttagatcacccc

SEQ ID NO: 284 - DNA, 33 bp, Homo sapiens
aagccggcgtaaagagtgttttagatcaccccc

SEQ ID NO: 285 - DNA, 27 bp, Homo sapiens
ccggcgtaaagagtgttttagatcacc

SEQ ID NO: 286 - DNA, 27 bp, Homo sapiens
cctccccaataaagctaaaactcacct

SEQ ID NO: 287 - DNA, 26 bp, Homo sapiens
ctccccaataaagctaaaactcacct

SEQ ID NO: 288 - DNA, 25 bp, Homo sapiens
tccccaataaagctaaaactcacct

SEQ ID NO: 289 - DNA, 23 bp, Homo sapiens
cccaataaagctaaaactcacct

SEQ ID NO: 290 - DNA, 22 bp, Homo sapiens
ccaataaagctaaaactcacct

SEQ ID NO: 291 - DNA, 20 bp, Homo sapiens
caataaagctaaaactcacc

SEQ ID NO: 292 - DNA, 21 bp, Homo sapiens
caataaagctaaaactcacct

SEQ ID NO: 293 - DNA, 19 bp, Homo sapiens
aataaagctaaaactcacc

SEQ ID NO: 294 - DNA, 20 bp, Homo sapiens
aataaagctaaaactcacct

SEQ ID NO: 295 - DNA, 21 bp, Homo sapiens
aataaagctaaaactcacctg

SEQ ID NO: 296 - DNA, 18 bp, Homo sapiens
ataaagctaaaactcacc

SEQ ID NO: 297 - DNA, 19 bp, Homo sapiens
ataaagctaaaactcacct

SEQ ID NO: 298 - DNA, 18 bp, Homo sapiens
taaagctaaaactcacct

SEQ ID NO: 299 - DNA, 17 bp, Homo sapiens
aaagctaaaactcacct

SEQ ID NO: 300 - DNA, 33 bp, Homo sapiens
aaagctaaaactcacctgagttgtaaaaaactc

SEQ ID NO: 301 - DNA, 16 bp, Homo sapiens
aagctaaaactcacct

SEQ ID NO: 302 - DNA, 32 bp, Homo sapiens
aagctaaaactcacctgagttgtaaaaaactc

SEQ ID NO: 303 - DNA, 21 bp, Homo sapiens
cacctgagttgtaaaaaactc

SEQ ID NO: 304 - DNA, 17 bp, Homo sapiens
tgagttgtaaaaaactc

SEQ ID NO: 305 - DNA, 23 bp, Homo sapiens
tgtaaaaaactccagttgacaca

SEQ ID NO: 306 - DNA, 22 bp, Homo sapiens
gtaaaaaactccagttgacaca

SEQ ID NO: 307 - DNA, 24 bp, Homo sapiens
actccagttgacacaaaatagact

SEQ ID NO: 308 - DNA, 19 bp, Homo sapiens
tacgaaagtggctttaaca

SEQ ID NO: 309 - DNA, 24 bp, Homo sapiens
tacgaaagtggctttaacatatct

SEQ ID NO: 310 - DNA, 29 bp, Homo sapiens
tacgaaagtggctttaacatatctgaaca

SEQ ID NO: 311 - DNA, 30 bp, Homo sapiens
tacgaaagtggctttaacatatctgaacac

SEQ ID NO: 312 - DNA, 31 bp, Homo sapiens
tacgaaagtggctttaacatatctgaacaca

SEQ ID NO: 313 - DNA, 33 bp, Homo sapiens
tacgaaagtggctttaacatatctgaacacaca

SEQ ID NO: 314 - DNA, 28 bp, Homo sapiens
acgaaagtggctttaacatatctgaaca

SEQ ID NO: 315 - DNA, 29 bp, Homo sapiens
acgaaagtggctttaacatatctgaacac

SEQ ID NO: 316 - DNA, 30 bp, Homo sapiens
acgaaagtggctttaacatatctgaacaca

SEQ ID NO: 317 - DNA, 31 bp, Homo sapiens
acgaaagtggctttaacatatctgaacacac

SEQ ID NO: 318 - DNA, 32 bp, Homo sapiens
acgaaagtggctttaacatatctgaacacaca

SEQ ID NO: 319 - DNA, 26 bp, Homo sapiens
gaaagtggctttaacatatctgaaca

SEQ ID NO: 320 - DNA, 24 bp, Homo sapiens
aaagtggctttaacatatctgaac

SEQ ID NO: 321 - DNA, 25 bp, Homo sapiens
aaagtggctttaacatatctgaaca

SEQ ID NO: 322 - DNA, 26 bp, Homo sapiens
aaagtggctttaacatatctgaacac

SEQ ID NO: 323 - DNA, 27 bp, Homo sapiens
aaagtggctttaacatatctgaacaca

SEQ ID NO: 324 - DNA, 28 bp, Homo sapiens
aaagtggctttaacatatctgaacacac

SEQ ID NO: 325 - DNA, 29 bp, Homo sapiens
aaagtggctttaacatatctgaacacaca

SEQ ID NO: 326 - DNA, 32 bp, Homo sapiens
aaagtggctttaacatatctgaacacacaata

SEQ ID NO: 327 - DNA, 33 bp, Homo sapiens
agtggctttaacatatctgaacacacaatagct

SEQ ID NO: 328 - DNA, 32 bp, Homo sapiens
gtggctttaacatatctgaacacacaatagct

SEQ ID NO: 329 - DNA, 33 bp, Homo sapiens
tttaacatatctgaacacacaatagctaagacc

SEQ ID NO: 330 - DNA, 26 bp, Homo sapiens
ttaacatatctgaacacacaatagct

SEQ ID NO: 331 - DNA, 32 bp, Homo sapiens
ttaacatatctgaacacacaatagctaagacc

SEQ ID NO: 332 - DNA, 33 bp, Homo sapiens
ttaacatatctgaacacacaatagctaagaccc

SEQ ID NO: 333 - DNA, 25 bp, Homo sapiens
taacatatctgaacacacaatagct

SEQ ID NO: 334 - DNA, 31 bp, Homo sapiens
taacatatctgaacacacaatagctaagacc

SEQ ID NO: 335 - DNA, 32 bp, Homo sapiens
taacatatctgaacacacaatagctaagaccc

SEQ ID NO: 336 - DNA, 33 bp, Homo sapiens
taacatatctgaacacacaatagctaagaccca

SEQ ID NO: 337 - DNA, 24 bp, Homo sapiens
aacatatctgaacacacaatagct

SEQ ID NO: 338 - DNA, 25 bp, Homo sapiens
aacatatctgaacacacaatagcta

SEQ ID NO: 339 - DNA, 27 bp, Homo sapiens
aacatatctgaacacacaatagctaag

SEQ ID NO: 340 - DNA, 30 bp, Homo sapiens
aacatatctgaacacacaatagctaagacc

SEQ ID NO: 341 - DNA, 31 bp, Homo sapiens
aacatatctgaacacacaatagctaagaccc

SEQ ID NO: 342 - DNA, 32 bp, Homo sapiens
aacatatctgaacacacaatagctaagaccca

SEQ ID NO: 343 - DNA, 23 bp, Homo sapiens
acatatctgaacacacaatagct

SEQ ID NO: 344 - DNA, 24 bp, Homo sapiens
acatatctgaacacacaatagcta

SEQ ID NO: 345 - DNA, 26 bp, Homo sapiens
acatatctgaacacacaatagctaag

SEQ ID NO: 346 - DNA, 29 bp, Homo sapiens
acatatctgaacacacaatagctaagacc

SEQ ID NO: 347 - DNA, 30 bp, Homo sapiens
acatatctgaacacacaatagctaagaccc

SEQ ID NO: 348 - DNA, 31 bp, Homo sapiens
acatatctgaacacacaatagctaagaccca

SEQ ID NO: 349 - DNA, 22 bp, Homo sapiens
catatctgaacacacaatagct

SEQ ID NO: 350 - DNA, 28 bp, Homo sapiens
catatctgaacacacaatagctaagacc

SEQ ID NO: 351 - DNA, 29 bp, Homo sapiens
catatctgaacacacaatagctaagaccc

SEQ ID NO: 352 - DNA, 30 bp, Homo sapiens
catatctgaacacacaatagctaagaccca

SEQ ID NO: 353 - DNA, 33 bp, Homo sapiens
catatctgaacacacaatagctaagacccaaac

SEQ ID NO: 354 - DNA, 21 bp, Homo sapiens
atatctgaacacacaatagct

SEQ ID NO: 355 - DNA, 24 bp, Homo sapiens
atatctgaacacacaatagctaag

SEQ ID NO: 356 - DNA, 27 bp, Homo sapiens
atatctgaacacacaatagctaagacc

SEQ ID NO: 357 - DNA, 28 bp, Homo sapiens
atatctgaacacacaatagctaagaccc

SEQ ID NO: 358 - DNA, 29 bp, Homo sapiens
atatctgaacacacaatagctaagaccca

SEQ ID NO: 359 - DNA, 33 bp, Homo sapiens
atatctgaacacacaatagctaagacccaaact

SEQ ID NO: 360 - DNA, 20 bp, Homo sapiens
tatctgaacacacaatagct

SEQ ID NO: 361 - DNA, 23 bp, Homo sapiens
tatctgaacacacaatagctaag

SEQ ID NO: 362 - DNA, 24 bp, Homo sapiens
tatctgaacacacaatagctaaga

SEQ ID NO: 363 - DNA, 26 bp, Homo sapiens
tatctgaacacacaatagctaagacc

SEQ ID NO: 364 - DNA, 27 bp, Homo sapiens
tatctgaacacacaatagctaagaccc

SEQ ID NO: 365 - DNA, 28 bp, Homo sapiens
tatctgaacacacaatagctaagaccca

SEQ ID NO: 366 - DNA, 32 bp, Homo sapiens
tatctgaacacacaatagctaagacccaaact

SEQ ID NO: 367 - DNA, 19 bp, Homo sapiens
atctgaacacacaatagct

SEQ ID NO: 368 - DNA, 22 bp, Homo sapiens
atctgaacacacaatagctaag

SEQ ID NO: 369 - DNA, 25 bp, Homo sapiens
atctgaacacacaatagctaagacc

SEQ ID NO: 370 - DNA, 26 bp, Homo sapiens
atctgaacacacaatagctaagaccc

SEQ ID NO: 371 - DNA, 27 bp, Homo sapiens
atctgaacacacaatagctaagaccca

SEQ ID NO: 372 - DNA, 31 bp, Homo sapiens
atctgaacacacaatagctaagacccaaact

SEQ ID NO: 373 - DNA, 24 bp, Homo sapiens
tctgaacacacaatagctaagacc

SEQ ID NO: 374 - DNA, 25 bp, Homo sapiens
tctgaacacacaatagctaagaccc

SEQ ID NO: 375 - DNA, 26 bp, Homo sapiens
tctgaacacacaatagctaagaccca

SEQ ID NO: 376 - DNA, 30 bp, Homo sapiens
tctgaacacacaatagctaagacccaaact

SEQ ID NO: 377 - DNA, 23 bp, Homo sapiens
ctgaacacacaatagctaagacc

SEQ ID NO: 378 - DNA, 24 bp, Homo sapiens
ctgaacacacaatagctaagaccc

SEQ ID NO: 379 - DNA, 22 bp, Homo sapiens
tgaacacacaatagctaagacc

SEQ ID NO: 380 - DNA, 23 bp, Homo sapiens
tgaacacacaatagctaagaccc

SEQ ID NO: 381 - DNA, 24 bp, Homo sapiens
tgaacacacaatagctaagaccca

SEQ ID NO: 382 - DNA, 28 bp, Homo sapiens
tgaacacacaatagctaagacccaaact

SEQ ID NO: 383 - DNA, 21 bp, Homo sapiens
gaacacacaatagctaagacc

SEQ ID NO: 384 - DNA, 22 bp, Homo sapiens
gaacacacaatagctaagaccc

SEQ ID NO: 385 - DNA, 16 bp, Homo sapiens
cacaatagctaagacc

SEQ ID NO: 386 - DNA, 17 bp, Homo sapiens
cacaatagctaagaccc

SEQ ID NO: 387 - DNA, 19 bp, Homo sapiens
caaactgggattagatacc

SEQ ID NO: 388 - DNA, 17 bp, Homo sapiens
aaactgggattagatac

SEQ ID NO: 389 - DNA, 18 bp, Homo sapiens
aaactgggattagatacc

SEQ ID NO: 390 - DNA, 16 bp, Homo sapiens
aactgggattagatac

SEQ ID NO: 391 - DNA, 17 bp, Homo sapiens
aactgggattagatacc

SEQ ID NO: 392 - DNA, 16 bp, Homo sapiens
actgggattagatacc

SEQ ID NO: 393 - DNA, 16 bp, Homo sapiens
cactatgcttagccct

SEQ ID NO: 394 - DNA, 21 bp, Homo sapiens
cactatgcttagccctaaacc

SEQ ID NO: 395 - DNA, 22 bp, Homo sapiens
cactatgcttagccctaaacct

SEQ ID NO: 396 - DNA, 20 bp, Homo sapiens
ctatgcttagccctaaacct

SEQ ID NO: 397 - DNA, 17 bp, Homo sapiens
atgcttagccctaaacc

SEQ ID NO: 398 - DNA, 18 bp, Homo sapiens
atgcttagccctaaacct

SEQ ID NO: 399 - DNA, 24 bp, Homo sapiens
gttaaatcaacaaaactgctcgcc

SEQ ID NO: 400 - DNA, 32 bp, Homo sapiens
gttaaatcaacaaaactgctcgccagaacact

SEQ ID NO: 401 - DNA, 29 bp, Homo sapiens
aaatcaacaaaactgctcgccagaacact

SEQ ID NO: 402 - DNA, 20 bp, Homo sapiens
aatcaacaaaactgctcgcc

SEQ ID NO: 403 - DNA, 28 bp, Homo sapiens
aatcaacaaaactgctcgccagaacact

SEQ ID NO: 404 - DNA, 27 bp, Homo sapiens
atcaacaaaactgctcgccagaacact

SEQ ID NO: 405 - DNA, 25 bp, Homo sapiens
caacaaaactgctcgccagaacact

SEQ ID NO: 406 - DNA, 16 bp, Homo sapiens
aacaaaactgctcgcc

SEQ ID NO: 407 - DNA, 24 bp, Homo sapiens
aacaaaactgctcgccagaacact

SEQ ID NO: 408 - DNA, 23 bp, Homo sapiens
acaaaactgctcgccagaacact

SEQ ID NO: 409 - DNA, 22 bp, Homo sapiens
caaaactgctcgccagaacact

SEQ ID NO: 410 - DNA, 20 bp, Homo sapiens
aaactgctcgccagaacact

SEQ ID NO: 411 - DNA, 33 bp, Homo sapiens
aaactgctcgccagaacactacgagccacagct

SEQ ID NO: 412 - DNA, 19 bp, Homo sapiens
aactgctcgccagaacact

SEQ ID NO: 413 - DNA, 17 bp, Homo sapiens
ctgctcgccagaacact

SEQ ID NO: 414 - DNA, 16 bp, Homo sapiens
tgctcgccagaacact

SEQ ID NO: 415 - DNA, 19 bp, Homo sapiens
cgccagaacactacgagcc

SEQ ID NO: 416 - DNA, 17 bp, Homo sapiens
ccagaacactacgagcc

SEQ ID NO: 417 - DNA, 30 bp, Homo sapiens
ccagaacactacgagccacagcttaaaact

SEQ ID NO: 418 - DNA, 16 bp, Homo sapiens
cagaacactacgagcc

SEQ ID NO: 419 - DNA, 22 bp, Homo sapiens
cagaacactacgagccacagct

SEQ ID NO: 420 - DNA, 24 bp, Homo sapiens
cagaacactacgagccacagctta

SEQ ID NO: 421 - DNA, 29 bp, Homo sapiens
cagaacactacgagccacagcttaaaact

SEQ ID NO: 422 - DNA, 21 bp, Homo sapiens
agaacactacgagccacagct

SEQ ID NO: 423 - DNA, 29 bp, Homo sapiens
agaacactacgagccacagcttaaaactc

SEQ ID NO: 424 - DNA, 28 bp, Homo sapiens
gaacactacgagccacagcttaaaactc

SEQ ID NO: 425 - DNA, 25 bp, Homo sapiens
cactacgagccacagcttaaaactc

SEQ ID NO: 426 - DNA, 24 bp, Homo sapiens
actacgagccacagcttaaaactc

SEQ ID NO: 427 - DNA, 23 bp, Homo sapiens
ctacgagccacagcttaaaactc

SEQ ID NO: 428 - DNA, 31 bp, Homo sapiens
ctacgagccacagcttaaaactcaaaggacc

SEQ ID NO: 429 - DNA, 32 bp, Homo sapiens
ctacgagccacagcttaaaactcaaaggacct

SEQ ID NO: 430 - DNA, 22 bp, Homo sapiens
tacgagccacagcttaaaactc

SEQ ID NO: 431 - DNA, 30 bp, Homo sapiens
tacgagccacagcttaaaactcaaaggacc

SEQ ID NO: 432 - DNA, 31 bp, Homo sapiens
tacgagccacagcttaaaactcaaaggacct

SEQ ID NO: 433 - DNA, 21 bp, Homo sapiens
acgagccacagcttaaaactc

SEQ ID NO: 434 - DNA, 29 bp, Homo sapiens
acgagccacagcttaaaactcaaaggacc

SEQ ID NO: 435 - DNA, 30 bp, Homo sapiens
acgagccacagcttaaaactcaaaggacct

SEQ ID NO: 436 - DNA, 20 bp, Homo sapiens
cgagccacagcttaaaactc

SEQ ID NO: 437 - DNA, 18 bp, Homo sapiens
agccacagcttaaaactc

SEQ ID NO: 438 - DNA, 27 bp, Homo sapiens
agccacagcttaaaactcaaaggacct

SEQ ID NO: 439 - DNA, 17 bp, Homo sapiens
gccacagcttaaaactc

SEQ ID NO: 440 - DNA, 16 bp, Homo sapiens
ccacagcttaaaactc

SEQ ID NO: 441 - DNA, 20 bp, Homo sapiens
gcttaaaactcaaaggacct

SEQ ID NO: 442 - DNA, 16 bp, Homo sapiens
taaaactcaaaggacc

SEQ ID NO: 443 - DNA, 17 bp, Homo sapiens
taaaactcaaaggacct

SEQ ID NO: 444 - DNA, 20 bp, Homo sapiens
taaaactcaaaggacctggc

SEQ ID NO: 445 - DNA, 26 bp, Homo sapiens
taaaactcaaaggacctggcggtgct

SEQ ID NO: 446 - DNA, 27 bp, Homo sapiens
taaaactcaaaggacctggcggtgctt

SEQ ID NO: 447 - DNA, 16 bp, Homo sapiens
aaaactcaaaggacct

SEQ ID NO: 448 - DNA, 25 bp, Homo sapiens
aaaactcaaaggacctggcggtgct

SEQ ID NO: 449 - DNA, 24 bp, Homo sapiens
aaactcaaaggacctggcggtgct

SEQ ID NO: 450 - DNA, 23 bp, Homo sapiens
aactcaaaggacctggcggtgct

SEQ ID NO: 451 - DNA, 24 bp, Homo sapiens
aactcaaaggacctggcggtgctt

SEQ ID NO: 452 - DNA, 22 bp, Homo sapiens
actcaaaggacctggcggtgct

SEQ ID NO: 453 - DNA, 32 bp, Homo sapiens
actcaaaggacctggcggtgcttcatatccct

SEQ ID NO: 454 - DNA, 21 bp, Homo sapiens
ctcaaaggacctggcggtgct

SEQ ID NO: 455 - DNA, 20 bp, Homo sapiens
tcaaaggacctggcggtgct

SEQ ID NO: 456 - DNA, 19 bp, Homo sapiens
caaaggacctggcggtgct

SEQ ID NO: 457 - DNA, 20 bp, Homo sapiens
caaaggacctggcggtgctt

SEQ ID NO: 458 - DNA, 28 bp, Homo sapiens
caaaggacctggcggtgcttcatatccc

SEQ ID NO: 459 - DNA, 29 bp, Homo sapiens
caaaggacctggcggtgcttcatatccct

SEQ ID NO: 460 - DNA, 32 bp, Homo sapiens
caaaggacctggcggtgcttcatatccctcta

SEQ ID NO: 461 - DNA, 33 bp, Homo sapiens
caaaggacctggcggtgcttcatatccctctag

SEQ ID NO: 462 - DNA, 18 bp, Homo sapiens
aaaggacctggcggtgct

SEQ ID NO: 463 - DNA, 27 bp, Homo sapiens
aaaggacctggcggtgcttcatatccc

SEQ ID NO: 464 - DNA, 28 bp, Homo sapiens
aaaggacctggcggtgcttcatatccct

SEQ ID NO: 465 - DNA, 32 bp, Homo sapiens
aaaggacctggcggtgcttcatatccctctag

SEQ ID NO: 466 - DNA, 17 bp, Homo sapiens
aaggacctggcggtgct

SEQ ID NO: 467 - DNA, 25 bp, Homo sapiens
aaggacctggcggtgcttcatatcc

SEQ ID NO: 468 - DNA, 26 bp, Homo sapiens
aaggacctggcggtgcttcatatccc

SEQ ID NO: 469 - DNA, 27 bp, Homo sapiens
aaggacctggcggtgcttcatatccct

SEQ ID NO: 470 - DNA, 29 bp, Homo sapiens
aaggacctggcggtgcttcatatccctct

SEQ ID NO: 471 - DNA, 31 bp, Homo sapiens
aaggacctggcggtgcttcatatccctctag

SEQ ID NO: 472 - DNA, 30 bp, Homo sapiens
tatccctctagaggagcctgttctgtaatc

SEQ ID NO: 473 - DNA, 27 bp, Homo sapiens
ccctctagaggagcctgttctgtaatc

SEQ ID NO: 474 - DNA, 23 bp, Homo sapiens
cctctagaggagcctgttctgta

SEQ ID NO: 475 - DNA, 26 bp, Homo sapiens
cctctagaggagcctgttctgtaatc

SEQ ID NO: 476 - DNA, 29 bp, Homo sapiens
cctctagaggagcctgttctgtaatcgat

SEQ ID NO: 477 - DNA, 30 bp, Homo sapiens
cctctagaggagcctgttctgtaatcgata

SEQ ID NO: 478 - DNA, 22 bp, Homo sapiens
ctctagaggagcctgttctgta

SEQ ID NO: 479 - DNA, 24 bp, Homo sapiens
ctctagaggagcctgttctgtaat

SEQ ID NO: 480 - DNA, 25 bp, Homo sapiens
ctctagaggagcctgttctgtaatc

SEQ ID NO: 481 - DNA, 26 bp, Homo sapiens
ctctagaggagcctgttctgtaatcg

SEQ ID NO: 482 - DNA, 28 bp, Homo sapiens
ctctagaggagcctgttctgtaatcgat

SEQ ID NO: 483 - DNA, 29 bp, Homo sapiens
ctctagaggagcctgttctgtaatcgata

SEQ ID NO: 484 - DNA, 30 bp, Homo sapiens
ctctagaggagcctgttctgtaatcgataa

SEQ ID NO: 485 - DNA, 33 bp, Homo sapiens
ctctagaggagcctgttctgtaatcgataaacc

SEQ ID NO: 486 - DNA, 17 bp, Homo sapiens
tctagaggagcctgttc

SEQ ID NO: 487 - DNA, 18 bp, Homo sapiens
tctagaggagcctgttct

SEQ ID NO: 488 - DNA, 21 bp, Homo sapiens
tctagaggagcctgttctgta

SEQ ID NO: 489 - DNA, 23 bp, Homo sapiens
tctagaggagcctgttctgtaat

SEQ ID NO: 490 - DNA, 24 bp, Homo sapiens
tctagaggagcctgttctgtaatc

SEQ ID NO: 491 - DNA, 25 bp, Homo sapiens
tctagaggagcctgttctgtaatcg

SEQ ID NO: 492 - DNA, 27 bp, Homo sapiens
tctagaggagcctgttctgtaatcgat

SEQ ID NO: 493 - DNA, 28 bp, Homo sapiens
tctagaggagcctgttctgtaatcgata

SEQ ID NO: 494 - DNA, 29 bp, Homo sapiens
tctagaggagcctgttctgtaatcgataa

SEQ ID NO: 495 - DNA, 32 bp, Homo sapiens
tctagaggagcctgttctgtaatcgataaacc

SEQ ID NO: 496 - DNA, 33 bp, Homo sapiens
tctagaggagcctgttctgtaatcgataaaccc

SEQ ID NO: 497 - DNA, 16 bp, Homo sapiens
ctagaggagcctgttc

SEQ ID NO: 498 - DNA, 20 bp, Homo sapiens
ctagaggagcctgttctgta

SEQ ID NO: 499 - DNA, 23 bp, Homo sapiens
ctagaggagcctgttctgtaatc

SEQ ID NO: 500 - DNA, 24 bp, Homo sapiens
ctagaggagcctgttctgtaatcg

SEQ ID NO: 501 - DNA, 26 bp, Homo sapiens
ctagaggagcctgttctgtaatcgat

SEQ ID NO: 502 - DNA, 27 bp, Homo sapiens
ctagaggagcctgttctgtaatcgata

SEQ ID NO: 503 - DNA, 28 bp, Homo sapiens
ctagaggagcctgttctgtaatcgataa

SEQ ID NO: 504 - DNA, 31 bp, Homo sapiens
ctagaggagcctgttctgtaatcgataaacc

SEQ ID NO: 505 - DNA, 32 bp, Homo sapiens
ctagaggagcctgttctgtaatcgataaaccc

SEQ ID NO: 506 - DNA, 33 bp, Homo sapiens
ctagaggagcctgttctgtaatcgataaacccc

SEQ ID NO: 507 - DNA, 19 bp, Homo sapiens
tagaggagcctgttctgta

SEQ ID NO: 508 - DNA, 22 bp, Homo sapiens
tagaggagcctgttctgtaatc

SEQ ID NO: 509 - DNA, 23 bp, Homo sapiens
tagaggagcctgttctgtaatcg

SEQ ID NO: 510 - DNA, 25 bp, Homo sapiens
tagaggagcctgttctgtaatcgat

SEQ ID NO: 511 - DNA, 26 bp, Homo sapiens
tagaggagcctgttctgtaatcgata

SEQ ID NO: 512 - DNA, 27 bp, Homo sapiens
tagaggagcctgttctgtaatcgataa

SEQ ID NO: 513 - DNA, 30 bp, Homo sapiens
tagaggagcctgttctgtaatcgataaacc

SEQ ID NO: 514 - DNA, 31 bp, Homo sapiens
tagaggagcctgttctgtaatcgataaaccc

SEQ ID NO: 515 - DNA, 32 bp, Homo sapiens
tagaggagcctgttctgtaatcgataaacccc

SEQ ID NO: 516 - DNA, 18 bp, Homo sapiens
agaggagcctgttctgta

SEQ ID NO: 517 - DNA, 20 bp, Homo sapiens
agaggagcctgttctgtaat

SEQ ID NO: 518 - DNA, 21 bp, Homo sapiens
agaggagcctgttctgtaatc

SEQ ID NO: 519 - DNA, 22 bp, Homo sapiens
agaggagcctgttctgtaatcg

SEQ ID NO: 520 - DNA, 24 bp, Homo sapiens
agaggagcctgttctgtaatcgat

SEQ ID NO: 521 - DNA, 25 bp, Homo sapiens
agaggagcctgttctgtaatcgata

SEQ ID NO: 522 - DNA, 26 bp, Homo sapiens
agaggagcctgttctgtaatcgataa

SEQ ID NO: 523 - DNA, 29 bp, Homo sapiens
agaggagcctgttctgtaatcgataaacc

SEQ ID NO: 524 - DNA, 30 bp, Homo sapiens
agaggagcctgttctgtaatcgataaaccc

SEQ ID NO: 525 - DNA, 31 bp, Homo sapiens
agaggagcctgttctgtaatcgataaacccc

SEQ ID NO: 526 - DNA, 17 bp, Homo sapiens
gaggagcctgttctgta

SEQ ID NO: 527 - DNA, 20 bp, Homo sapiens
gaggagcctgttctgtaatc

SEQ ID NO: 528 - DNA, 21 bp, Homo sapiens
gaggagcctgttctgtaatcg

SEQ ID NO: 529 - DNA, 23 bp, Homo sapiens
gaggagcctgttctgtaatcgat

SEQ ID NO: 530 - DNA, 24 bp, Homo sapiens
gaggagcctgttctgtaatcgata

SEQ ID NO: 531 - DNA, 25 bp, Homo sapiens
gaggagcctgttctgtaatcgataa

SEQ ID NO: 532 - DNA, 28 bp, Homo sapiens
gaggagcctgttctgtaatcgataaacc

SEQ ID NO: 533 - DNA, 29 bp, Homo sapiens
gaggagcctgttctgtaatcgataaaccc

SEQ ID NO: 534 - DNA, 30 bp, Homo sapiens
gaggagcctgttctgtaatcgataaacccc

SEQ ID NO: 535 - DNA, 19 bp, Homo sapiens
aggagcctgttctgtaatc

SEQ ID NO: 536 - DNA, 22 bp, Homo sapiens
aggagcctgttctgtaatcgat

SEQ ID NO: 537 - DNA, 23 bp, Homo sapiens
aggagcctgttctgtaatcgata

SEQ ID NO: 538 - DNA, 27 bp, Homo sapiens
aggagcctgttctgtaatcgataaacc

SEQ ID NO: 539 - DNA, 28 bp, Homo sapiens
aggagcctgttctgtaatcgataaaccc

SEQ ID NO: 540 - DNA, 29 bp, Homo sapiens
aggagcctgttctgtaatcgataaacccc

SEQ ID NO: 541 - DNA, 17 bp, Homo sapiens
gagcctgttctgtaatc

SEQ ID NO: 542 - DNA, 25 bp, Homo sapiens
gagcctgttctgtaatcgataaacc

SEQ ID NO: 543 - DNA, 26 bp, Homo sapiens
gagcctgttctgtaatcgataaaccc

SEQ ID NO: 544 - DNA, 27 bp, Homo sapiens
gagcctgttctgtaatcgataaacccc

SEQ ID NO: 545 - DNA, 28 bp, Homo sapiens
gagcctgttctgtaatcgataaaccccg

SEQ ID NO: 546 - DNA, 24 bp, Homo sapiens
agcctgttctgtaatcgataaacc

SEQ ID NO: 547 - DNA, 25 bp, Homo sapiens
agcctgttctgtaatcgataaaccc

SEQ ID NO: 548 - DNA, 26 bp, Homo sapiens
agcctgttctgtaatcgataaacccc

SEQ ID NO: 549 - DNA, 23 bp, Homo sapiens
gcctgttctgtaatcgataaacc

SEQ ID NO: 550 - DNA, 24 bp, Homo sapiens
gcctgttctgtaatcgataaaccc

SEQ ID NO: 551 - DNA, 25 bp, Homo sapiens
gcctgttctgtaatcgataaacccc

SEQ ID NO: 552 - DNA, 22 bp, Homo sapiens
cctgttctgtaatcgataaacc

SEQ ID NO: 553 - DNA, 23 bp, Homo sapiens
cctgttctgtaatcgataaaccc

SEQ ID NO: 554 - DNA, 21 bp, Homo sapiens
ctgttctgtaatcgataaacc

SEQ ID NO: 555 - DNA, 22 bp, Homo sapiens
ctgttctgtaatcgataaaccc

SEQ ID NO: 556 - DNA, 20 bp, Homo sapiens
tgttctgtaatcgataaacc

SEQ ID NO: 557 - DNA, 21 bp, Homo sapiens
tgttctgtaatcgataaaccc

SEQ ID NO: 558 - DNA, 22 bp, Homo sapiens
tgttctgtaatcgataaacccc

SEQ ID NO: 559 - DNA, 23 bp, Homo sapiens
tgttctgtaatcgataaaccccg

SEQ ID NO: 560 - DNA, 26 bp, Homo sapiens
tgttctgtaatcgataaaccccgatc

SEQ ID NO: 561 - DNA, 27 bp, Homo sapiens
tgttctgtaatcgataaaccccgatca

SEQ ID NO: 562 - DNA, 30 bp, Homo sapiens
tgttctgtaatcgataaaccccgatcaacc

SEQ ID NO: 563 - DNA, 31 bp, Homo sapiens
tgttctgtaatcgataaaccccgatcaacct

SEQ ID NO: 564 - DNA, 20 bp, Homo sapiens
gttctgtaatcgataaaccc

SEQ ID NO: 565 - DNA, 25 bp, Homo sapiens
gttctgtaatcgataaaccccgatc

SEQ ID NO: 566 - DNA, 26 bp, Homo sapiens
gttctgtaatcgataaaccccgatca

SEQ ID NO: 567 - DNA, 30 bp, Homo sapiens
ccgatcaacctcaccacctcttgctcagcc

SEQ ID NO: 568 - DNA, 31 bp, Homo sapiens
ccgatcaacctcaccacctcttgctcagcct

SEQ ID NO: 569 - DNA, 24 bp, Homo sapiens
cgatcaacctcaccacctcttgct

SEQ ID NO: 570 - DNA, 25 bp, Homo sapiens
cgatcaacctcaccacctcttgctc

SEQ ID NO: 571 - DNA, 26 bp, Homo sapiens
cgatcaacctcaccacctcttgctca

SEQ ID NO: 572 - DNA, 29 bp, Homo sapiens
cgatcaacctcaccacctcttgctcagcc

SEQ ID NO: 573 - DNA, 30 bp, Homo sapiens
cgatcaacctcaccacctcttgctcagcct

SEQ ID NO: 574 - DNA, 33 bp, Homo sapiens
cgatcaacctcaccacctcttgctcagcctata

SEQ ID NO: 575 - DNA, 28 bp, Homo sapiens
gatcaacctcaccacctcttgctcagcc

SEQ ID NO: 576 - DNA, 29 bp, Homo sapiens
gatcaacctcaccacctcttgctcagcct

SEQ ID NO: 577 - DNA, 27 bp, Homo sapiens
atcaacctcaccacctcttgctcagcc

SEQ ID NO: 578 - DNA, 28 bp, Homo sapiens
atcaacctcaccacctcttgctcagcct

SEQ ID NO: 579 - DNA, 31 bp, Homo sapiens
atcaacctcaccacctcttgctcagcctata

SEQ ID NO: 580 - DNA, 25 bp, Homo sapiens
caacctcaccacctcttgctcagcc

SEQ ID NO: 581 - DNA, 26 bp, Homo sapiens
caacctcaccacctcttgctcagcct

SEQ ID NO: 582 - DNA, 33 bp, Homo sapiens
caacctcaccacctcttgctcagcctatatacc

SEQ ID NO: 583 - DNA, 19 bp, Homo sapiens
aacctcaccacctcttgct

SEQ ID NO: 584 - DNA, 24 bp, Homo sapiens
aacctcaccacctcttgctcagcc

SEQ ID NO: 585 - DNA, 25 bp, Homo sapiens
aacctcaccacctcttgctcagcct

SEQ ID NO: 586 - DNA, 28 bp, Homo sapiens
aacctcaccacctcttgctcagcctata

SEQ ID NO: 587 - DNA, 32 bp, Homo sapiens
aacctcaccacctcttgctcagcctatatacc

SEQ ID NO: 588 - DNA, 33 bp, Homo sapiens
aacctcaccacctcttgctcagcctatataccg

SEQ ID NO: 589 - DNA, 23 bp, Homo sapiens
acctcaccacctcttgctcagcc

SEQ ID NO: 590 - DNA, 31 bp, Homo sapiens
acctcaccacctcttgctcagcctatatacc

SEQ ID NO: 591 - DNA, 32 bp, Homo sapiens
acctcaccacctcttgctcagcctatataccg

SEQ ID NO: 592 - DNA, 30 bp, Homo sapiens
cctcaccacctcttgctcagcctatatacc

SEQ ID NO: 593 - DNA, 29 bp, Homo sapiens
ctcaccacctcttgctcagcctatatacc

SEQ ID NO: 594 - DNA, 16 bp, Homo sapiens
tcaccacctcttgctc

SEQ ID NO: 595 - DNA, 20 bp, Homo sapiens
tcaccacctcttgctcagcc

SEQ ID NO: 596 - DNA, 21 bp, Homo sapiens
tcaccacctcttgctcagcct

SEQ ID NO: 597 - DNA, 24 bp, Homo sapiens
tcaccacctcttgctcagcctata

SEQ ID NO: 598 - DNA, 25 bp, Homo sapiens
tcaccacctcttgctcagcctatat

SEQ ID NO: 599 - DNA, 26 bp, Homo sapiens
tcaccacctcttgctcagcctatata

SEQ ID NO: 600 - DNA, 28 bp, Homo sapiens
tcaccacctcttgctcagcctatatacc

SEQ ID NO: 601 - DNA, 29 bp, Homo sapiens
tcaccacctcttgctcagcctatataccg

SEQ ID NO: 602 - DNA, 31 bp, Homo sapiens
tcaccacctcttgctcagcctatataccgcc

SEQ ID NO: 603 - DNA, 20 bp, Homo sapiens
caccacctcttgctcagcct

SEQ ID NO: 604 - DNA, 27 bp, Homo sapiens
caccacctcttgctcagcctatatacc

SEQ ID NO: 605 - DNA, 19 bp, Homo sapiens
cttgctcagcctatatacc

SEQ ID NO: 606 - DNA, 20 bp, Homo sapiens
tatataccgccatcttcagc

SEQ ID NO: 607 - DNA, 33 bp, Homo sapiens
ctgatgaaggctacaaagtaagcgcaagtaccc

SEQ ID NO: 608 - DNA, 17 bp, Homo sapiens
aagtaagcgcaagtacc

SEQ ID NO: 609 - DNA, 18 bp, Homo sapiens
aagtaagcgcaagtaccc

SEQ ID NO: 610 - DNA, 28 bp, Homo sapiens
aagtaagcgcaagtacccacgtaaagac

SEQ ID NO: 611 - DNA, 23 bp, Homo sapiens
agcgcaagtacccacgtaaagac

SEQ ID NO: 612 - DNA, 19 bp, Homo sapiens
caagtacccacgtaaagac

SEQ ID NO: 613 - DNA, 17 bp, Homo sapiens
agtacccacgtaaagac

SEQ ID NO: 614 - DNA, 19 bp, Homo sapiens
cacgtaaagacgttaggtc

SEQ ID NO: 615 - DNA, 22 bp, Homo sapiens
cacgtaaagacgttaggtcaag

SEQ ID NO: 616 - DNA, 30 bp, Homo sapiens
cacgtaaagacgttaggtcaaggtgtagcc

SEQ ID NO: 617 - DNA, 31 bp, Homo sapiens
cacgtaaagacgttaggtcaaggtgtagccc

SEQ ID NO: 618 - DNA, 18 bp, Homo sapiens
acgtaaagacgttaggtc

SEQ ID NO: 619 - DNA, 27 bp, Homo sapiens
acgtaaagacgttaggtcaaggtgtag

SEQ ID NO: 620 - DNA, 29 bp, Homo sapiens
acgtaaagacgttaggtcaaggtgtagcc

SEQ ID NO: 621 - DNA, 30 bp, Homo sapiens
acgtaaagacgttaggtcaaggtgtagccc

SEQ ID NO: 622 - DNA, 28 bp, Homo sapiens
cgtaaagacgttaggtcaaggtgtagcc

SEQ ID NO: 623 - DNA, 29 bp, Homo sapiens
cgtaaagacgttaggtcaaggtgtagccc

SEQ ID NO: 624 - DNA, 25 bp, Homo sapiens
gtaaagacgttaggtcaaggtgtag

SEQ ID NO: 625 - DNA, 27 bp, Homo sapiens
gtaaagacgttaggtcaaggtgtagcc

SEQ ID NO: 626 - DNA, 28 bp, Homo sapiens
gtaaagacgttaggtcaaggtgtagccc

SEQ ID NO: 627 - DNA, 23 bp, Homo sapiens
taaagacgttaggtcaaggtgta

SEQ ID NO: 628 - DNA, 24 bp, Homo sapiens
taaagacgttaggtcaaggtgtag

SEQ ID NO: 629 - DNA, 25 bp, Homo sapiens
taaagacgttaggtcaaggtgtagc

SEQ ID NO: 630 - DNA, 26 bp, Homo sapiens
taaagacgttaggtcaaggtgtagcc

SEQ ID NO: 631 - DNA, 27 bp, Homo sapiens
taaagacgttaggtcaaggtgtagccc

SEQ ID NO: 632 - DNA, 33 bp, Homo sapiens
taaagacgttaggtcaaggtgtagcccatgagg

SEQ ID NO: 633 - DNA, 25 bp, Homo sapiens
aaagacgttaggtcaaggtgtagcc

SEQ ID NO: 634 - DNA, 24 bp, Homo sapiens
aagacgttaggtcaaggtgtagcc

SEQ ID NO: 635 - DNA, 25 bp, Homo sapiens
aagacgttaggtcaaggtgtagccc

SEQ ID NO: 636 - DNA, 23 bp, Homo sapiens
agacgttaggtcaaggtgtagcc

SEQ ID NO: 637 - DNA, 22 bp, Homo sapiens
gacgttaggtcaaggtgtagcc

SEQ ID NO: 638 - DNA, 23 bp, Homo sapiens
gacgttaggtcaaggtgtagccc

SEQ ID NO: 639 - DNA, 21 bp, Homo sapiens
acgttaggtcaaggtgtagcc

SEQ ID NO: 640 - DNA, 22 bp, Homo sapiens
acgttaggtcaaggtgtagccc

SEQ ID NO: 641 - DNA, 20 bp, Homo sapiens
cgttaggtcaaggtgtagcc

SEQ ID NO: 642 - DNA, 19 bp, Homo sapiens
gttaggtcaaggtgtagcc

SEQ ID NO: 643 - DNA, 20 bp, Homo sapiens
gttaggtcaaggtgtagccc

SEQ ID NO: 644 - DNA, 18 bp, Homo sapiens
ttaggtcaaggtgtagcc

SEQ ID NO: 645 - DNA, 20 bp, Homo sapiens
aatgggctacattttctacc

SEQ ID NO: 646 - DNA, 19 bp, Homo sapiens
atgggctacattttctacc

SEQ ID NO: 647 - DNA, 20 bp, Homo sapiens
cagaaaactacgatagccct

SEQ ID NO: 648 - DNA, 29 bp, Homo sapiens
cagaaaactacgatagcccttatgaaact

SEQ ID NO: 649 - DNA, 28 bp, Homo sapiens
agaaaactacgatagcccttatgaaact

SEQ ID NO: 650 - DNA, 24 bp, Homo sapiens
aactacgatagcccttatgaaact

SEQ ID NO: 651 - DNA, 21 bp, Homo sapiens
tacgatagcccttatgaaact

SEQ ID NO: 652 - DNA, 20 bp, Homo sapiens
acgatagcccttatgaaact

SEQ ID NO: 653 - DNA, 19 bp, Homo sapiens
cgatagcccttatgaaact

SEQ ID NO: 654 - DNA, 29 bp, Homo sapiens
agagtagagtgcttagttgaacagggccc

SEQ ID NO: 655 - DNA, 30 bp, Homo sapiens
agagtagagtgcttagttgaacagggccct

SEQ ID NO: 656 - DNA, 27 bp, Homo sapiens
gagtagagtgcttagttgaacagggcc

SEQ ID NO: 657 - DNA, 28 bp, Homo sapiens
gagtagagtgcttagttgaacagggccc

SEQ ID NO: 658 - DNA, 29 bp, Homo sapiens
gagtagagtgcttagttgaacagggccct

SEQ ID NO: 659 - DNA, 33 bp, Homo sapiens
gagtagagtgcttagttgaacagggccctgaag

SEQ ID NO: 660 - DNA, 26 bp, Homo sapiens
agtagagtgcttagttgaacagggcc

SEQ ID NO: 661 - DNA, 27 bp, Homo sapiens
agtagagtgcttagttgaacagggccc

SEQ ID NO: 662 - DNA, 28 bp, Homo sapiens
agtagagtgcttagttgaacagggccct

SEQ ID NO: 663 - DNA, 26 bp, Homo sapiens
gtagagtgcttagttgaacagggccc

SEQ ID NO: 664 - DNA, 27 bp, Homo sapiens
gtagagtgcttagttgaacagggccct

SEQ ID NO: 665 - DNA, 25 bp, Homo sapiens
tagagtgcttagttgaacagggccc

SEQ ID NO: 666 - DNA, 26 bp, Homo sapiens
tagagtgcttagttgaacagggccct

SEQ ID NO: 667 - DNA, 23 bp, Homo sapiens
gagtgcttagttgaacagggccc

SEQ ID NO: 668 - DNA, 24 bp, Homo sapiens
gagtgcttagttgaacagggccct

SEQ ID NO: 669 - DNA, 23 bp, Homo sapiens
agtgcttagttgaacagggccct

SEQ ID NO: 670 - DNA, 22 bp, Homo sapiens
gtgcttagttgaacagggccct

SEQ ID NO: 671 - DNA, 26 bp, Homo sapiens
gtgcttagttgaacagggccctgaag

SEQ ID NO: 672 - DNA, 25 bp, Homo sapiens
tgcttagttgaacagggccctgaag

SEQ ID NO: 673 - DNA, 17 bp, Homo sapiens
cttagttgaacagggcc

SEQ ID NO: 674 - DNA, 18 bp, Homo sapiens
cttagttgaacagggccc

SEQ ID NO: 675 - DNA, 19 bp, Homo sapiens
cttagttgaacagggccct

SEQ ID NO: 676 - DNA, 23 bp, Homo sapiens
cttagttgaacagggccctgaag

SEQ ID NO: 677 - DNA, 22 bp, Homo sapiens
ttagttgaacagggccctgaag

SEQ ID NO: 678 - DNA, 16 bp, Homo sapiens
tagttgaacagggccc

SEQ ID NO: 679 - DNA, 17 bp, Homo sapiens
tagttgaacagggccct

SEQ ID NO: 680 - DNA, 20 bp, Homo sapiens
tagttgaacagggccctgaa

SEQ ID NO: 681 - DNA, 21 bp, Homo sapiens
tagttgaacagggccctgaag

SEQ ID NO: 682 - DNA, 22 bp, Homo sapiens
tagttgaacagggccctgaagc

SEQ ID NO: 683 - DNA, 16 bp, Homo sapiens
agttgaacagggccct

SEQ ID NO: 684 - DNA, 28 bp, Homo sapiens
gaacagggccctgaagcgcgtacacacc

SEQ ID NO: 685 - DNA, 27 bp, Homo sapiens
aacagggccctgaagcgcgtacacacc

SEQ ID NO: 686 - DNA, 31 bp, Homo sapiens
cgtcaccctcctcaagtatacttcaaaggac

SEQ ID NO: 687 - DNA, 30 bp, Homo sapiens
gtcaccctcctcaagtatacttcaaaggac

SEQ ID NO: 688 - DNA, 25 bp, Homo sapiens
ctcctcaagtatacttcaaaggaca

SEQ ID NO: 689 - DNA, 32 bp, Homo sapiens
ctcctcaagtatacttcaaaggacatttaact

SEQ ID NO: 690 - DNA, 29 bp, Homo sapiens
ctcaagtatacttcaaaggacatttaact

SEQ ID NO: 691 - DNA, 28 bp, Homo sapiens
tcaagtatacttcaaaggacatttaact

SEQ ID NO: 692 - DNA, 20 bp, Homo sapiens
caagtatacttcaaaggaca

SEQ ID NO: 693 - DNA, 22 bp, Homo sapiens
caagtatacttcaaaggacatt

SEQ ID NO: 694 - DNA, 27 bp, Homo sapiens
caagtatacttcaaaggacatttaact

SEQ ID NO: 695 - DNA, 33 bp, Homo sapiens
caagtatacttcaaaggacatttaactaaaacc

SEQ ID NO: 696 - DNA, 21 bp, Homo sapiens
aagtatacttcaaaggacatt

SEQ ID NO: 697 - DNA, 26 bp, Homo sapiens
aagtatacttcaaaggacatttaact

SEQ ID NO: 698 - DNA, 32 bp, Homo sapiens
aagtatacttcaaaggacatttaactaaaacc

SEQ ID NO: 699 - DNA, 33 bp, Homo sapiens
aagtatacttcaaaggacatttaactaaaaccc

SEQ ID NO: 700 - DNA, 17 bp, Homo sapiens
agtatacttcaaaggac

SEQ ID NO: 701 - DNA, 18 bp, Homo sapiens
agtatacttcaaaggaca

SEQ ID NO: 702 - DNA, 20 bp, Homo sapiens
agtatacttcaaaggacatt

SEQ ID NO: 703 - DNA, 25 bp, Homo sapiens
agtatacttcaaaggacatttaact

SEQ ID NO: 704 - DNA, 26 bp, Homo sapiens
agtatacttcaaaggacatttaacta

SEQ ID NO: 705 - DNA, 31 bp, Homo sapiens
agtatacttcaaaggacatttaactaaaacc

SEQ ID NO: 706 - DNA, 32 bp, Homo sapiens
agtatacttcaaaggacatttaactaaaaccc

SEQ ID NO: 707 - DNA, 33 bp, Homo sapiens
agtatacttcaaaggacatttaactaaaacccc

SEQ ID NO: 708 - DNA, 24 bp, Homo sapiens
gtatacttcaaaggacatttaact

SEQ ID NO: 709 - DNA, 30 bp, Homo sapiens
gtatacttcaaaggacatttaactaaaacc

SEQ ID NO: 710 - DNA, 23 bp, Homo sapiens
tatacttcaaaggacatttaact

SEQ ID NO: 711 - DNA, 29 bp, Homo sapiens
tatacttcaaaggacatttaactaaaacc

SEQ ID NO: 712 - DNA, 30 bp, Homo sapiens
tatacttcaaaggacatttaactaaaaccc

SEQ ID NO: 713 - DNA, 22 bp, Homo sapiens
atacttcaaaggacatttaact

SEQ ID NO: 714 - DNA, 28 bp, Homo sapiens
atacttcaaaggacatttaactaaaacc

SEQ ID NO: 715 - DNA, 29 bp, Homo sapiens
atacttcaaaggacatttaactaaaaccc

SEQ ID NO: 716 - DNA, 21 bp, Homo sapiens
tacttcaaaggacatttaact

SEQ ID NO: 717 - DNA, 27 bp, Homo sapiens
tacttcaaaggacatttaactaaaacc

SEQ ID NO: 718 - DNA, 28 bp, Homo sapiens
tacttcaaaggacatttaactaaaaccc

SEQ ID NO: 719 - DNA, 30 bp, Homo sapiens
tacttcaaaggacatttaactaaaacccct

SEQ ID NO: 720 - DNA, 20 bp, Homo sapiens
acttcaaaggacatttaact

SEQ ID NO: 721 - DNA, 26 bp, Homo sapiens
acttcaaaggacatttaactaaaacc

SEQ ID NO: 722 - DNA, 27 bp, Homo sapiens
acttcaaaggacatttaactaaaaccc

SEQ ID NO: 723 - DNA, 19 bp, Homo sapiens
cttcaaaggacatttaact

SEQ ID NO: 724 - DNA, 25 bp, Homo sapiens
cttcaaaggacatttaactaaaacc

SEQ ID NO: 725 - DNA, 26 bp, Homo sapiens
cttcaaaggacatttaactaaaaccc

SEQ ID NO: 726 - DNA, 18 bp, Homo sapiens
ttcaaaggacatttaact

SEQ ID NO: 727 - DNA, 24 bp, Homo sapiens
ttcaaaggacatttaactaaaacc

SEQ ID NO: 728 - DNA, 25 bp, Homo sapiens
ttcaaaggacatttaactaaaaccc

SEQ ID NO: 729 - DNA, 17 bp, Homo sapiens
tcaaaggacatttaact

SEQ ID NO: 730 - DNA, 23 bp, Homo sapiens
tcaaaggacatttaactaaaacc

SEQ ID NO: 731 - DNA, 24 bp, Homo sapiens
tcaaaggacatttaactaaaaccc

SEQ ID NO: 732 - DNA, 25 bp, Homo sapiens
tcaaaggacatttaactaaaacccc

SEQ ID NO: 733 - DNA, 16 bp, Homo sapiens
caaaggacatttaact

SEQ ID NO: 734 - DNA, 22 bp, Homo sapiens
caaaggacatttaactaaaacc

SEQ ID NO: 735 - DNA, 23 bp, Homo sapiens
caaaggacatttaactaaaaccc

SEQ ID NO: 736 - DNA, 24 bp, Homo sapiens
caaaggacatttaactaaaacccc

SEQ ID NO: 737 - DNA, 25 bp, Homo sapiens
caaaggacatttaactaaaacccct

SEQ ID NO: 738 - DNA, 21 bp, Homo sapiens
aaaggacatttaactaaaacc

SEQ ID NO: 739 - DNA, 22 bp, Homo sapiens
aaaggacatttaactaaaaccc

SEQ ID NO: 740 - DNA, 23 bp, Homo sapiens
aaaggacatttaactaaaacccc

SEQ ID NO: 741 - DNA, 24 bp, Homo sapiens
aaaggacatttaactaaaacccct

SEQ ID NO: 742 - DNA, 20 bp, Homo sapiens
aaggacatttaactaaaacc

SEQ ID NO: 743 - DNA, 21 bp, Homo sapiens
aaggacatttaactaaaaccc

SEQ ID NO: 744 - DNA, 22 bp, Homo sapiens
aaggacatttaactaaaacccc

SEQ ID NO: 745 - DNA, 23 bp, Homo sapiens
aaggacatttaactaaaacccct

SEQ ID NO: 746 - DNA, 19 bp, Homo sapiens
aggacatttaactaaaacc

SEQ ID NO: 747 - DNA, 20 bp, Homo sapiens
aggacatttaactaaaaccc

SEQ ID NO: 748 - DNA, 21 bp, Homo sapiens
aggacatttaactaaaacccc

SEQ ID NO: 749 - DNA, 22 bp, Homo sapiens
aggacatttaactaaaacccct

SEQ ID NO: 750 - DNA, 24 bp, Homo sapiens
cctacgcatttatatagaggagac

SEQ ID NO: 751 - DNA, 29 bp, Homo sapiens
cctacgcatttatatagaggagacaagtc

SEQ ID NO: 752 - DNA, 32 bp, Homo sapiens
cctacgcatttatatagaggagacaagtcgta

SEQ ID NO: 753 - DNA, 23 bp, Homo sapiens
ctacgcatttatatagaggagac

SEQ ID NO: 754 - DNA, 24 bp, Homo sapiens
ctacgcatttatatagaggagaca

SEQ ID NO: 755 - DNA, 28 bp, Homo sapiens
ctacgcatttatatagaggagacaagtc

SEQ ID NO: 756 - DNA, 31 bp, Homo sapiens
ctacgcatttatatagaggagacaagtcgta

SEQ ID NO: 757 - DNA, 33 bp, Homo sapiens
ctacgcatttatatagaggagacaagtcgtaac

SEQ ID NO: 758 - DNA, 22 bp, Homo sapiens
tacgcatttatatagaggagac

SEQ ID NO: 759 - DNA, 23 bp, Homo sapiens
tacgcatttatatagaggagaca

SEQ ID NO: 760 - DNA, 27 bp, Homo sapiens
tacgcatttatatagaggagacaagtc

SEQ ID NO: 761 - DNA, 32 bp, Homo sapiens
tacgcatttatatagaggagacaagtcgtaac

SEQ ID NO: 762 - DNA, 33 bp, Homo sapiens
tacgcatttatatagaggagacaagtcgtaaca

SEQ ID NO: 763 - DNA, 21 bp, Homo sapiens
acgcatttatatagaggagac

SEQ ID NO: 764 - DNA, 22 bp, Homo sapiens
acgcatttatatagaggagaca

SEQ ID NO: 765 - DNA, 26 bp, Homo sapiens
acgcatttatatagaggagacaagtc

SEQ ID NO: 766 - DNA, 30 bp, Homo sapiens
cgcatttatatagaggagacaagtcgtaac

SEQ ID NO: 767 - DNA, 31 bp, Homo sapiens
cgcatttatatagaggagacaagtcgtaaca

SEQ ID NO: 768 - DNA, 33 bp, Homo sapiens
cgcatttatatagaggagacaagtcgtaacatg

SEQ ID NO: 769 - DNA, 29 bp, Homo sapiens
gcatttatatagaggagacaagtcgtaac

SEQ ID NO: 770 - DNA, 30 bp, Homo sapiens
gcatttatatagaggagacaagtcgtaaca

SEQ ID NO: 771 - DNA, 32 bp, Homo sapiens
gcatttatatagaggagacaagtcgtaacatg

SEQ ID NO: 772 - DNA, 23 bp, Homo sapiens
catttatatagaggagacaagtc

SEQ ID NO: 773 - DNA, 28 bp, Homo sapiens
catttatatagaggagacaagtcgtaac

SEQ ID NO: 774 - DNA, 29 bp, Homo sapiens
catttatatagaggagacaagtcgtaaca

SEQ ID NO: 775 - DNA, 31 bp, Homo sapiens
catttatatagaggagacaagtcgtaacatg

SEQ ID NO: 776 - DNA, 28 bp, Homo sapiens
atttatatagaggagacaagtcgtaaca

SEQ ID NO: 777 - DNA, 16 bp, Homo sapiens
tttatatagaggagac

SEQ ID NO: 778 - DNA, 17 bp, Homo sapiens
tttatatagaggagaca

SEQ ID NO: 779 - DNA, 21 bp, Homo sapiens
tttatatagaggagacaagtc

SEQ ID NO: 780 - DNA, 24 bp, Homo sapiens
tttatatagaggagacaagtcgta

SEQ ID NO: 781 - DNA, 26 bp, Homo sapiens
tttatatagaggagacaagtcgtaac

SEQ ID NO: 782 - DNA, 27 bp, Homo sapiens
tttatatagaggagacaagtcgtaaca

SEQ ID NO: 783 - DNA, 28 bp, Homo sapiens
tttatatagaggagacaagtcgtaacat

SEQ ID NO: 784 - DNA, 29 bp, Homo sapiens
tttatatagaggagacaagtcgtaacatg

SEQ ID NO: 785 - DNA, 25 bp, Homo sapiens
ttatatagaggagacaagtcgtaac

SEQ ID NO: 786 - DNA, 26 bp, Homo sapiens
ttatatagaggagacaagtcgtaaca

SEQ ID NO: 787 - DNA, 28 bp, Homo sapiens
ttatatagaggagacaagtcgtaacatg

SEQ ID NO: 788 - DNA, 19 bp, Homo sapiens
tatatagaggagacaagtc

SEQ ID NO: 789 - DNA, 24 bp, Homo sapiens
tatatagaggagacaagtcgtaac

SEQ ID NO: 790 - DNA, 25 bp, Homo sapiens
tatatagaggagacaagtcgtaaca

SEQ ID NO: 791 - DNA, 27 bp, Homo sapiens
tatatagaggagacaagtcgtaacatg

SEQ ID NO: 792 - DNA, 18 bp, Homo sapiens
atatagaggagacaagtc

SEQ ID NO: 793 - DNA, 23 bp, Homo sapiens
atatagaggagacaagtcgtaac

SEQ ID NO: 794 - DNA, 24 bp, Homo sapiens
atatagaggagacaagtcgtaaca

SEQ ID NO: 795 - DNA, 26 bp, Homo sapiens
atatagaggagacaagtcgtaacatg

SEQ ID NO: 796 - DNA, 17 bp, Homo sapiens
tatagaggagacaagtc

SEQ ID NO: 797 - DNA, 22 bp, Homo sapiens
tatagaggagacaagtcgtaac

SEQ ID NO: 798 - DNA, 23 bp, Homo sapiens
tatagaggagacaagtcgtaaca

SEQ ID NO: 799 - DNA, 25 bp, Homo sapiens
tatagaggagacaagtcgtaacatg

SEQ ID NO: 800 - DNA, 16 bp, Homo sapiens
atagaggagacaagtc

SEQ ID NO: 801 - DNA, 21 bp, Homo sapiens
atagaggagacaagtcgtaac

SEQ ID NO: 802 - DNA, 22 bp, Homo sapiens
atagaggagacaagtcgtaaca

SEQ ID NO: 803 - DNA, 24 bp, Homo sapiens
atagaggagacaagtcgtaacatg

SEQ ID NO: 804 - DNA, 20 bp, Homo sapiens
tagaggagacaagtcgtaac

SEQ ID NO: 805 - DNA, 21 bp, Homo sapiens
tagaggagacaagtcgtaaca

SEQ ID NO: 806 - DNA, 23 bp, Homo sapiens
tagaggagacaagtcgtaacatg

SEQ ID NO: 807 - DNA, 33 bp, Homo sapiens
tagaggagacaagtcgtaacatggtaagtgtac

SEQ ID NO: 808 - DNA, 19 bp, Homo sapiens
agaggagacaagtcgtaac

SEQ ID NO: 809 - DNA, 20 bp, Homo sapiens
agaggagacaagtcgtaaca

SEQ ID NO: 810 - DNA, 22 bp, Homo sapiens
agaggagacaagtcgtaacatg

SEQ ID NO: 811 - DNA, 18 bp, Homo sapiens
gaggagacaagtcgtaac

SEQ ID NO: 812 - DNA, 19 bp, Homo sapiens
gaggagacaagtcgtaaca

SEQ ID NO: 813 - DNA, 32 bp, Homo sapiens
cgtaacatggtaagtgtactggaaagtgcact

SEQ ID NO: 814 - DNA, 33 bp, Homo sapiens
acatggtaagtgtactggaaagtgcacttggac

SEQ ID NO: 815 - DNA, 33 bp, Homo sapiens
catggtaagtgtactggaaagtgcacttggacg

SEQ ID NO: 816 - DNA, 21 bp, Homo sapiens
tactggaaagtgcacttggac

SEQ ID NO: 817 - DNA, 22 bp, Homo sapiens
tactggaaagtgcacttggacg

SEQ ID NO: 818 - DNA, 20 bp, Homo sapiens
actggaaagtgcacttggac

SEQ ID NO: 819 - DNA, 21 bp, Homo sapiens
actggaaagtgcacttggacg

SEQ ID NO: 820 - DNA, 19 bp, Homo sapiens
ctggaaagtgcacttggac

SEQ ID NO: 821 - DNA, 23 bp, Homo sapiens
ctggaaagtgcacttggacgaac

SEQ ID NO: 822 - DNA, 17 bp, Homo sapiens
ggaaagtgcacttggac

SEQ ID NO: 823 - DNA, 18 bp, Homo sapiens
ggaaagtgcacttggacg

SEQ ID NO: 824 - DNA, 20 bp, Homo sapiens
gctaaacctagccccaaacc

SEQ ID NO: 825 - DNA, 21 bp, Homo sapiens
gctaaacctagccccaaaccc

SEQ ID NO: 826 - DNA, 22 bp, Homo sapiens
gctaaacctagccccaaaccca

SEQ ID NO: 827 - DNA, 23 bp, Homo sapiens
gctaaacctagccccaaacccac

SEQ ID NO: 828 - DNA, 24 bp, Homo sapiens
gctaaacctagccccaaacccact

SEQ ID NO: 829 - DNA, 26 bp, Homo sapiens
gctaaacctagccccaaacccactcc

SEQ ID NO: 830 - DNA, 27 bp, Homo sapiens
gctaaacctagccccaaacccactcca

SEQ ID NO: 831 - DNA, 29 bp, Homo sapiens
gctaaacctagccccaaacccactccacc

SEQ ID NO: 832 - DNA, 30 bp, Homo sapiens
gctaaacctagccccaaacccactccacct

SEQ ID NO: 833 - DNA, 31 bp, Homo sapiens
gctaaacctagccccaaacccactccacctt

SEQ ID NO: 834 - DNA, 32 bp, Homo sapiens
gctaaacctagccccaaacccactccacctta

SEQ ID NO: 835 - DNA, 33 bp, Homo sapiens
gctaaacctagccccaaacccactccaccttac

SEQ ID NO: 836 - DNA, 21 bp, Homo sapiens
tagccccaaacccactccacc

SEQ ID NO: 837 - DNA, 29 bp, Homo sapiens
tagccccaaacccactccaccttactacc

SEQ ID NO: 838 - DNA, 33 bp, Homo sapiens
tagccccaaacccactccaccttactaccagac

SEQ ID NO: 839 - DNA, 20 bp, Homo sapiens
agccccaaacccactccacc

SEQ ID NO: 840 - DNA, 28 bp, Homo sapiens
agccccaaacccactccaccttactacc

SEQ ID NO: 841 - DNA, 23 bp, Homo sapiens
caaacccactccaccttactacc

SEQ ID NO: 842 - DNA, 22 bp, Homo sapiens
aaacccactccaccttactacc

SEQ ID NO: 843 - DNA, 23 bp, Homo sapiens
aaacccactccaccttactacca

SEQ ID NO: 844 - DNA, 26 bp, Homo sapiens
aaacccactccaccttactaccagac

SEQ ID NO: 845 - DNA, 30 bp, Homo sapiens
aaacccactccaccttactaccagacaacc

SEQ ID NO: 846 - DNA, 31 bp, Homo sapiens
aaacccactccaccttactaccagacaacct

SEQ ID NO: 847 - DNA, 21 bp, Homo sapiens
aacccactccaccttactacc

SEQ ID NO: 848 - DNA, 22 bp, Homo sapiens
aacccactccaccttactacca

SEQ ID NO: 849 - DNA, 25 bp, Homo sapiens
aacccactccaccttactaccagac

SEQ ID NO: 850 - DNA, 29 bp, Homo sapiens
aacccactccaccttactaccagacaacc

SEQ ID NO: 851 - DNA, 30 bp, Homo sapiens
aacccactccaccttactaccagacaacct

SEQ ID NO: 852 - DNA, 17 bp, Homo sapiens
cactccaccttactacc

SEQ ID NO: 853 - DNA, 25 bp, Homo sapiens
cactccaccttactaccagacaacc

SEQ ID NO: 854 - DNA, 31 bp, Homo sapiens
cactccaccttactaccagacaaccttagcc

SEQ ID NO: 855 - DNA, 16 bp, Homo sapiens
actccaccttactacc

SEQ ID NO: 856 - DNA, 30 bp, Homo sapiens
actccaccttactaccagacaaccttagcc

SEQ ID NO: 857 - DNA, 26 bp, Homo sapiens
caccttactaccagacaaccttagcc

SEQ ID NO: 858 - DNA, 31 bp, Homo sapiens
caccttactaccagacaaccttagccaaacc

SEQ ID NO: 859 - DNA, 25 bp, Homo sapiens
accttactaccagacaaccttagcc

SEQ ID NO: 860 - DNA, 30 bp, Homo sapiens
accttactaccagacaaccttagccaaacc

SEQ ID NO: 861 - DNA, 24 bp, Homo sapiens
ccttactaccagacaaccttagcc

SEQ ID NO: 862 - DNA, 29 bp, Homo sapiens
ccttactaccagacaaccttagccaaacc

SEQ ID NO: 863 - DNA, 28 bp, Homo sapiens
cttactaccagacaaccttagccaaacc

SEQ ID NO: 864 - DNA, 22 bp, Homo sapiens
ttactaccagacaaccttagcc

SEQ ID NO: 865 - DNA, 27 bp, Homo sapiens
ttactaccagacaaccttagccaaacc

SEQ ID NO: 866 - DNA, 21 bp, Homo sapiens
tactaccagacaaccttagcc

SEQ ID NO: 867 - DNA, 26 bp, Homo sapiens
tactaccagacaaccttagccaaacc

SEQ ID NO: 868 - DNA, 33 bp, Homo sapiens
tactaccagacaaccttagccaaaccatttacc

SEQ ID NO: 869 - DNA, 25 bp, Homo sapiens
actaccagacaaccttagccaaacc

SEQ ID NO: 870 - DNA, 24 bp, Homo sapiens
ctaccagacaaccttagccaaacc

SEQ ID NO: 871 - DNA, 26 bp, Homo sapiens
agacaaccttagccaaaccatttacc

SEQ ID NO: 872 - DNA, 27 bp, Homo sapiens
agacaaccttagccaaaccatttaccc

SEQ ID NO: 873 - DNA, 28 bp, Homo sapiens
agacaaccttagccaaaccatttaccca

SEQ ID NO: 874 - DNA, 23 bp, Homo sapiens
aaccttagccaaaccatttaccc

SEQ ID NO: 875 - DNA, 19 bp, Homo sapiens
ttagccaaaccatttaccc

SEQ ID NO: 876 - DNA, 20 bp, Homo sapiens
ttagccaaaccatttaccca

SEQ ID NO: 877 - DNA, 33 bp, Homo sapiens
cccaaataaagtataggcgatagaaattgaaac

SEQ ID NO: 878 - DNA, 32 bp, Homo sapiens
ccaaataaagtataggcgatagaaattgaaac

SEQ ID NO: 879 - DNA, 33 bp, Homo sapiens
ccaaataaagtataggcgatagaaattgaaacc

SEQ ID NO: 880 - DNA, 26 bp, Homo sapiens
caaataaagtataggcgatagaaatt

SEQ ID NO: 881 - DNA, 32 bp, Homo sapiens
caaataaagtataggcgatagaaattgaaacc

SEQ ID NO: 882 - DNA, 33 bp, Homo sapiens
caaataaagtataggcgatagaaattgaaacct

SEQ ID NO: 883 - DNA, 25 bp, Homo sapiens
aaataaagtataggcgatagaaatt

SEQ ID NO: 884 - DNA, 30 bp, Homo sapiens
aaataaagtataggcgatagaaattgaaac

SEQ ID NO: 885 - DNA, 31 bp, Homo sapiens
aaataaagtataggcgatagaaattgaaacc

SEQ ID NO: 886 - DNA, 32 bp, Homo sapiens
aaataaagtataggcgatagaaattgaaacct

SEQ ID NO: 887 - DNA, 18 bp, Homo sapiens
aataaagtataggcgata

SEQ ID NO: 888 - DNA, 24 bp, Homo sapiens
aataaagtataggcgatagaaatt

SEQ ID NO: 889 - DNA, 29 bp, Homo sapiens
aataaagtataggcgatagaaattgaaac

SEQ ID NO: 890 - DNA, 30 bp, Homo sapiens
aataaagtataggcgatagaaattgaaacc

SEQ ID NO: 891 - DNA, 31 bp, Homo sapiens
aataaagtataggcgatagaaattgaaacct

SEQ ID NO: 892 - DNA, 29 bp, Homo sapiens
ataaagtataggcgatagaaattgaaacc

SEQ ID NO: 893 - DNA, 28 bp, Homo sapiens
taaagtataggcgatagaaattgaaacc

SEQ ID NO: 894 - DNA, 29 bp, Homo sapiens
taaagtataggcgatagaaattgaaacct

SEQ ID NO: 895 - DNA, 25 bp, Homo sapiens
aaagtataggcgatagaaattgaaa

SEQ ID NO: 896 - DNA, 26 bp, Homo sapiens
aaagtataggcgatagaaattgaaac

SEQ ID NO: 897 - DNA, 27 bp, Homo sapiens
aaagtataggcgatagaaattgaaacc

SEQ ID NO: 898 - DNA, 28 bp, Homo sapiens
aaagtataggcgatagaaattgaaacct

SEQ ID NO: 899 - DNA, 33 bp, Homo sapiens
aaagtataggcgatagaaattgaaacctggcgc

SEQ ID NO: 900 - DNA, 24 bp, Homo sapiens
aagtataggcgatagaaattgaaa

SEQ ID NO: 901 - DNA, 25 bp, Homo sapiens
aagtataggcgatagaaattgaaac

SEQ ID NO: 902 - DNA, 26 bp, Homo sapiens
aagtataggcgatagaaattgaaacc

SEQ ID NO: 903 - DNA, 27 bp, Homo sapiens
aagtataggcgatagaaattgaaacct

SEQ ID NO: 904 - DNA, 32 bp, Homo sapiens
aagtataggcgatagaaattgaaacctggcgc

SEQ ID NO: 905 - DNA, 33 bp, Homo sapiens
aagtataggcgatagaaattgaaacctggcgca

SEQ ID NO: 906 - DNA, 25 bp, Homo sapiens
agtataggcgatagaaattgaaacc

SEQ ID NO: 907 - DNA, 26 bp, Homo sapiens
agtataggcgatagaaattgaaacct

SEQ ID NO: 908 - DNA, 31 bp, Homo sapiens
agtataggcgatagaaattgaaacctggcgc

SEQ ID NO: 909 - DNA, 32 bp, Homo sapiens
agtataggcgatagaaattgaaacctggcgca

SEQ ID NO: 910 - DNA, 24 bp, Homo sapiens
gtataggcgatagaaattgaaacc

SEQ ID NO: 911 - DNA, 23 bp, Homo sapiens
tataggcgatagaaattgaaacc

SEQ ID NO: 912 - DNA, 29 bp, Homo sapiens
tataggcgatagaaattgaaacctggcgc

SEQ ID NO: 913 - DNA, 30 bp, Homo sapiens
tataggcgatagaaattgaaacctggcgca

SEQ ID NO: 914 - DNA, 22 bp, Homo sapiens
ataggcgatagaaattgaaacc

SEQ ID NO: 915 - DNA, 23 bp, Homo sapiens
ataggcgatagaaattgaaacct

SEQ ID NO: 916 - DNA, 28 bp, Homo sapiens
ataggcgatagaaattgaaacctggcgc

SEQ ID NO: 917 - DNA, 29 bp, Homo sapiens
ataggcgatagaaattgaaacctggcgca

SEQ ID NO: 918 - DNA, 20 bp, Homo sapiens
taggcgatagaaattgaaac

SEQ ID NO: 919 - DNA, 21 bp, Homo sapiens
taggcgatagaaattgaaacc

SEQ ID NO: 920 - DNA, 22 bp, Homo sapiens
taggcgatagaaattgaaacct

SEQ ID NO: 921 - DNA, 25 bp, Homo sapiens
taggcgatagaaattgaaacctggc

SEQ ID NO: 922 - DNA, 26 bp, Homo sapiens
taggcgatagaaattgaaacctggcg

SEQ ID NO: 923 - DNA, 27 bp, Homo sapiens
taggcgatagaaattgaaacctggcgc

SEQ ID NO: 924 - DNA, 28 bp, Homo sapiens
taggcgatagaaattgaaacctggcgca

SEQ ID NO: 925 - DNA, 33 bp, Homo sapiens
taggcgatagaaattgaaacctggcgcaataga

SEQ ID NO: 926 - DNA, 20 bp, Homo sapiens
aggcgatagaaattgaaacc

SEQ ID NO: 927 - DNA, 26 bp, Homo sapiens
aggcgatagaaattgaaacctggcgc

SEQ ID NO: 928 - DNA, 27 bp, Homo sapiens
aggcgatagaaattgaaacctggcgca

SEQ ID NO: 929 - DNA, 32 bp, Homo sapiens
aggcgatagaaattgaaacctggcgcaataga

SEQ ID NO: 930 - DNA, 18 bp, Homo sapiens
gcgatagaaattgaaacc

SEQ ID NO: 931 - DNA, 19 bp, Homo sapiens
gcgatagaaattgaaacct

SEQ ID NO: 932 - DNA, 23 bp, Homo sapiens
gcgatagaaattgaaacctggcg

SEQ ID NO: 933 - DNA, 24 bp, Homo sapiens
gcgatagaaattgaaacctggcgc

SEQ ID NO: 934 - DNA, 18 bp, Homo sapiens
cgatagaaattgaaacct

SEQ ID NO: 935 - DNA, 23 bp, Homo sapiens
cgatagaaattgaaacctggcgc

SEQ ID NO: 936 - DNA, 24 bp, Homo sapiens
cgatagaaattgaaacctggcgca

SEQ ID NO: 937 - DNA, 29 bp, Homo sapiens
cgatagaaattgaaacctggcgcaataga

SEQ ID NO: 938 - DNA, 30 bp, Homo sapiens
cgatagaaattgaaacctggcgcaatagat

SEQ ID NO: 939 - DNA, 22 bp, Homo sapiens
gatagaaattgaaacctggcgc

SEQ ID NO: 940 - DNA, 23 bp, Homo sapiens
gatagaaattgaaacctggcgca

SEQ ID NO: 941 - DNA, 20 bp, Homo sapiens
atagaaattgaaacctggcg

SEQ ID NO: 942 - DNA, 21 bp, Homo sapiens
atagaaattgaaacctggcgc

SEQ ID NO: 943 - DNA, 22 bp, Homo sapiens
atagaaattgaaacctggcgca

SEQ ID NO: 944 - DNA, 23 bp, Homo sapiens
atagaaattgaaacctggcgcaa

SEQ ID NO: 945 - DNA, 24 bp, Homo sapiens
atagaaattgaaacctggcgcaat

SEQ ID NO: 946 - DNA, 25 bp, Homo sapiens
atagaaattgaaacctggcgcaata

SEQ ID NO: 947 - DNA, 26 bp, Homo sapiens
atagaaattgaaacctggcgcaatag

SEQ ID NO: 948 - DNA, 27 bp, Homo sapiens
atagaaattgaaacctggcgcaataga

SEQ ID NO: 949 - DNA, 28 bp, Homo sapiens
atagaaattgaaacctggcgcaatagat

SEQ ID NO: 950 - DNA, 32 bp, Homo sapiens
aaattataaccaagcataatatagcaaggact

SEQ ID NO: 951 - DNA, 31 bp, Homo sapiens
aattataaccaagcataatatagcaaggact

SEQ ID NO: 952 - DNA, 30 bp, Homo sapiens
attataaccaagcataatatagcaaggact

SEQ ID NO: 953 - DNA, 29 bp, Homo sapiens
ttataaccaagcataatatagcaaggact

SEQ ID NO: 954 - DNA, 28 bp, Homo sapiens
tataaccaagcataatatagcaaggact

SEQ ID NO: 955 - DNA, 27 bp, Homo sapiens
ataaccaagcataatatagcaaggact

SEQ ID NO: 956 - DNA, 26 bp, Homo sapiens
taaccaagcataatatagcaaggact

SEQ ID NO: 957 - DNA, 25 bp, Homo sapiens
aaccaagcataatatagcaaggact

SEQ ID NO: 958 - DNA, 24 bp, Homo sapiens
accaagcataatatagcaaggact

SEQ ID NO: 959 - DNA, 22 bp, Homo sapiens
caagcataatatagcaaggact

SEQ ID NO: 960 - DNA, 26 bp, Homo sapiens
caagcataatatagcaaggactaacc

SEQ ID NO: 961 - DNA, 27 bp, Homo sapiens
caagcataatatagcaaggactaaccc

SEQ ID NO: 962 - DNA, 21 bp, Homo sapiens
aagcataatatagcaaggact

SEQ ID NO: 963 - DNA, 22 bp, Homo sapiens
aagcataatatagcaaggacta

SEQ ID NO: 964 - DNA, 25 bp, Homo sapiens
aagcataatatagcaaggactaacc

SEQ ID NO: 965 - DNA, 26 bp, Homo sapiens
aagcataatatagcaaggactaaccc

SEQ ID NO: 966 - DNA, 27 bp, Homo sapiens
aagcataatatagcaaggactaacccc

SEQ ID NO: 967 - DNA, 28 bp, Homo sapiens
aagcataatatagcaaggactaacccct

SEQ ID NO: 968 - DNA, 33 bp, Homo sapiens
aagcataatatagcaaggactaacccctatacc

SEQ ID NO: 969 - DNA, 20 bp, Homo sapiens
agcataatatagcaaggact

SEQ ID NO: 970 - DNA, 24 bp, Homo sapiens
agcataatatagcaaggactaacc

SEQ ID NO: 971 - DNA, 25 bp, Homo sapiens
agcataatatagcaaggactaaccc

SEQ ID NO: 972 - DNA, 26 bp, Homo sapiens
agcataatatagcaaggactaacccc

SEQ ID NO: 973 - DNA, 19 bp, Homo sapiens
gcataatatagcaaggact

SEQ ID NO: 974 - DNA, 18 bp, Homo sapiens
cataatatagcaaggact

SEQ ID NO: 975 - DNA, 22 bp, Homo sapiens
cataatatagcaaggactaacc

SEQ ID NO: 976 - DNA, 23 bp, Homo sapiens
cataatatagcaaggactaaccc

SEQ ID NO: 977 - DNA, 24 bp, Homo sapiens
cataatatagcaaggactaacccc

SEQ ID NO: 978 - DNA, 17 bp, Homo sapiens
ataatatagcaaggact

SEQ ID NO: 979 - DNA, 21 bp, Homo sapiens
ataatatagcaaggactaacc

SEQ ID NO: 980 - DNA, 22 bp, Homo sapiens
ataatatagcaaggactaaccc

SEQ ID NO: 981 - DNA, 16 bp, Homo sapiens
taatatagcaaggact

SEQ ID NO: 982 - DNA, 20 bp, Homo sapiens
taatatagcaaggactaacc

SEQ ID NO: 983 - DNA, 21 bp, Homo sapiens
taatatagcaaggactaaccc

SEQ ID NO: 984 - DNA, 22 bp, Homo sapiens
taatatagcaaggactaacccc

SEQ ID NO: 985 - DNA, 23 bp, Homo sapiens
taatatagcaaggactaacccct

SEQ ID NO: 986 - DNA, 19 bp, Homo sapiens
aatatagcaaggactaacc

SEQ ID NO: 987 - DNA, 20 bp, Homo sapiens
aatatagcaaggactaaccc

SEQ ID NO: 988 - DNA, 21 bp, Homo sapiens
aatatagcaaggactaacccc

SEQ ID NO: 989 - DNA, 18 bp, Homo sapiens
atatagcaaggactaacc

SEQ ID NO: 990 - DNA, 19 bp, Homo sapiens
atatagcaaggactaaccc

SEQ ID NO: 991 - DNA, 20 bp, Homo sapiens
atatagcaaggactaacccc

SEQ ID NO: 992 - DNA, 17 bp, Homo sapiens
tatagcaaggactaacc

SEQ ID NO: 993 - DNA, 18 bp, Homo sapiens
tatagcaaggactaaccc

SEQ ID NO: 994 - DNA, 16 bp, Homo sapiens
atagcaaggactaacc

SEQ ID NO: 995 - DNA, 17 bp, Homo sapiens
atagcaaggactaaccc

SEQ ID NO: 996 - DNA, 16 bp, Homo sapiens
tagcaaggactaaccc

SEQ ID NO: 997 - DNA, 16 bp, Homo sapiens
agcaaggactaacccc

SEQ ID NO: 998 - DNA, 20 bp, Homo sapiens
caaggactaacccctatacc

SEQ ID NO: 999 - DNA, 18 bp, Homo sapiens
aggactaacccctatacc

SEQ ID NO: 1000 - DNA, 32 bp, Homo sapiens
aattaactagaaataactttgcaaggagagcc

SEQ ID NO: 1001 - DNA, 30 bp, Homo sapiens
ttaactagaaataactttgcaaggagagcc

SEQ ID NO: 1002 - DNA, 29 bp, Homo sapiens
taactagaaataactttgcaaggagagcc

SEQ ID NO: 1003 - DNA, 28 bp, Homo sapiens
aactagaaataactttgcaaggagagcc

SEQ ID NO: 1004 - DNA, 27 bp, Homo sapiens
actagaaataactttgcaaggagagcc

SEQ ID NO: 1005 - DNA, 24 bp, Homo sapiens
agaaataactttgcaaggagagcc

SEQ ID NO: 1006 - DNA, 30 bp, Homo sapiens
aactttgcaaggagagccaaagctaagacc

SEQ ID NO: 1007 - DNA, 28 bp, Homo sapiens
actttgcaaggagagccaaagctaagac

SEQ ID NO: 1008 - DNA, 29 bp, Homo sapiens
actttgcaaggagagccaaagctaagacc

SEQ ID NO: 1009 - DNA, 29 bp, Homo sapiens
cccgaaaccagacgagctacctaagaaca

SEQ ID NO: 1010 - DNA, 21 bp, Homo sapiens
ccgaaaccagacgagctacct

SEQ ID NO: 1011 - DNA, 26 bp, Homo sapiens
ccgaaaccagacgagctacctaagaa

SEQ ID NO: 1012 - DNA, 27 bp, Homo sapiens
ccgaaaccagacgagctacctaagaac

SEQ ID NO: 1013 - DNA, 28 bp, Homo sapiens
ccgaaaccagacgagctacctaagaaca

SEQ ID NO: 1014 - DNA, 19 bp, Homo sapiens
cgaaaccagacgagctacc

SEQ ID NO: 1015 - DNA, 20 bp, Homo sapiens
cgaaaccagacgagctacct

SEQ ID NO: 1016 - DNA, 25 bp, Homo sapiens
cgaaaccagacgagctacctaagaa

SEQ ID NO: 1017 - DNA, 26 bp, Homo sapiens
cgaaaccagacgagctacctaagaac

SEQ ID NO: 1018 - DNA, 27 bp, Homo sapiens
cgaaaccagacgagctacctaagaaca

SEQ ID NO: 1019 - DNA, 28 bp, Homo sapiens
cgaaaccagacgagctacctaagaacag

SEQ ID NO: 1020 - DNA, 29 bp, Homo sapiens
cgaaaccagacgagctacctaagaacagc

SEQ ID NO: 1021 - DNA, 32 bp, Homo sapiens
cgaaaccagacgagctacctaagaacagctaa

SEQ ID NO: 1022 - DNA, 33 bp, Homo sapiens
cgaaaccagacgagctacctaagaacagctaaa

SEQ ID NO: 1023 - DNA, 26 bp, Homo sapiens
gaaaccagacgagctacctaagaaca

SEQ ID NO: 1024 - DNA, 25 bp, Homo sapiens
aaaccagacgagctacctaagaaca

SEQ ID NO: 1025 - DNA, 21 bp, Homo sapiens
cagacgagctacctaagaaca

SEQ ID NO: 1026 - DNA, 19 bp, Homo sapiens
agacgagctacctaagaac

SEQ ID NO: 1027 - DNA, 20 bp, Homo sapiens
agacgagctacctaagaaca

SEQ ID NO: 1028 - DNA, 18 bp, Homo sapiens
gacgagctacctaagaac

SEQ ID NO: 1029 - DNA, 19 bp, Homo sapiens
gacgagctacctaagaaca

SEQ ID NO: 1030 - DNA, 24 bp, Homo sapiens
taagaacagctaaaagagcacacc

SEQ ID NO: 1031 - DNA, 25 bp, Homo sapiens
taagaacagctaaaagagcacaccc

SEQ ID NO: 1032 - DNA, 26 bp, Homo sapiens
taagaacagctaaaagagcacacccg

SEQ ID NO: 1033 - DNA, 31 bp, Homo sapiens
cagctaaaagagcacacccgtctatgtagca

SEQ ID NO: 1034 - DNA, 33 bp, Homo sapiens
taaaagagcacacccgtctatgtagcaaaatag

SEQ ID NO: 1035 - DNA, 26 bp, Homo sapiens
aaaagagcacacccgtctatgtagca

SEQ ID NO: 1036 - DNA, 21 bp, Homo sapiens
gagcacacccgtctatgtagc

SEQ ID NO: 1037 - DNA, 22 bp, Homo sapiens
gagcacacccgtctatgtagca

SEQ ID NO: 1038 - DNA, 31 bp, Homo sapiens
gagcacacccgtctatgtagcaaaatagtgg

SEQ ID NO: 1039 - DNA, 20 bp, Homo sapiens
agcacacccgtctatgtagc

SEQ ID NO: 1040 - DNA, 21 bp, Homo sapiens
agcacacccgtctatgtagca

SEQ ID NO: 1041 - DNA, 30 bp, Homo sapiens
agcacacccgtctatgtagcaaaatagtgg

SEQ ID NO: 1042 - DNA, 19 bp, Homo sapiens
gcacacccgtctatgtagc

SEQ ID NO: 1043 - DNA, 29 bp, Homo sapiens
gcacacccgtctatgtagcaaaatagtgg

SEQ ID NO: 1044 - DNA, 18 bp, Homo sapiens
cacacccgtctatgtagc

SEQ ID NO: 1045 - DNA, 19 bp, Homo sapiens
cacacccgtctatgtagca

SEQ ID NO: 1046 - DNA, 20 bp, Homo sapiens
cacacccgtctatgtagcaa

SEQ ID NO: 1047 - DNA, 21 bp, Homo sapiens
cacacccgtctatgtagcaaa

SEQ ID NO: 1048 - DNA, 22 bp, Homo sapiens
cacacccgtctatgtagcaaaa

SEQ ID NO: 1049 - DNA, 23 bp, Homo sapiens
cacacccgtctatgtagcaaaat

SEQ ID NO: 1050 - DNA, 24 bp, Homo sapiens
cacacccgtctatgtagcaaaata

SEQ ID NO: 1051 - DNA, 28 bp, Homo sapiens
cacacccgtctatgtagcaaaatagtgg

SEQ ID NO: 1052 - DNA, 18 bp, Homo sapiens
acacccgtctatgtagca

SEQ ID NO: 1053 - DNA, 16 bp, Homo sapiens
cacccgtctatgtagc

SEQ ID NO: 1054 - DNA, 17 bp, Homo sapiens
cacccgtctatgtagca

SEQ ID NO: 1055 - DNA, 18 bp, Homo sapiens
cacccgtctatgtagcaa

SEQ ID NO: 1056 - DNA, 19 bp, Homo sapiens
cacccgtctatgtagcaaa

SEQ ID NO: 1057 - DNA, 20 bp, Homo sapiens
cacccgtctatgtagcaaaa

SEQ ID NO: 1058 - DNA, 21 bp, Homo sapiens
cacccgtctatgtagcaaaat

SEQ ID NO: 1059 - DNA, 22 bp, Homo sapiens
cacccgtctatgtagcaaaata

SEQ ID NO: 1060 - DNA, 25 bp, Homo sapiens
cacccgtctatgtagcaaaatagtg

SEQ ID NO: 1061 - DNA, 26 bp, Homo sapiens
cacccgtctatgtagcaaaatagtgg

SEQ ID NO: 1062 - DNA, 23 bp, Homo sapiens
cccgtctatgtagcaaaatagtg

SEQ ID NO: 1063 - DNA, 24 bp, Homo sapiens
cccgtctatgtagcaaaatagtgg

SEQ ID NO: 1064 - DNA, 33 bp, Homo sapiens
aaatagtgggaagatttataggtagaggcgaca

SEQ ID NO: 1065 - DNA, 27 bp, Homo sapiens
aagatttataggtagaggcgacaaacc

SEQ ID NO: 1066 - DNA, 24 bp, Homo sapiens
atttataggtagaggcgacaaacc

SEQ ID NO: 1067 - DNA, 19 bp, Homo sapiens
tttataggtagaggcgaca

SEQ ID NO: 1068 - DNA, 17 bp, Homo sapiens
ttataggtagaggcgac

SEQ ID NO: 1069 - DNA, 18 bp, Homo sapiens
ttataggtagaggcgaca

SEQ ID NO: 1070 - DNA, 22 bp, Homo sapiens
ttataggtagaggcgacaaacc

SEQ ID NO: 1071 - DNA, 17 bp, Homo sapiens
tataggtagaggcgaca

SEQ ID NO: 1072 - DNA, 21 bp, Homo sapiens
tataggtagaggcgacaaacc

SEQ ID NO: 1073 - DNA, 20 bp, Homo sapiens
ataggtagaggcgacaaacc

SEQ ID NO: 1074 - DNA, 19 bp, Homo sapiens
taggtagaggcgacaaacc

SEQ ID NO: 1075 - DNA, 18 bp, Homo sapiens
aggtagaggcgacaaacc

SEQ ID NO: 1076 - DNA, 21 bp, Homo sapiens
taccgagcctggtgatagctg

SEQ ID NO: 1077 - DNA, 31 bp, Homo sapiens
taccgagcctggtgatagctggttgtccaag

SEQ ID NO: 1078 - DNA, 32 bp, Homo sapiens
taccgagcctggtgatagctggttgtccaaga

SEQ ID NO: 1079 - DNA, 33 bp, Homo sapiens
taccgagcctggtgatagctggttgtccaagat

SEQ ID NO: 1080 - DNA, 20 bp, Homo sapiens
accgagcctggtgatagctg

SEQ ID NO: 1081 - DNA, 29 bp, Homo sapiens
gagcctggtgatagctggttgtccaagat

SEQ ID NO: 1082 - DNA, 30 bp, Homo sapiens
gagcctggtgatagctggttgtccaagata

SEQ ID NO: 1083 - DNA, 24 bp, Homo sapiens
agcctggtgatagctggttgtcca

SEQ ID NO: 1084 - DNA, 26 bp, Homo sapiens
agcctggtgatagctggttgtccaag

SEQ ID NO: 1085 - DNA, 27 bp, Homo sapiens
agcctggtgatagctggttgtccaaga

SEQ ID NO: 1086 - DNA, 28 bp, Homo sapiens
agcctggtgatagctggttgtccaagat

SEQ ID NO: 1087 - DNA, 29 bp, Homo sapiens
agcctggtgatagctggttgtccaagata

SEQ ID NO: 1088 - DNA, 29 bp, Homo sapiens
ggtgatagctggttgtccaagatagaatc

SEQ ID NO: 1089 - DNA, 33 bp, Homo sapiens
agatagaatcttagttcaactttaaatttgccc

SEQ ID NO: 1090 - DNA, 27 bp, Homo sapiens
aatcttagttcaactttaaatttgccc

SEQ ID NO: 1091 - DNA, 25 bp, Homo sapiens
tcttagttcaactttaaatttgccc

SEQ ID NO: 1092 - DNA, 33 bp, Homo sapiens
tcttagttcaactttaaatttgcccacagaacc

SEQ ID NO: 1093 - DNA, 32 bp, Homo sapiens
cttagttcaactttaaatttgcccacagaacc

SEQ ID NO: 1094 - DNA, 24 bp, Homo sapiens
actttaaatttgcccacagaaccc

SEQ ID NO: 1095 - DNA, 33 bp, Homo sapiens
tttgcccacagaaccctctaaatccccttgtaa

SEQ ID NO: 1096 - DNA, 19 bp, Homo sapiens
cacagaaccctctaaatcc

SEQ ID NO: 1097 - DNA, 20 bp, Homo sapiens
cacagaaccctctaaatccc

SEQ ID NO: 1098 - DNA, 21 bp, Homo sapiens
cacagaaccctctaaatcccc

SEQ ID NO: 1099 - DNA, 22 bp, Homo sapiens
cacagaaccctctaaatcccct

SEQ ID NO: 1100 - DNA, 17 bp, Homo sapiens
acagaaccctctaaatc

SEQ ID NO: 1101 - DNA, 18 bp, Homo sapiens
acagaaccctctaaatcc

SEQ ID NO: 1102 - DNA, 19 bp, Homo sapiens
acagaaccctctaaatccc

SEQ ID NO: 1103 - DNA, 20 bp, Homo sapiens
acagaaccctctaaatcccc

SEQ ID NO: 1104 - DNA, 21 bp, Homo sapiens
acagaaccctctaaatcccct

SEQ ID NO: 1105 - DNA, 17 bp, Homo sapiens
cagaaccctctaaatcc

SEQ ID NO: 1106 - DNA, 18 bp, Homo sapiens
cagaaccctctaaatccc

SEQ ID NO: 1107 - DNA, 19 bp, Homo sapiens
cagaaccctctaaatcccc

SEQ ID NO: 1108 - DNA, 20 bp, Homo sapiens
cagaaccctctaaatcccct

SEQ ID NO: 1109 - DNA, 33 bp, Homo sapiens
cagaaccctctaaatccccttgtaaatttaact

SEQ ID NO: 1110 - DNA, 16 bp, Homo sapiens
gaaccctctaaatccc

SEQ ID NO: 1111 - DNA, 17 bp, Homo sapiens
gaaccctctaaatcccc

SEQ ID NO: 1112 - DNA, 32 bp, Homo sapiens
gaaccctctaaatccccttgtaaatttaactg

SEQ ID NO: 1113 - DNA, 31 bp, Homo sapiens
aaccctctaaatccccttgtaaatttaactg

SEQ ID NO: 1114 - DNA, 27 bp, Homo sapiens
ctctaaatccccttgtaaatttaactg

SEQ ID NO: 1115 - DNA, 26 bp, Homo sapiens
tctaaatccccttgtaaatttaactg

SEQ ID NO: 1116 - DNA, 24 bp, Homo sapiens
taaatccccttgtaaatttaactg

SEQ ID NO: 1117 - DNA, 23 bp, Homo sapiens
aaatccccttgtaaatttaactg

SEQ ID NO: 1118 - DNA, 22 bp, Homo sapiens
aatccccttgtaaatttaactg

SEQ ID NO: 1119 - DNA, 33 bp, Homo sapiens
aatccccttgtaaatttaactgttagtccaaag

SEQ ID NO: 1120 - DNA, 21 bp, Homo sapiens
atccccttgtaaatttaactg

SEQ ID NO: 1121 - DNA, 28 bp, Homo sapiens
ccttgtaaatttaactgttagtccaaag

SEQ ID NO: 1122 - DNA, 27 bp, Homo sapiens
cttgtaaatttaactgttagtccaaag

SEQ ID NO: 1123 - DNA, 29 bp, Homo sapiens
cttgtaaatttaactgttagtccaaagag

SEQ ID NO: 1124 - DNA, 33 bp, Homo sapiens
cttgtaaatttaactgttagtccaaagaggaac

SEQ ID NO: 1125 - DNA, 26 bp, Homo sapiens
ttgtaaatttaactgttagtccaaag

SEQ ID NO: 1126 - DNA, 27 bp, Homo sapiens
ttgtaaatttaactgttagtccaaaga

SEQ ID NO: 1127 - DNA, 28 bp, Homo sapiens
ttgtaaatttaactgttagtccaaagag

SEQ ID NO: 1128 - DNA, 32 bp, Homo sapiens
ttgtaaatttaactgttagtccaaagaggaac

SEQ ID NO: 1129 - DNA, 33 bp, Homo sapiens
ttgtaaatttaactgttagtccaaagaggaaca

SEQ ID NO: 1130 - DNA, 25 bp, Homo sapiens
tgtaaatttaactgttagtccaaag

SEQ ID NO: 1131 - DNA, 32 bp, Homo sapiens
tgtaaatttaactgttagtccaaagaggaaca

SEQ ID NO: 1132 - DNA, 28 bp, Homo sapiens
aatttaactgttagtccaaagaggaaca

SEQ ID NO: 1133 - DNA, 25 bp, Homo sapiens
aaagaggaacagctctttggacact

SEQ ID NO: 1134 - DNA, 24 bp, Homo sapiens
aagaggaacagctctttggacact

SEQ ID NO: 1135 - DNA, 29 bp, Homo sapiens
aagaggaacagctctttggacactaggaa

SEQ ID NO: 1136 - DNA, 20 bp, Homo sapiens
agaggaacagctctttggac

SEQ ID NO: 1137 - DNA, 23 bp, Homo sapiens
agaggaacagctctttggacact

SEQ ID NO: 1138 - DNA, 28 bp, Homo sapiens
agaggaacagctctttggacactaggaa

SEQ ID NO: 1139 - DNA, 19 bp, Homo sapiens
gaggaacagctctttggac

SEQ ID NO: 1140 - DNA, 20 bp, Homo sapiens
gaggaacagctctttggaca

SEQ ID NO: 1141 - DNA, 22 bp, Homo sapiens
gaggaacagctctttggacact

SEQ ID NO: 1142 - DNA, 25 bp, Homo sapiens
gaggaacagctctttggacactagg

SEQ ID NO: 1143 - DNA, 26 bp, Homo sapiens
gaggaacagctctttggacactagga

SEQ ID NO: 1144 - DNA, 27 bp, Homo sapiens
gaggaacagctctttggacactaggaa

SEQ ID NO: 1145 - DNA, 28 bp, Homo sapiens
gaggaacagctctttggacactaggaaa

SEQ ID NO: 1146 - DNA, 32 bp, Homo sapiens
gaggaacagctctttggacactaggaaaaaac

SEQ ID NO: 1147 - DNA, 33 bp, Homo sapiens
gaggaacagctctttggacactaggaaaaaacc

SEQ ID NO: 1148 - DNA, 18 bp, Homo sapiens
aggaacagctctttggac

SEQ ID NO: 1149 - DNA, 21 bp, Homo sapiens
aggaacagctctttggacact

SEQ ID NO: 1150 - DNA, 24 bp, Homo sapiens
aggaacagctctttggacactagg

SEQ ID NO: 1151 - DNA, 25 bp, Homo sapiens
aggaacagctctttggacactagga

SEQ ID NO: 1152 - DNA, 26 bp, Homo sapiens
aggaacagctctttggacactaggaa

SEQ ID NO: 1153 - DNA, 27 bp, Homo sapiens
aggaacagctctttggacactaggaaa

SEQ ID NO: 1154 - DNA, 31 bp, Homo sapiens
aggaacagctctttggacactaggaaaaaac

SEQ ID NO: 1155 - DNA, 32 bp, Homo sapiens
aggaacagctctttggacactaggaaaaaacc

SEQ ID NO: 1156 - DNA, 17 bp, Homo sapiens
ggaacagctctttggac

SEQ ID NO: 1157 - DNA, 18 bp, Homo sapiens
ggaacagctctttggaca

SEQ ID NO: 1158 - DNA, 19 bp, Homo sapiens
ggaacagctctttggacac

SEQ ID NO: 1159 - DNA, 31 bp, Homo sapiens
ggaacagctctttggacactaggaaaaaacc

SEQ ID NO: 1160 - DNA, 16 bp, Homo sapiens
gaacagctctttggac

SEQ ID NO: 1161 - DNA, 19 bp, Homo sapiens
gaacagctctttggacact

SEQ ID NO: 1162 - DNA, 29 bp, Homo sapiens
gaacagctctttggacactaggaaaaaac

SEQ ID NO: 1163 - DNA, 30 bp, Homo sapiens
gaacagctctttggacactaggaaaaaacc

SEQ ID NO: 1164 - DNA, 31 bp, Homo sapiens
gaacagctctttggacactaggaaaaaacct

SEQ ID NO: 1165 - DNA, 29 bp, Homo sapiens
aacagctctttggacactaggaaaaaacc

SEQ ID NO: 1166 - DNA, 30 bp, Homo sapiens
aacagctctttggacactaggaaaaaacct

SEQ ID NO: 1167 - DNA, 27 bp, Homo sapiens
cagctctttggacactaggaaaaaacc

SEQ ID NO: 1168 - DNA, 26 bp, Homo sapiens
agctctttggacactaggaaaaaacc

SEQ ID NO: 1169 - DNA, 16 bp, Homo sapiens
gctctttggacactag

SEQ ID NO: 1170 - DNA, 21 bp, Homo sapiens
gctctttggacactaggaaaa

SEQ ID NO: 1171 - DNA, 24 bp, Homo sapiens
gctctttggacactaggaaaaaac

SEQ ID NO: 1172 - DNA, 25 bp, Homo sapiens
gctctttggacactaggaaaaaacc

SEQ ID NO: 1173 - DNA, 26 bp, Homo sapiens
gctctttggacactaggaaaaaacct

SEQ ID NO: 1174 - DNA, 28 bp, Homo sapiens
gctctttggacactaggaaaaaaccttg

SEQ ID NO: 1175 - DNA, 24 bp, Homo sapiens
ctctttggacactaggaaaaaacc

SEQ ID NO: 1176 - DNA, 25 bp, Homo sapiens
ctctttggacactaggaaaaaacct

SEQ ID NO: 1177 - DNA, 22 bp, Homo sapiens
ctttggacactaggaaaaaacc

SEQ ID NO: 1178 - DNA, 23 bp, Homo sapiens
ctttggacactaggaaaaaacct

SEQ ID NO: 1179 - DNA, 21 bp, Homo sapiens
tttggacactaggaaaaaacc

SEQ ID NO: 1180 - DNA, 20 bp, Homo sapiens
ttggacactaggaaaaaacc

SEQ ID NO: 1181 - DNA, 33 bp, Homo sapiens
aaaccttgtagagagagtaaaaaatttaacacc

SEQ ID NO: 1182 - DNA, 32 bp, Homo sapiens
aaccttgtagagagagtaaaaaatttaacacc

SEQ ID NO: 1183 - DNA, 33 bp, Homo sapiens
aaccttgtagagagagtaaaaaatttaacaccc

SEQ ID NO: 1184 - DNA, 17 bp, Homo sapiens
ttgtagagagagtaaaa

SEQ ID NO: 1185 - DNA, 18 bp, Homo sapiens
ttgtagagagagtaaaaa

SEQ ID NO: 1186 - DNA, 23 bp, Homo sapiens
ttgtagagagagtaaaaaattta

SEQ ID NO: 1187 - DNA, 28 bp, Homo sapiens
ttgtagagagagtaaaaaatttaacacc

SEQ ID NO: 1188 - DNA, 29 bp, Homo sapiens
ttgtagagagagtaaaaaatttaacaccc

SEQ ID NO: 1189 - DNA, 30 bp, Homo sapiens
ttgtagagagagtaaaaaatttaacaccca

SEQ ID NO: 1190 - DNA, 27 bp, Homo sapiens
tgtagagagagtaaaaaatttaacacc

SEQ ID NO: 1191 - DNA, 23 bp, Homo sapiens
aatttaacacccatagtaggcct

SEQ ID NO: 1192 - DNA, 22 bp, Homo sapiens
atttaacacccatagtaggcct

SEQ ID NO: 1193 - DNA, 21 bp, Homo sapiens
tttaacacccatagtaggcct

SEQ ID NO: 1194 - DNA, 19 bp, Homo sapiens
taacacccatagtaggcct

SEQ ID NO: 1195 - DNA, 32 bp, Homo sapiens
taacacccatagtaggcctaaaagcagccacc

SEQ ID NO: 1196 - DNA, 18 bp, Homo sapiens
aacacccatagtaggcct

SEQ ID NO: 1197 - DNA, 31 bp, Homo sapiens
aacacccatagtaggcctaaaagcagccacc

SEQ ID NO: 1198 - DNA, 29 bp, Homo sapiens
cacccatagtaggcctaaaagcagccacc

SEQ ID NO: 1199 - DNA, 24 bp, Homo sapiens
cccatagtaggcctaaaagcagcc

SEQ ID NO: 1200 - DNA, 25 bp, Homo sapiens
cccatagtaggcctaaaagcagcca

SEQ ID NO: 1201 - DNA, 27 bp, Homo sapiens
cccatagtaggcctaaaagcagccacc

SEQ ID NO: 1202 - DNA, 26 bp, Homo sapiens
ccatagtaggcctaaaagcagccacc

SEQ ID NO: 1203 - DNA, 19 bp, Homo sapiens
catagtaggcctaaaagca

SEQ ID NO: 1204 - DNA, 22 bp, Homo sapiens
catagtaggcctaaaagcagcc

SEQ ID NO: 1205 - DNA, 25 bp, Homo sapiens
catagtaggcctaaaagcagccacc

SEQ ID NO: 1206 - DNA, 26 bp, Homo sapiens
catagtaggcctaaaagcagccacca

SEQ ID NO: 1207 - DNA, 24 bp, Homo sapiens
atagtaggcctaaaagcagccacc

SEQ ID NO: 1208 - DNA, 28 bp, Homo sapiens
aattaagaaagcgttcaagctcaacacc

SEQ ID NO: 1209 - DNA, 29 bp, Homo sapiens
aattaagaaagcgttcaagctcaacaccc

SEQ ID NO: 1210 - DNA, 28 bp, Homo sapiens
attaagaaagcgttcaagctcaacaccc

SEQ ID NO: 1211 - DNA, 18 bp, Homo sapiens
cactacctaaaaaatccc

SEQ ID NO: 1212 - DNA, 31 bp, Homo sapiens
cactacctaaaaaatcccaaacatataactg

SEQ ID NO: 1213 - DNA, 30 bp, Homo sapiens
actacctaaaaaatcccaaacatataactg

SEQ ID NO: 1214 - DNA, 29 bp, Homo sapiens
ctacctaaaaaatcccaaacatataactg

SEQ ID NO: 1215 - DNA, 27 bp, Homo sapiens
acctaaaaaatcccaaacatataactg

SEQ ID NO: 1216 - DNA, 24 bp, Homo sapiens
taaaaaatcccaaacatataactg

SEQ ID NO: 1217 - DNA, 31 bp, Homo sapiens
taaaaaatcccaaacatataactgaactcct

SEQ ID NO: 1218 - DNA, 30 bp, Homo sapiens
aaaaaatcccaaacatataactgaactcct

SEQ ID NO: 1219 - DNA, 33 bp, Homo sapiens
aaatcccaaacatataactgaactcctcacacc

SEQ ID NO: 1220 - DNA, 26 bp, Homo sapiens
aatcccaaacatataactgaactcct

SEQ ID NO: 1221 - DNA, 32 bp, Homo sapiens
aatcccaaacatataactgaactcctcacacc

SEQ ID NO: 1222 - DNA, 33 bp, Homo sapiens
aatcccaaacatataactgaactcctcacaccc

SEQ ID NO: 1223 - DNA, 31 bp, Homo sapiens
atcccaaacatataactgaactcctcacacc

SEQ ID NO: 1224 - DNA, 32 bp, Homo sapiens
atcccaaacatataactgaactcctcacaccc

SEQ ID NO: 1225 - DNA, 33 bp, Homo sapiens
atcccaaacatataactgaactcctcacaccca

SEQ ID NO: 1226 - DNA, 30 bp, Homo sapiens
tcccaaacatataactgaactcctcacacc

SEQ ID NO: 1227 - DNA, 31 bp, Homo sapiens
tcccaaacatataactgaactcctcacaccc

SEQ ID NO: 1228 - DNA, 29 bp, Homo sapiens
cccaaacatataactgaactcctcacacc

SEQ ID NO: 1229 - DNA, 30 bp, Homo sapiens
cccaaacatataactgaactcctcacaccc

SEQ ID NO: 1230 - DNA, 33 bp, Homo sapiens
cccaaacatataactgaactcctcacacccaat

SEQ ID NO: 1231 - DNA, 22 bp, Homo sapiens
ccaaacatataactgaactcct

SEQ ID NO: 1232 - DNA, 28 bp, Homo sapiens
ccaaacatataactgaactcctcacacc

SEQ ID NO: 1233 - DNA, 29 bp, Homo sapiens
ccaaacatataactgaactcctcacaccc

SEQ ID NO: 1234 - DNA, 30 bp, Homo sapiens
ccaaacatataactgaactcctcacaccca

SEQ ID NO: 1235 - DNA, 32 bp, Homo sapiens
ccaaacatataactgaactcctcacacccaat

SEQ ID NO: 1236 - DNA, 21 bp, Homo sapiens
caaacatataactgaactcct

SEQ ID NO: 1237 - DNA, 27 bp, Homo sapiens
caaacatataactgaactcctcacacc

SEQ ID NO: 1238 - DNA, 28 bp, Homo sapiens
caaacatataactgaactcctcacaccc

SEQ ID NO: 1239 - DNA, 29 bp, Homo sapiens
caaacatataactgaactcctcacaccca

SEQ ID NO: 1240 - DNA, 19 bp, Homo sapiens
aaacatataactgaactcc

SEQ ID NO: 1241 - DNA, 20 bp, Homo sapiens
aaacatataactgaactcct

SEQ ID NO: 1242 - DNA, 24 bp, Homo sapiens
aaacatataactgaactcctcaca

SEQ ID NO: 1243 - DNA, 25 bp, Homo sapiens
aaacatataactgaactcctcacac

SEQ ID NO: 1244 - DNA, 26 bp, Homo sapiens
aaacatataactgaactcctcacacc

SEQ ID NO: 1245 - DNA, 27 bp, Homo sapiens
aaacatataactgaactcctcacaccc

SEQ ID NO: 1246 - DNA, 28 bp, Homo sapiens
aaacatataactgaactcctcacaccca

SEQ ID NO: 1247 - DNA, 29 bp, Homo sapiens
aaacatataactgaactcctcacacccaa

SEQ ID NO: 1248 - DNA, 30 bp, Homo sapiens
aaacatataactgaactcctcacacccaat

SEQ ID NO: 1249 - DNA, 31 bp, Homo sapiens
aaacatataactgaactcctcacacccaatt

SEQ ID NO: 1250 - DNA, 32 bp, Homo sapiens
aaacatataactgaactcctcacacccaattg

SEQ ID NO: 1251 - DNA, 33 bp, Homo sapiens
aaacatataactgaactcctcacacccaattgg

SEQ ID NO: 1252 - DNA, 19 bp, Homo sapiens
aacatataactgaactcct

SEQ ID NO: 1253 - DNA, 23 bp, Homo sapiens
aacatataactgaactcctcaca

SEQ ID NO: 1254 - DNA, 25 bp, Homo sapiens
aacatataactgaactcctcacacc

SEQ ID NO: 1255 - DNA, 26 bp, Homo sapiens
aacatataactgaactcctcacaccc

SEQ ID NO: 1256 - DNA, 27 bp, Homo sapiens
aacatataactgaactcctcacaccca

SEQ ID NO: 1257 - DNA, 28 bp, Homo sapiens
aacatataactgaactcctcacacccaa

SEQ ID NO: 1258 - DNA, 29 bp, Homo sapiens
aacatataactgaactcctcacacccaat

SEQ ID NO: 1259 - DNA, 30 bp, Homo sapiens
aacatataactgaactcctcacacccaatt

SEQ ID NO: 1260 - DNA, 31 bp, Homo sapiens
aacatataactgaactcctcacacccaattg

SEQ ID NO: 1261 - DNA, 32 bp, Homo sapiens
aacatataactgaactcctcacacccaattgg

SEQ ID NO: 1262 - DNA, 33 bp, Homo sapiens
aacatataactgaactcctcacacccaattgga

SEQ ID NO: 1263 - DNA, 18 bp, Homo sapiens
acatataactgaactcct

SEQ ID NO: 1264 - DNA, 24 bp, Homo sapiens
acatataactgaactcctcacacc

SEQ ID NO: 1265 - DNA, 25 bp, Homo sapiens
acatataactgaactcctcacaccc

SEQ ID NO: 1266 - DNA, 26 bp, Homo sapiens
acatataactgaactcctcacaccca

SEQ ID NO: 1267 - DNA, 23 bp, Homo sapiens
catataactgaactcctcacacc

SEQ ID NO: 1268 - DNA, 24 bp, Homo sapiens
catataactgaactcctcacaccc

SEQ ID NO: 1269 - DNA, 25 bp, Homo sapiens
catataactgaactcctcacaccca

SEQ ID NO: 1270 - DNA, 33 bp, Homo sapiens
catataactgaactcctcacacccaattggacc

SEQ ID NO: 1271 - DNA, 16 bp, Homo sapiens
atataactgaactcct

SEQ ID NO: 1272 - DNA, 22 bp, Homo sapiens
atataactgaactcctcacacc

SEQ ID NO: 1273 - DNA, 23 bp, Homo sapiens
atataactgaactcctcacaccc

SEQ ID NO: 1274 - DNA, 24 bp, Homo sapiens
atataactgaactcctcacaccca

SEQ ID NO: 1275 - DNA, 30 bp, Homo sapiens
atataactgaactcctcacacccaattgga

SEQ ID NO: 1276 - DNA, 32 bp, Homo sapiens
atataactgaactcctcacacccaattggacc

SEQ ID NO: 1277 - DNA, 19 bp, Homo sapiens
tataactgaactcctcaca

SEQ ID NO: 1278 - DNA, 21 bp, Homo sapiens
tataactgaactcctcacacc

SEQ ID NO: 1279 - DNA, 22 bp, Homo sapiens
tataactgaactcctcacaccc

SEQ ID NO: 1280 - DNA, 23 bp, Homo sapiens
tataactgaactcctcacaccca

SEQ ID NO: 1281 - DNA, 28 bp, Homo sapiens
tataactgaactcctcacacccaattgg

SEQ ID NO: 1282 - DNA, 29 bp, Homo sapiens
tataactgaactcctcacacccaattgga

SEQ ID NO: 1283 - DNA, 31 bp, Homo sapiens
tataactgaactcctcacacccaattggacc

SEQ ID NO: 1284 - DNA, 20 bp, Homo sapiens
ataactgaactcctcacacc

SEQ ID NO: 1285 - DNA, 21 bp, Homo sapiens
ataactgaactcctcacaccc

SEQ ID NO: 1286 - DNA, 22 bp, Homo sapiens
ataactgaactcctcacaccca

SEQ ID NO: 1287 - DNA, 30 bp, Homo sapiens
ataactgaactcctcacacccaattggacc

SEQ ID NO: 1288 - DNA, 19 bp, Homo sapiens
taactgaactcctcacacc

SEQ ID NO: 1289 - DNA, 20 bp, Homo sapiens
taactgaactcctcacaccc

SEQ ID NO: 1290 - DNA, 21 bp, Homo sapiens
taactgaactcctcacaccca

SEQ ID NO: 1291 - DNA, 29 bp, Homo sapiens
taactgaactcctcacacccaattggacc

SEQ ID NO: 1292 - DNA, 16 bp, Homo sapiens
aactgaactcctcaca

SEQ ID NO: 1293 - DNA, 18 bp, Homo sapiens
aactgaactcctcacacc

SEQ ID NO: 1294 - DNA, 19 bp, Homo sapiens
aactgaactcctcacaccc

SEQ ID NO: 1295 - DNA, 20 bp, Homo sapiens
aactgaactcctcacaccca

SEQ ID NO: 1296 - DNA, 25 bp, Homo sapiens
aactgaactcctcacacccaattgg

SEQ ID NO: 1297 - DNA, 26 bp, Homo sapiens
aactgaactcctcacacccaattgga

SEQ ID NO: 1298 - DNA, 28 bp, Homo sapiens
aactgaactcctcacacccaattggacc

SEQ ID NO: 1299 - DNA, 32 bp, Homo sapiens
aactgaactcctcacacccaattggaccaatc

SEQ ID NO: 1300 - DNA, 33 bp, Homo sapiens
aactgaactcctcacacccaattggaccaatct

SEQ ID NO: 1301 - DNA, 17 bp, Homo sapiens
actgaactcctcacacc

SEQ ID NO: 1302 - DNA, 18 bp, Homo sapiens
actgaactcctcacaccc

SEQ ID NO: 1303 - DNA, 19 bp, Homo sapiens
actgaactcctcacaccca

SEQ ID NO: 1304 - DNA, 27 bp, Homo sapiens
actgaactcctcacacccaattggacc

SEQ ID NO: 1305 - DNA, 16 bp, Homo sapiens
ctgaactcctcacacc

SEQ ID NO: 1306 - DNA, 17 bp, Homo sapiens
ctgaactcctcacaccc

SEQ ID NO: 1307 - DNA, 18 bp, Homo sapiens
ctgaactcctcacaccca

SEQ ID NO: 1308 - DNA, 26 bp, Homo sapiens
ctgaactcctcacacccaattggacc

SEQ ID NO: 1309 - DNA, 16 bp, Homo sapiens
tgaactcctcacaccc

SEQ ID NO: 1310 - DNA, 17 bp, Homo sapiens
tgaactcctcacaccca

SEQ ID NO: 1311 - DNA, 19 bp, Homo sapiens
cctcacacccaattggacc

SEQ ID NO: 1312 - DNA, 17 bp, Homo sapiens
tcacacccaattggacc

SEQ ID NO: 1313 - DNA, 28 bp, Homo sapiens
tcacacccaattggaccaatctatcacc

SEQ ID NO: 1314 - DNA, 29 bp, Homo sapiens
tcacacccaattggaccaatctatcaccc

SEQ ID NO: 1315 - DNA, 30 bp, Homo sapiens
tcacacccaattggaccaatctatcaccct

SEQ ID NO: 1316 - DNA, 16 bp, Homo sapiens
cacacccaattggacc

SEQ ID NO: 1317 - DNA, 27 bp, Homo sapiens
cacacccaattggaccaatctatcacc

SEQ ID NO: 1318 - DNA, 28 bp, Homo sapiens
cacacccaattggaccaatctatcaccc

SEQ ID NO: 1319 - DNA, 29 bp, Homo sapiens
cacacccaattggaccaatctatcaccct

SEQ ID NO: 1320 - DNA, 28 bp, Homo sapiens
acacccaattggaccaatctatcaccct

SEQ ID NO: 1321 - DNA, 25 bp, Homo sapiens
cacccaattggaccaatctatcacc

SEQ ID NO: 1322 - DNA, 26 bp, Homo sapiens
cacccaattggaccaatctatcaccc

SEQ ID NO: 1323 - DNA, 27 bp, Homo sapiens
cacccaattggaccaatctatcaccct

SEQ ID NO: 1324 - DNA, 30 bp, Homo sapiens
cacccaattggaccaatctatcaccctata

SEQ ID NO: 1325 - DNA, 31 bp, Homo sapiens
cacccaattggaccaatctatcaccctatag

SEQ ID NO: 1326 - DNA, 33 bp, Homo sapiens
cacccaattggaccaatctatcaccctatagaa

SEQ ID NO: 1327 - DNA, 24 bp, Homo sapiens
cccaattggaccaatctatcaccc

SEQ ID NO: 1328 - DNA, 25 bp, Homo sapiens
cccaattggaccaatctatcaccct

SEQ ID NO: 1329 - DNA, 31 bp, Homo sapiens
cccaattggaccaatctatcaccctatagaa

SEQ ID NO: 1330 - DNA, 23 bp, Homo sapiens
ccaattggaccaatctatcaccc

SEQ ID NO: 1331 - DNA, 24 bp, Homo sapiens
ccaattggaccaatctatcaccct

SEQ ID NO: 1332 - DNA, 30 bp, Homo sapiens
ccaattggaccaatctatcaccctatagaa

SEQ ID NO: 1333 - DNA, 21 bp, Homo sapiens
caattggaccaatctatcacc

SEQ ID NO: 1334 - DNA, 22 bp, Homo sapiens
caattggaccaatctatcaccc

SEQ ID NO: 1335 - DNA, 23 bp, Homo sapiens
caattggaccaatctatcaccct

SEQ ID NO: 1336 - DNA, 24 bp, Homo sapiens
caattggaccaatctatcacccta

SEQ ID NO: 1337 - DNA, 25 bp, Homo sapiens
caattggaccaatctatcaccctat

SEQ ID NO: 1338 - DNA, 26 bp, Homo sapiens
caattggaccaatctatcaccctata

SEQ ID NO: 1339 - DNA, 27 bp, Homo sapiens
caattggaccaatctatcaccctatag

SEQ ID NO: 1340 - DNA, 28 bp, Homo sapiens
caattggaccaatctatcaccctataga

SEQ ID NO: 1341 - DNA, 29 bp, Homo sapiens
caattggaccaatctatcaccctatagaa

SEQ ID NO: 1342 - DNA, 30 bp, Homo sapiens
caattggaccaatctatcaccctatagaag

SEQ ID NO: 1343 - DNA, 31 bp, Homo sapiens
caattggaccaatctatcaccctatagaaga

SEQ ID NO: 1344 - DNA, 32 bp, Homo sapiens
caattggaccaatctatcaccctatagaagaa

SEQ ID NO: 1345 - DNA, 33 bp, Homo sapiens
caattggaccaatctatcaccctatagaagaac

SEQ ID NO: 1346 - DNA, 17 bp, Homo sapiens
aattggaccaatctatc

SEQ ID NO: 1347 - DNA, 20 bp, Homo sapiens
aattggaccaatctatcacc

SEQ ID NO: 1348 - DNA, 21 bp, Homo sapiens
aattggaccaatctatcaccc

SEQ ID NO: 1349 - DNA, 22 bp, Homo sapiens
aattggaccaatctatcaccct

SEQ ID NO: 1350 - DNA, 23 bp, Homo sapiens
aattggaccaatctatcacccta

SEQ ID NO: 1351 - DNA, 24 bp, Homo sapiens
aattggaccaatctatcaccctat

SEQ ID NO: 1352 - DNA, 25 bp, Homo sapiens
aattggaccaatctatcaccctata

SEQ ID NO: 1353 - DNA, 26 bp, Homo sapiens
aattggaccaatctatcaccctatag

SEQ ID NO: 1354 - DNA, 27 bp, Homo sapiens
aattggaccaatctatcaccctataga

SEQ ID NO: 1355 - DNA, 28 bp, Homo sapiens
aattggaccaatctatcaccctatagaa

SEQ ID NO: 1356 - DNA, 29 bp, Homo sapiens
aattggaccaatctatcaccctatagaag

SEQ ID NO: 1357 - DNA, 30 bp, Homo sapiens
aattggaccaatctatcaccctatagaaga

SEQ ID NO: 1358 - DNA, 31 bp, Homo sapiens
aattggaccaatctatcaccctatagaagaa

SEQ ID NO: 1359 - DNA, 32 bp, Homo sapiens
aattggaccaatctatcaccctatagaagaac

SEQ ID NO: 1360 - DNA, 33 bp, Homo sapiens
aattggaccaatctatcaccctatagaagaact

SEQ ID NO: 1361 - DNA, 19 bp, Homo sapiens
attggaccaatctatcacc

SEQ ID NO: 1362 - DNA, 20 bp, Homo sapiens
attggaccaatctatcaccc

SEQ ID NO: 1363 - DNA, 21 bp, Homo sapiens
attggaccaatctatcaccct

SEQ ID NO: 1364 - DNA, 22 bp, Homo sapiens
attggaccaatctatcacccta

SEQ ID NO: 1365 - DNA, 24 bp, Homo sapiens
attggaccaatctatcaccctata

SEQ ID NO: 1366 - DNA, 26 bp, Homo sapiens
attggaccaatctatcaccctataga

SEQ ID NO: 1367 - DNA, 27 bp, Homo sapiens
attggaccaatctatcaccctatagaa

SEQ ID NO: 1368 - DNA, 28 bp, Homo sapiens
attggaccaatctatcaccctatagaag

SEQ ID NO: 1369 - DNA, 29 bp, Homo sapiens
attggaccaatctatcaccctatagaaga

SEQ ID NO: 1370 - DNA, 31 bp, Homo sapiens
attggaccaatctatcaccctatagaagaac

SEQ ID NO: 1371 - DNA, 32 bp, Homo sapiens
attggaccaatctatcaccctatagaagaact

SEQ ID NO: 1372 - DNA, 19 bp, Homo sapiens
ttggaccaatctatcaccc

SEQ ID NO: 1373 - DNA, 20 bp, Homo sapiens
ttggaccaatctatcaccct

SEQ ID NO: 1374 - DNA, 26 bp, Homo sapiens
ttggaccaatctatcaccctatagaa

SEQ ID NO: 1375 - DNA, 27 bp, Homo sapiens
ttggaccaatctatcaccctatagaag

SEQ ID NO: 1376 - DNA, 31 bp, Homo sapiens
ttggaccaatctatcaccctatagaagaact

SEQ ID NO: 1377 - DNA, 21 bp, Homo sapiens
gcataagcctgcgtcagatta

SEQ ID NO: 1378 - DNA, 28 bp, Homo sapiens
gcataagcctgcgtcagattaaaacact

SEQ ID NO: 1379 - DNA, 33 bp, Homo sapiens
gcataagcctgcgtcagattaaaacactgaact

SEQ ID NO: 1380 - DNA, 18 bp, Homo sapiens
cataagcctgcgtcagat

SEQ ID NO: 1381 - DNA, 20 bp, Homo sapiens
cataagcctgcgtcagatta

SEQ ID NO: 1382 - DNA, 24 bp, Homo sapiens
cataagcctgcgtcagattaaaac

SEQ ID NO: 1383 - DNA, 25 bp, Homo sapiens
cataagcctgcgtcagattaaaaca

SEQ ID NO: 1384 - DNA, 26 bp, Homo sapiens
cataagcctgcgtcagattaaaacac

SEQ ID NO: 1385 - DNA, 27 bp, Homo sapiens
cataagcctgcgtcagattaaaacact

SEQ ID NO: 1386 - DNA, 28 bp, Homo sapiens
cataagcctgcgtcagattaaaacactg

SEQ ID NO: 1387 - DNA, 31 bp, Homo sapiens
cataagcctgcgtcagattaaaacactgaac

SEQ ID NO: 1388 - DNA, 32 bp, Homo sapiens
cataagcctgcgtcagattaaaacactgaact

SEQ ID NO: 1389 - DNA, 26 bp, Homo sapiens
ataagcctgcgtcagattaaaacact

SEQ ID NO: 1390 - DNA, 31 bp, Homo sapiens
ataagcctgcgtcagattaaaacactgaact

SEQ ID NO: 1391 - DNA, 16 bp, Homo sapiens
taagcctgcgtcagat

SEQ ID NO: 1392 - DNA, 22 bp, Homo sapiens
taagcctgcgtcagattaaaac

SEQ ID NO: 1393 - DNA, 24 bp, Homo sapiens
taagcctgcgtcagattaaaacac

SEQ ID NO: 1394 - DNA, 25 bp, Homo sapiens
taagcctgcgtcagattaaaacact

SEQ ID NO: 1395 - DNA, 30 bp, Homo sapiens
taagcctgcgtcagattaaaacactgaact

SEQ ID NO: 1396 - DNA, 33 bp, Homo sapiens
taagcctgcgtcagattaaaacactgaactgac

SEQ ID NO: 1397 - DNA, 24 bp, Homo sapiens
aagcctgcgtcagattaaaacact

SEQ ID NO: 1398 - DNA, 29 bp, Homo sapiens
aagcctgcgtcagattaaaacactgaact

SEQ ID NO: 1399 - DNA, 32 bp, Homo sapiens
aagcctgcgtcagattaaaacactgaactgac

SEQ ID NO: 1400 - DNA, 33 bp, Homo sapiens
aagcctgcgtcagattaaaacactgaactgaca

SEQ ID NO: 1401 - DNA, 23 bp, Homo sapiens
agcctgcgtcagattaaaacact

SEQ ID NO: 1402 - DNA, 28 bp, Homo sapiens
agcctgcgtcagattaaaacactgaact

SEQ ID NO: 1403 - DNA, 31 bp, Homo sapiens
agcctgcgtcagattaaaacactgaactgac

SEQ ID NO: 1404 - DNA, 32 bp, Homo sapiens
agcctgcgtcagattaaaacactgaactgaca

SEQ ID NO: 1405 - DNA, 27 bp, Homo sapiens
gcctgcgtcagattaaaacactgaact

SEQ ID NO: 1406 - DNA, 31 bp, Homo sapiens
gcctgcgtcagattaaaacactgaactgaca

SEQ ID NO: 1407 - DNA, 19 bp, Homo sapiens
tgcgtcagattaaaacact

SEQ ID NO: 1408 - DNA, 24 bp, Homo sapiens
tgcgtcagattaaaacactgaact

SEQ ID NO: 1409 - DNA, 18 bp, Homo sapiens
agattaaaacactgaact

SEQ ID NO: 1410 - DNA, 17 bp, Homo sapiens
gattaaaacactgaact

SEQ ID NO: 1411 - DNA, 31 bp, Homo sapiens
gattaaaacactgaactgacaattaacagcc

SEQ ID NO: 1412 - DNA, 32 bp, Homo sapiens
gattaaaacactgaactgacaattaacagccc

SEQ ID NO: 1413 - DNA, 30 bp, Homo sapiens
attaaaacactgaactgacaattaacagcc

SEQ ID NO: 1414 - DNA, 31 bp, Homo sapiens
attaaaacactgaactgacaattaacagccc

SEQ ID NO: 1415 - DNA, 28 bp, Homo sapiens
taaaacactgaactgacaattaacagcc

SEQ ID NO: 1416 - DNA, 29 bp, Homo sapiens
taaaacactgaactgacaattaacagccc

SEQ ID NO: 1417 - DNA, 28 bp, Homo sapiens
aaaacactgaactgacaattaacagccc

SEQ ID NO: 1418 - DNA, 26 bp, Homo sapiens
aaacactgaactgacaattaacagcc

SEQ ID NO: 1419 - DNA, 27 bp, Homo sapiens
aaacactgaactgacaattaacagccc

SEQ ID NO: 1420 - DNA, 25 bp, Homo sapiens
aacactgaactgacaattaacagcc

SEQ ID NO: 1421 - DNA, 26 bp, Homo sapiens
aacactgaactgacaattaacagccc

SEQ ID NO: 1422 - DNA, 24 bp, Homo sapiens
cactgaactgacaattaacagccc

SEQ ID NO: 1423 - DNA, 21 bp, Homo sapiens
ctgaactgacaattaacagcc

SEQ ID NO: 1424 - DNA, 22 bp, Homo sapiens
ctgaactgacaattaacagccc

SEQ ID NO: 1425 - DNA, 28 bp, Homo sapiens
attaacagcccaatatctacaatcaacc

SEQ ID NO: 1426 - DNA, 32 bp, Homo sapiens
attaacagcccaatatctacaatcaaccaaca

SEQ ID NO: 1427 - DNA, 25 bp, Homo sapiens
aacagcccaatatctacaatcaacc

SEQ ID NO: 1428 - DNA, 22 bp, Homo sapiens
caatatctacaatcaaccaaca

SEQ ID NO: 1429 - DNA, 21 bp, Homo sapiens
aatatctacaatcaaccaaca

SEQ ID NO: 1430 - DNA, 20 bp, Homo sapiens
atatctacaatcaaccaaca

SEQ ID NO: 1431 - DNA, 33 bp, Homo sapiens
atatctacaatcaaccaacaagtcattattacc

SEQ ID NO: 1432 - DNA, 27 bp, Homo sapiens
acaatcaaccaacaagtcattattacc

SEQ ID NO: 1433 - DNA, 33 bp, Homo sapiens
acaatcaaccaacaagtcattattaccctcact

SEQ ID NO: 1434 - DNA, 30 bp, Homo sapiens
atcaaccaacaagtcattattaccctcact

SEQ ID NO: 1435 - DNA, 21 bp, Homo sapiens
aaccaacaagtcattattacc

SEQ ID NO: 1436 - DNA, 23 bp, Homo sapiens
aacaagtcattattaccctcact

SEQ ID NO: 1437 - DNA, 25 bp, Homo sapiens
aacaagtcattattaccctcactgt

SEQ ID NO: 1438 - DNA, 26 bp, Homo sapiens
aacaagtcattattaccctcactgtc

SEQ ID NO: 1439 - DNA, 30 bp, Homo sapiens
aacaagtcattattaccctcactgtcaacc

SEQ ID NO: 1440 - DNA, 31 bp, Homo sapiens
aacaagtcattattaccctcactgtcaaccc

SEQ ID NO: 1441 - DNA, 25 bp, Homo sapiens
acaagtcattattaccctcactgtc

SEQ ID NO: 1442 - DNA, 29 bp, Homo sapiens
acaagtcattattaccctcactgtcaacc

SEQ ID NO: 1443 - DNA, 30 bp, Homo sapiens
acaagtcattattaccctcactgtcaaccc

SEQ ID NO: 1444 - DNA, 27 bp, Homo sapiens
agtcattattaccctcactgtcaaccc

SEQ ID NO: 1445 - DNA, 18 bp, Homo sapiens
attattaccctcactgtc

SEQ ID NO: 1446 - DNA, 22 bp, Homo sapiens
attattaccctcactgtcaacc

SEQ ID NO: 1447 - DNA, 23 bp, Homo sapiens
attattaccctcactgtcaaccc

SEQ ID NO: 1448 - DNA, 21 bp, Homo sapiens
ttattaccctcactgtcaacc

SEQ ID NO: 1449 - DNA, 22 bp, Homo sapiens
ttattaccctcactgtcaaccc

SEQ ID NO: 1450 - DNA, 21 bp, Homo sapiens
tattaccctcactgtcaaccc

SEQ ID NO: 1451 - DNA, 19 bp, Homo sapiens
attaccctcactgtcaacc

SEQ ID NO: 1452 - DNA, 20 bp, Homo sapiens
attaccctcactgtcaaccc

SEQ ID NO: 1453 - DNA, 18 bp, Homo sapiens
ttaccctcactgtcaacc

SEQ ID NO: 1454 - DNA, 19 bp, Homo sapiens
ttaccctcactgtcaaccc

SEQ ID NO: 1455 - DNA, 18 bp, Homo sapiens
taccctcactgtcaaccc

SEQ ID NO: 1456 - DNA, 25 bp, Homo sapiens
aacacaggcatgctcataaggaaag

SEQ ID NO: 1457 - DNA, 33 bp, Homo sapiens
cataaggaaaggttaaaaaaagtaaaaggaact

SEQ ID NO: 1458 - DNA, 31 bp, Homo sapiens
taaggaaaggttaaaaaaagtaaaaggaact

SEQ ID NO: 1459 - DNA, 30 bp, Homo sapiens
aaggaaaggttaaaaaaagtaaaaggaact

SEQ ID NO: 1460 - DNA, 32 bp, Homo sapiens
gaaaggttaaaaaaagtaaaaggaactcggca

SEQ ID NO: 1461 - DNA, 31 bp, Homo sapiens
gttaaaaaaagtaaaaggaactcggcaaatc

SEQ ID NO: 1462 - DNA, 29 bp, Homo sapiens
taaaaaaagtaaaaggaactcggcaaatc

SEQ ID NO: 1463 - DNA, 24 bp, Homo sapiens
aaaaaaagtaaaaggaactcggca

SEQ ID NO: 1464 - DNA, 28 bp, Homo sapiens
aaaaaaagtaaaaggaactcggcaaatc

SEQ ID NO: 1465 - DNA, 29 bp, Homo sapiens
aaaaaaagtaaaaggaactcggcaaatct

SEQ ID NO: 1466 - DNA, 33 bp, Homo sapiens
aaaaaaagtaaaaggaactcggcaaatcttacc

SEQ ID NO: 1467 - DNA, 27 bp, Homo sapiens
aaaaaagtaaaaggaactcggcaaatc

SEQ ID NO: 1468 - DNA, 28 bp, Homo sapiens
aaaaaagtaaaaggaactcggcaaatct

SEQ ID NO: 1469 - DNA, 32 bp, Homo sapiens
aaaaaagtaaaaggaactcggcaaatcttacc

SEQ ID NO: 1470 - DNA, 22 bp, Homo sapiens
aaaaagtaaaaggaactcggca

SEQ ID NO: 1471 - DNA, 26 bp, Homo sapiens
aaaaagtaaaaggaactcggcaaatc

SEQ ID NO: 1472 - DNA, 27 bp, Homo sapiens
aaaaagtaaaaggaactcggcaaatct

SEQ ID NO: 1473 - DNA, 31 bp, Homo sapiens
aaaaagtaaaaggaactcggcaaatcttacc

SEQ ID NO: 1474 - DNA, 21 bp, Homo sapiens
aaaagtaaaaggaactcggca

SEQ ID NO: 1475 - DNA, 25 bp, Homo sapiens
aaaagtaaaaggaactcggcaaatc

SEQ ID NO: 1476 - DNA, 26 bp, Homo sapiens
aaaagtaaaaggaactcggcaaatct

SEQ ID NO: 1477 - DNA, 30 bp, Homo sapiens
aaaagtaaaaggaactcggcaaatcttacc

SEQ ID NO: 1478 - DNA, 31 bp, Homo sapiens
aaaagtaaaaggaactcggcaaatcttaccc

SEQ ID NO: 1479 - DNA, 20 bp, Homo sapiens
aaagtaaaaggaactcggca

SEQ ID NO: 1480 - DNA, 24 bp, Homo sapiens
aaagtaaaaggaactcggcaaatc

SEQ ID NO: 1481 - DNA, 25 bp, Homo sapiens
aaagtaaaaggaactcggcaaatct

SEQ ID NO: 1482 - DNA, 29 bp, Homo sapiens
aaagtaaaaggaactcggcaaatcttacc

SEQ ID NO: 1483 - DNA, 30 bp, Homo sapiens
aaagtaaaaggaactcggcaaatcttaccc

SEQ ID NO: 1484 - DNA, 19 bp, Homo sapiens
aagtaaaaggaactcggca

SEQ ID NO: 1485 - DNA, 23 bp, Homo sapiens
aagtaaaaggaactcggcaaatc

SEQ ID NO: 1486 - DNA, 24 bp, Homo sapiens
aagtaaaaggaactcggcaaatct

SEQ ID NO: 1487 - DNA, 28 bp, Homo sapiens
aagtaaaaggaactcggcaaatcttacc

SEQ ID NO: 1488 - DNA, 29 bp, Homo sapiens
aagtaaaaggaactcggcaaatcttaccc

SEQ ID NO: 1489 - DNA, 22 bp, Homo sapiens
agtaaaaggaactcggcaaatc

SEQ ID NO: 1490 - DNA, 21 bp, Homo sapiens
gtaaaaggaactcggcaaatc

SEQ ID NO: 1491 - DNA, 20 bp, Homo sapiens
taaaaggaactcggcaaatc

SEQ ID NO: 1492 - DNA, 25 bp, Homo sapiens
taaaaggaactcggcaaatcttacc

SEQ ID NO: 1493 - DNA, 26 bp, Homo sapiens
taaaaggaactcggcaaatcttaccc

SEQ ID NO: 1494 - DNA, 19 bp, Homo sapiens
aaaaggaactcggcaaatc

SEQ ID NO: 1495 - DNA, 24 bp, Homo sapiens
aaaaggaactcggcaaatcttacc

SEQ ID NO: 1496 - DNA, 25 bp, Homo sapiens
aaaaggaactcggcaaatcttaccc

SEQ ID NO: 1497 - DNA, 18 bp, Homo sapiens
aaaggaactcggcaaatc

SEQ ID NO: 1498 - DNA, 19 bp, Homo sapiens
aaaggaactcggcaaatct

SEQ ID NO: 1499 - DNA, 23 bp, Homo sapiens
aaaggaactcggcaaatcttacc

SEQ ID NO: 1500 - DNA, 24 bp, Homo sapiens
aaaggaactcggcaaatcttaccc

SEQ ID NO: 1501 - DNA, 25 bp, Homo sapiens
aaaggaactcggcaaatcttacccc

SEQ ID NO: 1502 - DNA, 28 bp, Homo sapiens
aaaggaactcggcaaatcttaccccgcc

SEQ ID NO: 1503 - DNA, 29 bp, Homo sapiens
aaaggaactcggcaaatcttaccccgcct

SEQ ID NO: 1504 - DNA, 17 bp, Homo sapiens
aaggaactcggcaaatc

SEQ ID NO: 1505 - DNA, 22 bp, Homo sapiens
aaggaactcggcaaatcttacc

SEQ ID NO: 1506 - DNA, 23 bp, Homo sapiens
aaggaactcggcaaatcttaccc

SEQ ID NO: 1507 - DNA, 27 bp, Homo sapiens
aaggaactcggcaaatcttaccccgcc

SEQ ID NO: 1508 - DNA, 28 bp, Homo sapiens
aaggaactcggcaaatcttaccccgcct

SEQ ID NO: 1509 - DNA, 16 bp, Homo sapiens
aggaactcggcaaatc

SEQ ID NO: 1510 - DNA, 21 bp, Homo sapiens
aggaactcggcaaatcttacc

SEQ ID NO: 1511 - DNA, 22 bp, Homo sapiens
aggaactcggcaaatcttaccc

SEQ ID NO: 1512 - DNA, 27 bp, Homo sapiens
aggaactcggcaaatcttaccccgcct

SEQ ID NO: 1513 - DNA, 27 bp, Homo sapiens
cggcaaatcttaccccgcctgtttacc

SEQ ID NO: 1514 - DNA, 22 bp, Homo sapiens
aatcttaccccgcctgtttacc

SEQ ID NO: 1515 - DNA, 19 bp, Homo sapiens
cttaccccgcctgtttacc

SEQ ID NO: 1516 - DNA, 18 bp, Homo sapiens
ttaccccgcctgtttacc

SEQ ID NO: 1517 - DNA, 17 bp, Homo sapiens
taccccgcctgtttacc

SEQ ID NO: 1518 - DNA, 24 bp, Homo sapiens
aaaaacatcacctctagcatcacc

SEQ ID NO: 1519 - DNA, 23 bp, Homo sapiens
aaaacatcacctctagcatcacc

SEQ ID NO: 1520 - DNA, 33 bp, Homo sapiens
gcccagtgacacatgtttaacggccgcggtacc

SEQ ID NO: 1521 - DNA, 32 bp, Homo sapiens
cccagtgacacatgtttaacggccgcggtacc

SEQ ID NO: 1522 - DNA, 33 bp, Homo sapiens
cccagtgacacatgtttaacggccgcggtaccc

SEQ ID NO: 1523 - DNA, 22 bp, Homo sapiens
cagtgacacatgtttaacggcc

SEQ ID NO: 1524 - DNA, 29 bp, Homo sapiens
cagtgacacatgtttaacggccgcggtac

SEQ ID NO: 1525 - DNA, 30 bp, Homo sapiens
cagtgacacatgtttaacggccgcggtacc

SEQ ID NO: 1526 - DNA, 31 bp, Homo sapiens
cagtgacacatgtttaacggccgcggtaccc

SEQ ID NO: 1527 - DNA, 32 bp, Homo sapiens
cagtgacacatgtttaacggccgcggtaccct

SEQ ID NO: 1528 - DNA, 33 bp, Homo sapiens
cagtgacacatgtttaacggccgcggtacccta

SEQ ID NO: 1529 - DNA, 21 bp, Homo sapiens
agtgacacatgtttaacggcc

SEQ ID NO: 1530 - DNA, 28 bp, Homo sapiens
agtgacacatgtttaacggccgcggtac

SEQ ID NO: 1531 - DNA, 29 bp, Homo sapiens
agtgacacatgtttaacggccgcggtacc

SEQ ID NO: 1532 - DNA, 30 bp, Homo sapiens
agtgacacatgtttaacggccgcggtaccc

SEQ ID NO: 1533 - DNA, 31 bp, Homo sapiens
agtgacacatgtttaacggccgcggtaccct

SEQ ID NO: 1534 - DNA, 32 bp, Homo sapiens
agtgacacatgtttaacggccgcggtacccta

SEQ ID NO: 1535 - DNA, 28 bp, Homo sapiens
gtgacacatgtttaacggccgcggtacc

SEQ ID NO: 1536 - DNA, 29 bp, Homo sapiens
gtgacacatgtttaacggccgcggtaccc

SEQ ID NO: 1537 - DNA, 30 bp, Homo sapiens
gtgacacatgtttaacggccgcggtaccct

SEQ ID NO: 1538 - DNA, 31 bp, Homo sapiens
gtgacacatgtttaacggccgcggtacccta

SEQ ID NO: 1539 - DNA, 19 bp, Homo sapiens
tgacacatgtttaacggcc

SEQ ID NO: 1540 - DNA, 27 bp, Homo sapiens
tgacacatgtttaacggccgcggtacc

SEQ ID NO: 1541 - DNA, 28 bp, Homo sapiens
tgacacatgtttaacggccgcggtaccc

SEQ ID NO: 1542 - DNA, 29 bp, Homo sapiens
tgacacatgtttaacggccgcggtaccct

SEQ ID NO: 1543 - DNA, 30 bp, Homo sapiens
tgacacatgtttaacggccgcggtacccta

SEQ ID NO: 1544 - DNA, 18 bp, Homo sapiens
gacacatgtttaacggcc

SEQ ID NO: 1545 - DNA, 26 bp, Homo sapiens
gacacatgtttaacggccgcggtacc

SEQ ID NO: 1546 - DNA, 27 bp, Homo sapiens
gacacatgtttaacggccgcggtaccc

SEQ ID NO: 1547 - DNA, 17 bp, Homo sapiens
acacatgtttaacggcc

SEQ ID NO: 1548 - DNA, 20 bp, Homo sapiens
acacatgtttaacggccgcg

SEQ ID NO: 1549 - DNA, 24 bp, Homo sapiens
acacatgtttaacggccgcggtac

SEQ ID NO: 1550 - DNA, 25 bp, Homo sapiens
acacatgtttaacggccgcggtacc

SEQ ID NO: 1551 - DNA, 26 bp, Homo sapiens
acacatgtttaacggccgcggtaccc

SEQ ID NO: 1552 - DNA, 27 bp, Homo sapiens
acacatgtttaacggccgcggtaccct

SEQ ID NO: 1553 - DNA, 28 bp, Homo sapiens
acacatgtttaacggccgcggtacccta

SEQ ID NO: 1554 - DNA, 31 bp, Homo sapiens
acacatgtttaacggccgcggtaccctaacc

SEQ ID NO: 1555 - DNA, 16 bp, Homo sapiens
cacatgtttaacggcc

SEQ ID NO: 1556 - DNA, 23 bp, Homo sapiens
cacatgtttaacggccgcggtac

SEQ ID NO: 1557 - DNA, 24 bp, Homo sapiens
cacatgtttaacggccgcggtacc

SEQ ID NO: 1558 - DNA, 25 bp, Homo sapiens
cacatgtttaacggccgcggtaccc

SEQ ID NO: 1559 - DNA, 26 bp, Homo sapiens
cacatgtttaacggccgcggtaccct

SEQ ID NO: 1560 - DNA, 27 bp, Homo sapiens
cacatgtttaacggccgcggtacccta

SEQ ID NO: 1561 - DNA, 30 bp, Homo sapiens
cacatgtttaacggccgcggtaccctaacc

SEQ ID NO: 1562 - DNA, 23 bp, Homo sapiens
acatgtttaacggccgcggtacc

SEQ ID NO: 1563 - DNA, 24 bp, Homo sapiens
acatgtttaacggccgcggtaccc

SEQ ID NO: 1564 - DNA, 26 bp, Homo sapiens
acatgtttaacggccgcggtacccta

SEQ ID NO: 1565 - DNA, 21 bp, Homo sapiens
catgtttaacggccgcggtac

SEQ ID NO: 1566 - DNA, 22 bp, Homo sapiens
catgtttaacggccgcggtacc

SEQ ID NO: 1567 - DNA, 23 bp, Homo sapiens
catgtttaacggccgcggtaccc

SEQ ID NO: 1568 - DNA, 24 bp, Homo sapiens
catgtttaacggccgcggtaccct

SEQ ID NO: 1569 - DNA, 25 bp, Homo sapiens
catgtttaacggccgcggtacccta

SEQ ID NO: 1570 - DNA, 28 bp, Homo sapiens
catgtttaacggccgcggtaccctaacc

SEQ ID NO: 1571 - DNA, 21 bp, Homo sapiens
atgtttaacggccgcggtacc

SEQ ID NO: 1572 - DNA, 22 bp, Homo sapiens
atgtttaacggccgcggtaccc

SEQ ID NO: 1573 - DNA, 24 bp, Homo sapiens
atgtttaacggccgcggtacccta

SEQ ID NO: 1574 - DNA, 19 bp, Homo sapiens
tgtttaacggccgcggtac

SEQ ID NO: 1575 - DNA, 20 bp, Homo sapiens
tgtttaacggccgcggtacc

SEQ ID NO: 1576 - DNA, 21 bp, Homo sapiens
tgtttaacggccgcggtaccc

SEQ ID NO: 1577 - DNA, 18 bp, Homo sapiens
gtttaacggccgcggtac

SEQ ID NO: 1578 - DNA, 19 bp, Homo sapiens
gtttaacggccgcggtacc

SEQ ID NO: 1579 - DNA, 20 bp, Homo sapiens
gtttaacggccgcggtaccc

SEQ ID NO: 1580 - DNA, 18 bp, Homo sapiens
tttaacggccgcggtacc

SEQ ID NO: 1581 - DNA, 19 bp, Homo sapiens
tttaacggccgcggtaccc

SEQ ID NO: 1582 - DNA, 21 bp, Homo sapiens
tttaacggccgcggtacccta

SEQ ID NO: 1583 - DNA, 17 bp, Homo sapiens
ttaacggccgcggtacc

SEQ ID NO: 1584 - DNA, 18 bp, Homo sapiens
ttaacggccgcggtaccc

SEQ ID NO: 1585 - DNA, 16 bp, Homo sapiens
taacggccgcggtacc

SEQ ID NO: 1586 - DNA, 17 bp, Homo sapiens
taacggccgcggtaccc

SEQ ID NO: 1587 - DNA, 16 bp, Homo sapiens
aacggccgcggtaccc

SEQ ID NO: 1588 - DNA, 16 bp, Homo sapiens
agggacctgtatgaat

SEQ ID NO: 1589 - DNA, 17 bp, Homo sapiens
agggacctgtatgaatg

SEQ ID NO: 1590 - DNA, 20 bp, Homo sapiens
agggacctgtatgaatggct

SEQ ID NO: 1591 - DNA, 22 bp, Homo sapiens
agggacctgtatgaatggctcc

SEQ ID NO: 1592 - DNA, 31 bp, Homo sapiens
agggacctgtatgaatggctccacgagggtt

SEQ ID NO: 1593 - DNA, 32 bp, Homo sapiens
agggacctgtatgaatggctccacgagggttc

SEQ ID NO: 1594 - DNA, 33 bp, Homo sapiens
agggacctgtatgaatggctccacgagggttca

SEQ ID NO: 1595 - DNA, 18 bp, Homo sapiens
gggacctgtatgaatggc

SEQ ID NO: 1596 - DNA, 19 bp, Homo sapiens
gggacctgtatgaatggct

SEQ ID NO: 1597 - DNA, 21 bp, Homo sapiens
gggacctgtatgaatggctcc

SEQ ID NO: 1598 - DNA, 30 bp, Homo sapiens
gggacctgtatgaatggctccacgagggtt

SEQ ID NO: 1599 - DNA, 31 bp, Homo sapiens
gggacctgtatgaatggctccacgagggttc

SEQ ID NO: 1600 - DNA, 32 bp, Homo sapiens
gggacctgtatgaatggctccacgagggttca

SEQ ID NO: 1601 - DNA, 33 bp, Homo sapiens
gacctgtatgaatggctccacgagggttcagct

SEQ ID NO: 1602 - DNA, 28 bp, Homo sapiens
agggttcagctgtctcttacttttaacc

SEQ ID NO: 1603 - DNA, 18 bp, Homo sapiens
agtgaaattgacctgccc

SEQ ID NO: 1604 - DNA, 16 bp, Homo sapiens
ccgtgaagaggcgggc

SEQ ID NO: 1605 - DNA, 28 bp, Homo sapiens
cagcaagacgagaagaccctatggagct

SEQ ID NO: 1606 - DNA, 29 bp, Homo sapiens
cagcaagacgagaagaccctatggagctt

SEQ ID NO: 1607 - DNA, 28 bp, Homo sapiens
agcaagacgagaagaccctatggagctt

SEQ ID NO: 1608 - DNA, 26 bp, Homo sapiens
gcaagacgagaagaccctatggagct

SEQ ID NO: 1609 - DNA, 27 bp, Homo sapiens
gcaagacgagaagaccctatggagctt

SEQ ID NO: 1610 - DNA, 28 bp, Homo sapiens
gcaagacgagaagaccctatggagcttt

SEQ ID NO: 1611 - DNA, 25 bp, Homo sapiens
caagacgagaagaccctatggagct

SEQ ID NO: 1612 - DNA, 24 bp, Homo sapiens
agacgagaagaccctatggagctt

SEQ ID NO: 1613 - DNA, 20 bp, Homo sapiens
cgagaagaccctatggagct

SEQ ID NO: 1614 - DNA, 19 bp, Homo sapiens
gagaagaccctatggagct

SEQ ID NO: 1615 - DNA, 20 bp, Homo sapiens
gagaagaccctatggagctt

SEQ ID NO: 1616 - DNA, 18 bp, Homo sapiens
agaagaccctatggagct

SEQ ID NO: 1617 - DNA, 19 bp, Homo sapiens
agaagaccctatggagctt

SEQ ID NO: 1618 - DNA, 17 bp, Homo sapiens
aagaccctatggagctt

SEQ ID NO: 1619 - DNA, 32 bp, Homo sapiens
aatttattaatgcaaacagtacctaacaaacc

SEQ ID NO: 1620 - DNA, 19 bp, Homo sapiens
aaacagtacctaacaaacc

SEQ ID NO: 1621 - DNA, 29 bp, Homo sapiens
cctaacaaacccacaggtcctaaactacc

SEQ ID NO: 1622 - DNA, 16 bp, Homo sapiens
ccacaggtcctaaact

SEQ ID NO: 1623 - DNA, 16 bp, Homo sapiens
cacaggtcctaaacta

SEQ ID NO: 1624 - DNA, 17 bp, Homo sapiens
cacaggtcctaaactac

SEQ ID NO: 1625 - DNA, 18 bp, Homo sapiens
cacaggtcctaaactacc

SEQ ID NO: 1626 - DNA, 32 bp, Homo sapiens
aaacctgcattaaaaatttcggttggggcgac

SEQ ID NO: 1627 - DNA, 28 bp, Homo sapiens
tgcattaaaaatttcggttggggcgacc

SEQ ID NO: 1628 - DNA, 24 bp, Homo sapiens
ttaaaaatttcggttggggcgacc

SEQ ID NO: 1629 - DNA, 21 bp, Homo sapiens
aaaatttcggttggggcgacc

SEQ ID NO: 1630 - DNA, 33 bp, Homo sapiens
aaatttcggttggggcgacctcggagcagaacc

SEQ ID NO: 1631 - DNA, 19 bp, Homo sapiens
aatttcggttggggcgacc

SEQ ID NO: 1632 - DNA, 27 bp, Homo sapiens
aatttcggttggggcgacctcggagca

SEQ ID NO: 1633 - DNA, 32 bp, Homo sapiens
aatttcggttggggcgacctcggagcagaacc

SEQ ID NO: 1634 - DNA, 33 bp, Homo sapiens
aatttcggttggggcgacctcggagcagaaccc

SEQ ID NO: 1635 - DNA, 18 bp, Homo sapiens
atttcggttggggcgacc

SEQ ID NO: 1636 - DNA, 31 bp, Homo sapiens
atttcggttggggcgacctcggagcagaacc

SEQ ID NO: 1637 - DNA, 32 bp, Homo sapiens
atttcggttggggcgacctcggagcagaaccc

SEQ ID NO: 1638 - DNA, 30 bp, Homo sapiens
tttcggttggggcgacctcggagcagaacc

SEQ ID NO: 1639 - DNA, 31 bp, Homo sapiens
tttcggttggggcgacctcggagcagaaccc

SEQ ID NO: 1640 - DNA, 16 bp, Homo sapiens
ttcggttggggcgacc

SEQ ID NO: 1641 - DNA, 29 bp, Homo sapiens
ttcggttggggcgacctcggagcagaacc

SEQ ID NO: 1642 - DNA, 30 bp, Homo sapiens
ttcggttggggcgacctcggagcagaaccc

SEQ ID NO: 1643 - DNA, 28 bp, Homo sapiens
tcggttggggcgacctcggagcagaacc

SEQ ID NO: 1644 - DNA, 29 bp, Homo sapiens
tcggttggggcgacctcggagcagaaccc

SEQ ID NO: 1645 - DNA, 27 bp, Homo sapiens
cggttggggcgacctcggagcagaacc

SEQ ID NO: 1646 - DNA, 26 bp, Homo sapiens
ggttggggcgacctcggagcagaacc

SEQ ID NO: 1647 - DNA, 25 bp, Homo sapiens
gttggggcgacctcggagcagaacc

SEQ ID NO: 1648 - DNA, 26 bp, Homo sapiens
gttggggcgacctcggagcagaaccc

SEQ ID NO: 1649 - DNA, 22 bp, Homo sapiens
ggggcgacctcggagcagaacc

SEQ ID NO: 1650 - DNA, 23 bp, Homo sapiens
ggggcgacctcggagcagaaccc

SEQ ID NO: 1651 - DNA, 21 bp, Homo sapiens
gggcgacctcggagcagaacc

SEQ ID NO: 1652 - DNA, 20 bp, Homo sapiens
ggcgacctcggagcagaacc

SEQ ID NO: 1653 - DNA, 19 bp, Homo sapiens
gcgacctcggagcagaacc

SEQ ID NO: 1654 - DNA, 18 bp, Homo sapiens
cgacctcggagcagaacc

SEQ ID NO: 1655 - DNA, 19 bp, Homo sapiens
cgacctcggagcagaaccc

SEQ ID NO: 1656 - DNA, 17 bp, Homo sapiens
gacctcggagcagaacc

SEQ ID NO: 1657 - DNA, 18 bp, Homo sapiens
gacctcggagcagaaccc

SEQ ID NO: 1658 - DNA, 16 bp, Homo sapiens
acctcggagcagaacc

SEQ ID NO: 1659 - DNA, 17 bp, Homo sapiens
acctcggagcagaaccc

SEQ ID NO: 1660 - DNA, 24 bp, Homo sapiens
acctcggagcagaacccaacctcc

SEQ ID NO: 1661 - DNA, 22 bp, Homo sapiens
ctcggagcagaacccaacctcc

SEQ ID NO: 1662 - DNA, 19 bp, Homo sapiens
tcggagcagaacccaacct

SEQ ID NO: 1663 - DNA, 21 bp, Homo sapiens
tcggagcagaacccaacctcc

SEQ ID NO: 1664 - DNA, 18 bp, Homo sapiens
cggagcagaacccaacct

SEQ ID NO: 1665 - DNA, 20 bp, Homo sapiens
cggagcagaacccaacctcc

SEQ ID NO: 1666 - DNA, 20 bp, Homo sapiens
caacctccgagcagtacatg

SEQ ID NO: 1667 - DNA, 27 bp, Homo sapiens
caacctccgagcagtacatgctaagac

SEQ ID NO: 1668 - DNA, 28 bp, Homo sapiens
caacctccgagcagtacatgctaagact

SEQ ID NO: 1669 - DNA, 33 bp, Homo sapiens
caacctccgagcagtacatgctaagacttcacc

SEQ ID NO: 1670 - DNA, 26 bp, Homo sapiens
aacctccgagcagtacatgctaagac

SEQ ID NO: 1671 - DNA, 27 bp, Homo sapiens
aacctccgagcagtacatgctaagact

SEQ ID NO: 1672 - DNA, 32 bp, Homo sapiens
aacctccgagcagtacatgctaagacttcacc

SEQ ID NO: 1673 - DNA, 31 bp, Homo sapiens
acctccgagcagtacatgctaagacttcacc

SEQ ID NO: 1674 - DNA, 20 bp, Homo sapiens
gtacatgctaagacttcacc

SEQ ID NO: 1675 - DNA, 19 bp, Homo sapiens
tacatgctaagacttcacc

SEQ ID NO: 1676 - DNA, 17 bp, Homo sapiens
catgctaagacttcacc

SEQ ID NO: 1677 - DNA, 18 bp, Homo sapiens
catgctaagacttcacca

SEQ ID NO: 1678 - DNA, 16 bp, Homo sapiens
atgctaagacttcacc

SEQ ID NO: 1679 - DNA, 25 bp, Homo sapiens
aagacttcaccagtcaaagcgaact

SEQ ID NO: 1680 - DNA, 21 bp, Homo sapiens
cttcaccagtcaaagcgaact

SEQ ID NO: 1681 - DNA, 20 bp, Homo sapiens
ttcaccagtcaaagcgaact

SEQ ID NO: 1682 - DNA, 19 bp, Homo sapiens
tcaccagtcaaagcgaact

SEQ ID NO: 1683 - DNA, 27 bp, Homo sapiens
tcaccagtcaaagcgaactactatact

SEQ ID NO: 1684 - DNA, 22 bp, Homo sapiens
agtcaaagcgaactactatact

SEQ ID NO: 1685 - DNA, 31 bp, Homo sapiens
agtcaaagcgaactactatactcaattgatc

SEQ ID NO: 1686 - DNA, 32 bp, Homo sapiens
agtcaaagcgaactactatactcaattgatcc

SEQ ID NO: 1687 - DNA, 21 bp, Homo sapiens
gtcaaagcgaactactatact

SEQ ID NO: 1688 - DNA, 30 bp, Homo sapiens
gtcaaagcgaactactatactcaattgatc

SEQ ID NO: 1689 - DNA, 27 bp, Homo sapiens
aagcgaactactatactcaattgatcc

SEQ ID NO: 1690 - DNA, 31 bp, Homo sapiens
tactatactcaattgatccaataacttgacc

SEQ ID NO: 1691 - DNA, 24 bp, Homo sapiens
actatactcaattgatccaataac

SEQ ID NO: 1692 - DNA, 25 bp, Homo sapiens
actatactcaattgatccaataact

SEQ ID NO: 1693 - DNA, 26 bp, Homo sapiens
actatactcaattgatccaataactt

SEQ ID NO: 1694 - DNA, 27 bp, Homo sapiens
actatactcaattgatccaataacttg

SEQ ID NO: 1695 - DNA, 29 bp, Homo sapiens
actatactcaattgatccaataacttgac

SEQ ID NO: 1696 - DNA, 30 bp, Homo sapiens
actatactcaattgatccaataacttgacc

SEQ ID NO: 1697 - DNA, 29 bp, Homo sapiens
ctatactcaattgatccaataacttgacc

SEQ ID NO: 1698 - DNA, 28 bp, Homo sapiens
tatactcaattgatccaataacttgacc

SEQ ID NO: 1699 - DNA, 27 bp, Homo sapiens
atactcaattgatccaataacttgacc

SEQ ID NO: 1700 - DNA, 22 bp, Homo sapiens
caattgatccaataacttgacc

SEQ ID NO: 1701 - DNA, 21 bp, Homo sapiens
aattgatccaataacttgacc

SEQ ID NO: 1702 - DNA, 20 bp, Homo sapiens
attgatccaataacttgacc

SEQ ID NO: 1703 - DNA, 25 bp, Homo sapiens
cttgaccaacggaacaagttaccct

SEQ ID NO: 1704 - DNA, 24 bp, Homo sapiens
ttgaccaacggaacaagttaccct

SEQ ID NO: 1705 - DNA, 23 bp, Homo sapiens
tgaccaacggaacaagttaccct

SEQ ID NO: 1706 - DNA, 33 bp, Homo sapiens
tgaccaacggaacaagttaccctagggataaca

SEQ ID NO: 1707 - DNA, 19 bp, Homo sapiens
caacggaacaagttaccct

SEQ ID NO: 1708 - DNA, 29 bp, Homo sapiens
caacggaacaagttaccctagggataaca

SEQ ID NO: 1709 - DNA, 17 bp, Homo sapiens
aacggaacaagttaccc

SEQ ID NO: 1710 - DNA, 18 bp, Homo sapiens
aacggaacaagttaccct

SEQ ID NO: 1711 - DNA, 24 bp, Homo sapiens
aacggaacaagttaccctagggat

SEQ ID NO: 1712 - DNA, 25 bp, Homo sapiens
aacggaacaagttaccctagggata

SEQ ID NO: 1713 - DNA, 26 bp, Homo sapiens
aacggaacaagttaccctagggataa

SEQ ID NO: 1714 - DNA, 27 bp, Homo sapiens
aacggaacaagttaccctagggataac

SEQ ID NO: 1715 - DNA, 28 bp, Homo sapiens
aacggaacaagttaccctagggataaca

SEQ ID NO: 1716 - DNA, 17 bp, Homo sapiens
acggaacaagttaccct

SEQ ID NO: 1717 - DNA, 23 bp, Homo sapiens
acggaacaagttaccctagggat

SEQ ID NO: 1718 - DNA, 27 bp, Homo sapiens
acggaacaagttaccctagggataaca

SEQ ID NO: 1719 - DNA, 32 bp, Homo sapiens
catatcaacaatagggtttacgacctcgatgt

SEQ ID NO: 1720 - DNA, 19 bp, Homo sapiens
aacaatagggtttacgacc

SEQ ID NO: 1721 - DNA, 24 bp, Homo sapiens
ggtttacgacctcgatgttggatc

SEQ ID NO: 1722 - DNA, 33 bp, Homo sapiens
ggtttacgacctcgatgttggatcaggacatcc

SEQ ID NO: 1723 - DNA, 23 bp, Homo sapiens
gtttacgacctcgatgttggatc

SEQ ID NO: 1724 - DNA, 32 bp, Homo sapiens
gtttacgacctcgatgttggatcaggacatcc

SEQ ID NO: 1725 - DNA, 30 bp, Homo sapiens
ttacgacctcgatgttggatcaggacatcc

SEQ ID NO: 1726 - DNA, 29 bp, Homo sapiens
tacgacctcgatgttggatcaggacatcc

SEQ ID NO: 1727 - DNA, 28 bp, Homo sapiens
acgacctcgatgttggatcaggacatcc

SEQ ID NO: 1728 - DNA, 27 bp, Homo sapiens
cgacctcgatgttggatcaggacatcc

SEQ ID NO: 1729 - DNA, 28 bp, Homo sapiens
cgacctcgatgttggatcaggacatccc

SEQ ID NO: 1730 - DNA, 25 bp, Homo sapiens
gacctcgatgttggatcaggacatc

SEQ ID NO: 1731 - DNA, 26 bp, Homo sapiens
gacctcgatgttggatcaggacatcc

SEQ ID NO: 1732 - DNA, 27 bp, Homo sapiens
gacctcgatgttggatcaggacatccc

SEQ ID NO: 1733 - DNA, 28 bp, Homo sapiens
gacctcgatgttggatcaggacatcccg

SEQ ID NO: 1734 - DNA, 30 bp, Homo sapiens
gacctcgatgttggatcaggacatcccgat

SEQ ID NO: 1735 - DNA, 31 bp, Homo sapiens
gacctcgatgttggatcaggacatcccgatg

SEQ ID NO: 1736 - DNA, 33 bp, Homo sapiens
gacctcgatgttggatcaggacatcccgatggt

SEQ ID NO: 1737 - DNA, 24 bp, Homo sapiens
acctcgatgttggatcaggacatc

SEQ ID NO: 1738 - DNA, 25 bp, Homo sapiens
acctcgatgttggatcaggacatcc

SEQ ID NO: 1739 - DNA, 26 bp, Homo sapiens
acctcgatgttggatcaggacatccc

SEQ ID NO: 1740 - DNA, 27 bp, Homo sapiens
acctcgatgttggatcaggacatcccg

SEQ ID NO: 1741 - DNA, 29 bp, Homo sapiens
acctcgatgttggatcaggacatcccgat

SEQ ID NO: 1742 - DNA, 30 bp, Homo sapiens
acctcgatgttggatcaggacatcccgatg

SEQ ID NO: 1743 - DNA, 19 bp, Homo sapiens
tcgatgttggatcaggaca

SEQ ID NO: 1744 - DNA, 23 bp, Homo sapiens
tcgatgttggatcaggacatccc

SEQ ID NO: 1745 - DNA, 31 bp, Homo sapiens
tcgatgttggatcaggacatcccgatggtgc

SEQ ID NO: 1746 - DNA, 32 bp, Homo sapiens
tcgatgttggatcaggacatcccgatggtgca

SEQ ID NO: 1747 - DNA, 30 bp, Homo sapiens
cgatgttggatcaggacatcccgatggtgc

SEQ ID NO: 1748 - DNA, 31 bp, Homo sapiens
cgatgttggatcaggacatcccgatggtgca

SEQ ID NO: 1749 - DNA, 21 bp, Homo sapiens
gatgttggatcaggacatccc

SEQ ID NO: 1750 - DNA, 33 bp, Homo sapiens
gatgttggatcaggacatcccgatggtgcagcc

SEQ ID NO: 1751 - DNA, 16 bp, Homo sapiens
atgttggatcaggaca

SEQ ID NO: 1752 - DNA, 19 bp, Homo sapiens
atgttggatcaggacatcc

SEQ ID NO: 1753 - DNA, 20 bp, Homo sapiens
atgttggatcaggacatccc

SEQ ID NO: 1754 - DNA, 24 bp, Homo sapiens
atgttggatcaggacatcccgatg

SEQ ID NO: 1755 - DNA, 26 bp, Homo sapiens
atgttggatcaggacatcccgatggt

SEQ ID NO: 1756 - DNA, 29 bp, Homo sapiens
atgttggatcaggacatcccgatggtgca

SEQ ID NO: 1757 - DNA, 31 bp, Homo sapiens
atgttggatcaggacatcccgatggtgcagc

SEQ ID NO: 1758 - DNA, 32 bp, Homo sapiens
atgttggatcaggacatcccgatggtgcagcc

SEQ ID NO: 1759 - DNA, 33 bp, Homo sapiens
atgttggatcaggacatcccgatggtgcagccg

SEQ ID NO: 1760 - DNA, 29 bp, Homo sapiens
ttggatcaggacatcccgatggtgcagcc

SEQ ID NO: 1761 - DNA, 23 bp, Homo sapiens
caggacatcccgatggtgcagcc

SEQ ID NO: 1762 - DNA, 25 bp, Homo sapiens
gctattaaaggttcgtttgttcaac

SEQ ID NO: 1763 - DNA, 22 bp, Homo sapiens
attaaaggttcgtttgttcaac

SEQ ID NO: 1764 - DNA, 21 bp, Homo sapiens
ttaaaggttcgtttgttcaac

SEQ ID NO: 1765 - DNA, 20 bp, Homo sapiens
taaaggttcgtttgttcaac

SEQ ID NO: 1766 - DNA, 19 bp, Homo sapiens
aaaggttcgtttgttcaac

SEQ ID NO: 1767 - DNA, 20 bp, Homo sapiens
aaaggttcgtttgttcaacg

SEQ ID NO: 1768 - DNA, 18 bp, Homo sapiens
aaggttcgtttgttcaac

SEQ ID NO: 1769 - DNA, 19 bp, Homo sapiens
aaggttcgtttgttcaacg

SEQ ID NO: 1770 - DNA, 32 bp, Homo sapiens
gattaaagtcctacgtgatctgagttcagacc

SEQ ID NO: 1771 - DNA, 33 bp, Homo sapiens
gattaaagtcctacgtgatctgagttcagaccg

SEQ ID NO: 1772 - DNA, 31 bp, Homo sapiens
attaaagtcctacgtgatctgagttcagacc

SEQ ID NO: 1773 - DNA, 32 bp, Homo sapiens
attaaagtcctacgtgatctgagttcagaccg

SEQ ID NO: 1774 - DNA, 30 bp, Homo sapiens
ttaaagtcctacgtgatctgagttcagacc

SEQ ID NO: 1775 - DNA, 29 bp, Homo sapiens
taaagtcctacgtgatctgagttcagacc

SEQ ID NO: 1776 - DNA, 28 bp, Homo sapiens
aaagtcctacgtgatctgagttcagacc

SEQ ID NO: 1777 - DNA, 29 bp, Homo sapiens
aaagtcctacgtgatctgagttcagaccg

SEQ ID NO: 1778 - DNA, 27 bp, Homo sapiens
aagtcctacgtgatctgagttcagacc

SEQ ID NO: 1779 - DNA, 28 bp, Homo sapiens
aagtcctacgtgatctgagttcagaccg

SEQ ID NO: 1780 - DNA, 26 bp, Homo sapiens
agtcctacgtgatctgagttcagacc

SEQ ID NO: 1781 - DNA, 27 bp, Homo sapiens
agtcctacgtgatctgagttcagaccg

SEQ ID NO: 1782 - DNA, 25 bp, Homo sapiens
gtcctacgtgatctgagttcagacc

SEQ ID NO: 1783 - DNA, 26 bp, Homo sapiens
gtcctacgtgatctgagttcagaccg

SEQ ID NO: 1784 - DNA, 25 bp, Homo sapiens
tcctacgtgatctgagttcagaccg

SEQ ID NO: 1785 - DNA, 23 bp, Homo sapiens
cctacgtgatctgagttcagacc

SEQ ID NO: 1786 - DNA, 24 bp, Homo sapiens
cctacgtgatctgagttcagaccg

SEQ ID NO: 1787 - DNA, 18 bp, Homo sapiens
ctacgtgatctgagttca

SEQ ID NO: 1788 - DNA, 22 bp, Homo sapiens
ctacgtgatctgagttcagacc

SEQ ID NO: 1789 - DNA, 23 bp, Homo sapiens
ctacgtgatctgagttcagaccg

SEQ ID NO: 1790 - DNA, 17 bp, Homo sapiens
tacgtgatctgagttca

SEQ ID NO: 1791 - DNA, 20 bp, Homo sapiens
tacgtgatctgagttcagac

SEQ ID NO: 1792 - DNA, 21 bp, Homo sapiens
tacgtgatctgagttcagacc

SEQ ID NO: 1793 - DNA, 22 bp, Homo sapiens
tacgtgatctgagttcagaccg

SEQ ID NO: 1794 - DNA, 20 bp, Homo sapiens
acgtgatctgagttcagacc

SEQ ID NO: 1795 - DNA, 21 bp, Homo sapiens
acgtgatctgagttcagaccg

SEQ ID NO: 1796 - DNA, 22 bp, Homo sapiens
cggagtaatccaggtcggtttc

SEQ ID NO: 1797 - DNA, 23 bp, Homo sapiens
cggagtaatccaggtcggtttct

SEQ ID NO: 1798 - DNA, 27 bp, Homo sapiens
cggagtaatccaggtcggtttctatct

SEQ ID NO: 1799 - DNA, 18 bp, Homo sapiens
gagtaatccaggtcggtt

SEQ ID NO: 1800 - DNA, 20 bp, Homo sapiens
gagtaatccaggtcggtttc

SEQ ID NO: 1801 - DNA, 21 bp, Homo sapiens
gagtaatccaggtcggtttct

SEQ ID NO: 1802 - DNA, 17 bp, Homo sapiens
aatccaggtcggtttct

SEQ ID NO: 1803 - DNA, 21 bp, Homo sapiens
aatccaggtcggtttctatct

SEQ ID NO: 1804 - DNA, 16 bp, Homo sapiens
atccaggtcggtttct

SEQ ID NO: 1805 - DNA, 19 bp, Homo sapiens
atccaggtcggtttctatc

SEQ ID NO: 1806 - DNA, 20 bp, Homo sapiens
atccaggtcggtttctatct

SEQ ID NO: 1807 - DNA, 22 bp, Homo sapiens
atccaggtcggtttctatctac

SEQ ID NO: 1808 - DNA, 26 bp, Homo sapiens
tcaaattcctccctgtacgaaaggac

SEQ ID NO: 1809 - DNA, 29 bp, Homo sapiens
tcaaattcctccctgtacgaaaggacaag

SEQ ID NO: 1810 - DNA, 25 bp, Homo sapiens
caaattcctccctgtacgaaaggac

SEQ ID NO: 1811 - DNA, 24 bp, Homo sapiens
aaattcctccctgtacgaaaggac

SEQ ID NO: 1812 - DNA, 25 bp, Homo sapiens
aaattcctccctgtacgaaaggaca

SEQ ID NO: 1813 - DNA, 27 bp, Homo sapiens
aaattcctccctgtacgaaaggacaag

SEQ ID NO: 1814 - DNA, 20 bp, Homo sapiens
aattcctccctgtacgaaag

SEQ ID NO: 1815 - DNA, 23 bp, Homo sapiens
aattcctccctgtacgaaaggac

SEQ ID NO: 1816 - DNA, 24 bp, Homo sapiens
aattcctccctgtacgaaaggaca

SEQ ID NO: 1817 - DNA, 26 bp, Homo sapiens
aattcctccctgtacgaaaggacaag

SEQ ID NO: 1818 - DNA, 30 bp, Homo sapiens
aattcctccctgtacgaaaggacaagagaa

SEQ ID NO: 1819 - DNA, 22 bp, Homo sapiens
attcctccctgtacgaaaggac

SEQ ID NO: 1820 - DNA, 23 bp, Homo sapiens
attcctccctgtacgaaaggaca

SEQ ID NO: 1821 - DNA, 25 bp, Homo sapiens
attcctccctgtacgaaaggacaag

SEQ ID NO: 1822 - DNA, 22 bp, Homo sapiens
ttcctccctgtacgaaaggaca

SEQ ID NO: 1823 - DNA, 25 bp, Homo sapiens
ttcctccctgtacgaaaggacaaga

SEQ ID NO: 1824 - DNA, 21 bp, Homo sapiens
tcctccctgtacgaaaggaca

SEQ ID NO: 1825 - DNA, 20 bp, Homo sapiens
cctccctgtacgaaaggaca

SEQ ID NO: 1826 - DNA, 19 bp, Homo sapiens
ctccctgtacgaaaggaca

SEQ ID NO: 1827 - DNA, 33 bp, Homo sapiens
ctccctgtacgaaaggacaagagaaataaggcc

SEQ ID NO: 1828 - DNA, 18 bp, Homo sapiens
tccctgtacgaaaggaca

SEQ ID NO: 1829 - DNA, 32 bp, Homo sapiens
tccctgtacgaaaggacaagagaaataaggcc

SEQ ID NO: 1830 - DNA, 33 bp, Homo sapiens
tccctgtacgaaaggacaagagaaataaggcct

SEQ ID NO: 1831 - DNA, 17 bp, Homo sapiens
ccctgtacgaaaggaca

SEQ ID NO: 1832 - DNA, 31 bp, Homo sapiens
ccctgtacgaaaggacaagagaaataaggcc

SEQ ID NO: 1833 - DNA, 32 bp, Homo sapiens
ccctgtacgaaaggacaagagaaataaggcct

SEQ ID NO: 1834 - DNA, 30 bp, Homo sapiens
cctgtacgaaaggacaagagaaataaggcc

SEQ ID NO: 1835 - DNA, 29 bp, Homo sapiens
ctgtacgaaaggacaagagaaataaggcc

SEQ ID NO: 1836 - DNA, 30 bp, Homo sapiens
ctgtacgaaaggacaagagaaataaggcct

SEQ ID NO: 1837 - DNA, 33 bp, Homo sapiens
ctgtacgaaaggacaagagaaataaggcctact

SEQ ID NO: 1838 - DNA, 28 bp, Homo sapiens
tgtacgaaaggacaagagaaataaggcc

SEQ ID NO: 1839 - DNA, 29 bp, Homo sapiens
tgtacgaaaggacaagagaaataaggcct

SEQ ID NO: 1840 - DNA, 32 bp, Homo sapiens
tgtacgaaaggacaagagaaataaggcctact

SEQ ID NO: 1841 - DNA, 27 bp, Homo sapiens
gtacgaaaggacaagagaaataaggcc

SEQ ID NO: 1842 - DNA, 28 bp, Homo sapiens
gtacgaaaggacaagagaaataaggcct

SEQ ID NO: 1843 - DNA, 31 bp, Homo sapiens
gtacgaaaggacaagagaaataaggcctact

SEQ ID NO: 1844 - DNA, 26 bp, Homo sapiens
tacgaaaggacaagagaaataaggcc

SEQ ID NO: 1845 - DNA, 30 bp, Homo sapiens
tacgaaaggacaagagaaataaggcctact

SEQ ID NO: 1846 - DNA, 25 bp, Homo sapiens
acgaaaggacaagagaaataaggcc

SEQ ID NO: 1847 - DNA, 26 bp, Homo sapiens
acgaaaggacaagagaaataaggcct

SEQ ID NO: 1848 - DNA, 29 bp, Homo sapiens
acgaaaggacaagagaaataaggcctact

SEQ ID NO: 1849 - DNA, 24 bp, Homo sapiens
cgaaaggacaagagaaataaggcc

SEQ ID NO: 1850 - DNA, 28 bp, Homo sapiens
cgaaaggacaagagaaataaggcctact

SEQ ID NO: 1851 - DNA, 23 bp, Homo sapiens
gaaaggacaagagaaataaggcc

SEQ ID NO: 1852 - DNA, 27 bp, Homo sapiens
gaaaggacaagagaaataaggcctact

SEQ ID NO: 1853 - DNA, 22 bp, Homo sapiens
aaaggacaagagaaataaggcc

SEQ ID NO: 1854 - DNA, 23 bp, Homo sapiens
aaaggacaagagaaataaggcct

SEQ ID NO: 1855 - DNA, 26 bp, Homo sapiens
aaaggacaagagaaataaggcctact

SEQ ID NO: 1856 - DNA, 21 bp, Homo sapiens
aaggacaagagaaataaggcc

SEQ ID NO: 1857 - DNA, 25 bp, Homo sapiens
aaggacaagagaaataaggcctact

SEQ ID NO: 1858 - DNA, 20 bp, Homo sapiens
aggacaagagaaataaggcc

SEQ ID NO: 1859 - DNA, 29 bp, Homo sapiens
cccgtaaatgatatcatctcaacttagta

SEQ ID NO: 1860 - DNA, 33 bp, Homo sapiens
atatcatctcaacttagtattatacccacaccc

SEQ ID NO: 1861 - DNA, 24 bp, Homo sapiens
caacttagtattatacccacaccc

SEQ ID NO: 1862 - DNA, 28 bp, Homo sapiens
caacttagtattatacccacacccaccc

SEQ ID NO: 1863 - DNA, 20 bp, Homo sapiens
cccaagaacagggtttgtta

SEQ ID NO: 1864 - DNA, 19 bp, Homo sapiens
ccaagaacagggtttgtta

SEQ ID NO: 1865 - DNA, 18 bp, Homo sapiens
caagaacagggtttgtta

SEQ ID NO: 1866 - DNA, 17 bp, Homo sapiens
aagaacagggtttgtta

SEQ ID NO: 1867 - DNA, 16 bp, Homo sapiens
gtgggggagaggctgt

SEQ ID NO: 1868 - DNA, 26 bp, Homo sapiens
gctgacacgctgtcctctggcgacct

SEQ ID NO: 1869 - DNA, 23 bp, Homo sapiens
tcttcgtgatcgatgtggtgacg

SEQ ID NO: 1870 - DNA, 30 bp, Homo sapiens
tcttcgtgatcgatgtggtgacgtcgtgct

SEQ ID NO: 1871 - DNA, 17 bp, Homo sapiens
cttcgtgatcgatgtgg

SEQ ID NO: 1872 - DNA, 21 bp, Homo sapiens
cttcgtgatcgatgtggtgac

SEQ ID NO: 1873 - DNA, 22 bp, Homo sapiens
cttcgtgatcgatgtggtgacg

SEQ ID NO: 1874 - DNA, 23 bp, Homo sapiens
cttcgtgatcgatgtggtgacgt

SEQ ID NO: 1875 - DNA, 24 bp, Homo sapiens
cttcgtgatcgatgtggtgacgtc

SEQ ID NO: 1876 - DNA, 28 bp, Homo sapiens
cttcgtgatcgatgtggtgacgtcgtgc

SEQ ID NO: 1877 - DNA, 29 bp, Homo sapiens
cttcgtgatcgatgtggtgacgtcgtgct

SEQ ID NO: 1878 - DNA, 30 bp, Homo sapiens
cttcgtgatcgatgtggtgacgtcgtgctc

SEQ ID NO: 1879 - DNA, 31 bp, Homo sapiens
cttcgtgatcgatgtggtgacgtcgtgctct

SEQ ID NO: 1880 - DNA, 32 bp, Homo sapiens
cttcgtgatcgatgtggtgacgtcgtgctctc

SEQ ID NO: 1881 - DNA, 33 bp, Homo sapiens
cttcgtgatcgatgtggtgacgtcgtgctctcc

SEQ ID NO: 1882 - DNA, 20 bp, Homo sapiens
ttcgtgatcgatgtggtgac

SEQ ID NO: 1883 - DNA, 21 bp, Homo sapiens
ttcgtgatcgatgtggtgacg

SEQ ID NO: 1884 - DNA, 23 bp, Homo sapiens
ttcgtgatcgatgtggtgacgtc

SEQ ID NO: 1885 - DNA, 26 bp, Homo sapiens
ttcgtgatcgatgtggtgacgtcgtg

SEQ ID NO: 1886 - DNA, 28 bp, Homo sapiens
ttcgtgatcgatgtggtgacgtcgtgct

SEQ ID NO: 1887 - DNA, 29 bp, Homo sapiens
ttcgtgatcgatgtggtgacgtcgtgctc

SEQ ID NO: 1888 - DNA, 30 bp, Homo sapiens
ttcgtgatcgatgtggtgacgtcgtgctct

SEQ ID NO: 1889 - DNA, 32 bp, Homo sapiens
ttcgtgatcgatgtggtgacgtcgtgctctcc

SEQ ID NO: 1890 - DNA, 16 bp, Homo sapiens
gatcgatgtggtgacg

SEQ ID NO: 1891 - DNA, 23 bp, Homo sapiens
gatcgatgtggtgacgtcgtgct

SEQ ID NO: 1892 - DNA, 25 bp, Homo sapiens
gatcgatgtggtgacgtcgtgctct

SEQ ID NO: 1893 - DNA, 29 bp, Homo sapiens
gatcgatgtggtgacgtcgtgctctcccg

SEQ ID NO: 1894 - DNA, 30 bp, Homo sapiens
gatcgatgtggtgacgtcgtgctctcccgg

SEQ ID NO: 1895 - DNA, 31 bp, Homo sapiens
gatcgatgtggtgacgtcgtgctctcccggg

SEQ ID NO: 1896 - DNA, 17 bp, Homo sapiens
atcgatgtggtgacgtc

SEQ ID NO: 1897 - DNA, 22 bp, Homo sapiens
atcgatgtggtgacgtcgtgct

SEQ ID NO: 1898 - DNA, 23 bp, Homo sapiens
atcgatgtggtgacgtcgtgctc

SEQ ID NO: 1899 - DNA, 24 bp, Homo sapiens
atcgatgtggtgacgtcgtgctct

SEQ ID NO: 1900 - DNA, 26 bp, Homo sapiens
atcgatgtggtgacgtcgtgctctcc

SEQ ID NO: 1901 - DNA, 27 bp, Homo sapiens
atcgatgtggtgacgtcgtgctctccc

SEQ ID NO: 1902 - DNA, 28 bp, Homo sapiens
atcgatgtggtgacgtcgtgctctcccg

SEQ ID NO: 1903 - DNA, 29 bp, Homo sapiens
atcgatgtggtgacgtcgtgctctcccgg

SEQ ID NO: 1904 - DNA, 30 bp, Homo sapiens
atcgatgtggtgacgtcgtgctctcccggg

SEQ ID NO: 1905 - DNA, 31 bp, Homo sapiens
atcgatgtggtgacgtcgtgctctcccgggc

SEQ ID NO: 1906 - DNA, 32 bp, Homo sapiens
atcgatgtggtgacgtcgtgctctcccgggcc

SEQ ID NO: 1907 - DNA, 33 bp, Homo sapiens
atcgatgtggtgacgtcgtgctctcccgggccg

SEQ ID NO: 1908 - DNA, 28 bp, Homo sapiens
tcgatgtggtgacgtcgtgctctcccgg

SEQ ID NO: 1909 - DNA, 29 bp, Homo sapiens
tcgatgtggtgacgtcgtgctctcccggg

SEQ ID NO: 1910 - DNA, 33 bp, Homo sapiens
tcgatgtggtgacgtcgtgctctcccgggccgg

SEQ ID NO: 1911 - DNA, 22 bp, Homo sapiens
tggccgagtgcggctcgtcgcc

SEQ ID NO: 1912 - DNA, 16 bp, Homo sapiens
tacctggttgatcctg

SEQ ID NO: 1913 - DNA, 17 bp, Homo sapiens
tacctggttgatcctgc

SEQ ID NO: 1914 - DNA, 18 bp, Homo sapiens
tacctggttgatcctgcc

SEQ ID NO: 1915 - DNA, 19 bp, Homo sapiens
tacctggttgatcctgcca

SEQ ID NO: 1916 - DNA, 21 bp, Homo sapiens
tacctggttgatcctgccagt

SEQ ID NO: 1917 - DNA, 24 bp, Homo sapiens
tacctggttgatcctgccagtagc

SEQ ID NO: 1918 - DNA, 17 bp, Homo sapiens
ttgatcctgccagtagc

SEQ ID NO: 1919 - DNA, 21 bp, Homo sapiens
catatgcttgtctcaaagatt

SEQ ID NO: 1920 - DNA, 17 bp, Homo sapiens
atatgcttgtctcaaag

SEQ ID NO: 1921 - DNA, 16 bp, Homo sapiens
tatgcttgtctcaaag

SEQ ID NO: 1922 - DNA, 18 bp, Homo sapiens
atgcttgtctcaaagatt

SEQ ID NO: 1923 - DNA, 16 bp, Homo sapiens
gcttgtctcaaagatt

SEQ ID NO: 1924 - DNA, 18 bp, Homo sapiens
agtacgcacggccggtac

SEQ ID NO: 1925 - DNA, 27 bp, Homo sapiens
agtacgcacggccggtacagtgaaact

SEQ ID NO: 1926 - DNA, 29 bp, Homo sapiens
agtacgcacggccggtacagtgaaactgc

SEQ ID NO: 1927 - DNA, 28 bp, Homo sapiens
gtacgcacggccggtacagtgaaactgc

SEQ ID NO: 1928 - DNA, 24 bp, Homo sapiens
tacgcacggccggtacagtgaaac

SEQ ID NO: 1929 - DNA, 25 bp, Homo sapiens
tacgcacggccggtacagtgaaact

SEQ ID NO: 1930 - DNA, 27 bp, Homo sapiens
tacgcacggccggtacagtgaaactgc

SEQ ID NO: 1931 - DNA, 28 bp, Homo sapiens
tacgcacggccggtacagtgaaactgcg

SEQ ID NO: 1932 - DNA, 24 bp, Homo sapiens
acgcacggccggtacagtgaaact

SEQ ID NO: 1933 - DNA, 26 bp, Homo sapiens
acgcacggccggtacagtgaaactgc

SEQ ID NO: 1934 - DNA, 17 bp, Homo sapiens
cgcacggccggtacagt

SEQ ID NO: 1935 - DNA, 18 bp, Homo sapiens
cgcacggccggtacagtg

SEQ ID NO: 1936 - DNA, 22 bp, Homo sapiens
cgcacggccggtacagtgaaac

SEQ ID NO: 1937 - DNA, 23 bp, Homo sapiens
cgcacggccggtacagtgaaact

SEQ ID NO: 1938 - DNA, 24 bp, Homo sapiens
cgcacggccggtacagtgaaactg

SEQ ID NO: 1939 - DNA, 25 bp, Homo sapiens
cgcacggccggtacagtgaaactgc

SEQ ID NO: 1940 - DNA, 26 bp, Homo sapiens
cgcacggccggtacagtgaaactgcg

SEQ ID NO: 1941 - DNA, 30 bp, Homo sapiens
cgcacggccggtacagtgaaactgcgaatg

SEQ ID NO: 1942 - DNA, 32 bp, Homo sapiens
cgcacggccggtacagtgaaactgcgaatggc

SEQ ID NO: 1943 - DNA, 33 bp, Homo sapiens
cgcacggccggtacagtgaaactgcgaatggct

SEQ ID NO: 1944 - DNA, 22 bp, Homo sapiens
gcacggccggtacagtgaaact

SEQ ID NO: 1945 - DNA, 23 bp, Homo sapiens
gcacggccggtacagtgaaactg

SEQ ID NO: 1946 - DNA, 24 bp, Homo sapiens
gcacggccggtacagtgaaactgc

SEQ ID NO: 1947 - DNA, 25 bp, Homo sapiens
gcacggccggtacagtgaaactgcg

SEQ ID NO: 1948 - DNA, 28 bp, Homo sapiens
gcacggccggtacagtgaaactgcgaat

SEQ ID NO: 1949 - DNA, 30 bp, Homo sapiens
gcacggccggtacagtgaaactgcgaatgg

SEQ ID NO: 1950 - DNA, 20 bp, Homo sapiens
cacggccggtacagtgaaac

SEQ ID NO: 1951 - DNA, 21 bp, Homo sapiens
cacggccggtacagtgaaact

SEQ ID NO: 1952 - DNA, 23 bp, Homo sapiens
cacggccggtacagtgaaactgc

SEQ ID NO: 1953 - DNA, 24 bp, Homo sapiens
cacggccggtacagtgaaactgcg

SEQ ID NO: 1954 - DNA, 28 bp, Homo sapiens
cacggccggtacagtgaaactgcgaatg

SEQ ID NO: 1955 - DNA, 18 bp, Homo sapiens
cggccggtacagtgaaac

SEQ ID NO: 1956 - DNA, 19 bp, Homo sapiens
cggccggtacagtgaaact

SEQ ID NO: 1957 - DNA, 21 bp, Homo sapiens
cggccggtacagtgaaactgc

SEQ ID NO: 1958 - DNA, 27 bp, Homo sapiens
cggccggtacagtgaaactgcgaatgg

SEQ ID NO: 1959 - DNA, 28 bp, Homo sapiens
cggccggtacagtgaaactgcgaatggc

SEQ ID NO: 1960 - DNA, 18 bp, Homo sapiens
ggccggtacagtgaaact

SEQ ID NO: 1961 - DNA, 19 bp, Homo sapiens
ggccggtacagtgaaactg

SEQ ID NO: 1962 - DNA, 20 bp, Homo sapiens
ggccggtacagtgaaactgc

SEQ ID NO: 1963 - DNA, 25 bp, Homo sapiens
ggccggtacagtgaaactgcgaatg

SEQ ID NO: 1964 - DNA, 26 bp, Homo sapiens
ggccggtacagtgaaactgcgaatgg

SEQ ID NO: 1965 - DNA, 16 bp, Homo sapiens
gccggtacagtgaaac

SEQ ID NO: 1966 - DNA, 17 bp, Homo sapiens
gccggtacagtgaaact

SEQ ID NO: 1967 - DNA, 19 bp, Homo sapiens
gccggtacagtgaaactgc

SEQ ID NO: 1968 - DNA, 24 bp, Homo sapiens
gccggtacagtgaaactgcgaatg

SEQ ID NO: 1969 - DNA, 25 bp, Homo sapiens
gccggtacagtgaaactgcgaatgg

SEQ ID NO: 1970 - DNA, 26 bp, Homo sapiens
ccggtacagtgaaactgcgaatggct

SEQ ID NO: 1971 - DNA, 24 bp, Homo sapiens
cggtacagtgaaactgcgaatggc

SEQ ID NO: 1972 - DNA, 25 bp, Homo sapiens
cggtacagtgaaactgcgaatggct

SEQ ID NO: 1973 - DNA, 26 bp, Homo sapiens
cggtacagtgaaactgcgaatggctc

SEQ ID NO: 1974 - DNA, 25 bp, Homo sapiens
ggtacagtgaaactgcgaatggctc

SEQ ID NO: 1975 - DNA, 24 bp, Homo sapiens
gtacagtgaaactgcgaatggctc

SEQ ID NO: 1976 - DNA, 23 bp, Homo sapiens
tacagtgaaactgcgaatggctc

SEQ ID NO: 1977 - DNA, 22 bp, Homo sapiens
acagtgaaactgcgaatggctc

SEQ ID NO: 1978 - DNA, 20 bp, Homo sapiens
cagtgaaactgcgaatggct

SEQ ID NO: 1979 - DNA, 21 bp, Homo sapiens
cagtgaaactgcgaatggctc

SEQ ID NO: 1980 - DNA, 19 bp, Homo sapiens
agtgaaactgcgaatggct

SEQ ID NO: 1981 - DNA, 20 bp, Homo sapiens
agtgaaactgcgaatggctc

SEQ ID NO: 1982 - DNA, 23 bp, Homo sapiens
agtgaaactgcgaatggctcatt

SEQ ID NO: 1983 - DNA, 33 bp, Homo sapiens
agtgaaactgcgaatggctcattaaatcagtta

SEQ ID NO: 1984 - DNA, 18 bp, Homo sapiens
gtgaaactgcgaatggct

SEQ ID NO: 1985 - DNA, 19 bp, Homo sapiens
gtgaaactgcgaatggctc

SEQ ID NO: 1986 - DNA, 18 bp, Homo sapiens
tgaaactgcgaatggctc

SEQ ID NO: 1987 - DNA, 17 bp, Homo sapiens
gaaactgcgaatggctc

SEQ ID NO: 1988 - DNA, 16 bp, Homo sapiens
aaactgcgaatggctc

SEQ ID NO: 1989 - DNA, 24 bp, Homo sapiens
aaactgcgaatggctcattaaatc

SEQ ID NO: 1990 - DNA, 32 bp, Homo sapiens
cattaaatcagttatggttcctttggtcgctc

SEQ ID NO: 1991 - DNA, 33 bp, Homo sapiens
cattaaatcagttatggttcctttggtcgctcg

SEQ ID NO: 1992 - DNA, 31 bp, Homo sapiens
attaaatcagttatggttcctttggtcgctc

SEQ ID NO: 1993 - DNA, 32 bp, Homo sapiens
attaaatcagttatggttcctttggtcgctcg

SEQ ID NO: 1994 - DNA, 33 bp, Homo sapiens
attaaatcagttatggttcctttggtcgctcgc

SEQ ID NO: 1995 - DNA, 26 bp, Homo sapiens
aaatcagttatggttcctttggtcgc

SEQ ID NO: 1996 - DNA, 29 bp, Homo sapiens
aaatcagttatggttcctttggtcgctcg

SEQ ID NO: 1997 - DNA, 30 bp, Homo sapiens
aaatcagttatggttcctttggtcgctcgc

SEQ ID NO: 1998 - DNA, 31 bp, Homo sapiens
aaatcagttatggttcctttggtcgctcgct

SEQ ID NO: 1999 - DNA, 32 bp, Homo sapiens
aaatcagttatggttcctttggtcgctcgctc

SEQ ID NO: 2000 - DNA, 33 bp, Homo sapiens
aaatcagttatggttcctttggtcgctcgctcc

SEQ ID NO: 2001 - DNA, 30 bp, Homo sapiens
aatcagttatggttcctttggtcgctcgct

SEQ ID NO: 2002 - DNA, 31 bp, Homo sapiens
aatcagttatggttcctttggtcgctcgctc

SEQ ID NO: 2003 - DNA, 32 bp, Homo sapiens
aatcagttatggttcctttggtcgctcgctcc

SEQ ID NO: 2004 - DNA, 33 bp, Homo sapiens
aatcagttatggttcctttggtcgctcgctcct

SEQ ID NO: 2005 - DNA, 32 bp, Homo sapiens
atcagttatggttcctttggtcgctcgctcct

SEQ ID NO: 2006 - DNA, 30 bp, Homo sapiens
cagttatggttcctttggtcgctcgctcct

SEQ ID NO: 2007 - DNA, 23 bp, Homo sapiens
agttatggttcctttggtcgctc

SEQ ID NO: 2008 - DNA, 24 bp, Homo sapiens
agttatggttcctttggtcgctcg

SEQ ID NO: 2009 - DNA, 25 bp, Homo sapiens
agttatggttcctttggtcgctcgc

SEQ ID NO: 2010 - DNA, 26 bp, Homo sapiens
agttatggttcctttggtcgctcgct

SEQ ID NO: 2011 - DNA, 27 bp, Homo sapiens
agttatggttcctttggtcgctcgctc

SEQ ID NO: 2012 - DNA, 28 bp, Homo sapiens
agttatggttcctttggtcgctcgctcc

SEQ ID NO: 2013 - DNA, 29 bp, Homo sapiens
agttatggttcctttggtcgctcgctcct

SEQ ID NO: 2014 - DNA, 31 bp, Homo sapiens
agttatggttcctttggtcgctcgctcctct

SEQ ID NO: 2015 - DNA, 32 bp, Homo sapiens
agttatggttcctttggtcgctcgctcctctc

SEQ ID NO: 2016 - DNA, 33 bp, Homo sapiens
agttatggttcctttggtcgctcgctcctctcc

SEQ ID NO: 2017 - DNA, 18 bp, Homo sapiens
gttatggttcctttggtc

SEQ ID NO: 2018 - DNA, 25 bp, Homo sapiens
gttatggttcctttggtcgctcgct

SEQ ID NO: 2019 - DNA, 26 bp, Homo sapiens
gttatggttcctttggtcgctcgctc

SEQ ID NO: 2020 - DNA, 27 bp, Homo sapiens
gttatggttcctttggtcgctcgctcc

SEQ ID NO: 2021 - DNA, 28 bp, Homo sapiens
gttatggttcctttggtcgctcgctcct

SEQ ID NO: 2022 - DNA, 30 bp, Homo sapiens
gttatggttcctttggtcgctcgctcctct

SEQ ID NO: 2023 - DNA, 32 bp, Homo sapiens
gttatggttcctttggtcgctcgctcctctcc

SEQ ID NO: 2024 - DNA, 33 bp, Homo sapiens
gttatggttcctttggtcgctcgctcctctcct

SEQ ID NO: 2025 - DNA, 27 bp, Homo sapiens
ttatggttcctttggtcgctcgctcct

SEQ ID NO: 2026 - DNA, 29 bp, Homo sapiens
ttatggttcctttggtcgctcgctcctct

SEQ ID NO: 2027 - DNA, 19 bp, Homo sapiens
atggttcctttggtcgctc

SEQ ID NO: 2028 - DNA, 20 bp, Homo sapiens
atggttcctttggtcgctcg

SEQ ID NO: 2029 - DNA, 21 bp, Homo sapiens
atggttcctttggtcgctcgc

SEQ ID NO: 2030 - DNA, 22 bp, Homo sapiens
atggttcctttggtcgctcgct

SEQ ID NO: 2031 - DNA, 23 bp, Homo sapiens
atggttcctttggtcgctcgctc

SEQ ID NO: 2032 - DNA, 24 bp, Homo sapiens
atggttcctttggtcgctcgctcc

SEQ ID NO: 2033 - DNA, 25 bp, Homo sapiens
atggttcctttggtcgctcgctcct

SEQ ID NO: 2034 - DNA, 26 bp, Homo sapiens
atggttcctttggtcgctcgctcctc

SEQ ID NO: 2035 - DNA, 27 bp, Homo sapiens
atggttcctttggtcgctcgctcctct

SEQ ID NO: 2036 - DNA, 28 bp, Homo sapiens
atggttcctttggtcgctcgctcctctc

SEQ ID NO: 2037 - DNA, 29 bp, Homo sapiens
atggttcctttggtcgctcgctcctctcc

SEQ ID NO: 2038 - DNA, 30 bp, Homo sapiens
atggttcctttggtcgctcgctcctctcct

SEQ ID NO: 2039 - DNA, 33 bp, Homo sapiens
atggttcctttggtcgctcgctcctctcctact

SEQ ID NO: 2040 - DNA, 24 bp, Homo sapiens
tggttcctttggtcgctcgctcct

SEQ ID NO: 2041 - DNA, 26 bp, Homo sapiens
tggttcctttggtcgctcgctcctct

SEQ ID NO: 2042 - DNA, 19 bp, Homo sapiens
ggttcctttggtcgctcgc

SEQ ID NO: 2043 - DNA, 20 bp, Homo sapiens
ggttcctttggtcgctcgct

SEQ ID NO: 2044 - DNA, 21 bp, Homo sapiens
ggttcctttggtcgctcgctc

SEQ ID NO: 2045 - DNA, 22 bp, Homo sapiens
ggttcctttggtcgctcgctcc

SEQ ID NO: 2046 - DNA, 23 bp, Homo sapiens
ggttcctttggtcgctcgctcct

SEQ ID NO: 2047 - DNA, 25 bp, Homo sapiens
ggttcctttggtcgctcgctcctct

SEQ ID NO: 2048 - DNA, 28 bp, Homo sapiens
ggttcctttggtcgctcgctcctctcct

SEQ ID NO: 2049 - DNA, 16 bp, Homo sapiens
gttcctttggtcgctc

SEQ ID NO: 2050 - DNA, 17 bp, Homo sapiens
gttcctttggtcgctcg

SEQ ID NO: 2051 - DNA, 18 bp, Homo sapiens
gttcctttggtcgctcgc

SEQ ID NO: 2052 - DNA, 19 bp, Homo sapiens
gttcctttggtcgctcgct

SEQ ID NO: 2053 - DNA, 20 bp, Homo sapiens
gttcctttggtcgctcgctc

SEQ ID NO: 2054 - DNA, 21 bp, Homo sapiens
gttcctttggtcgctcgctcc

SEQ ID NO: 2055 - DNA, 22 bp, Homo sapiens
gttcctttggtcgctcgctcct

SEQ ID NO: 2056 - DNA, 24 bp, Homo sapiens
gttcctttggtcgctcgctcctct

SEQ ID NO: 2057 - DNA, 25 bp, Homo sapiens
gttcctttggtcgctcgctcctctc

SEQ ID NO: 2058 - DNA, 26 bp, Homo sapiens
gttcctttggtcgctcgctcctctcc

SEQ ID NO: 2059 - DNA, 21 bp, Homo sapiens
ttcctttggtcgctcgctcct

SEQ ID NO: 2060 - DNA, 22 bp, Homo sapiens
ttcctttggtcgctcgctcctc

SEQ ID NO: 2061 - DNA, 16 bp, Homo sapiens
tcctttggtcgctcgc

SEQ ID NO: 2062 - DNA, 21 bp, Homo sapiens
tcctttggtcgctcgctcctc

SEQ ID NO: 2063 - DNA, 16 bp, Homo sapiens
tttggtcgctcgctcc

SEQ ID NO: 2064 - DNA, 17 bp, Homo sapiens
tttggtcgctcgctcct

SEQ ID NO: 2065 - DNA, 21 bp, Homo sapiens
tttggtcgctcgctcctctcc

SEQ ID NO: 2066 - DNA, 22 bp, Homo sapiens
tttggtcgctcgctcctctcct

SEQ ID NO: 2067 - DNA, 31 bp, Homo sapiens
tttggtcgctcgctcctctcctacttggata

SEQ ID NO: 2068 - DNA, 21 bp, Homo sapiens
ttggtcgctcgctcctctcct

SEQ ID NO: 2069 - DNA, 20 bp, Homo sapiens
tggtcgctcgctcctctcct

SEQ ID NO: 2070 - DNA, 28 bp, Homo sapiens
ctcctacttggataactgtggtaattct

SEQ ID NO: 2071 - DNA, 30 bp, Homo sapiens
ctcctacttggataactgtggtaattctag

SEQ ID NO: 2072 - DNA, 32 bp, Homo sapiens
ctcctacttggataactgtggtaattctagag

SEQ ID NO: 2073 - DNA, 33 bp, Homo sapiens
ctcctacttggataactgtggtaattctagagc

SEQ ID NO: 2074 - DNA, 27 bp, Homo sapiens
tcctacttggataactgtggtaattct

SEQ ID NO: 2075 - DNA, 33 bp, Homo sapiens
tcctacttggataactgtggtaattctagagct

SEQ ID NO: 2076 - DNA, 16 bp, Homo sapiens
cctacttggataactg

SEQ ID NO: 2077 - DNA, 25 bp, Homo sapiens
cctacttggataactgtggtaattc

SEQ ID NO: 2078 - DNA, 26 bp, Homo sapiens
cctacttggataactgtggtaattct

SEQ ID NO: 2079 - DNA, 27 bp, Homo sapiens
cctacttggataactgtggtaattcta

SEQ ID NO: 2080 - DNA, 28 bp, Homo sapiens
cctacttggataactgtggtaattctag

SEQ ID NO: 2081 - DNA, 30 bp, Homo sapiens
cctacttggataactgtggtaattctagag

SEQ ID NO: 2082 - DNA, 31 bp, Homo sapiens
cctacttggataactgtggtaattctagagc

SEQ ID NO: 2083 - DNA, 32 bp, Homo sapiens
cctacttggataactgtggtaattctagagct

SEQ ID NO: 2084 - DNA, 25 bp, Homo sapiens
ctacttggataactgtggtaattct

SEQ ID NO: 2085 - DNA, 26 bp, Homo sapiens
ctacttggataactgtggtaattcta

SEQ ID NO: 2086 - DNA, 29 bp, Homo sapiens
ctacttggataactgtggtaattctagag

SEQ ID NO: 2087 - DNA, 30 bp, Homo sapiens
ctacttggataactgtggtaattctagagc

SEQ ID NO: 2088 - DNA, 31 bp, Homo sapiens
ctacttggataactgtggtaattctagagct

SEQ ID NO: 2089 - DNA, 23 bp, Homo sapiens
tacttggataactgtggtaattc

SEQ ID NO: 2090 - DNA, 24 bp, Homo sapiens
tacttggataactgtggtaattct

SEQ ID NO: 2091 - DNA, 25 bp, Homo sapiens
tacttggataactgtggtaattcta

SEQ ID NO: 2092 - DNA, 28 bp, Homo sapiens
tacttggataactgtggtaattctagag

SEQ ID NO: 2093 - DNA, 29 bp, Homo sapiens
tacttggataactgtggtaattctagagc

SEQ ID NO: 2094 - DNA, 30 bp, Homo sapiens
tacttggataactgtggtaattctagagct

SEQ ID NO: 2095 - DNA, 31 bp, Homo sapiens
tacttggataactgtggtaattctagagcta

SEQ ID NO: 2096 - DNA, 22 bp, Homo sapiens
acttggataactgtggtaattc

SEQ ID NO: 2097 - DNA, 23 bp, Homo sapiens
acttggataactgtggtaattct

SEQ ID NO: 2098 - DNA, 24 bp, Homo sapiens
acttggataactgtggtaattcta

SEQ ID NO: 2099 - DNA, 27 bp, Homo sapiens
acttggataactgtggtaattctagag

SEQ ID NO: 2100 - DNA, 28 bp, Homo sapiens
acttggataactgtggtaattctagagc

SEQ ID NO: 2101 - DNA, 29 bp, Homo sapiens
acttggataactgtggtaattctagagct

SEQ ID NO: 2102 - DNA, 30 bp, Homo sapiens
acttggataactgtggtaattctagagcta

SEQ ID NO: 2103 - DNA, 22 bp, Homo sapiens
cttggataactgtggtaattct

SEQ ID NO: 2104 - DNA, 28 bp, Homo sapiens
cttggataactgtggtaattctagagct

SEQ ID NO: 2105 - DNA, 27 bp, Homo sapiens
ttggataactgtggtaattctagagct

SEQ ID NO: 2106 - DNA, 26 bp, Homo sapiens
tggataactgtggtaattctagagct

SEQ ID NO: 2107 - DNA, 25 bp, Homo sapiens
ggataactgtggtaattctagagct

SEQ ID NO: 2108 - DNA, 18 bp, Homo sapiens
gataactgtggtaattct

SEQ ID NO: 2109 - DNA, 19 bp, Homo sapiens
gataactgtggtaattcta

SEQ ID NO: 2110 - DNA, 23 bp, Homo sapiens
gataactgtggtaattctagagc

SEQ ID NO: 2111 - DNA, 24 bp, Homo sapiens
gataactgtggtaattctagagct

SEQ ID NO: 2112 - DNA, 25 bp, Homo sapiens
gataactgtggtaattctagagcta

SEQ ID NO: 2113 - DNA, 33 bp, Homo sapiens
gataactgtggtaattctagagctaatacatgc

SEQ ID NO: 2114 - DNA, 23 bp, Homo sapiens
ataactgtggtaattctagagct

SEQ ID NO: 2115 - DNA, 33 bp, Homo sapiens
ataactgtggtaattctagagctaatacatgcc

SEQ ID NO: 2116 - DNA, 32 bp, Homo sapiens
taactgtggtaattctagagctaatacatgcc

SEQ ID NO: 2117 - DNA, 19 bp, Homo sapiens
aactgtggtaattctagag

SEQ ID NO: 2118 - DNA, 21 bp, Homo sapiens
aactgtggtaattctagagct

SEQ ID NO: 2119 - DNA, 30 bp, Homo sapiens
aactgtggtaattctagagctaatacatgc

SEQ ID NO: 2120 - DNA, 31 bp, Homo sapiens
aactgtggtaattctagagctaatacatgcc

SEQ ID NO: 2121 - DNA, 32 bp, Homo sapiens
aactgtggtaattctagagctaatacatgccg

SEQ ID NO: 2122 - DNA, 20 bp, Homo sapiens
actgtggtaattctagagct

SEQ ID NO: 2123 - DNA, 30 bp, Homo sapiens
actgtggtaattctagagctaatacatgcc

SEQ ID NO: 2124 - DNA, 31 bp, Homo sapiens
actgtggtaattctagagctaatacatgccg

SEQ ID NO: 2125 - DNA, 19 bp, Homo sapiens
ctgtggtaattctagagct

SEQ ID NO: 2126 - DNA, 29 bp, Homo sapiens
ctgtggtaattctagagctaatacatgcc

SEQ ID NO: 2127 - DNA, 28 bp, Homo sapiens
tgtggtaattctagagctaatacatgcc

SEQ ID NO: 2128 - DNA, 27 bp, Homo sapiens
gtggtaattctagagctaatacatgcc

SEQ ID NO: 2129 - DNA, 26 bp, Homo sapiens
taatacatgccgacgggcgctgaccc

SEQ ID NO: 2130 - DNA, 24 bp, Homo sapiens
aatacatgccgacgggcgctgacc

SEQ ID NO: 2131 - DNA, 25 bp, Homo sapiens
aatacatgccgacgggcgctgaccc

SEQ ID NO: 2132 - DNA, 26 bp, Homo sapiens
aatacatgccgacgggcgctgacccc

SEQ ID NO: 2133 - DNA, 28 bp, Homo sapiens
aatacatgccgacgggcgctgaccccct

SEQ ID NO: 2134 - DNA, 23 bp, Homo sapiens
atacatgccgacgggcgctgacc

SEQ ID NO: 2135 - DNA, 24 bp, Homo sapiens
atacatgccgacgggcgctgaccc

SEQ ID NO: 2136 - DNA, 25 bp, Homo sapiens
atacatgccgacgggcgctgacccc

SEQ ID NO: 2137 - DNA, 23 bp, Homo sapiens
tacatgccgacgggcgctgaccc

SEQ ID NO: 2138 - DNA, 26 bp, Homo sapiens
tacatgccgacgggcgctgaccccct

SEQ ID NO: 2139 - DNA, 21 bp, Homo sapiens
catgccgacgggcgctgaccc

SEQ ID NO: 2140 - DNA, 22 bp, Homo sapiens
tgccgacgggcgctgaccccct

SEQ ID NO: 2141 - DNA, 16 bp, Homo sapiens
ccgacgggcgctgacc

SEQ ID NO: 2142 - DNA, 33 bp, Homo sapiens
cgacgggcgctgacccccttcgcgggggggatg

SEQ ID NO: 2143 - DNA, 32 bp, Homo sapiens
gacgggcgctgacccccttcgcgggggggatg

SEQ ID NO: 2144 - DNA, 33 bp, Homo sapiens
gacgggcgctgacccccttcgcgggggggatgc

SEQ ID NO: 2145 - DNA, 24 bp, Homo sapiens
ctgacccccttcgcgggggggatg

SEQ ID NO: 2146 - DNA, 30 bp, Homo sapiens
gatcaaaaccaacccggtcagcccctctcc

SEQ ID NO: 2147 - DNA, 29 bp, Homo sapiens
atcaaaaccaacccggtcagcccctctcc

SEQ ID NO: 2148 - DNA, 25 bp, Homo sapiens
cccggtcagcccctctccggccccg

SEQ ID NO: 2149 - DNA, 25 bp, Homo sapiens
ggctttggtgactctagataacctc

SEQ ID NO: 2150 - DNA, 24 bp, Homo sapiens
gctttggtgactctagataacctc

SEQ ID NO: 2151 - DNA, 29 bp, Homo sapiens
gctttggtgactctagataacctcgggcc

SEQ ID NO: 2152 - DNA, 28 bp, Homo sapiens
ctttggtgactctagataacctcgggcc

SEQ ID NO: 2153 - DNA, 20 bp, Homo sapiens
tttggtgactctagataacc

SEQ ID NO: 2154 - DNA, 27 bp, Homo sapiens
tttggtgactctagataacctcgggcc

SEQ ID NO: 2155 - DNA, 18 bp, Homo sapiens
ttggtgactctagataac

SEQ ID NO: 2156 - DNA, 19 bp, Homo sapiens
ttggtgactctagataacc

SEQ ID NO: 2157 - DNA, 26 bp, Homo sapiens
ttggtgactctagataacctcgggcc

SEQ ID NO: 2158 - DNA, 30 bp, Homo sapiens
ttggtgactctagataacctcgggccgatc

SEQ ID NO: 2159 - DNA, 33 bp, Homo sapiens
ttggtgactctagataacctcgggccgatcgca

SEQ ID NO: 2160 - DNA, 18 bp, Homo sapiens
tggtgactctagataacc

SEQ ID NO: 2161 - DNA, 25 bp, Homo sapiens
tggtgactctagataacctcgggcc

SEQ ID NO: 2162 - DNA, 33 bp, Homo sapiens
tggtgactctagataacctcgggccgatcgcac

SEQ ID NO: 2163 - DNA, 16 bp, Homo sapiens
ggtgactctagataac

SEQ ID NO: 2164 - DNA, 17 bp, Homo sapiens
ggtgactctagataacc

SEQ ID NO: 2165 - DNA, 24 bp, Homo sapiens
ggtgactctagataacctcgggcc

SEQ ID NO: 2166 - DNA, 28 bp, Homo sapiens
ggtgactctagataacctcgggccgatc

SEQ ID NO: 2167 - DNA, 31 bp, Homo sapiens
ggtgactctagataacctcgggccgatcgca

SEQ ID NO: 2168 - DNA, 32 bp, Homo sapiens
ggtgactctagataacctcgggccgatcgcac

SEQ ID NO: 2169 - DNA, 33 bp, Homo sapiens
ggtgactctagataacctcgggccgatcgcacg

SEQ ID NO: 2170 - DNA, 16 bp, Homo sapiens
gtgactctagataacc

SEQ ID NO: 2171 - DNA, 17 bp, Homo sapiens
gtgactctagataacct

SEQ ID NO: 2172 - DNA, 18 bp, Homo sapiens
gtgactctagataacctc

SEQ ID NO: 2173 - DNA, 23 bp, Homo sapiens
gtgactctagataacctcgggcc

SEQ ID NO: 2174 - DNA, 30 bp, Homo sapiens
gtgactctagataacctcgggccgatcgca

SEQ ID NO: 2175 - DNA, 31 bp, Homo sapiens
gtgactctagataacctcgggccgatcgcac

SEQ ID NO: 2176 - DNA, 32 bp, Homo sapiens
gtgactctagataacctcgggccgatcgcacg

SEQ ID NO: 2177 - DNA, 33 bp, Homo sapiens
gtgactctagataacctcgggccgatcgcacgc

SEQ ID NO: 2178 - DNA, 16 bp, Homo sapiens
tgactctagataacct

SEQ ID NO: 2179 - DNA, 30 bp, Homo sapiens
tgactctagataacctcgggccgatcgcac

SEQ ID NO: 2180 - DNA, 31 bp, Homo sapiens
tgactctagataacctcgggccgatcgcacg

SEQ ID NO: 2181 - DNA, 32 bp, Homo sapiens
tgactctagataacctcgggccgatcgcacgc

SEQ ID NO: 2182 - DNA, 29 bp, Homo sapiens
gactctagataacctcgggccgatcgcac

SEQ ID NO: 2183 - DNA, 20 bp, Homo sapiens
actctagataacctcgggcc

SEQ ID NO: 2184 - DNA, 28 bp, Homo sapiens
actctagataacctcgggccgatcgcac

SEQ ID NO: 2185 - DNA, 19 bp, Homo sapiens
ctctagataacctcgggcc

SEQ ID NO: 2186 - DNA, 27 bp, Homo sapiens
ctctagataacctcgggccgatcgcac

SEQ ID NO: 2187 - DNA, 18 bp, Homo sapiens
tctagataacctcgggcc

SEQ ID NO: 2188 - DNA, 17 bp, Homo sapiens
ctagataacctcgggcc

SEQ ID NO: 2189 - DNA, 25 bp, Homo sapiens
ctagataacctcgggccgatcgcac

SEQ ID NO: 2190 - DNA, 16 bp, Homo sapiens
tagataacctcgggcc

SEQ ID NO: 2191 - DNA, 21 bp, Homo sapiens
ataacctcgggccgatcgcac

SEQ ID NO: 2192 - DNA, 19 bp, Homo sapiens
aacctcgggccgatcgcac

SEQ ID NO: 2193 - DNA, 20 bp, Homo sapiens
aacctcgggccgatcgcacg

SEQ ID NO: 2194 - DNA, 22 bp, Homo sapiens
aacctcgggccgatcgcacgcc

SEQ ID NO: 2195 - DNA, 18 bp, Homo sapiens
acctcgggccgatcgcac

SEQ ID NO: 2196 - DNA, 17 bp, Homo sapiens
cctcgggccgatcgcac

SEQ ID NO: 2197 - DNA, 18 bp, Homo sapiens
cctcgggccgatcgcacg

SEQ ID NO: 2198 - DNA, 20 bp, Homo sapiens
cctcgggccgatcgcacgcc

SEQ ID NO: 2199 - DNA, 16 bp, Homo sapiens
ctcgggccgatcgcac

SEQ ID NO: 2200 - DNA, 17 bp, Homo sapiens
ctcgggccgatcgcacg

SEQ ID NO: 2201 - DNA, 19 bp, Homo sapiens
ctcgggccgatcgcacgcc

SEQ ID NO: 2202 - DNA, 21 bp, Homo sapiens
ctcgggccgatcgcacgcccc

SEQ ID NO: 2203 - DNA, 29 bp, Homo sapiens
ctcgggccgatcgcacgccccccgtggcg

SEQ ID NO: 2204 - DNA, 16 bp, Homo sapiens
tcgggccgatcgcacg

SEQ ID NO: 2205 - DNA, 18 bp, Homo sapiens
tcgggccgatcgcacgcc

SEQ ID NO: 2206 - DNA, 33 bp, Homo sapiens
tcgggccgatcgcacgccccccgtggcggcgac

SEQ ID NO: 2207 - DNA, 17 bp, Homo sapiens
cgggccgatcgcacgcc

SEQ ID NO: 2208 - DNA, 16 bp, Homo sapiens
gggccgatcgcacgcc

SEQ ID NO: 2209 - DNA, 31 bp, Homo sapiens
gccccccgtggcggcgacgacccattcgaac

SEQ ID NO: 2210 - DNA, 25 bp, Homo sapiens
gacgacccattcgaacgtctgccct

SEQ ID NO: 2211 - DNA, 23 bp, Homo sapiens
acgacccattcgaacgtctgccc

SEQ ID NO: 2212 - DNA, 24 bp, Homo sapiens
acgacccattcgaacgtctgccct

SEQ ID NO: 2213 - DNA, 20 bp, Homo sapiens
gacccattcgaacgtctgcc

SEQ ID NO: 2214 - DNA, 19 bp, Homo sapiens
acccattcgaacgtctgcc

SEQ ID NO: 2215 - DNA, 20 bp, Homo sapiens
acccattcgaacgtctgccc

SEQ ID NO: 2216 - DNA, 21 bp, Homo sapiens
acccattcgaacgtctgccct

SEQ ID NO: 2217 - DNA, 22 bp, Homo sapiens
acccattcgaacgtctgcccta

SEQ ID NO: 2218 - DNA, 24 bp, Homo sapiens
acccattcgaacgtctgccctatc

SEQ ID NO: 2219 - DNA, 28 bp, Homo sapiens
acccattcgaacgtctgccctatcaact

SEQ ID NO: 2220 - DNA, 17 bp, Homo sapiens
ccattcgaacgtctgcc

SEQ ID NO: 2221 - DNA, 18 bp, Homo sapiens
ccattcgaacgtctgccc

SEQ ID NO: 2222 - DNA, 19 bp, Homo sapiens
ccattcgaacgtctgccct

SEQ ID NO: 2223 - DNA, 22 bp, Homo sapiens
ccattcgaacgtctgccctatc

SEQ ID NO: 2224 - DNA, 23 bp, Homo sapiens
ccattcgaacgtctgccctatca

SEQ ID NO: 2225 - DNA, 24 bp, Homo sapiens
ccattcgaacgtctgccctatcaa

SEQ ID NO: 2226 - DNA, 26 bp, Homo sapiens
ccattcgaacgtctgccctatcaact

SEQ ID NO: 2227 - DNA, 30 bp, Homo sapiens
ccattcgaacgtctgccctatcaactttcg

SEQ ID NO: 2228 - DNA, 16 bp, Homo sapiens
cattcgaacgtctgcc

SEQ ID NO: 2229 - DNA, 17 bp, Homo sapiens
cattcgaacgtctgccc

SEQ ID NO: 2230 - DNA, 18 bp, Homo sapiens
cattcgaacgtctgccct

SEQ ID NO: 2231 - DNA, 20 bp, Homo sapiens
cattcgaacgtctgccctat

SEQ ID NO: 2232 - DNA, 21 bp, Homo sapiens
cattcgaacgtctgccctatc

SEQ ID NO: 2233 - DNA, 22 bp, Homo sapiens
cattcgaacgtctgccctatca

SEQ ID NO: 2234 - DNA, 25 bp, Homo sapiens
cattcgaacgtctgccctatcaact

SEQ ID NO: 2235 - DNA, 16 bp, Homo sapiens
attcgaacgtctgccc

SEQ ID NO: 2236 - DNA, 17 bp, Homo sapiens
attcgaacgtctgccct

SEQ ID NO: 2237 - DNA, 20 bp, Homo sapiens
attcgaacgtctgccctatc

SEQ ID NO: 2238 - DNA, 21 bp, Homo sapiens
attcgaacgtctgccctatca

SEQ ID NO: 2239 - DNA, 24 bp, Homo sapiens
attcgaacgtctgccctatcaact

SEQ ID NO: 2240 - DNA, 16 bp, Homo sapiens
ttcgaacgtctgccct

SEQ ID NO: 2241 - DNA, 19 bp, Homo sapiens
ttcgaacgtctgccctatc

SEQ ID NO: 2242 - DNA, 18 bp, Homo sapiens
tcgaacgtctgccctatc

SEQ ID NO: 2243 - DNA, 17 bp, Homo sapiens
cgaacgtctgccctatc

SEQ ID NO: 2244 - DNA, 18 bp, Homo sapiens
cgaacgtctgccctatca

SEQ ID NO: 2245 - DNA, 21 bp, Homo sapiens
cgaacgtctgccctatcaact

SEQ ID NO: 2246 - DNA, 16 bp, Homo sapiens
gaacgtctgccctatc

SEQ ID NO: 2247 - DNA, 20 bp, Homo sapiens
aactttcgatggtagtcgcc

SEQ ID NO: 2248 - DNA, 19 bp, Homo sapiens
actttcgatggtagtcgcc

SEQ ID NO: 2249 - DNA, 18 bp, Homo sapiens
ctttcgatggtagtcgcc

SEQ ID NO: 2250 - DNA, 33 bp, Homo sapiens
ctttcgatggtagtcgccgtgcctaccatggtg

SEQ ID NO: 2251 - DNA, 16 bp, Homo sapiens
ttcgatggtagtcgcc

SEQ ID NO: 2252 - DNA, 31 bp, Homo sapiens
ttcgatggtagtcgccgtgcctaccatggtg

SEQ ID NO: 2253 - DNA, 33 bp, Homo sapiens
ttcgatggtagtcgccgtgcctaccatggtgac

SEQ ID NO: 2254 - DNA, 32 bp, Homo sapiens
tcgatggtagtcgccgtgcctaccatggtgac

SEQ ID NO: 2255 - DNA, 31 bp, Homo sapiens
cgatggtagtcgccgtgcctaccatggtgac

SEQ ID NO: 2256 - DNA, 32 bp, Homo sapiens
cgatggtagtcgccgtgcctaccatggtgacc

SEQ ID NO: 2257 - DNA, 18 bp, Homo sapiens
gatggtagtcgccgtgcc

SEQ ID NO: 2258 - DNA, 30 bp, Homo sapiens
gatggtagtcgccgtgcctaccatggtgac

SEQ ID NO: 2259 - DNA, 17 bp, Homo sapiens
atggtagtcgccgtgcc

SEQ ID NO: 2260 - DNA, 19 bp, Homo sapiens
atggtagtcgccgtgccta

SEQ ID NO: 2261 - DNA, 20 bp, Homo sapiens
atggtagtcgccgtgcctac

SEQ ID NO: 2262 - DNA, 29 bp, Homo sapiens
atggtagtcgccgtgcctaccatggtgac

SEQ ID NO: 2263 - DNA, 16 bp, Homo sapiens
tggtagtcgccgtgcc

SEQ ID NO: 2264 - DNA, 23 bp, Homo sapiens
acgggtgacggggaatcagggtt

SEQ ID NO: 2265 - DNA, 25 bp, Homo sapiens
acgggtgacggggaatcagggttcg

SEQ ID NO: 2266 - DNA, 25 bp, Homo sapiens
cgattccggagagggagcctgagaa

SEQ ID NO: 2267 - DNA, 31 bp, Homo sapiens
cgattccggagagggagcctgagaaacggct

SEQ ID NO: 2268 - DNA, 23 bp, Homo sapiens
gattccggagagggagcctgaga

SEQ ID NO: 2269 - DNA, 24 bp, Homo sapiens
gattccggagagggagcctgagaa

SEQ ID NO: 2270 - DNA, 26 bp, Homo sapiens
gattccggagagggagcctgagaaac

SEQ ID NO: 2271 - DNA, 27 bp, Homo sapiens
gattccggagagggagcctgagaaacg

SEQ ID NO: 2272 - DNA, 30 bp, Homo sapiens
gattccggagagggagcctgagaaacggct

SEQ ID NO: 2273 - DNA, 32 bp, Homo sapiens
gattccggagagggagcctgagaaacggctac

SEQ ID NO: 2274 - DNA, 17 bp, Homo sapiens
attccggagagggagcc

SEQ ID NO: 2275 - DNA, 18 bp, Homo sapiens
attccggagagggagcct

SEQ ID NO: 2276 - DNA, 22 bp, Homo sapiens
attccggagagggagcctgaga

SEQ ID NO: 2277 - DNA, 23 bp, Homo sapiens
attccggagagggagcctgagaa

SEQ ID NO: 2278 - DNA, 24 bp, Homo sapiens
attccggagagggagcctgagaaa

SEQ ID NO: 2279 - DNA, 25 bp, Homo sapiens
attccggagagggagcctgagaaac

SEQ ID NO: 2280 - DNA, 26 bp, Homo sapiens
attccggagagggagcctgagaaacg

SEQ ID NO: 2281 - DNA, 27 bp, Homo sapiens
attccggagagggagcctgagaaacgg

SEQ ID NO: 2282 - DNA, 29 bp, Homo sapiens
attccggagagggagcctgagaaacggct

SEQ ID NO: 2283 - DNA, 31 bp, Homo sapiens
attccggagagggagcctgagaaacggctac

SEQ ID NO: 2284 - DNA, 32 bp, Homo sapiens
attccggagagggagcctgagaaacggctacc

SEQ ID NO: 2285 - DNA, 25 bp, Homo sapiens
ttccggagagggagcctgagaaacg

SEQ ID NO: 2286 - DNA, 24 bp, Homo sapiens
tccggagagggagcctgagaaacg

SEQ ID NO: 2287 - DNA, 25 bp, Homo sapiens
tccggagagggagcctgagaaacgg

SEQ ID NO: 2288 - DNA, 30 bp, Homo sapiens
ccaaggaaggcagcaggcgcgcaaattacc

SEQ ID NO: 2289 - DNA, 22 bp, Homo sapiens
cgcaaattacccactcccgacc

SEQ ID NO: 2290 - DNA, 20 bp, Homo sapiens
caaattacccactcccgacc

SEQ ID NO: 2291 - DNA, 21 bp, Homo sapiens
caaattacccactcccgaccc

SEQ ID NO: 2292 - DNA, 18 bp, Homo sapiens
aattacccactcccgacc

SEQ ID NO: 2293 - DNA, 19 bp, Homo sapiens
aattacccactcccgaccc

SEQ ID NO: 2294 - DNA, 27 bp, Homo sapiens
cactcccgacccggggaggtagtgacg

SEQ ID NO: 2295 - DNA, 28 bp, Homo sapiens
cactcccgacccggggaggtagtgacga

SEQ ID NO: 2296 - DNA, 26 bp, Homo sapiens
actcccgacccggggaggtagtgacg

SEQ ID NO: 2297 - DNA, 27 bp, Homo sapiens
actcccgacccggggaggtagtgacga

SEQ ID NO: 2298 - DNA, 26 bp, Homo sapiens
ctcccgacccggggaggtagtgacga

SEQ ID NO: 2299 - DNA, 33 bp, Homo sapiens
tcccgacccggggaggtagtgacgaaaaataac

SEQ ID NO: 2300 - DNA, 24 bp, Homo sapiens
cgacccggggaggtagtgacgaaa

SEQ ID NO: 2301 - DNA, 23 bp, Homo sapiens
gacccggggaggtagtgacgaaa

SEQ ID NO: 2302 - DNA, 17 bp, Homo sapiens
cggggaggtagtgacga

SEQ ID NO: 2303 - DNA, 18 bp, Homo sapiens
cggggaggtagtgacgaa

SEQ ID NO: 2304 - DNA, 19 bp, Homo sapiens
cggggaggtagtgacgaaa

SEQ ID NO: 2305 - DNA, 20 bp, Homo sapiens
cggggaggtagtgacgaaaa

SEQ ID NO: 2306 - DNA, 21 bp, Homo sapiens
cggggaggtagtgacgaaaaa

SEQ ID NO: 2307 - DNA, 22 bp, Homo sapiens
cggggaggtagtgacgaaaaat

SEQ ID NO: 2308 - DNA, 23 bp, Homo sapiens
cggggaggtagtgacgaaaaata

SEQ ID NO: 2309 - DNA, 25 bp, Homo sapiens
cggggaggtagtgacgaaaaataac

SEQ ID NO: 2310 - DNA, 26 bp, Homo sapiens
cggggaggtagtgacgaaaaataaca

SEQ ID NO: 2311 - DNA, 32 bp, Homo sapiens
gaggtagtgacgaaaaataacaatacaggact

SEQ ID NO: 2312 - DNA, 31 bp, Homo sapiens
aggtagtgacgaaaaataacaatacaggact

SEQ ID NO: 2313 - DNA, 30 bp, Homo sapiens
ggtagtgacgaaaaataacaatacaggact

SEQ ID NO: 2314 - DNA, 26 bp, Homo sapiens
gtgacgaaaaataacaatacaggact

SEQ ID NO: 2315 - DNA, 23 bp, Homo sapiens
gacgaaaaataacaatacaggac

SEQ ID NO: 2316 - DNA, 24 bp, Homo sapiens
gacgaaaaataacaatacaggact

SEQ ID NO: 2317 - DNA, 28 bp, Homo sapiens
gacgaaaaataacaatacaggactcttt

SEQ ID NO: 2318 - DNA, 29 bp, Homo sapiens
gacgaaaaataacaatacaggactctttc

SEQ ID NO: 2319 - DNA, 22 bp, Homo sapiens
acgaaaaataacaatacaggac

SEQ ID NO: 2320 - DNA, 23 bp, Homo sapiens
acgaaaaataacaatacaggact

SEQ ID NO: 2321 - DNA, 27 bp, Homo sapiens
acgaaaaataacaatacaggactcttt

SEQ ID NO: 2322 - DNA, 28 bp, Homo sapiens
acgaaaaataacaatacaggactctttc

SEQ ID NO: 2323 - DNA, 29 bp, Homo sapiens
acgaaaaataacaatacaggactctttcg

SEQ ID NO: 2324 - DNA, 22 bp, Homo sapiens
cgaaaaataacaatacaggact

SEQ ID NO: 2325 - DNA, 27 bp, Homo sapiens
cgaaaaataacaatacaggactctttc

SEQ ID NO: 2326 - DNA, 19 bp, Homo sapiens
aaaaataacaatacaggac

SEQ ID NO: 2327 - DNA, 20 bp, Homo sapiens
aaaaataacaatacaggact

SEQ ID NO: 2328 - DNA, 19 bp, Homo sapiens
aaaataacaatacaggact

SEQ ID NO: 2329 - DNA, 24 bp, Homo sapiens
aaaataacaatacaggactctttc

SEQ ID NO: 2330 - DNA, 18 bp, Homo sapiens
aaataacaatacaggact

SEQ ID NO: 2331 - DNA, 23 bp, Homo sapiens
aaataacaatacaggactctttc

SEQ ID NO: 2332 - DNA, 17 bp, Homo sapiens
aataacaatacaggact

SEQ ID NO: 2333 - DNA, 19 bp, Homo sapiens
aataacaatacaggactct

SEQ ID NO: 2334 - DNA, 21 bp, Homo sapiens
aataacaatacaggactcttt

SEQ ID NO: 2335 - DNA, 22 bp, Homo sapiens
aataacaatacaggactctttc

SEQ ID NO: 2336 - DNA, 23 bp, Homo sapiens
aataacaatacaggactctttcg

SEQ ID NO: 2337 - DNA, 27 bp, Homo sapiens
aataacaatacaggactctttcgaggc

SEQ ID NO: 2338 - DNA, 16 bp, Homo sapiens
ataacaatacaggact

SEQ ID NO: 2339 - DNA, 21 bp, Homo sapiens
ataacaatacaggactctttc

SEQ ID NO: 2340 - DNA, 20 bp, Homo sapiens
taacaatacaggactctttc

SEQ ID NO: 2341 - DNA, 19 bp, Homo sapiens
aacaatacaggactctttc

SEQ ID NO: 2342 - DNA, 18 bp, Homo sapiens
acaatacaggactctttc

SEQ ID NO: 2343 - DNA, 17 bp, Homo sapiens
caatacaggactctttc

SEQ ID NO: 2344 - DNA, 16 bp, Homo sapiens
aatacaggactctttc

SEQ ID NO: 2345 - DNA, 20 bp, Homo sapiens
atacaggactctttcgaggc

SEQ ID NO: 2346 - DNA, 28 bp, Homo sapiens
atacaggactctttcgaggccctgtaat

SEQ ID NO: 2347 - DNA, 18 bp, Homo sapiens
acaggactctttcgaggc

SEQ ID NO: 2348 - DNA, 21 bp, Homo sapiens
acaggactctttcgaggccct

SEQ ID NO: 2349 - DNA, 17 bp, Homo sapiens
aggactctttcgaggcc

SEQ ID NO: 2350 - DNA, 21 bp, Homo sapiens
actctttcgaggccctgtaat

SEQ ID NO: 2351 - DNA, 20 bp, Homo sapiens
ctctttcgaggccctgtaat

SEQ ID NO: 2352 - DNA, 16 bp, Homo sapiens
tctttcgaggccctgt

SEQ ID NO: 2353 - DNA, 17 bp, Homo sapiens
tctttcgaggccctgta

SEQ ID NO: 2354 - DNA, 18 bp, Homo sapiens
tctttcgaggccctgtaa

SEQ ID NO: 2355 - DNA, 19 bp, Homo sapiens
tctttcgaggccctgtaat

SEQ ID NO: 2356 - DNA, 20 bp, Homo sapiens
tctttcgaggccctgtaatt

SEQ ID NO: 2357 - DNA, 21 bp, Homo sapiens
tctttcgaggccctgtaattg

SEQ ID NO: 2358 - DNA, 26 bp, Homo sapiens
tctttcgaggccctgtaattggaatg

SEQ ID NO: 2359 - DNA, 31 bp, Homo sapiens
tctttcgaggccctgtaattggaatgagtcc

SEQ ID NO: 2360 - DNA, 32 bp, Homo sapiens
tctttcgaggccctgtaattggaatgagtcca

SEQ ID NO: 2361 - DNA, 16 bp, Homo sapiens
ctttcgaggccctgta

SEQ ID NO: 2362 - DNA, 17 bp, Homo sapiens
ctttcgaggccctgtaa

SEQ ID NO: 2363 - DNA, 18 bp, Homo sapiens
ctttcgaggccctgtaat

SEQ ID NO: 2364 - DNA, 19 bp, Homo sapiens
ctttcgaggccctgtaatt

SEQ ID NO: 2365 - DNA, 20 bp, Homo sapiens
ctttcgaggccctgtaattg

SEQ ID NO: 2366 - DNA, 25 bp, Homo sapiens
ctttcgaggccctgtaattggaatg

SEQ ID NO: 2367 - DNA, 27 bp, Homo sapiens
ctttcgaggccctgtaattggaatgag

SEQ ID NO: 2368 - DNA, 29 bp, Homo sapiens
ctttcgaggccctgtaattggaatgagtc

SEQ ID NO: 2369 - DNA, 30 bp, Homo sapiens
ctttcgaggccctgtaattggaatgagtcc

SEQ ID NO: 2370 - DNA, 31 bp, Homo sapiens
ctttcgaggccctgtaattggaatgagtcca

SEQ ID NO: 2371 - DNA, 33 bp, Homo sapiens
ctttcgaggccctgtaattggaatgagtccact

SEQ ID NO: 2372 - DNA, 16 bp, Homo sapiens
tttcgaggccctgtaa

SEQ ID NO: 2373 - DNA, 17 bp, Homo sapiens
tttcgaggccctgtaat

SEQ ID NO: 2374 - DNA, 18 bp, Homo sapiens
tttcgaggccctgtaatt

SEQ ID NO: 2375 - DNA, 19 bp, Homo sapiens
tttcgaggccctgtaattg

SEQ ID NO: 2376 - DNA, 20 bp, Homo sapiens
tttcgaggccctgtaattgg

SEQ ID NO: 2377 - DNA, 24 bp, Homo sapiens
tttcgaggccctgtaattggaatg

SEQ ID NO: 2378 - DNA, 26 bp, Homo sapiens
tttcgaggccctgtaattggaatgag

SEQ ID NO: 2379 - DNA, 28 bp, Homo sapiens
tttcgaggccctgtaattggaatgagtc

SEQ ID NO: 2380 - DNA, 29 bp, Homo sapiens
tttcgaggccctgtaattggaatgagtcc

SEQ ID NO: 2381 - DNA, 30 bp, Homo sapiens
tttcgaggccctgtaattggaatgagtcca

SEQ ID NO: 2382 - DNA, 32 bp, Homo sapiens
tttcgaggccctgtaattggaatgagtccact

SEQ ID NO: 2383 - DNA, 16 bp, Homo sapiens
ttcgaggccctgtaat

SEQ ID NO: 2384 - DNA, 23 bp, Homo sapiens
ttcgaggccctgtaattggaatg

SEQ ID NO: 2385 - DNA, 28 bp, Homo sapiens
ttcgaggccctgtaattggaatgagtcc

SEQ ID NO: 2386 - DNA, 31 bp, Homo sapiens
ttcgaggccctgtaattggaatgagtccact

SEQ ID NO: 2387 - DNA, 22 bp, Homo sapiens
tcgaggccctgtaattggaatg

SEQ ID NO: 2388 - DNA, 30 bp, Homo sapiens
tcgaggccctgtaattggaatgagtccact

SEQ ID NO: 2389 - DNA, 21 bp, Homo sapiens
cgaggccctgtaattggaatg

SEQ ID NO: 2390 - DNA, 26 bp, Homo sapiens
cgaggccctgtaattggaatgagtcc

SEQ ID NO: 2391 - DNA, 29 bp, Homo sapiens
cgaggccctgtaattggaatgagtccact

SEQ ID NO: 2392 - DNA, 20 bp, Homo sapiens
gaggccctgtaattggaatg

SEQ ID NO: 2393 - DNA, 22 bp, Homo sapiens
gaggccctgtaattggaatgag

SEQ ID NO: 2394 - DNA, 24 bp, Homo sapiens
gaggccctgtaattggaatgagtc

SEQ ID NO: 2395 - DNA, 25 bp, Homo sapiens
gaggccctgtaattggaatgagtcc

SEQ ID NO: 2396 - DNA, 28 bp, Homo sapiens
gaggccctgtaattggaatgagtccact

SEQ ID NO: 2397 - DNA, 30 bp, Homo sapiens
gaggccctgtaattggaatgagtccacttt

SEQ ID NO: 2398 - DNA, 24 bp, Homo sapiens
aggccctgtaattggaatgagtcc

SEQ ID NO: 2399 - DNA, 27 bp, Homo sapiens
aggccctgtaattggaatgagtccact

SEQ ID NO: 2400 - DNA, 27 bp, Homo sapiens
aattggaatgagtccactttaaatcct

SEQ ID NO: 2401 - DNA, 26 bp, Homo sapiens
attggaatgagtccactttaaatcct

SEQ ID NO: 2402 - DNA, 25 bp, Homo sapiens
ttggaatgagtccactttaaatcct

SEQ ID NO: 2403 - DNA, 33 bp, Homo sapiens
gagtccactttaaatcctttaacgaggatccat

SEQ ID NO: 2404 - DNA, 32 bp, Homo sapiens
agtccactttaaatcctttaacgaggatccat

SEQ ID NO: 2405 - DNA, 25 bp, Homo sapiens
ctttaacgaggatccattggagggc

SEQ ID NO: 2406 - DNA, 24 bp, Homo sapiens
tttaacgaggatccattggagggc

SEQ ID NO: 2407 - DNA, 29 bp, Homo sapiens
aggatccattggagggcaagtctggtgcc

SEQ ID NO: 2408 - DNA, 28 bp, Homo sapiens
ggatccattggagggcaagtctggtgcc

SEQ ID NO: 2409 - DNA, 27 bp, Homo sapiens
gatccattggagggcaagtctggtgcc

SEQ ID NO: 2410 - DNA, 23 bp, Homo sapiens
cattggagggcaagtctggtgcc

SEQ ID NO: 2411 - DNA, 31 bp, Homo sapiens
cattggagggcaagtctggtgccagcagccg

SEQ ID NO: 2412 - DNA, 22 bp, Homo sapiens
attggagggcaagtctggtgcc

SEQ ID NO: 2413 - DNA, 23 bp, Homo sapiens
attggagggcaagtctggtgcca

SEQ ID NO: 2414 - DNA, 29 bp, Homo sapiens
attggagggcaagtctggtgccagcagcc

SEQ ID NO: 2415 - DNA, 30 bp, Homo sapiens
attggagggcaagtctggtgccagcagccg

SEQ ID NO: 2416 - DNA, 21 bp, Homo sapiens
ttggagggcaagtctggtgcc

SEQ ID NO: 2417 - DNA, 29 bp, Homo sapiens
ttggagggcaagtctggtgccagcagccg

SEQ ID NO: 2418 - DNA, 18 bp, Homo sapiens
gagggcaagtctggtgcc

SEQ ID NO: 2419 - DNA, 17 bp, Homo sapiens
agggcaagtctggtgcc

SEQ ID NO: 2420 - DNA, 21 bp, Homo sapiens
cagccgcggtaattccagctc

SEQ ID NO: 2421 - DNA, 18 bp, Homo sapiens
ccgcggtaattccagctc

SEQ ID NO: 2422 - DNA, 33 bp, Homo sapiens
tattaaagttgctgcagttaaaaagctcgtagt

SEQ ID NO: 2423 - DNA, 32 bp, Homo sapiens
attaaagttgctgcagttaaaaagctcgtagt

SEQ ID NO: 2424 - DNA, 31 bp, Homo sapiens
ttaaagttgctgcagttaaaaagctcgtagt

SEQ ID NO: 2425 - DNA, 30 bp, Homo sapiens
taaagttgctgcagttaaaaagctcgtagt

SEQ ID NO: 2426 - DNA, 29 bp, Homo sapiens
aaagttgctgcagttaaaaagctcgtagt

SEQ ID NO: 2427 - DNA, 33 bp, Homo sapiens
gttgctgcagttaaaaagctcgtagttggatct

SEQ ID NO: 2428 - DNA, 29 bp, Homo sapiens
gctgcagttaaaaagctcgtagttggatc

SEQ ID NO: 2429 - DNA, 30 bp, Homo sapiens
gctgcagttaaaaagctcgtagttggatct

SEQ ID NO: 2430 - DNA, 32 bp, Homo sapiens
cgtagttggatcttgggagcgggcgggcggtc

SEQ ID NO: 2431 - DNA, 33 bp, Homo sapiens
cgtagttggatcttgggagcgggcgggcggtcc

SEQ ID NO: 2432 - DNA, 22 bp, Homo sapiens
cgagccaccgcccgtccccgcc

SEQ ID NO: 2433 - DNA, 29 bp, Homo sapiens
tctcggcgccccctcgatgctcttagctg

SEQ ID NO: 2434 - DNA, 22 bp, Homo sapiens
ctcggcgccccctcgatgctct

SEQ ID NO: 2435 - DNA, 28 bp, Homo sapiens
ctcggcgccccctcgatgctcttagctg

SEQ ID NO: 2436 - DNA, 30 bp, Homo sapiens
gagtgtcccgcggggcccgaagcgtttact

SEQ ID NO: 2437 - DNA, 29 bp, Homo sapiens
agtgtcccgcggggcccgaagcgtttact

SEQ ID NO: 2438 - DNA, 28 bp, Homo sapiens
gtgtcccgcggggcccgaagcgtttact

SEQ ID NO: 2439 - DNA, 29 bp, Homo sapiens
aattagagtgttcaaagcaggcccgagcc

SEQ ID NO: 2440 - DNA, 16 bp, Homo sapiens
cccgagccgcctggat

SEQ ID NO: 2441 - DNA, 18 bp, Homo sapiens
ccgagccgcctggatacc

SEQ ID NO: 2442 - DNA, 29 bp, Homo sapiens
agccgcctggataccgcagctaggaataa

SEQ ID NO: 2443 - DNA, 28 bp, Homo sapiens
gccgcctggataccgcagctaggaataa

SEQ ID NO: 2444 - DNA, 25 bp, Homo sapiens
gcctggataccgcagctaggaataa

SEQ ID NO: 2445 - DNA, 22 bp, Homo sapiens
tggataccgcagctaggaataa

SEQ ID NO: 2446 - DNA, 21 bp, Homo sapiens
ggataccgcagctaggaataa

SEQ ID NO: 2447 - DNA, 26 bp, Homo sapiens
gcagctaggaataatggaataggacc

SEQ ID NO: 2448 - DNA, 27 bp, Homo sapiens
gcagctaggaataatggaataggaccg

SEQ ID NO: 2449 - DNA, 33 bp, Homo sapiens
gaataatggaataggaccgcggttctattttgt

SEQ ID NO: 2450 - DNA, 21 bp, Homo sapiens
aatggaataggaccgcggttc

SEQ ID NO: 2451 - DNA, 22 bp, Homo sapiens
aatggaataggaccgcggttct

SEQ ID NO: 2452 - DNA, 33 bp, Homo sapiens
gaccgcggttctattttgttggttttcggaact

SEQ ID NO: 2453 - DNA, 32 bp, Homo sapiens
ccgcggttctattttgttggttttcggaactg

SEQ ID NO: 2454 - DNA, 30 bp, Homo sapiens
cgcggttctattttgttggttttcggaact

SEQ ID NO: 2455 - DNA, 31 bp, Homo sapiens
cgcggttctattttgttggttttcggaactg

SEQ ID NO: 2456 - DNA, 28 bp, Homo sapiens
gcggttctattttgttggttttcggaac

SEQ ID NO: 2457 - DNA, 29 bp, Homo sapiens
gcggttctattttgttggttttcggaact

SEQ ID NO: 2458 - DNA, 27 bp, Homo sapiens
cggttctattttgttggttttcggaac

SEQ ID NO: 2459 - DNA, 28 bp, Homo sapiens
cggttctattttgttggttttcggaact

SEQ ID NO: 2460 - DNA, 33 bp, Homo sapiens
ggttctattttgttggttttcggaactgaggcc

SEQ ID NO: 2461 - DNA, 24 bp, Homo sapiens
gttctattttgttggttttcggaa

SEQ ID NO: 2462 - DNA, 26 bp, Homo sapiens
gttctattttgttggttttcggaact

SEQ ID NO: 2463 - DNA, 32 bp, Homo sapiens
gttctattttgttggttttcggaactgaggcc

SEQ ID NO: 2464 - DNA, 19 bp, Homo sapiens
aagagggacggccgggggc

SEQ ID NO: 2465 - DNA, 32 bp, Homo sapiens
cattcgtattgcgccgctagaggtgaaattct

SEQ ID NO: 2466 - DNA, 33 bp, Homo sapiens
cgtattgcgccgctagaggtgaaattcttggac

SEQ ID NO: 2467 - DNA, 32 bp, Homo sapiens
gtattgcgccgctagaggtgaaattcttggac

SEQ ID NO: 2468 - DNA, 31 bp, Homo sapiens
tattgcgccgctagaggtgaaattcttggac

SEQ ID NO: 2469 - DNA, 30 bp, Homo sapiens
attgcgccgctagaggtgaaattcttggac

SEQ ID NO: 2470 - DNA, 29 bp, Homo sapiens
ttgcgccgctagaggtgaaattcttggac

SEQ ID NO: 2471 - DNA, 28 bp, Homo sapiens
tgcgccgctagaggtgaaattcttggac

SEQ ID NO: 2472 - DNA, 27 bp, Homo sapiens
gcgccgctagaggtgaaattcttggac

SEQ ID NO: 2473 - DNA, 26 bp, Homo sapiens
cgccgctagaggtgaaattcttggac

SEQ ID NO: 2474 - DNA, 27 bp, Homo sapiens
cgccgctagaggtgaaattcttggacc

SEQ ID NO: 2475 - DNA, 25 bp, Homo sapiens
gccgctagaggtgaaattcttggac

SEQ ID NO: 2476 - DNA, 26 bp, Homo sapiens
gccgctagaggtgaaattcttggacc

SEQ ID NO: 2477 - DNA, 24 bp, Homo sapiens
cgctagaggtgaaattcttggacc

SEQ ID NO: 2478 - DNA, 23 bp, Homo sapiens
gctagaggtgaaattcttggacc

SEQ ID NO: 2479 - DNA, 19 bp, Homo sapiens
agaggtgaaattcttggac

SEQ ID NO: 2480 - DNA, 20 bp, Homo sapiens
agaggtgaaattcttggacc

SEQ ID NO: 2481 - DNA, 29 bp, Homo sapiens
agaggtgaaattcttggaccggcgcaaga

SEQ ID NO: 2482 - DNA, 30 bp, Homo sapiens
agaggtgaaattcttggaccggcgcaagac

SEQ ID NO: 2483 - DNA, 18 bp, Homo sapiens
gaggtgaaattcttggac

SEQ ID NO: 2484 - DNA, 19 bp, Homo sapiens
gaggtgaaattcttggacc

SEQ ID NO: 2485 - DNA, 17 bp, Homo sapiens
aggtgaaattcttggac

SEQ ID NO: 2486 - DNA, 16 bp, Homo sapiens
ggtgaaattcttggac

SEQ ID NO: 2487 - DNA, 31 bp, Homo sapiens
ggtgaaattcttggaccggcgcaagacggac

SEQ ID NO: 2488 - DNA, 30 bp, Homo sapiens
gtgaaattcttggaccggcgcaagacggac

SEQ ID NO: 2489 - DNA, 27 bp, Homo sapiens
aaattcttggaccggcgcaagacggac

SEQ ID NO: 2490 - DNA, 26 bp, Homo sapiens
aattcttggaccggcgcaagacggac

SEQ ID NO: 2491 - DNA, 25 bp, Homo sapiens
attcttggaccggcgcaagacggac

SEQ ID NO: 2492 - DNA, 24 bp, Homo sapiens
ttcttggaccggcgcaagacggac

SEQ ID NO: 2493 - DNA, 18 bp, Homo sapiens
cttggaccggcgcaagac

SEQ ID NO: 2494 - DNA, 19 bp, Homo sapiens
cttggaccggcgcaagacg

SEQ ID NO: 2495 - DNA, 22 bp, Homo sapiens
cttggaccggcgcaagacggac

SEQ ID NO: 2496 - DNA, 23 bp, Homo sapiens
cttggaccggcgcaagacggacc

SEQ ID NO: 2497 - DNA, 17 bp, Homo sapiens
ttggaccggcgcaagac

SEQ ID NO: 2498 - DNA, 18 bp, Homo sapiens
ttggaccggcgcaagacg

SEQ ID NO: 2499 - DNA, 22 bp, Homo sapiens
ttggaccggcgcaagacggacc

SEQ ID NO: 2500 - DNA, 19 bp, Homo sapiens
gaccggcgcaagacggacc

SEQ ID NO: 2501 - DNA, 16 bp, Homo sapiens
cggcgcaagacggacc

SEQ ID NO: 2502 - DNA, 17 bp, Homo sapiens
cggcgcaagacggacca

SEQ ID NO: 2503 - DNA, 21 bp, Homo sapiens
cggcgcaagacggaccagagc

SEQ ID NO: 2504 - DNA, 27 bp, Homo sapiens
cggcgcaagacggaccagagcgaaagc

SEQ ID NO: 2505 - DNA, 28 bp, Homo sapiens
cggcgcaagacggaccagagcgaaagca

SEQ ID NO: 2506 - DNA, 29 bp, Homo sapiens
cggcgcaagacggaccagagcgaaagcat

SEQ ID NO: 2507 - DNA, 30 bp, Homo sapiens
cggcgcaagacggaccagagcgaaagcatt

SEQ ID NO: 2508 - DNA, 32 bp, Homo sapiens
cggcgcaagacggaccagagcgaaagcatttg

SEQ ID NO: 2509 - DNA, 16 bp, Homo sapiens
ggcgcaagacggacca

SEQ ID NO: 2510 - DNA, 17 bp, Homo sapiens
ggcgcaagacggaccag

SEQ ID NO: 2511 - DNA, 19 bp, Homo sapiens
ggcgcaagacggaccagag

SEQ ID NO: 2512 - DNA, 20 bp, Homo sapiens
ggcgcaagacggaccagagc

SEQ ID NO: 2513 - DNA, 21 bp, Homo sapiens
ggcgcaagacggaccagagcg

SEQ ID NO: 2514 - DNA, 26 bp, Homo sapiens
ggcgcaagacggaccagagcgaaagc

SEQ ID NO: 2515 - DNA, 27 bp, Homo sapiens
ggcgcaagacggaccagagcgaaagca

SEQ ID NO: 2516 - DNA, 28 bp, Homo sapiens
ggcgcaagacggaccagagcgaaagcat

SEQ ID NO: 2517 - DNA, 29 bp, Homo sapiens
ggcgcaagacggaccagagcgaaagcatt

SEQ ID NO: 2518 - DNA, 31 bp, Homo sapiens
ggcgcaagacggaccagagcgaaagcatttg

SEQ ID NO: 2519 - DNA, 25 bp, Homo sapiens
gcgcaagacggaccagagcgaaagc

SEQ ID NO: 2520 - DNA, 26 bp, Homo sapiens
gcgcaagacggaccagagcgaaagca

SEQ ID NO: 2521 - DNA, 27 bp, Homo sapiens
gcgcaagacggaccagagcgaaagcat

SEQ ID NO: 2522 - DNA, 28 bp, Homo sapiens
gcgcaagacggaccagagcgaaagcatt

SEQ ID NO: 2523 - DNA, 33 bp, Homo sapiens
gcgcaagacggaccagagcgaaagcatttgcca

SEQ ID NO: 2524 - DNA, 24 bp, Homo sapiens
cgcaagacggaccagagcgaaagc

SEQ ID NO: 2525 - DNA, 25 bp, Homo sapiens
cgcaagacggaccagagcgaaagca

SEQ ID NO: 2526 - DNA, 27 bp, Homo sapiens
cgcaagacggaccagagcgaaagcatt

SEQ ID NO: 2527 - DNA, 32 bp, Homo sapiens
cgcaagacggaccagagcgaaagcatttgcca

SEQ ID NO: 2528 - DNA, 23 bp, Homo sapiens
gcaagacggaccagagcgaaagc

SEQ ID NO: 2529 - DNA, 24 bp, Homo sapiens
gcaagacggaccagagcgaaagca

SEQ ID NO: 2530 - DNA, 26 bp, Homo sapiens
gcaagacggaccagagcgaaagcatt

SEQ ID NO: 2531 - DNA, 31 bp, Homo sapiens
gcaagacggaccagagcgaaagcatttgcca

SEQ ID NO: 2532 - DNA, 22 bp, Homo sapiens
caagacggaccagagcgaaagc

SEQ ID NO: 2533 - DNA, 25 bp, Homo sapiens
caagacggaccagagcgaaagcatt

SEQ ID NO: 2534 - DNA, 29 bp, Homo sapiens
caagacggaccagagcgaaagcatttgcc

SEQ ID NO: 2535 - DNA, 21 bp, Homo sapiens
aagacggaccagagcgaaagc

SEQ ID NO: 2536 - DNA, 22 bp, Homo sapiens
aagacggaccagagcgaaagca

SEQ ID NO: 2537 - DNA, 24 bp, Homo sapiens
aagacggaccagagcgaaagcatt

SEQ ID NO: 2538 - DNA, 25 bp, Homo sapiens
aagacggaccagagcgaaagcattt

SEQ ID NO: 2539 - DNA, 28 bp, Homo sapiens
aagacggaccagagcgaaagcatttgcc

SEQ ID NO: 2540 - DNA, 29 bp, Homo sapiens
aagacggaccagagcgaaagcatttgcca

SEQ ID NO: 2541 - DNA, 20 bp, Homo sapiens
agacggaccagagcgaaagc

SEQ ID NO: 2542 - DNA, 21 bp, Homo sapiens
agacggaccagagcgaaagca

SEQ ID NO: 2543 - DNA, 23 bp, Homo sapiens
agacggaccagagcgaaagcatt

SEQ ID NO: 2544 - DNA, 28 bp, Homo sapiens
agacggaccagagcgaaagcatttgcca

SEQ ID NO: 2545 - DNA, 19 bp, Homo sapiens
gacggaccagagcgaaagc

SEQ ID NO: 2546 - DNA, 22 bp, Homo sapiens
gacggaccagagcgaaagcatt

SEQ ID NO: 2547 - DNA, 26 bp, Homo sapiens
gacggaccagagcgaaagcatttgcc

SEQ ID NO: 2548 - DNA, 18 bp, Homo sapiens
acggaccagagcgaaagc

SEQ ID NO: 2549 - DNA, 19 bp, Homo sapiens
acggaccagagcgaaagca

SEQ ID NO: 2550 - DNA, 21 bp, Homo sapiens
acggaccagagcgaaagcatt

SEQ ID NO: 2551 - DNA, 22 bp, Homo sapiens
acggaccagagcgaaagcattt

SEQ ID NO: 2552 - DNA, 25 bp, Homo sapiens
acggaccagagcgaaagcatttgcc

SEQ ID NO: 2553 - DNA, 32 bp, Homo sapiens
acggaccagagcgaaagcatttgccaagaatg

SEQ ID NO: 2554 - DNA, 33 bp, Homo sapiens
acggaccagagcgaaagcatttgccaagaatgt

SEQ ID NO: 2555 - DNA, 24 bp, Homo sapiens
cggaccagagcgaaagcatttgcc

SEQ ID NO: 2556 - DNA, 31 bp, Homo sapiens
ttcattaatcaagaacgaaagtcggaggttc

SEQ ID NO: 2557 - DNA, 29 bp, Homo sapiens
cattaatcaagaacgaaagtcggaggttc

SEQ ID NO: 2558 - DNA, 28 bp, Homo sapiens
attaatcaagaacgaaagtcggaggttc

SEQ ID NO: 2559 - DNA, 27 bp, Homo sapiens
ttaatcaagaacgaaagtcggaggttc

SEQ ID NO: 2560 - DNA, 25 bp, Homo sapiens
aatcaagaacgaaagtcggaggttc

SEQ ID NO: 2561 - DNA, 26 bp, Homo sapiens
aatcaagaacgaaagtcggaggttcg

SEQ ID NO: 2562 - DNA, 30 bp, Homo sapiens
aatcaagaacgaaagtcggaggttcgaaga

SEQ ID NO: 2563 - DNA, 31 bp, Homo sapiens
aatcaagaacgaaagtcggaggttcgaagac

SEQ ID NO: 2564 - DNA, 23 bp, Homo sapiens
atcaagaacgaaagtcggaggtt

SEQ ID NO: 2565 - DNA, 24 bp, Homo sapiens
atcaagaacgaaagtcggaggttc

SEQ ID NO: 2566 - DNA, 25 bp, Homo sapiens
atcaagaacgaaagtcggaggttcg

SEQ ID NO: 2567 - DNA, 29 bp, Homo sapiens
atcaagaacgaaagtcggaggttcgaaga

SEQ ID NO: 2568 - DNA, 30 bp, Homo sapiens
atcaagaacgaaagtcggaggttcgaagac

SEQ ID NO: 2569 - DNA, 31 bp, Homo sapiens
atcaagaacgaaagtcggaggttcgaagacg

SEQ ID NO: 2570 - DNA, 23 bp, Homo sapiens
tcaagaacgaaagtcggaggttc

SEQ ID NO: 2571 - DNA, 21 bp, Homo sapiens
caagaacgaaagtcggaggtt

SEQ ID NO: 2572 - DNA, 22 bp, Homo sapiens
caagaacgaaagtcggaggttc

SEQ ID NO: 2573 - DNA, 23 bp, Homo sapiens
caagaacgaaagtcggaggttcg

SEQ ID NO: 2574 - DNA, 27 bp, Homo sapiens
caagaacgaaagtcggaggttcgaaga

SEQ ID NO: 2575 - DNA, 28 bp, Homo sapiens
caagaacgaaagtcggaggttcgaagac

SEQ ID NO: 2576 - DNA, 29 bp, Homo sapiens
caagaacgaaagtcggaggttcgaagacg

SEQ ID NO: 2577 - DNA, 32 bp, Homo sapiens
caagaacgaaagtcggaggttcgaagacgatc

SEQ ID NO: 2578 - DNA, 33 bp, Homo sapiens
caagaacgaaagtcggaggttcgaagacgatca

SEQ ID NO: 2579 - DNA, 20 bp, Homo sapiens
aagaacgaaagtcggaggtt

SEQ ID NO: 2580 - DNA, 21 bp, Homo sapiens
aagaacgaaagtcggaggttc

SEQ ID NO: 2581 - DNA, 22 bp, Homo sapiens
aagaacgaaagtcggaggttcg

SEQ ID NO: 2582 - DNA, 26 bp, Homo sapiens
aagaacgaaagtcggaggttcgaaga

SEQ ID NO: 2583 - DNA, 27 bp, Homo sapiens
aagaacgaaagtcggaggttcgaagac

SEQ ID NO: 2584 - DNA, 28 bp, Homo sapiens
aagaacgaaagtcggaggttcgaagacg

SEQ ID NO: 2585 - DNA, 31 bp, Homo sapiens
aagaacgaaagtcggaggttcgaagacgatc

SEQ ID NO: 2586 - DNA, 32 bp, Homo sapiens
aagaacgaaagtcggaggttcgaagacgatca

SEQ ID NO: 2587 - DNA, 19 bp, Homo sapiens
agaacgaaagtcggaggtt

SEQ ID NO: 2588 - DNA, 20 bp, Homo sapiens
agaacgaaagtcggaggttc

SEQ ID NO: 2589 - DNA, 21 bp, Homo sapiens
agaacgaaagtcggaggttcg

SEQ ID NO: 2590 - DNA, 24 bp, Homo sapiens
agaacgaaagtcggaggttcgaag

SEQ ID NO: 2591 - DNA, 25 bp, Homo sapiens
agaacgaaagtcggaggttcgaaga

SEQ ID NO: 2592 - DNA, 26 bp, Homo sapiens
agaacgaaagtcggaggttcgaagac

SEQ ID NO: 2593 - DNA, 27 bp, Homo sapiens
agaacgaaagtcggaggttcgaagacg

SEQ ID NO: 2594 - DNA, 29 bp, Homo sapiens
agaacgaaagtcggaggttcgaagacgat

SEQ ID NO: 2595 - DNA, 30 bp, Homo sapiens
agaacgaaagtcggaggttcgaagacgatc

SEQ ID NO: 2596 - DNA, 31 bp, Homo sapiens
agaacgaaagtcggaggttcgaagacgatca

SEQ ID NO: 2597 - DNA, 33 bp, Homo sapiens
agaacgaaagtcggaggttcgaagacgatcaga

SEQ ID NO: 2598 - DNA, 18 bp, Homo sapiens
gaacgaaagtcggaggtt

SEQ ID NO: 2599 - DNA, 19 bp, Homo sapiens
gaacgaaagtcggaggttc

SEQ ID NO: 2600 - DNA, 20 bp, Homo sapiens
gaacgaaagtcggaggttcg

SEQ ID NO: 2601 - DNA, 24 bp, Homo sapiens
gaacgaaagtcggaggttcgaaga

SEQ ID NO: 2602 - DNA, 25 bp, Homo sapiens
gaacgaaagtcggaggttcgaagac

SEQ ID NO: 2603 - DNA, 26 bp, Homo sapiens
gaacgaaagtcggaggttcgaagacg

SEQ ID NO: 2604 - DNA, 28 bp, Homo sapiens
gaacgaaagtcggaggttcgaagacgat

SEQ ID NO: 2605 - DNA, 29 bp, Homo sapiens
gaacgaaagtcggaggttcgaagacgatc

SEQ ID NO: 2606 - DNA, 30 bp, Homo sapiens
gaacgaaagtcggaggttcgaagacgatca

SEQ ID NO: 2607 - DNA, 17 bp, Homo sapiens
aacgaaagtcggaggtt

SEQ ID NO: 2608 - DNA, 18 bp, Homo sapiens
aacgaaagtcggaggttc

SEQ ID NO: 2609 - DNA, 19 bp, Homo sapiens
aacgaaagtcggaggttcg

SEQ ID NO: 2610 - DNA, 23 bp, Homo sapiens
aacgaaagtcggaggttcgaaga

SEQ ID NO: 2611 - DNA, 24 bp, Homo sapiens
aacgaaagtcggaggttcgaagac

SEQ ID NO: 2612 - DNA, 25 bp, Homo sapiens
aacgaaagtcggaggttcgaagacg

SEQ ID NO: 2613 - DNA, 27 bp, Homo sapiens
aacgaaagtcggaggttcgaagacgat

SEQ ID NO: 2614 - DNA, 28 bp, Homo sapiens
aacgaaagtcggaggttcgaagacgatc

SEQ ID NO: 2615 - DNA, 29 bp, Homo sapiens
aacgaaagtcggaggttcgaagacgatca

SEQ ID NO: 2616 - DNA, 33 bp, Homo sapiens
aacgaaagtcggaggttcgaagacgatcagata

SEQ ID NO: 2617 - DNA, 17 bp, Homo sapiens
acgaaagtcggaggttc

SEQ ID NO: 2618 - DNA, 18 bp, Homo sapiens
acgaaagtcggaggttcg

SEQ ID NO: 2619 - DNA, 22 bp, Homo sapiens
acgaaagtcggaggttcgaaga

SEQ ID NO: 2620 - DNA, 23 bp, Homo sapiens
acgaaagtcggaggttcgaagac

SEQ ID NO: 2621 - DNA, 27 bp, Homo sapiens
acgaaagtcggaggttcgaagacgatc

SEQ ID NO: 2622 - DNA, 33 bp, Homo sapiens
acgaaagtcggaggttcgaagacgatcagatac

SEQ ID NO: 2623 - DNA, 26 bp, Homo sapiens
cgaaagtcggaggttcgaagacgatc

SEQ ID NO: 2624 - DNA, 33 bp, Homo sapiens
cgaaagtcggaggttcgaagacgatcagatacc

SEQ ID NO: 2625 - DNA, 20 bp, Homo sapiens
gaaagtcggaggttcgaaga

SEQ ID NO: 2626 - DNA, 21 bp, Homo sapiens
gaaagtcggaggttcgaagac

SEQ ID NO: 2627 - DNA, 25 bp, Homo sapiens
gaaagtcggaggttcgaagacgatc

SEQ ID NO: 2628 - DNA, 16 bp, Homo sapiens
aaagtcggaggttcga

SEQ ID NO: 2629 - DNA, 17 bp, Homo sapiens
aaagtcggaggttcgaa

SEQ ID NO: 2630 - DNA, 18 bp, Homo sapiens
aaagtcggaggttcgaag

SEQ ID NO: 2631 - DNA, 19 bp, Homo sapiens
aaagtcggaggttcgaaga

SEQ ID NO: 2632 - DNA, 20 bp, Homo sapiens
aaagtcggaggttcgaagac

SEQ ID NO: 2633 - DNA, 21 bp, Homo sapiens
aaagtcggaggttcgaagacg

SEQ ID NO: 2634 - DNA, 24 bp, Homo sapiens
aaagtcggaggttcgaagacgatc

SEQ ID NO: 2635 - DNA, 25 bp, Homo sapiens
aaagtcggaggttcgaagacgatca

SEQ ID NO: 2636 - DNA, 26 bp, Homo sapiens
aaagtcggaggttcgaagacgatcag

SEQ ID NO: 2637 - DNA, 27 bp, Homo sapiens
aaagtcggaggttcgaagacgatcaga

SEQ ID NO: 2638 - DNA, 28 bp, Homo sapiens
aaagtcggaggttcgaagacgatcagat

SEQ ID NO: 2639 - DNA, 29 bp, Homo sapiens
aaagtcggaggttcgaagacgatcagata

SEQ ID NO: 2640 - DNA, 30 bp, Homo sapiens
aaagtcggaggttcgaagacgatcagatac

SEQ ID NO: 2641 - DNA, 31 bp, Homo sapiens
aaagtcggaggttcgaagacgatcagatacc

SEQ ID NO: 2642 - DNA, 32 bp, Homo sapiens
aaagtcggaggttcgaagacgatcagataccg

SEQ ID NO: 2643 - DNA, 18 bp, Homo sapiens
aagtcggaggttcgaaga

SEQ ID NO: 2644 - DNA, 19 bp, Homo sapiens
aagtcggaggttcgaagac

SEQ ID NO: 2645 - DNA, 23 bp, Homo sapiens
aagtcggaggttcgaagacgatc

SEQ ID NO: 2646 - DNA, 30 bp, Homo sapiens
aagtcggaggttcgaagacgatcagatacc

SEQ ID NO: 2647 - DNA, 18 bp, Homo sapiens
agtcggaggttcgaagac

SEQ ID NO: 2648 - DNA, 17 bp, Homo sapiens
gtcggaggttcgaagac

SEQ ID NO: 2649 - DNA, 16 bp, Homo sapiens
tcggaggttcgaagac

SEQ ID NO: 2650 - DNA, 20 bp, Homo sapiens
tcggaggttcgaagacgatc

SEQ ID NO: 2651 - DNA, 27 bp, Homo sapiens
tcggaggttcgaagacgatcagatacc

SEQ ID NO: 2652 - DNA, 19 bp, Homo sapiens
cggaggttcgaagacgatc

SEQ ID NO: 2653 - DNA, 26 bp, Homo sapiens
cggaggttcgaagacgatcagatacc

SEQ ID NO: 2654 - DNA, 18 bp, Homo sapiens
ggaggttcgaagacgatc

SEQ ID NO: 2655 - DNA, 24 bp, Homo sapiens
ggaggttcgaagacgatcagatac

SEQ ID NO: 2656 - DNA, 25 bp, Homo sapiens
ggaggttcgaagacgatcagatacc

SEQ ID NO: 2657 - DNA, 18 bp, Homo sapiens
cgaagacgatcagatacc

SEQ ID NO: 2658 - DNA, 17 bp, Homo sapiens
gaagacgatcagatacc

SEQ ID NO: 2659 - DNA, 31 bp, Homo sapiens
gaagacgatcagataccgtcgtagttccgac

SEQ ID NO: 2660 - DNA, 32 bp, Homo sapiens
gaagacgatcagataccgtcgtagttccgacc

SEQ ID NO: 2661 - DNA, 16 bp, Homo sapiens
aagacgatcagatacc

SEQ ID NO: 2662 - DNA, 30 bp, Homo sapiens
aagacgatcagataccgtcgtagttccgac

SEQ ID NO: 2663 - DNA, 31 bp, Homo sapiens
aagacgatcagataccgtcgtagttccgacc

SEQ ID NO: 2664 - DNA, 22 bp, Homo sapiens
cgatcagataccgtcgtagttc

SEQ ID NO: 2665 - DNA, 26 bp, Homo sapiens
cgatcagataccgtcgtagttccgac

SEQ ID NO: 2666 - DNA, 21 bp, Homo sapiens
gatcagataccgtcgtagttc

SEQ ID NO: 2667 - DNA, 22 bp, Homo sapiens
gatcagataccgtcgtagttcc

SEQ ID NO: 2668 - DNA, 25 bp, Homo sapiens
gatcagataccgtcgtagttccgac

SEQ ID NO: 2669 - DNA, 26 bp, Homo sapiens
gatcagataccgtcgtagttccgacc

SEQ ID NO: 2670 - DNA, 29 bp, Homo sapiens
gatcagataccgtcgtagttccgaccata

SEQ ID NO: 2671 - DNA, 20 bp, Homo sapiens
atcagataccgtcgtagttc

SEQ ID NO: 2672 - DNA, 24 bp, Homo sapiens
atcagataccgtcgtagttccgac

SEQ ID NO: 2673 - DNA, 25 bp, Homo sapiens
atcagataccgtcgtagttccgacc

SEQ ID NO: 2674 - DNA, 19 bp, Homo sapiens
tcagataccgtcgtagttc

SEQ ID NO: 2675 - DNA, 22 bp, Homo sapiens
cagataccgtcgtagttccgac

SEQ ID NO: 2676 - DNA, 17 bp, Homo sapiens
gataccgtcgtagttcc

SEQ ID NO: 2677 - DNA, 18 bp, Homo sapiens
gataccgtcgtagttccg

SEQ ID NO: 2678 - DNA, 20 bp, Homo sapiens
gataccgtcgtagttccgac

SEQ ID NO: 2679 - DNA, 21 bp, Homo sapiens
gataccgtcgtagttccgacc

SEQ ID NO: 2680 - DNA, 33 bp, Homo sapiens
gataccgtcgtagttccgaccataaacgatgcc

SEQ ID NO: 2681 - DNA, 32 bp, Homo sapiens
ataccgtcgtagttccgaccataaacgatgcc

SEQ ID NO: 2682 - DNA, 28 bp, Homo sapiens
cgtcgtagttccgaccataaacgatgcc

SEQ ID NO: 2683 - DNA, 32 bp, Homo sapiens
cgtcgtagttccgaccataaacgatgccgacc

SEQ ID NO: 2684 - DNA, 17 bp, Homo sapiens
tcgtagttccgaccata

SEQ ID NO: 2685 - DNA, 26 bp, Homo sapiens
tcgtagttccgaccataaacgatgcc

SEQ ID NO: 2686 - DNA, 30 bp, Homo sapiens
tcgtagttccgaccataaacgatgccgacc

SEQ ID NO: 2687 - DNA, 16 bp, Homo sapiens
cgtagttccgaccata

SEQ ID NO: 2688 - DNA, 25 bp, Homo sapiens
cgtagttccgaccataaacgatgcc

SEQ ID NO: 2689 - DNA, 29 bp, Homo sapiens
cgtagttccgaccataaacgatgccgacc

SEQ ID NO: 2690 - DNA, 28 bp, Homo sapiens
gtagttccgaccataaacgatgccgacc

SEQ ID NO: 2691 - DNA, 23 bp, Homo sapiens
tagttccgaccataaacgatgcc

SEQ ID NO: 2692 - DNA, 27 bp, Homo sapiens
tagttccgaccataaacgatgccgacc

SEQ ID NO: 2693 - DNA, 21 bp, Homo sapiens
cgaccataaacgatgccgacc

SEQ ID NO: 2694 - DNA, 20 bp, Homo sapiens
gaccataaacgatgccgacc

SEQ ID NO: 2695 - DNA, 21 bp, Homo sapiens
gaccataaacgatgccgaccg

SEQ ID NO: 2696 - DNA, 17 bp, Homo sapiens
cataaacgatgccgacc

SEQ ID NO: 2697 - DNA, 16 bp, Homo sapiens
ataaacgatgccgacc

SEQ ID NO: 2698 - DNA, 22 bp, Homo sapiens
ggcgatgcggcggcgttattcc

SEQ ID NO: 2699 - DNA, 23 bp, Homo sapiens
ggcgatgcggcggcgttattccc

SEQ ID NO: 2700 - DNA, 18 bp, Homo sapiens
atgcggcggcgttattcc

SEQ ID NO: 2701 - DNA, 19 bp, Homo sapiens
atgcggcggcgttattccc

SEQ ID NO: 2702 - DNA, 16 bp, Homo sapiens
cggcggcgttattccc

SEQ ID NO: 2703 - DNA, 22 bp, Homo sapiens
ttattcccatgacccgccgggc

SEQ ID NO: 2704 - DNA, 23 bp, Homo sapiens
ttattcccatgacccgccgggca

SEQ ID NO: 2705 - DNA, 16 bp, Homo sapiens
tattcccatgacccgc

SEQ ID NO: 2706 - DNA, 21 bp, Homo sapiens
tattcccatgacccgccgggc

SEQ ID NO: 2707 - DNA, 22 bp, Homo sapiens
tattcccatgacccgccgggca

SEQ ID NO: 2708 - DNA, 25 bp, Homo sapiens
tattcccatgacccgccgggcagct

SEQ ID NO: 2709 - DNA, 32 bp, Homo sapiens
tattcccatgacccgccgggcagcttccggga

SEQ ID NO: 2710 - DNA, 20 bp, Homo sapiens
attcccatgacccgccgggc

SEQ ID NO: 2711 - DNA, 21 bp, Homo sapiens
attcccatgacccgccgggca

SEQ ID NO: 2712 - DNA, 16 bp, Homo sapiens
ccatgacccgccgggc

SEQ ID NO: 2713 - DNA, 16 bp, Homo sapiens
catgacccgccgggca

SEQ ID NO: 2714 - DNA, 19 bp, Homo sapiens
catgacccgccgggcagct

SEQ ID NO: 2715 - DNA, 23 bp, Homo sapiens
catgacccgccgggcagcttccg

SEQ ID NO: 2716 - DNA, 26 bp, Homo sapiens
catgacccgccgggcagcttccggga

SEQ ID NO: 2717 - DNA, 27 bp, Homo sapiens
catgacccgccgggcagcttccgggaa

SEQ ID NO: 2718 - DNA, 28 bp, Homo sapiens
catgacccgccgggcagcttccgggaaa

SEQ ID NO: 2719 - DNA, 29 bp, Homo sapiens
catgacccgccgggcagcttccgggaaac

SEQ ID NO: 2720 - DNA, 30 bp, Homo sapiens
catgacccgccgggcagcttccgggaaacc

SEQ ID NO: 2721 - DNA, 31 bp, Homo sapiens
catgacccgccgggcagcttccgggaaacca

SEQ ID NO: 2722 - DNA, 17 bp, Homo sapiens
atgacccgccgggcagc

SEQ ID NO: 2723 - DNA, 18 bp, Homo sapiens
atgacccgccgggcagct

SEQ ID NO: 2724 - DNA, 19 bp, Homo sapiens
atgacccgccgggcagctt

SEQ ID NO: 2725 - DNA, 20 bp, Homo sapiens
atgacccgccgggcagcttc

SEQ ID NO: 2726 - DNA, 21 bp, Homo sapiens
atgacccgccgggcagcttcc

SEQ ID NO: 2727 - DNA, 22 bp, Homo sapiens
atgacccgccgggcagcttccg

SEQ ID NO: 2728 - DNA, 24 bp, Homo sapiens
atgacccgccgggcagcttccggg

SEQ ID NO: 2729 - DNA, 25 bp, Homo sapiens
atgacccgccgggcagcttccggga

SEQ ID NO: 2730 - DNA, 26 bp, Homo sapiens
atgacccgccgggcagcttccgggaa

SEQ ID NO: 2731 - DNA, 27 bp, Homo sapiens
atgacccgccgggcagcttccgggaaa

SEQ ID NO: 2732 - DNA, 28 bp, Homo sapiens
atgacccgccgggcagcttccgggaaac

SEQ ID NO: 2733 - DNA, 29 bp, Homo sapiens
atgacccgccgggcagcttccgggaaacc

SEQ ID NO: 2734 - DNA, 30 bp, Homo sapiens
atgacccgccgggcagcttccgggaaacca

SEQ ID NO: 2735 - DNA, 32 bp, Homo sapiens
atgacccgccgggcagcttccgggaaaccaaa

SEQ ID NO: 2736 - DNA, 33 bp, Homo sapiens
atgacccgccgggcagcttccgggaaaccaaag

SEQ ID NO: 2737 - DNA, 16 bp, Homo sapiens
tgacccgccgggcagc

SEQ ID NO: 2738 - DNA, 17 bp, Homo sapiens
tgacccgccgggcagct

SEQ ID NO: 2739 - DNA, 18 bp, Homo sapiens
tgacccgccgggcagctt

SEQ ID NO: 2740 - DNA, 19 bp, Homo sapiens
tgacccgccgggcagcttc

SEQ ID NO: 2741 - DNA, 20 bp, Homo sapiens
tgacccgccgggcagcttcc

SEQ ID NO: 2742 - DNA, 21 bp, Homo sapiens
tgacccgccgggcagcttccg

SEQ ID NO: 2743 - DNA, 24 bp, Homo sapiens
tgacccgccgggcagcttccggga

SEQ ID NO: 2744 - DNA, 25 bp, Homo sapiens
tgacccgccgggcagcttccgggaa

SEQ ID NO: 2745 - DNA, 27 bp, Homo sapiens
tgacccgccgggcagcttccgggaaac

SEQ ID NO: 2746 - DNA, 28 bp, Homo sapiens
tgacccgccgggcagcttccgggaaacc

SEQ ID NO: 2747 - DNA, 29 bp, Homo sapiens
tgacccgccgggcagcttccgggaaacca

SEQ ID NO: 2748 - DNA, 32 bp, Homo sapiens
tgacccgccgggcagcttccgggaaaccaaag

SEQ ID NO: 2749 - DNA, 31 bp, Homo sapiens
gacccgccgggcagcttccgggaaaccaaag

SEQ ID NO: 2750 - DNA, 28 bp, Homo sapiens
cgggcagcttccgggaaaccaaagtctt

SEQ ID NO: 2751 - DNA, 20 bp, Homo sapiens
tttgggttccggggggagta

SEQ ID NO: 2752 - DNA, 22 bp, Homo sapiens
tttgggttccggggggagtatg

SEQ ID NO: 2753 - DNA, 25 bp, Homo sapiens
tttgggttccggggggagtatggtt

SEQ ID NO: 2754 - DNA, 26 bp, Homo sapiens
tttgggttccggggggagtatggttg

SEQ ID NO: 2755 - DNA, 28 bp, Homo sapiens
tttgggttccggggggagtatggttgca

SEQ ID NO: 2756 - DNA, 32 bp, Homo sapiens
tttgggttccggggggagtatggttgcaaagc

SEQ ID NO: 2757 - DNA, 33 bp, Homo sapiens
tttgggttccggggggagtatggttgcaaagct

SEQ ID NO: 2758 - DNA, 19 bp, Homo sapiens
ttgggttccggggggagta

SEQ ID NO: 2759 - DNA, 21 bp, Homo sapiens
ttgggttccggggggagtatg

SEQ ID NO: 2760 - DNA, 24 bp, Homo sapiens
ttgggttccggggggagtatggtt

SEQ ID NO: 2761 - DNA, 25 bp, Homo sapiens
ttgggttccggggggagtatggttg

SEQ ID NO: 2762 - DNA, 27 bp, Homo sapiens
ttgggttccggggggagtatggttgca

SEQ ID NO: 2763 - DNA, 31 bp, Homo sapiens
ttgggttccggggggagtatggttgcaaagc

SEQ ID NO: 2764 - DNA, 32 bp, Homo sapiens
ttgggttccggggggagtatggttgcaaagct

SEQ ID NO: 2765 - DNA, 33 bp, Homo sapiens
ttgggttccggggggagtatggttgcaaagctg

SEQ ID NO: 2766 - DNA, 18 bp, Homo sapiens
tgggttccggggggagta

SEQ ID NO: 2767 - DNA, 26 bp, Homo sapiens
tgggttccggggggagtatggttgca

SEQ ID NO: 2768 - DNA, 31 bp, Homo sapiens
tgggttccggggggagtatggttgcaaagct

SEQ ID NO: 2769 - DNA, 32 bp, Homo sapiens
tgggttccggggggagtatggttgcaaagctg

SEQ ID NO: 2770 - DNA, 20 bp, Homo sapiens
atggttgcaaagctgaaact

SEQ ID NO: 2771 - DNA, 16 bp, Homo sapiens
tgcaaagctgaaactt

SEQ ID NO: 2772 - DNA, 30 bp, Homo sapiens
gaaacttaaaggaattgacggaagggcacc

SEQ ID NO: 2773 - DNA, 29 bp, Homo sapiens
aaacttaaaggaattgacggaagggcacc

SEQ ID NO: 2774 - DNA, 26 bp, Homo sapiens
cttaaaggaattgacggaagggcacc

SEQ ID NO: 2775 - DNA, 25 bp, Homo sapiens
ttaaaggaattgacggaagggcacc

SEQ ID NO: 2776 - DNA, 33 bp, Homo sapiens
ttaaaggaattgacggaagggcaccaccaggag

SEQ ID NO: 2777 - DNA, 24 bp, Homo sapiens
taaaggaattgacggaagggcacc

SEQ ID NO: 2778 - DNA, 32 bp, Homo sapiens
taaaggaattgacggaagggcaccaccaggag

SEQ ID NO: 2779 - DNA, 23 bp, Homo sapiens
aaaggaattgacggaagggcacc

SEQ ID NO: 2780 - DNA, 31 bp, Homo sapiens
aaaggaattgacggaagggcaccaccaggag

SEQ ID NO: 2781 - DNA, 32 bp, Homo sapiens
aaaggaattgacggaagggcaccaccaggagt

SEQ ID NO: 2782 - DNA, 22 bp, Homo sapiens
aaggaattgacggaagggcacc

SEQ ID NO: 2783 - DNA, 18 bp, Homo sapiens
aattgacggaagggcacc

SEQ ID NO: 2784 - DNA, 19 bp, Homo sapiens
aattgacggaagggcacca

SEQ ID NO: 2785 - DNA, 33 bp, Homo sapiens
aattgacggaagggcaccaccaggagtggagcc

SEQ ID NO: 2786 - DNA, 17 bp, Homo sapiens
attgacggaagggcacc

SEQ ID NO: 2787 - DNA, 16 bp, Homo sapiens
ttgacggaagggcacc

SEQ ID NO: 2788 - DNA, 22 bp, Homo sapiens
accaggagtggagcctgcggct

SEQ ID NO: 2789 - DNA, 23 bp, Homo sapiens
accaggagtggagcctgcggctt

SEQ ID NO: 2790 - DNA, 24 bp, Homo sapiens
accaggagtggagcctgcggctta

SEQ ID NO: 2791 - DNA, 27 bp, Homo sapiens
accaggagtggagcctgcggcttaatt

SEQ ID NO: 2792 - DNA, 29 bp, Homo sapiens
accaggagtggagcctgcggcttaatttg

SEQ ID NO: 2793 - DNA, 33 bp, Homo sapiens
accaggagtggagcctgcggcttaatttgactc

SEQ ID NO: 2794 - DNA, 22 bp, Homo sapiens
ccaggagtggagcctgcggctt

SEQ ID NO: 2795 - DNA, 20 bp, Homo sapiens
aggagtggagcctgcggctt

SEQ ID NO: 2796 - DNA, 29 bp, Homo sapiens
caacacgggaaacctcacccggcccggac

SEQ ID NO: 2797 - DNA, 32 bp, Homo sapiens
caacacgggaaacctcacccggcccggacacg

SEQ ID NO: 2798 - DNA, 28 bp, Homo sapiens
aacacgggaaacctcacccggcccggac

SEQ ID NO: 2799 - DNA, 29 bp, Homo sapiens
aacacgggaaacctcacccggcccggaca

SEQ ID NO: 2800 - DNA, 30 bp, Homo sapiens
aacacgggaaacctcacccggcccggacac

SEQ ID NO: 2801 - DNA, 31 bp, Homo sapiens
aacacgggaaacctcacccggcccggacacg

SEQ ID NO: 2802 - DNA, 27 bp, Homo sapiens
acacgggaaacctcacccggcccggac

SEQ ID NO: 2803 - DNA, 28 bp, Homo sapiens
acacgggaaacctcacccggcccggaca

SEQ ID NO: 2804 - DNA, 29 bp, Homo sapiens
acacgggaaacctcacccggcccggacac

SEQ ID NO: 2805 - DNA, 30 bp, Homo sapiens
acacgggaaacctcacccggcccggacacg

SEQ ID NO: 2806 - DNA, 33 bp, Homo sapiens
acacgggaaacctcacccggcccggacacggac

SEQ ID NO: 2807 - DNA, 26 bp, Homo sapiens
cacgggaaacctcacccggcccggac

SEQ ID NO: 2808 - DNA, 29 bp, Homo sapiens
cacgggaaacctcacccggcccggacacg

SEQ ID NO: 2809 - DNA, 25 bp, Homo sapiens
acgggaaacctcacccggcccggac

SEQ ID NO: 2810 - DNA, 28 bp, Homo sapiens
acgggaaacctcacccggcccggacacg

SEQ ID NO: 2811 - DNA, 33 bp, Homo sapiens
acgggaaacctcacccggcccggacacggacag

SEQ ID NO: 2812 - DNA, 24 bp, Homo sapiens
cgggaaacctcacccggcccggac

SEQ ID NO: 2813 - DNA, 26 bp, Homo sapiens
cgggaaacctcacccggcccggacac

SEQ ID NO: 2814 - DNA, 27 bp, Homo sapiens
cgggaaacctcacccggcccggacacg

SEQ ID NO: 2815 - DNA, 32 bp, Homo sapiens
cgggaaacctcacccggcccggacacggacag

SEQ ID NO: 2816 - DNA, 23 bp, Homo sapiens
gggaaacctcacccggcccggac

SEQ ID NO: 2817 - DNA, 24 bp, Homo sapiens
gggaaacctcacccggcccggaca

SEQ ID NO: 2818 - DNA, 26 bp, Homo sapiens
gggaaacctcacccggcccggacacg

SEQ ID NO: 2819 - DNA, 31 bp, Homo sapiens
gggaaacctcacccggcccggacacggacag

SEQ ID NO: 2820 - DNA, 22 bp, Homo sapiens
ggaaacctcacccggcccggac

SEQ ID NO: 2821 - DNA, 23 bp, Homo sapiens
ggaaacctcacccggcccggaca

SEQ ID NO: 2822 - DNA, 24 bp, Homo sapiens
ggaaacctcacccggcccggacac

SEQ ID NO: 2823 - DNA, 25 bp, Homo sapiens
ggaaacctcacccggcccggacacg

SEQ ID NO: 2824 - DNA, 28 bp, Homo sapiens
ggaaacctcacccggcccggacacggac

SEQ ID NO: 2825 - DNA, 29 bp, Homo sapiens
ggaaacctcacccggcccggacacggaca

SEQ ID NO: 2826 - DNA, 30 bp, Homo sapiens
ggaaacctcacccggcccggacacggacag

SEQ ID NO: 2827 - DNA, 21 bp, Homo sapiens
gaaacctcacccggcccggac

SEQ ID NO: 2828 - DNA, 24 bp, Homo sapiens
gaaacctcacccggcccggacacg

SEQ ID NO: 2829 - DNA, 27 bp, Homo sapiens
gaaacctcacccggcccggacacggac

SEQ ID NO: 2830 - DNA, 29 bp, Homo sapiens
gaaacctcacccggcccggacacggacag

SEQ ID NO: 2831 - DNA, 20 bp, Homo sapiens
aaacctcacccggcccggac

SEQ ID NO: 2832 - DNA, 21 bp, Homo sapiens
aaacctcacccggcccggaca

SEQ ID NO: 2833 - DNA, 23 bp, Homo sapiens
aaacctcacccggcccggacacg

SEQ ID NO: 2834 - DNA, 26 bp, Homo sapiens
aaacctcacccggcccggacacggac

SEQ ID NO: 2835 - DNA, 27 bp, Homo sapiens
aaacctcacccggcccggacacggaca

SEQ ID NO: 2836 - DNA, 28 bp, Homo sapiens
aaacctcacccggcccggacacggacag

SEQ ID NO: 2837 - DNA, 19 bp, Homo sapiens
aacctcacccggcccggac

SEQ ID NO: 2838 - DNA, 22 bp, Homo sapiens
aacctcacccggcccggacacg

SEQ ID NO: 2839 - DNA, 25 bp, Homo sapiens
aacctcacccggcccggacacggac

SEQ ID NO: 2840 - DNA, 32 bp, Homo sapiens
aacctcacccggcccggacacggacaggattg

SEQ ID NO: 2841 - DNA, 18 bp, Homo sapiens
acctcacccggcccggac

SEQ ID NO: 2842 - DNA, 19 bp, Homo sapiens
acctcacccggcccggaca

SEQ ID NO: 2843 - DNA, 21 bp, Homo sapiens
acctcacccggcccggacacg

SEQ ID NO: 2844 - DNA, 24 bp, Homo sapiens
acctcacccggcccggacacggac

SEQ ID NO: 2845 - DNA, 17 bp, Homo sapiens
cctcacccggcccggac

SEQ ID NO: 2846 - DNA, 18 bp, Homo sapiens
cctcacccggcccggaca

SEQ ID NO: 2847 - DNA, 20 bp, Homo sapiens
cctcacccggcccggacacg

SEQ ID NO: 2848 - DNA, 23 bp, Homo sapiens
cctcacccggcccggacacggac

SEQ ID NO: 2849 - DNA, 16 bp, Homo sapiens
ctcacccggcccggac

SEQ ID NO: 2850 - DNA, 17 bp, Homo sapiens
ctcacccggcccggaca

SEQ ID NO: 2851 - DNA, 19 bp, Homo sapiens
ctcacccggcccggacacg

SEQ ID NO: 2852 - DNA, 22 bp, Homo sapiens
ctcacccggcccggacacggac

SEQ ID NO: 2853 - DNA, 24 bp, Homo sapiens
ctcacccggcccggacacggacag

SEQ ID NO: 2854 - DNA, 16 bp, Homo sapiens
tcacccggcccggaca

SEQ ID NO: 2855 - DNA, 17 bp, Homo sapiens
tcacccggcccggacac

SEQ ID NO: 2856 - DNA, 18 bp, Homo sapiens
tcacccggcccggacacg

SEQ ID NO: 2857 - DNA, 21 bp, Homo sapiens
tcacccggcccggacacggac

SEQ ID NO: 2858 - DNA, 22 bp, Homo sapiens
tcacccggcccggacacggaca

SEQ ID NO: 2859 - DNA, 23 bp, Homo sapiens
tcacccggcccggacacggacag

SEQ ID NO: 2860 - DNA, 33 bp, Homo sapiens
tcacccggcccggacacggacaggattgacaga

SEQ ID NO: 2861 - DNA, 16 bp, Homo sapiens
cacccggcccggacac

SEQ ID NO: 2862 - DNA, 17 bp, Homo sapiens
cacccggcccggacacg

SEQ ID NO: 2863 - DNA, 20 bp, Homo sapiens
cacccggcccggacacggac

SEQ ID NO: 2864 - DNA, 21 bp, Homo sapiens
cacccggcccggacacggaca

SEQ ID NO: 2865 - DNA, 22 bp, Homo sapiens
cacccggcccggacacggacag

SEQ ID NO: 2866 - DNA, 16 bp, Homo sapiens
acccggcccggacacg

SEQ ID NO: 2867 - DNA, 19 bp, Homo sapiens
acccggcccggacacggac

SEQ ID NO: 2868 - DNA, 18 bp, Homo sapiens
cccggcccggacacggac

SEQ ID NO: 2869 - DNA, 19 bp, Homo sapiens
cccggcccggacacggaca

SEQ ID NO: 2870 - DNA, 17 bp, Homo sapiens
ccggcccggacacggac

SEQ ID NO: 2871 - DNA, 16 bp, Homo sapiens
cggcccggacacggac

SEQ ID NO: 2872 - DNA, 18 bp, Homo sapiens
cggcccggacacggacag

SEQ ID NO: 2873 - DNA, 23 bp, Homo sapiens
cggcccggacacggacaggattg

SEQ ID NO: 2874 - DNA, 25 bp, Homo sapiens
cggcccggacacggacaggattgac

SEQ ID NO: 2875 - DNA, 26 bp, Homo sapiens
cggcccggacacggacaggattgaca

SEQ ID NO: 2876 - DNA, 27 bp, Homo sapiens
cggcccggacacggacaggattgacag

SEQ ID NO: 2877 - DNA, 28 bp, Homo sapiens
cggcccggacacggacaggattgacaga

SEQ ID NO: 2878 - DNA, 29 bp, Homo sapiens
cggcccggacacggacaggattgacagat

SEQ ID NO: 2879 - DNA, 30 bp, Homo sapiens
cggcccggacacggacaggattgacagatt

SEQ ID NO: 2880 - DNA, 31 bp, Homo sapiens
cggcccggacacggacaggattgacagattg

SEQ ID NO: 2881 - DNA, 32 bp, Homo sapiens
cggcccggacacggacaggattgacagattga

SEQ ID NO: 2882 - DNA, 33 bp, Homo sapiens
cggcccggacacggacaggattgacagattgat

SEQ ID NO: 2883 - DNA, 17 bp, Homo sapiens
ggcccggacacggacag

SEQ ID NO: 2884 - DNA, 22 bp, Homo sapiens
ggcccggacacggacaggattg

SEQ ID NO: 2885 - DNA, 25 bp, Homo sapiens
ggcccggacacggacaggattgaca

SEQ ID NO: 2886 - DNA, 27 bp, Homo sapiens
ggcccggacacggacaggattgacaga

SEQ ID NO: 2887 - DNA, 28 bp, Homo sapiens
ggcccggacacggacaggattgacagat

SEQ ID NO: 2888 - DNA, 29 bp, Homo sapiens
ggcccggacacggacaggattgacagatt

SEQ ID NO: 2889 - DNA, 30 bp, Homo sapiens
ggcccggacacggacaggattgacagattg

SEQ ID NO: 2890 - DNA, 32 bp, Homo sapiens
ggcccggacacggacaggattgacagattgat

SEQ ID NO: 2891 - DNA, 21 bp, Homo sapiens
gcccggacacggacaggattg

SEQ ID NO: 2892 - DNA, 21 bp, Homo sapiens
ccggacacggacaggattgac

SEQ ID NO: 2893 - DNA, 22 bp, Homo sapiens
ccggacacggacaggattgaca

SEQ ID NO: 2894 - DNA, 24 bp, Homo sapiens
ccggacacggacaggattgacaga

SEQ ID NO: 2895 - DNA, 26 bp, Homo sapiens
ccggacacggacaggattgacagatt

SEQ ID NO: 2896 - DNA, 28 bp, Homo sapiens
ccggacacggacaggattgacagattga

SEQ ID NO: 2897 - DNA, 32 bp, Homo sapiens
ccggacacggacaggattgacagattgatagc

SEQ ID NO: 2898 - DNA, 33 bp, Homo sapiens
ccggacacggacaggattgacagattgatagct

SEQ ID NO: 2899 - DNA, 20 bp, Homo sapiens
cggacacggacaggattgac

SEQ ID NO: 2900 - DNA, 21 bp, Homo sapiens
cggacacggacaggattgaca

SEQ ID NO: 2901 - DNA, 22 bp, Homo sapiens
cggacacggacaggattgacag

SEQ ID NO: 2902 - DNA, 23 bp, Homo sapiens
cggacacggacaggattgacaga

SEQ ID NO: 2903 - DNA, 24 bp, Homo sapiens
cggacacggacaggattgacagat

SEQ ID NO: 2904 - DNA, 25 bp, Homo sapiens
cggacacggacaggattgacagatt

SEQ ID NO: 2905 - DNA, 26 bp, Homo sapiens
cggacacggacaggattgacagattg

SEQ ID NO: 2906 - DNA, 28 bp, Homo sapiens
cggacacggacaggattgacagattgat

SEQ ID NO: 2907 - DNA, 32 bp, Homo sapiens
cggacacggacaggattgacagattgatagct

SEQ ID NO: 2908 - DNA, 19 bp, Homo sapiens
ggacacggacaggattgac

SEQ ID NO: 2909 - DNA, 20 bp, Homo sapiens
ggacacggacaggattgaca

SEQ ID NO: 2910 - DNA, 22 bp, Homo sapiens
ggacacggacaggattgacaga

SEQ ID NO: 2911 - DNA, 23 bp, Homo sapiens
ggacacggacaggattgacagat

SEQ ID NO: 2912 - DNA, 24 bp, Homo sapiens
ggacacggacaggattgacagatt

SEQ ID NO: 2913 - DNA, 25 bp, Homo sapiens
ggacacggacaggattgacagattg

SEQ ID NO: 2914 - DNA, 27 bp, Homo sapiens
ggacacggacaggattgacagattgat

SEQ ID NO: 2915 - DNA, 31 bp, Homo sapiens
ggacacggacaggattgacagattgatagct

SEQ ID NO: 2916 - DNA, 18 bp, Homo sapiens
gacacggacaggattgac

SEQ ID NO: 2917 - DNA, 19 bp, Homo sapiens
gacacggacaggattgaca

SEQ ID NO: 2918 - DNA, 23 bp, Homo sapiens
gacacggacaggattgacagatt

SEQ ID NO: 2919 - DNA, 24 bp, Homo sapiens
gacacggacaggattgacagattg

SEQ ID NO: 2920 - DNA, 26 bp, Homo sapiens
gacacggacaggattgacagattgat

SEQ ID NO: 2921 - DNA, 30 bp, Homo sapiens
gacacggacaggattgacagattgatagct

SEQ ID NO: 2922 - DNA, 31 bp, Homo sapiens
gacacggacaggattgacagattgatagctc

SEQ ID NO: 2923 - DNA, 32 bp, Homo sapiens
gacacggacaggattgacagattgatagctct

SEQ ID NO: 2924 - DNA, 17 bp, Homo sapiens
acacggacaggattgac

SEQ ID NO: 2925 - DNA, 18 bp, Homo sapiens
acacggacaggattgaca

SEQ ID NO: 2926 - DNA, 20 bp, Homo sapiens
acacggacaggattgacaga

SEQ ID NO: 2927 - DNA, 22 bp, Homo sapiens
acacggacaggattgacagatt

SEQ ID NO: 2928 - DNA, 23 bp, Homo sapiens
acacggacaggattgacagattg

SEQ ID NO: 2929 - DNA, 24 bp, Homo sapiens
acacggacaggattgacagattga

SEQ ID NO: 2930 - DNA, 25 bp, Homo sapiens
acacggacaggattgacagattgat

SEQ ID NO: 2931 - DNA, 29 bp, Homo sapiens
acacggacaggattgacagattgatagct

SEQ ID NO: 2932 - DNA, 33 bp, Homo sapiens
acacggacaggattgacagattgatagctcttt

SEQ ID NO: 2933 - DNA, 16 bp, Homo sapiens
cacggacaggattgac

SEQ ID NO: 2934 - DNA, 17 bp, Homo sapiens
cacggacaggattgaca

SEQ ID NO: 2935 - DNA, 19 bp, Homo sapiens
cacggacaggattgacaga

SEQ ID NO: 2936 - DNA, 28 bp, Homo sapiens
cacggacaggattgacagattgatagct

SEQ ID NO: 2937 - DNA, 16 bp, Homo sapiens
acggacaggattgaca

SEQ ID NO: 2938 - DNA, 19 bp, Homo sapiens
acggacaggattgacagat

SEQ ID NO: 2939 - DNA, 20 bp, Homo sapiens
acggacaggattgacagatt

SEQ ID NO: 2940 - DNA, 26 bp, Homo sapiens
acggacaggattgacagattgatagc

SEQ ID NO: 2941 - DNA, 27 bp, Homo sapiens
acggacaggattgacagattgatagct

SEQ ID NO: 2942 - DNA, 28 bp, Homo sapiens
acggacaggattgacagattgatagctc

SEQ ID NO: 2943 - DNA, 29 bp, Homo sapiens
acggacaggattgacagattgatagctct

SEQ ID NO: 2944 - DNA, 31 bp, Homo sapiens
acggacaggattgacagattgatagctcttt

SEQ ID NO: 2945 - DNA, 33 bp, Homo sapiens
acggacaggattgacagattgatagctctttct

SEQ ID NO: 2946 - DNA, 17 bp, Homo sapiens
cggacaggattgacaga

SEQ ID NO: 2947 - DNA, 18 bp, Homo sapiens
cggacaggattgacagat

SEQ ID NO: 2948 - DNA, 19 bp, Homo sapiens
cggacaggattgacagatt

SEQ ID NO: 2949 - DNA, 20 bp, Homo sapiens
cggacaggattgacagattg

SEQ ID NO: 2950 - DNA, 21 bp, Homo sapiens
cggacaggattgacagattga

SEQ ID NO: 2951 - DNA, 22 bp, Homo sapiens
cggacaggattgacagattgat

SEQ ID NO: 2952 - DNA, 25 bp, Homo sapiens
cggacaggattgacagattgatagc

SEQ ID NO: 2953 - DNA, 26 bp, Homo sapiens
cggacaggattgacagattgatagct

SEQ ID NO: 2954 - DNA, 27 bp, Homo sapiens
cggacaggattgacagattgatagctc

SEQ ID NO: 2955 - DNA, 28 bp, Homo sapiens
cggacaggattgacagattgatagctct

SEQ ID NO: 2956 - DNA, 30 bp, Homo sapiens
cggacaggattgacagattgatagctcttt

SEQ ID NO: 2957 - DNA, 32 bp, Homo sapiens
cggacaggattgacagattgatagctctttct

SEQ ID NO: 2958 - DNA, 18 bp, Homo sapiens
ggacaggattgacagatt

SEQ ID NO: 2959 - DNA, 19 bp, Homo sapiens
ggacaggattgacagattg

SEQ ID NO: 2960 - DNA, 25 bp, Homo sapiens
ggacaggattgacagattgatagct

SEQ ID NO: 2961 - DNA, 26 bp, Homo sapiens
ggacaggattgacagattgatagctc

SEQ ID NO: 2962 - DNA, 27 bp, Homo sapiens
ggacaggattgacagattgatagctct

SEQ ID NO: 2963 - DNA, 29 bp, Homo sapiens
ggacaggattgacagattgatagctcttt

SEQ ID NO: 2964 - DNA, 31 bp, Homo sapiens
ggacaggattgacagattgatagctctttct

SEQ ID NO: 2965 - DNA, 17 bp, Homo sapiens
gacaggattgacagatt

SEQ ID NO: 2966 - DNA, 18 bp, Homo sapiens
gacaggattgacagattg

SEQ ID NO: 2967 - DNA, 23 bp, Homo sapiens
gacaggattgacagattgatagc

SEQ ID NO: 2968 - DNA, 24 bp, Homo sapiens
gacaggattgacagattgatagct

SEQ ID NO: 2969 - DNA, 25 bp, Homo sapiens
gacaggattgacagattgatagctc

SEQ ID NO: 2970 - DNA, 26 bp, Homo sapiens
gacaggattgacagattgatagctct

SEQ ID NO: 2971 - DNA, 28 bp, Homo sapiens
gacaggattgacagattgatagctcttt

SEQ ID NO: 2972 - DNA, 30 bp, Homo sapiens
gacaggattgacagattgatagctctttct

SEQ ID NO: 2973 - DNA, 23 bp, Homo sapiens
acaggattgacagattgatagct

SEQ ID NO: 2974 - DNA, 22 bp, Homo sapiens
caggattgacagattgatagct

SEQ ID NO: 2975 - DNA, 21 bp, Homo sapiens
aggattgacagattgatagct

SEQ ID NO: 2976 - DNA, 33 bp, Homo sapiens
agattgatagctctttctcgattccgtgggtgg

SEQ ID NO: 2977 - DNA, 33 bp, Homo sapiens
cgtgggtggtggtgcatggccgttcttagttgg

SEQ ID NO: 2978 - DNA, 22 bp, Homo sapiens
gagcgatttgtctggttaattc

SEQ ID NO: 2979 - DNA, 18 bp, Homo sapiens
gatttgtctggttaattc

SEQ ID NO: 2980 - DNA, 17 bp, Homo sapiens
atttgtctggttaattc

SEQ ID NO: 2981 - DNA, 18 bp, Homo sapiens
atttgtctggttaattcc

SEQ ID NO: 2982 - DNA, 33 bp, Homo sapiens
ttgtctggttaattccgataacgaacgagactc

SEQ ID NO: 2983 - DNA, 33 bp, Homo sapiens
tggttaattccgataacgaacgagactctggca

SEQ ID NO: 2984 - DNA, 25 bp, Homo sapiens
ggttaattccgataacgaacgagac

SEQ ID NO: 2985 - DNA, 26 bp, Homo sapiens
ggttaattccgataacgaacgagact

SEQ ID NO: 2986 - DNA, 27 bp, Homo sapiens
ggttaattccgataacgaacgagactc

SEQ ID NO: 2987 - DNA, 28 bp, Homo sapiens
ggttaattccgataacgaacgagactct

SEQ ID NO: 2988 - DNA, 31 bp, Homo sapiens
ggttaattccgataacgaacgagactctggc

SEQ ID NO: 2989 - DNA, 32 bp, Homo sapiens
ggttaattccgataacgaacgagactctggca

SEQ ID NO: 2990 - DNA, 33 bp, Homo sapiens
ggttaattccgataacgaacgagactctggcat

SEQ ID NO: 2991 - DNA, 30 bp, Homo sapiens
gttaattccgataacgaacgagactctggc

SEQ ID NO: 2992 - DNA, 31 bp, Homo sapiens
gttaattccgataacgaacgagactctggca

SEQ ID NO: 2993 - DNA, 32 bp, Homo sapiens
gttaattccgataacgaacgagactctggcat

SEQ ID NO: 2994 - DNA, 33 bp, Homo sapiens
gttaattccgataacgaacgagactctggcatg

SEQ ID NO: 2995 - DNA, 30 bp, Homo sapiens
ttaattccgataacgaacgagactctggca

SEQ ID NO: 2996 - DNA, 31 bp, Homo sapiens
ttaattccgataacgaacgagactctggcat

SEQ ID NO: 2997 - DNA, 32 bp, Homo sapiens
ttaattccgataacgaacgagactctggcatg

SEQ ID NO: 2998 - DNA, 33 bp, Homo sapiens
ttaattccgataacgaacgagactctggcatgc

SEQ ID NO: 2999 - DNA, 28 bp, Homo sapiens
taattccgataacgaacgagactctggc

SEQ ID NO: 3000 - DNA, 29 bp, Homo sapiens
taattccgataacgaacgagactctggca

SEQ ID NO: 3001 - DNA, 30 bp, Homo sapiens
taattccgataacgaacgagactctggcat

SEQ ID NO: 3002 - DNA, 31 bp, Homo sapiens
taattccgataacgaacgagactctggcatg

SEQ ID NO: 3003 - DNA, 32 bp, Homo sapiens
taattccgataacgaacgagactctggcatgc

SEQ ID NO: 3004 - DNA, 33 bp, Homo sapiens
taattccgataacgaacgagactctggcatgct

SEQ ID NO: 3005 - DNA, 27 bp, Homo sapiens
aattccgataacgaacgagactctggc

SEQ ID NO: 3006 - DNA, 28 bp, Homo sapiens
aattccgataacgaacgagactctggca

SEQ ID NO: 3007 - DNA, 29 bp, Homo sapiens
aattccgataacgaacgagactctggcat

SEQ ID NO: 3008 - DNA, 30 bp, Homo sapiens
aattccgataacgaacgagactctggcatg

SEQ ID NO: 3009 - DNA, 31 bp, Homo sapiens
aattccgataacgaacgagactctggcatgc

SEQ ID NO: 3010 - DNA, 32 bp, Homo sapiens
aattccgataacgaacgagactctggcatgct

SEQ ID NO: 3011 - DNA, 33 bp, Homo sapiens
aattccgataacgaacgagactctggcatgcta

SEQ ID NO: 3012 - DNA, 26 bp, Homo sapiens
attccgataacgaacgagactctggc

SEQ ID NO: 3013 - DNA, 27 bp, Homo sapiens
attccgataacgaacgagactctggca

SEQ ID NO: 3014 - DNA, 28 bp, Homo sapiens
attccgataacgaacgagactctggcat

SEQ ID NO: 3015 - DNA, 29 bp, Homo sapiens
attccgataacgaacgagactctggcatg

SEQ ID NO: 3016 - DNA, 30 bp, Homo sapiens
attccgataacgaacgagactctggcatgc

SEQ ID NO: 3017 - DNA, 31 bp, Homo sapiens
attccgataacgaacgagactctggcatgct

SEQ ID NO: 3018 - DNA, 32 bp, Homo sapiens
attccgataacgaacgagactctggcatgcta

SEQ ID NO: 3019 - DNA, 25 bp, Homo sapiens
ttccgataacgaacgagactctggc

SEQ ID NO: 3020 - DNA, 26 bp, Homo sapiens
ttccgataacgaacgagactctggca

SEQ ID NO: 3021 - DNA, 27 bp, Homo sapiens
ttccgataacgaacgagactctggcat

SEQ ID NO: 3022 - DNA, 28 bp, Homo sapiens
ttccgataacgaacgagactctggcatg

SEQ ID NO: 3023 - DNA, 29 bp, Homo sapiens
ttccgataacgaacgagactctggcatgc

SEQ ID NO: 3024 - DNA, 30 bp, Homo sapiens
ttccgataacgaacgagactctggcatgct

SEQ ID NO: 3025 - DNA, 31 bp, Homo sapiens
ttccgataacgaacgagactctggcatgcta

SEQ ID NO: 3026 - DNA, 33 bp, Homo sapiens
ttccgataacgaacgagactctggcatgctaac

SEQ ID NO: 3027 - DNA, 24 bp, Homo sapiens
tccgataacgaacgagactctggc

SEQ ID NO: 3028 - DNA, 25 bp, Homo sapiens
tccgataacgaacgagactctggca

SEQ ID NO: 3029 - DNA, 26 bp, Homo sapiens
tccgataacgaacgagactctggcat

SEQ ID NO: 3030 - DNA, 27 bp, Homo sapiens
tccgataacgaacgagactctggcatg

SEQ ID NO: 3031 - DNA, 28 bp, Homo sapiens
tccgataacgaacgagactctggcatgc

SEQ ID NO: 3032 - DNA, 29 bp, Homo sapiens
tccgataacgaacgagactctggcatgct

SEQ ID NO: 3033 - DNA, 30 bp, Homo sapiens
tccgataacgaacgagactctggcatgcta

SEQ ID NO: 3034 - DNA, 32 bp, Homo sapiens
tccgataacgaacgagactctggcatgctaac

SEQ ID NO: 3035 - DNA, 33 bp, Homo sapiens
tccgataacgaacgagactctggcatgctaact

SEQ ID NO: 3036 - DNA, 23 bp, Homo sapiens
ccgataacgaacgagactctggc

SEQ ID NO: 3037 - DNA, 24 bp, Homo sapiens
ccgataacgaacgagactctggca

SEQ ID NO: 3038 - DNA, 25 bp, Homo sapiens
ccgataacgaacgagactctggcat

SEQ ID NO: 3039 - DNA, 26 bp, Homo sapiens
ccgataacgaacgagactctggcatg

SEQ ID NO: 3040 - DNA, 27 bp, Homo sapiens
ccgataacgaacgagactctggcatgc

SEQ ID NO: 3041 - DNA, 28 bp, Homo sapiens
ccgataacgaacgagactctggcatgct

SEQ ID NO: 3042 - DNA, 29 bp, Homo sapiens
ccgataacgaacgagactctggcatgcta

SEQ ID NO: 3043 - DNA, 31 bp, Homo sapiens
ccgataacgaacgagactctggcatgctaac

SEQ ID NO: 3044 - DNA, 32 bp, Homo sapiens
ccgataacgaacgagactctggcatgctaact

SEQ ID NO: 3045 - DNA, 33 bp, Homo sapiens
ccgataacgaacgagactctggcatgctaacta

SEQ ID NO: 3046 - DNA, 22 bp, Homo sapiens
cgataacgaacgagactctggc

SEQ ID NO: 3047 - DNA, 23 bp, Homo sapiens
cgataacgaacgagactctggca

SEQ ID NO: 3048 - DNA, 24 bp, Homo sapiens
cgataacgaacgagactctggcat

SEQ ID NO: 3049 - DNA, 25 bp, Homo sapiens
cgataacgaacgagactctggcatg

SEQ ID NO: 3050 - DNA, 26 bp, Homo sapiens
cgataacgaacgagactctggcatgc

SEQ ID NO: 3051 - DNA, 27 bp, Homo sapiens
cgataacgaacgagactctggcatgct

SEQ ID NO: 3052 - DNA, 28 bp, Homo sapiens
cgataacgaacgagactctggcatgcta

SEQ ID NO: 3053 - DNA, 29 bp, Homo sapiens
cgataacgaacgagactctggcatgctaa

SEQ ID NO: 3054 - DNA, 30 bp, Homo sapiens
cgataacgaacgagactctggcatgctaac

SEQ ID NO: 3055 - DNA, 31 bp, Homo sapiens
cgataacgaacgagactctggcatgctaact

SEQ ID NO: 3056 - DNA, 32 bp, Homo sapiens
cgataacgaacgagactctggcatgctaacta

SEQ ID NO: 3057 - DNA, 33 bp, Homo sapiens
cgataacgaacgagactctggcatgctaactag

SEQ ID NO: 3058 - DNA, 19 bp, Homo sapiens
gataacgaacgagactctg

SEQ ID NO: 3059 - DNA, 21 bp, Homo sapiens
gataacgaacgagactctggc

SEQ ID NO: 3060 - DNA, 22 bp, Homo sapiens
gataacgaacgagactctggca

SEQ ID NO: 3061 - DNA, 23 bp, Homo sapiens
gataacgaacgagactctggcat

SEQ ID NO: 3062 - DNA, 24 bp, Homo sapiens
gataacgaacgagactctggcatg

SEQ ID NO: 3063 - DNA, 25 bp, Homo sapiens
gataacgaacgagactctggcatgc

SEQ ID NO: 3064 - DNA, 26 bp, Homo sapiens
gataacgaacgagactctggcatgct

SEQ ID NO: 3065 - DNA, 27 bp, Homo sapiens
gataacgaacgagactctggcatgcta

SEQ ID NO: 3066 - DNA, 28 bp, Homo sapiens
gataacgaacgagactctggcatgctaa

SEQ ID NO: 3067 - DNA, 29 bp, Homo sapiens
gataacgaacgagactctggcatgctaac

SEQ ID NO: 3068 - DNA, 30 bp, Homo sapiens
gataacgaacgagactctggcatgctaact

SEQ ID NO: 3069 - DNA, 31 bp, Homo sapiens
gataacgaacgagactctggcatgctaacta

SEQ ID NO: 3070 - DNA, 32 bp, Homo sapiens
gataacgaacgagactctggcatgctaactag

SEQ ID NO: 3071 - DNA, 33 bp, Homo sapiens
gataacgaacgagactctggcatgctaactagt

SEQ ID NO: 3072 - DNA, 20 bp, Homo sapiens
ataacgaacgagactctggc

SEQ ID NO: 3073 - DNA, 21 bp, Homo sapiens
ataacgaacgagactctggca

SEQ ID NO: 3074 - DNA, 22 bp, Homo sapiens
ataacgaacgagactctggcat

SEQ ID NO: 3075 - DNA, 23 bp, Homo sapiens
ataacgaacgagactctggcatg

SEQ ID NO: 3076 - DNA, 24 bp, Homo sapiens
ataacgaacgagactctggcatgc

SEQ ID NO: 3077 - DNA, 25 bp, Homo sapiens
ataacgaacgagactctggcatgct

SEQ ID NO: 3078 - DNA, 26 bp, Homo sapiens
ataacgaacgagactctggcatgcta

SEQ ID NO: 3079 - DNA, 27 bp, Homo sapiens
ataacgaacgagactctggcatgctaa

SEQ ID NO: 3080 - DNA, 28 bp, Homo sapiens
ataacgaacgagactctggcatgctaac

SEQ ID NO: 3081 - DNA, 29 bp, Homo sapiens
ataacgaacgagactctggcatgctaact

SEQ ID NO: 3082 - DNA, 30 bp, Homo sapiens
ataacgaacgagactctggcatgctaacta

SEQ ID NO: 3083 - DNA, 31 bp, Homo sapiens
ataacgaacgagactctggcatgctaactag

SEQ ID NO: 3084 - DNA, 32 bp, Homo sapiens
ataacgaacgagactctggcatgctaactagt

SEQ ID NO: 3085 - DNA, 33 bp, Homo sapiens
ataacgaacgagactctggcatgctaactagtt

SEQ ID NO: 3086 - DNA, 19 bp, Homo sapiens
taacgaacgagactctggc

SEQ ID NO: 3087 - DNA, 20 bp, Homo sapiens
taacgaacgagactctggca

SEQ ID NO: 3088 - DNA, 21 bp, Homo sapiens
taacgaacgagactctggcat

SEQ ID NO: 3089 - DNA, 22 bp, Homo sapiens
taacgaacgagactctggcatg

SEQ ID NO: 3090 - DNA, 23 bp, Homo sapiens
taacgaacgagactctggcatgc

SEQ ID NO: 3091 - DNA, 24 bp, Homo sapiens
taacgaacgagactctggcatgct

SEQ ID NO: 3092 - DNA, 25 bp, Homo sapiens
taacgaacgagactctggcatgcta

SEQ ID NO: 3093 - DNA, 27 bp, Homo sapiens
taacgaacgagactctggcatgctaac

SEQ ID NO: 3094 - DNA, 28 bp, Homo sapiens
taacgaacgagactctggcatgctaact

SEQ ID NO: 3095 - DNA, 29 bp, Homo sapiens
taacgaacgagactctggcatgctaacta

SEQ ID NO: 3096 - DNA, 30 bp, Homo sapiens
taacgaacgagactctggcatgctaactag

SEQ ID NO: 3097 - DNA, 31 bp, Homo sapiens
taacgaacgagactctggcatgctaactagt

SEQ ID NO: 3098 - DNA, 32 bp, Homo sapiens
taacgaacgagactctggcatgctaactagtt

SEQ ID NO: 3099 - DNA, 18 bp, Homo sapiens
aacgaacgagactctggc

SEQ ID NO: 3100 - DNA, 19 bp, Homo sapiens
aacgaacgagactctggca

SEQ ID NO: 3101 - DNA, 20 bp, Homo sapiens
aacgaacgagactctggcat

SEQ ID NO: 3102 - DNA, 21 bp, Homo sapiens
aacgaacgagactctggcatg

SEQ ID NO: 3103 - DNA, 22 bp, Homo sapiens
aacgaacgagactctggcatgc

SEQ ID NO: 3104 - DNA, 23 bp, Homo sapiens
aacgaacgagactctggcatgct

SEQ ID NO: 3105 - DNA, 24 bp, Homo sapiens
aacgaacgagactctggcatgcta

SEQ ID NO: 3106 - DNA, 25 bp, Homo sapiens
aacgaacgagactctggcatgctaa

SEQ ID NO: 3107 - DNA, 26 bp, Homo sapiens
aacgaacgagactctggcatgctaac

SEQ ID NO: 3108 - DNA, 27 bp, Homo sapiens
aacgaacgagactctggcatgctaact

SEQ ID NO: 3109 - DNA, 28 bp, Homo sapiens
aacgaacgagactctggcatgctaacta

SEQ ID NO: 3110 - DNA, 29 bp, Homo sapiens
aacgaacgagactctggcatgctaactag

SEQ ID NO: 3111 - DNA, 30 bp, Homo sapiens
aacgaacgagactctggcatgctaactagt

SEQ ID NO: 3112 - DNA, 31 bp, Homo sapiens
aacgaacgagactctggcatgctaactagtt

SEQ ID NO: 3113 - DNA, 32 bp, Homo sapiens
aacgaacgagactctggcatgctaactagtta

SEQ ID NO: 3114 - DNA, 33 bp, Homo sapiens
aacgaacgagactctggcatgctaactagttac

SEQ ID NO: 3115 - DNA, 17 bp, Homo sapiens
acgaacgagactctggc

SEQ ID NO: 3116 - DNA, 18 bp, Homo sapiens
acgaacgagactctggca

SEQ ID NO: 3117 - DNA, 19 bp, Homo sapiens
acgaacgagactctggcat

SEQ ID NO: 3118 - DNA, 20 bp, Homo sapiens
acgaacgagactctggcatg

SEQ ID NO: 3119 - DNA, 21 bp, Homo sapiens
acgaacgagactctggcatgc

SEQ ID NO: 3120 - DNA, 22 bp, Homo sapiens
acgaacgagactctggcatgct

SEQ ID NO: 3121 - DNA, 23 bp, Homo sapiens
acgaacgagactctggcatgcta

SEQ ID NO: 3122 - DNA, 24 bp, Homo sapiens
acgaacgagactctggcatgctaa

SEQ ID NO: 3123 - DNA, 25 bp, Homo sapiens
acgaacgagactctggcatgctaac

SEQ ID NO: 3124 - DNA, 26 bp, Homo sapiens
acgaacgagactctggcatgctaact

SEQ ID NO: 3125 - DNA, 27 bp, Homo sapiens
acgaacgagactctggcatgctaacta

SEQ ID NO: 3126 - DNA, 28 bp, Homo sapiens
acgaacgagactctggcatgctaactag

SEQ ID NO: 3127 - DNA, 29 bp, Homo sapiens
acgaacgagactctggcatgctaactagt

SEQ ID NO: 3128 - DNA, 30 bp, Homo sapiens
acgaacgagactctggcatgctaactagtt

SEQ ID NO: 3129 - DNA, 31 bp, Homo sapiens
acgaacgagactctggcatgctaactagtta

SEQ ID NO: 3130 - DNA, 32 bp, Homo sapiens
acgaacgagactctggcatgctaactagttac

SEQ ID NO: 3131 - DNA, 33 bp, Homo sapiens
acgaacgagactctggcatgctaactagttacg

SEQ ID NO: 3132 - DNA, 16 bp, Homo sapiens
cgaacgagactctggc

SEQ ID NO: 3133 - DNA, 17 bp, Homo sapiens
cgaacgagactctggca

SEQ ID NO: 3134 - DNA, 18 bp, Homo sapiens
cgaacgagactctggcat

SEQ ID NO: 3135 - DNA, 19 bp, Homo sapiens
cgaacgagactctggcatg

SEQ ID NO: 3136 - DNA, 20 bp, Homo sapiens
cgaacgagactctggcatgc

SEQ ID NO: 3137 - DNA, 21 bp, Homo sapiens
cgaacgagactctggcatgct

SEQ ID NO: 3138 - DNA, 22 bp, Homo sapiens
cgaacgagactctggcatgcta

SEQ ID NO: 3139 - DNA, 23 bp, Homo sapiens
cgaacgagactctggcatgctaa

SEQ ID NO: 3140 - DNA, 24 bp, Homo sapiens
cgaacgagactctggcatgctaac

SEQ ID NO: 3141 - DNA, 25 bp, Homo sapiens
cgaacgagactctggcatgctaact

SEQ ID NO: 3142 - DNA, 26 bp, Homo sapiens
cgaacgagactctggcatgctaacta

SEQ ID NO: 3143 - DNA, 27 bp, Homo sapiens
cgaacgagactctggcatgctaactag

SEQ ID NO: 3144 - DNA, 28 bp, Homo sapiens
cgaacgagactctggcatgctaactagt

SEQ ID NO: 3145 - DNA, 29 bp, Homo sapiens
cgaacgagactctggcatgctaactagtt

SEQ ID NO: 3146 - DNA, 30 bp, Homo sapiens
cgaacgagactctggcatgctaactagtta

SEQ ID NO: 3147 - DNA, 31 bp, Homo sapiens
cgaacgagactctggcatgctaactagttac

SEQ ID NO: 3148 - DNA, 32 bp, Homo sapiens
cgaacgagactctggcatgctaactagttacg

SEQ ID NO: 3149 - DNA, 16 bp, Homo sapiens
gaacgagactctggca

SEQ ID NO: 3150 - DNA, 17 bp, Homo sapiens
gaacgagactctggcat

SEQ ID NO: 3151 - DNA, 18 bp, Homo sapiens
gaacgagactctggcatg

SEQ ID NO: 3152 - DNA, 19 bp, Homo sapiens
gaacgagactctggcatgc

SEQ ID NO: 3153 - DNA, 20 bp, Homo sapiens
gaacgagactctggcatgct

SEQ ID NO: 3154 - DNA, 21 bp, Homo sapiens
gaacgagactctggcatgcta

SEQ ID NO: 3155 - DNA, 22 bp, Homo sapiens
gaacgagactctggcatgctaa

SEQ ID NO: 3156 - DNA, 23 bp, Homo sapiens
gaacgagactctggcatgctaac

SEQ ID NO: 3157 - DNA, 24 bp, Homo sapiens
gaacgagactctggcatgctaact

SEQ ID NO: 3158 - DNA, 25 bp, Homo sapiens
gaacgagactctggcatgctaacta

SEQ ID NO: 3159 - DNA, 26 bp, Homo sapiens
gaacgagactctggcatgctaactag

SEQ ID NO: 3160 - DNA, 27 bp, Homo sapiens
gaacgagactctggcatgctaactagt

SEQ ID NO: 3161 - DNA, 28 bp, Homo sapiens
gaacgagactctggcatgctaactagtt

SEQ ID NO: 3162 - DNA, 29 bp, Homo sapiens
gaacgagactctggcatgctaactagtta

SEQ ID NO: 3163 - DNA, 30 bp, Homo sapiens
gaacgagactctggcatgctaactagttac

SEQ ID NO: 3164 - DNA, 31 bp, Homo sapiens
gaacgagactctggcatgctaactagttacg

SEQ ID NO: 3165 - DNA, 33 bp, Homo sapiens
gaacgagactctggcatgctaactagttacgcg

SEQ ID NO: 3166 - DNA, 16 bp, Homo sapiens
aacgagactctggcat

SEQ ID NO: 3167 - DNA, 17 bp, Homo sapiens
aacgagactctggcatg

SEQ ID NO: 3168 - DNA, 18 bp, Homo sapiens
aacgagactctggcatgc

SEQ ID NO: 3169 - DNA, 19 bp, Homo sapiens
aacgagactctggcatgct

SEQ ID NO: 3170 - DNA, 20 bp, Homo sapiens
aacgagactctggcatgcta

SEQ ID NO: 3171 - DNA, 21 bp, Homo sapiens
aacgagactctggcatgctaa

SEQ ID NO: 3172 - DNA, 22 bp, Homo sapiens
aacgagactctggcatgctaac

SEQ ID NO: 3173 - DNA, 23 bp, Homo sapiens
aacgagactctggcatgctaact

SEQ ID NO: 3174 - DNA, 24 bp, Homo sapiens
aacgagactctggcatgctaacta

SEQ ID NO: 3175 - DNA, 25 bp, Homo sapiens
aacgagactctggcatgctaactag

SEQ ID NO: 3176 - DNA, 26 bp, Homo sapiens
aacgagactctggcatgctaactagt

SEQ ID NO: 3177 - DNA, 27 bp, Homo sapiens
aacgagactctggcatgctaactagtt

SEQ ID NO: 3178 - DNA, 28 bp, Homo sapiens
aacgagactctggcatgctaactagtta

SEQ ID NO: 3179 - DNA, 29 bp, Homo sapiens
aacgagactctggcatgctaactagttac

SEQ ID NO: 3180 - DNA, 30 bp, Homo sapiens
aacgagactctggcatgctaactagttacg

SEQ ID NO: 3181 - DNA, 31 bp, Homo sapiens
aacgagactctggcatgctaactagttacgc

SEQ ID NO: 3182 - DNA, 32 bp, Homo sapiens
aacgagactctggcatgctaactagttacgcg

SEQ ID NO: 3183 - DNA, 33 bp, Homo sapiens
aacgagactctggcatgctaactagttacgcga

SEQ ID NO: 3184 - DNA, 16 bp, Homo sapiens
acgagactctggcatg

SEQ ID NO: 3185 - DNA, 17 bp, Homo sapiens
acgagactctggcatgc

SEQ ID NO: 3186 - DNA, 18 bp, Homo sapiens
acgagactctggcatgct

SEQ ID NO: 3187 - DNA, 19 bp, Homo sapiens
acgagactctggcatgcta

SEQ ID NO: 3188 - DNA, 20 bp, Homo sapiens
acgagactctggcatgctaa

SEQ ID NO: 3189 - DNA, 21 bp, Homo sapiens
acgagactctggcatgctaac

SEQ ID NO: 3190 - DNA, 22 bp, Homo sapiens
acgagactctggcatgctaact

SEQ ID NO: 3191 - DNA, 23 bp, Homo sapiens
acgagactctggcatgctaacta

SEQ ID NO: 3192 - DNA, 24 bp, Homo sapiens
acgagactctggcatgctaactag

SEQ ID NO: 3193 - DNA, 25 bp, Homo sapiens
acgagactctggcatgctaactagt

SEQ ID NO: 3194 - DNA, 26 bp, Homo sapiens
acgagactctggcatgctaactagtt

SEQ ID NO: 3195 - DNA, 27 bp, Homo sapiens
acgagactctggcatgctaactagtta

SEQ ID NO: 3196 - DNA, 28 bp, Homo sapiens
acgagactctggcatgctaactagttac

SEQ ID NO: 3197 - DNA, 29 bp, Homo sapiens
acgagactctggcatgctaactagttacg

SEQ ID NO: 3198 - DNA, 31 bp, Homo sapiens
acgagactctggcatgctaactagttacgcg

SEQ ID NO: 3199 - DNA, 32 bp, Homo sapiens
acgagactctggcatgctaactagttacgcga

SEQ ID NO: 3200 - DNA, 33 bp, Homo sapiens
acgagactctggcatgctaactagttacgcgac

SEQ ID NO: 3201 - DNA, 17 bp, Homo sapiens
cgagactctggcatgct

SEQ ID NO: 3202 - DNA, 30 bp, Homo sapiens
cgagactctggcatgctaactagttacgcg

SEQ ID NO: 3203 - DNA, 33 bp, Homo sapiens
cgagactctggcatgctaactagttacgcgacc

SEQ ID NO: 3204 - DNA, 18 bp, Homo sapiens
agactctggcatgctaac

SEQ ID NO: 3205 - DNA, 19 bp, Homo sapiens
agactctggcatgctaact

SEQ ID NO: 3206 - DNA, 33 bp, Homo sapiens
agactctggcatgctaactagttacgcgacccc

SEQ ID NO: 3207 - DNA, 26 bp, Homo sapiens
tctggcatgctaactagttacgcgac

SEQ ID NO: 3208 - DNA, 25 bp, Homo sapiens
ctggcatgctaactagttacgcgac

SEQ ID NO: 3209 - DNA, 29 bp, Homo sapiens
gcatgctaactagttacgcgacccccgag

SEQ ID NO: 3210 - DNA, 30 bp, Homo sapiens
gcatgctaactagttacgcgacccccgagc

SEQ ID NO: 3211 - DNA, 31 bp, Homo sapiens
gcatgctaactagttacgcgacccccgagcg

SEQ ID NO: 3212 - DNA, 16 bp, Homo sapiens
aactagttacgcgacc

SEQ ID NO: 3213 - DNA, 26 bp, Homo sapiens
agttacgcgacccccgagcggtcggc

SEQ ID NO: 3214 - DNA, 25 bp, Homo sapiens
gttacgcgacccccgagcggtcggc

SEQ ID NO: 3215 - DNA, 24 bp, Homo sapiens
ttacgcgacccccgagcggtcggc

SEQ ID NO: 3216 - DNA, 23 bp, Homo sapiens
tacgcgacccccgagcggtcggc

SEQ ID NO: 3217 - DNA, 22 bp, Homo sapiens
acgcgacccccgagcggtcggc

SEQ ID NO: 3218 - DNA, 23 bp, Homo sapiens
acgcgacccccgagcggtcggcg

SEQ ID NO: 3219 - DNA, 21 bp, Homo sapiens
cgcgacccccgagcggtcggc

SEQ ID NO: 3220 - DNA, 20 bp, Homo sapiens
gcgacccccgagcggtcggc

SEQ ID NO: 3221 - DNA, 19 bp, Homo sapiens
cgacccccgagcggtcggc

SEQ ID NO: 3222 - DNA, 17 bp, Homo sapiens
acccccgagcggtcggc

SEQ ID NO: 3223 - DNA, 18 bp, Homo sapiens
acccccgagcggtcggcg

SEQ ID NO: 3224 - DNA, 20 bp, Homo sapiens
acccccgagcggtcggcgtc

SEQ ID NO: 3225 - DNA, 21 bp, Homo sapiens
acccccgagcggtcggcgtcc

SEQ ID NO: 3226 - DNA, 22 bp, Homo sapiens
acccccgagcggtcggcgtccc

SEQ ID NO: 3227 - DNA, 23 bp, Homo sapiens
acccccgagcggtcggcgtcccc

SEQ ID NO: 3228 - DNA, 20 bp, Homo sapiens
cccccgagcggtcggcgtcc

SEQ ID NO: 3229 - DNA, 18 bp, Homo sapiens
ccccgagcggtcggcgtc

SEQ ID NO: 3230 - DNA, 19 bp, Homo sapiens
ccccgagcggtcggcgtcc

SEQ ID NO: 3231 - DNA, 20 bp, Homo sapiens
ccccgagcggtcggcgtccc

SEQ ID NO: 3232 - DNA, 21 bp, Homo sapiens
ccccgagcggtcggcgtcccc

SEQ ID NO: 3233 - DNA, 17 bp, Homo sapiens
cccgagcggtcggcgtc

SEQ ID NO: 3234 - DNA, 18 bp, Homo sapiens
cccgagcggtcggcgtcc

SEQ ID NO: 3235 - DNA, 19 bp, Homo sapiens
cccgagcggtcggcgtccc

SEQ ID NO: 3236 - DNA, 20 bp, Homo sapiens
cccgagcggtcggcgtcccc

SEQ ID NO: 3237 - DNA, 21 bp, Homo sapiens
cccgagcggtcggcgtccccc

SEQ ID NO: 3238 - DNA, 28 bp, Homo sapiens
cccgagcggtcggcgtcccccaacttct

SEQ ID NO: 3239 - DNA, 16 bp, Homo sapiens
ccgagcggtcggcgtc

SEQ ID NO: 3240 - DNA, 17 bp, Homo sapiens
ccgagcggtcggcgtcc

SEQ ID NO: 3241 - DNA, 18 bp, Homo sapiens
ccgagcggtcggcgtccc

SEQ ID NO: 3242 - DNA, 19 bp, Homo sapiens
ccgagcggtcggcgtcccc

SEQ ID NO: 3243 - DNA, 27 bp, Homo sapiens
ccgagcggtcggcgtcccccaacttct

SEQ ID NO: 3244 - DNA, 16 bp, Homo sapiens
cgagcggtcggcgtcc

SEQ ID NO: 3245 - DNA, 17 bp, Homo sapiens
cgagcggtcggcgtccc

SEQ ID NO: 3246 - DNA, 18 bp, Homo sapiens
cgagcggtcggcgtcccc

SEQ ID NO: 3247 - DNA, 19 bp, Homo sapiens
cgagcggtcggcgtccccc

SEQ ID NO: 3248 - DNA, 26 bp, Homo sapiens
cgagcggtcggcgtcccccaacttct

SEQ ID NO: 3249 - DNA, 16 bp, Homo sapiens
gagcggtcggcgtccc

SEQ ID NO: 3250 - DNA, 17 bp, Homo sapiens
gagcggtcggcgtcccc

SEQ ID NO: 3251 - DNA, 18 bp, Homo sapiens
gagcggtcggcgtccccc

SEQ ID NO: 3252 - DNA, 25 bp, Homo sapiens
gagcggtcggcgtcccccaacttct

SEQ ID NO: 3253 - DNA, 16 bp, Homo sapiens
agcggtcggcgtcccc

SEQ ID NO: 3254 - DNA, 17 bp, Homo sapiens
agcggtcggcgtccccc

SEQ ID NO: 3255 - DNA, 24 bp, Homo sapiens
agcggtcggcgtcccccaacttct

SEQ ID NO: 3256 - DNA, 30 bp, Homo sapiens
agcggtcggcgtcccccaacttcttagagg

SEQ ID NO: 3257 - DNA, 31 bp, Homo sapiens
agcggtcggcgtcccccaacttcttagaggg

SEQ ID NO: 3258 - DNA, 22 bp, Homo sapiens
cggtcggcgtcccccaacttct

SEQ ID NO: 3259 - DNA, 28 bp, Homo sapiens
cggtcggcgtcccccaacttcttagagg

SEQ ID NO: 3260 - DNA, 20 bp, Homo sapiens
gtcggcgtcccccaacttct

SEQ ID NO: 3261 - DNA, 26 bp, Homo sapiens
gtcggcgtcccccaacttcttagagg

SEQ ID NO: 3262 - DNA, 21 bp, Homo sapiens
caacttcttagagggacaagt

SEQ ID NO: 3263 - DNA, 31 bp, Homo sapiens
tagagggacaagtggcgttcagccacccgag

SEQ ID NO: 3264 - DNA, 32 bp, Homo sapiens
tagagggacaagtggcgttcagccacccgaga

SEQ ID NO: 3265 - DNA, 33 bp, Homo sapiens
tagagggacaagtggcgttcagccacccgagat

SEQ ID NO: 3266 - DNA, 32 bp, Homo sapiens
agagggacaagtggcgttcagccacccgagat

SEQ ID NO: 3267 - DNA, 33 bp, Homo sapiens
agagggacaagtggcgttcagccacccgagatt

SEQ ID NO: 3268 - DNA, 26 bp, Homo sapiens
cccgagattgagcaataacaggtctg

SEQ ID NO: 3269 - DNA, 25 bp, Homo sapiens
ccgagattgagcaataacaggtctg

SEQ ID NO: 3270 - DNA, 25 bp, Homo sapiens
cgagattgagcaataacaggtctgt

SEQ ID NO: 3271 - DNA, 26 bp, Homo sapiens
cgagattgagcaataacaggtctgtg

SEQ ID NO: 3272 - DNA, 27 bp, Homo sapiens
gagattgagcaataacaggtctgtgat

SEQ ID NO: 3273 - DNA, 28 bp, Homo sapiens
gagattgagcaataacaggtctgtgatg

SEQ ID NO: 3274 - DNA, 21 bp, Homo sapiens
gagcaataacaggtctgtgat

SEQ ID NO: 3275 - DNA, 22 bp, Homo sapiens
agcaataacaggtctgtgatgc

SEQ ID NO: 3276 - DNA, 21 bp, Homo sapiens
caataacaggtctgtgatgcc

SEQ ID NO: 3277 - DNA, 22 bp, Homo sapiens
caataacaggtctgtgatgccc

SEQ ID NO: 3278 - DNA, 19 bp, Homo sapiens
aataacaggtctgtgatgc

SEQ ID NO: 3279 - DNA, 20 bp, Homo sapiens
aataacaggtctgtgatgcc

SEQ ID NO: 3280 - DNA, 21 bp, Homo sapiens
aataacaggtctgtgatgccc

SEQ ID NO: 3281 - DNA, 22 bp, Homo sapiens
aataacaggtctgtgatgccct

SEQ ID NO: 3282 - DNA, 18 bp, Homo sapiens
ataacaggtctgtgatgc

SEQ ID NO: 3283 - DNA, 19 bp, Homo sapiens
ataacaggtctgtgatgcc

SEQ ID NO: 3284 - DNA, 20 bp, Homo sapiens
ataacaggtctgtgatgccc

SEQ ID NO: 3285 - DNA, 30 bp, Homo sapiens
ataacaggtctgtgatgcccttagatgtcc

SEQ ID NO: 3286 - DNA, 33 bp, Homo sapiens
ataacaggtctgtgatgcccttagatgtccggg

SEQ ID NO: 3287 - DNA, 18 bp, Homo sapiens
taacaggtctgtgatgcc

SEQ ID NO: 3288 - DNA, 19 bp, Homo sapiens
taacaggtctgtgatgccc

SEQ ID NO: 3289 - DNA, 16 bp, Homo sapiens
aacaggtctgtgatgc

SEQ ID NO: 3290 - DNA, 17 bp, Homo sapiens
aacaggtctgtgatgcc

SEQ ID NO: 3291 - DNA, 18 bp, Homo sapiens
aacaggtctgtgatgccc

SEQ ID NO: 3292 - DNA, 16 bp, Homo sapiens
acaggtctgtgatgcc

SEQ ID NO: 3293 - DNA, 17 bp, Homo sapiens
acaggtctgtgatgccc

SEQ ID NO: 3294 - DNA, 27 bp, Homo sapiens
acaggtctgtgatgcccttagatgtcc

SEQ ID NO: 3295 - DNA, 16 bp, Homo sapiens
caggtctgtgatgccc

SEQ ID NO: 3296 - DNA, 26 bp, Homo sapiens
caggtctgtgatgcccttagatgtcc

SEQ ID NO: 3297 - DNA, 17 bp, Homo sapiens
ccttagatgtccggggc

SEQ ID NO: 3298 - DNA, 18 bp, Homo sapiens
ccttagatgtccggggct

SEQ ID NO: 3299 - DNA, 16 bp, Homo sapiens
cttagatgtccggggc

SEQ ID NO: 3300 - DNA, 17 bp, Homo sapiens
cttagatgtccggggct

SEQ ID NO: 3301 - DNA, 20 bp, Homo sapiens
cttagatgtccggggctgca

SEQ ID NO: 3302 - DNA, 28 bp, Homo sapiens
cttagatgtccggggctgcacgcgcgct

SEQ ID NO: 3303 - DNA, 31 bp, Homo sapiens
cttagatgtccggggctgcacgcgcgctaca

SEQ ID NO: 3304 - DNA, 33 bp, Homo sapiens
cttagatgtccggggctgcacgcgcgctacact

SEQ ID NO: 3305 - DNA, 16 bp, Homo sapiens
ttagatgtccggggct

SEQ ID NO: 3306 - DNA, 32 bp, Homo sapiens
ttagatgtccggggctgcacgcgcgctacact

SEQ ID NO: 3307 - DNA, 31 bp, Homo sapiens
tagatgtccggggctgcacgcgcgctacact

SEQ ID NO: 3308 - DNA, 33 bp, Homo sapiens
agatgtccggggctgcacgcgcgctacactgac

SEQ ID NO: 3309 - DNA, 16 bp, Homo sapiens
gatgtccggggctgca

SEQ ID NO: 3310 - DNA, 27 bp, Homo sapiens
gatgtccggggctgcacgcgcgctaca

SEQ ID NO: 3311 - DNA, 33 bp, Homo sapiens
gatgtccggggctgcacgcgcgctacactgact

SEQ ID NO: 3312 - DNA, 27 bp, Homo sapiens
cggggctgcacgcgcgctacactgact

SEQ ID NO: 3313 - DNA, 30 bp, Homo sapiens
cgcgcgctacactgactggctcagcgtgtg

SEQ ID NO: 3314 - DNA, 28 bp, Homo sapiens
cgcgctacactgactggctcagcgtgtg

SEQ ID NO: 3315 - DNA, 16 bp, Homo sapiens
ctacactgactggctc

SEQ ID NO: 3316 - DNA, 23 bp, Homo sapiens
cactgactggctcagcgtgtgcc

SEQ ID NO: 3317 - DNA, 24 bp, Homo sapiens
cactgactggctcagcgtgtgcct

SEQ ID NO: 3318 - DNA, 27 bp, Homo sapiens
cactgactggctcagcgtgtgcctacc

SEQ ID NO: 3319 - DNA, 28 bp, Homo sapiens
cactgactggctcagcgtgtgcctaccc

SEQ ID NO: 3320 - DNA, 22 bp, Homo sapiens
actgactggctcagcgtgtgcc

SEQ ID NO: 3321 - DNA, 23 bp, Homo sapiens
actgactggctcagcgtgtgcct

SEQ ID NO: 3322 - DNA, 27 bp, Homo sapiens
actgactggctcagcgtgtgcctaccc

SEQ ID NO: 3323 - DNA, 21 bp, Homo sapiens
ctgactggctcagcgtgtgcc

SEQ ID NO: 3324 - DNA, 22 bp, Homo sapiens
ctgactggctcagcgtgtgcct

SEQ ID NO: 3325 - DNA, 25 bp, Homo sapiens
ctgactggctcagcgtgtgcctacc

SEQ ID NO: 3326 - DNA, 26 bp, Homo sapiens
ctgactggctcagcgtgtgcctaccc

SEQ ID NO: 3327 - DNA, 31 bp, Homo sapiens
ctgactggctcagcgtgtgcctaccctacgc

SEQ ID NO: 3328 - DNA, 20 bp, Homo sapiens
tgactggctcagcgtgtgcc

SEQ ID NO: 3329 - DNA, 17 bp, Homo sapiens
taccctacgccggcagg

SEQ ID NO: 3330 - DNA, 16 bp, Homo sapiens
accctacgccggcagg

SEQ ID NO: 3331 - DNA, 28 bp, Homo sapiens
ccggcaggcgcgggtaacccgttgaacc

SEQ ID NO: 3332 - DNA, 29 bp, Homo sapiens
ccggcaggcgcgggtaacccgttgaaccc

SEQ ID NO: 3333 - DNA, 30 bp, Homo sapiens
ccggcaggcgcgggtaacccgttgaacccc

SEQ ID NO: 3334 - DNA, 27 bp, Homo sapiens
cggcaggcgcgggtaacccgttgaacc

SEQ ID NO: 3335 - DNA, 28 bp, Homo sapiens
cggcaggcgcgggtaacccgttgaaccc

SEQ ID NO: 3336 - DNA, 29 bp, Homo sapiens
cggcaggcgcgggtaacccgttgaacccc

SEQ ID NO: 3337 - DNA, 21 bp, Homo sapiens
cgcgggtaacccgttgaaccc

SEQ ID NO: 3338 - DNA, 33 bp, Homo sapiens
cgcgggtaacccgttgaaccccattcgtgatgg

SEQ ID NO: 3339 - DNA, 19 bp, Homo sapiens
cgggtaacccgttgaaccc

SEQ ID NO: 3340 - DNA, 17 bp, Homo sapiens
ggtaacccgttgaaccc

SEQ ID NO: 3341 - DNA, 21 bp, Homo sapiens
cgttgaaccccattcgtgatg

SEQ ID NO: 3342 - DNA, 22 bp, Homo sapiens
cgttgaaccccattcgtgatgg

SEQ ID NO: 3343 - DNA, 33 bp, Homo sapiens
gaaccccattcgtgatggggatcggggattgca

SEQ ID NO: 3344 - DNA, 30 bp, Homo sapiens
ccccattcgtgatggggatcggggattgca

SEQ ID NO: 3345 - DNA, 29 bp, Homo sapiens
cccattcgtgatggggatcggggattgca

SEQ ID NO: 3346 - DNA, 28 bp, Homo sapiens
ccattcgtgatggggatcggggattgca

SEQ ID NO: 3347 - DNA, 27 bp, Homo sapiens
cattcgtgatggggatcggggattgca

SEQ ID NO: 3348 - DNA, 26 bp, Homo sapiens
attcgtgatggggatcggggattgca

SEQ ID NO: 3349 - DNA, 25 bp, Homo sapiens
ttcgtgatggggatcggggattgca

SEQ ID NO: 3350 - DNA, 22 bp, Homo sapiens
gtgatggggatcggggattgca

SEQ ID NO: 3351 - DNA, 21 bp, Homo sapiens
tgatggggatcggggattgca

SEQ ID NO: 3352 - DNA, 19 bp, Homo sapiens
atggggatcggggattgca

SEQ ID NO: 3353 - DNA, 25 bp, Homo sapiens
atggggatcggggattgcaattatt

SEQ ID NO: 3354 - DNA, 26 bp, Homo sapiens
atggggatcggggattgcaattattc

SEQ ID NO: 3355 - DNA, 17 bp, Homo sapiens
ggggatcggggattgca

SEQ ID NO: 3356 - DNA, 23 bp, Homo sapiens
ggggatcggggattgcaattatt

SEQ ID NO: 3357 - DNA, 24 bp, Homo sapiens
ggggatcggggattgcaattattc

SEQ ID NO: 3358 - DNA, 20 bp, Homo sapiens
atcggggattgcaattattc

SEQ ID NO: 3359 - DNA, 19 bp, Homo sapiens
tcggggattgcaattattc

SEQ ID NO: 3360 - DNA, 18 bp, Homo sapiens
cggggattgcaattattc

SEQ ID NO: 3361 - DNA, 17 bp, Homo sapiens
ggggattgcaattattc

SEQ ID NO: 3362 - DNA, 16 bp, Homo sapiens
gggattgcaattattc

SEQ ID NO: 3363 - DNA, 28 bp, Homo sapiens
aacgaggaattcccagtaagtgcgggtc

SEQ ID NO: 3364 - DNA, 16 bp, Homo sapiens
ccagtaagtgcgggtc

SEQ ID NO: 3365 - DNA, 22 bp, Homo sapiens
cagtaagtgcgggtcataagct

SEQ ID NO: 3366 - DNA, 21 bp, Homo sapiens
agtaagtgcgggtcataagct

SEQ ID NO: 3367 - DNA, 17 bp, Homo sapiens
agtgcgggtcataagct

SEQ ID NO: 3368 - DNA, 30 bp, Homo sapiens
ataagcttgcgttgattaagtccctgccct

SEQ ID NO: 3369 - DNA, 22 bp, Homo sapiens
tgcgttgattaagtccctgccc

SEQ ID NO: 3370 - DNA, 23 bp, Homo sapiens
tgcgttgattaagtccctgccct

SEQ ID NO: 3371 - DNA, 29 bp, Homo sapiens
tgcgttgattaagtccctgccctttgtac

SEQ ID NO: 3372 - DNA, 30 bp, Homo sapiens
tgcgttgattaagtccctgccctttgtaca

SEQ ID NO: 3373 - DNA, 31 bp, Homo sapiens
tgcgttgattaagtccctgccctttgtacac

SEQ ID NO: 3374 - DNA, 32 bp, Homo sapiens
tgcgttgattaagtccctgccctttgtacaca

SEQ ID NO: 3375 - DNA, 29 bp, Homo sapiens
gcgttgattaagtccctgccctttgtaca

SEQ ID NO: 3376 - DNA, 33 bp, Homo sapiens
gcgttgattaagtccctgccctttgtacacacc

SEQ ID NO: 3377 - DNA, 26 bp, Homo sapiens
ttgattaagtccctgccctttgtaca

SEQ ID NO: 3378 - DNA, 30 bp, Homo sapiens
ttgattaagtccctgccctttgtacacacc

SEQ ID NO: 3379 - DNA, 24 bp, Homo sapiens
gattaagtccctgccctttgtaca

SEQ ID NO: 3380 - DNA, 28 bp, Homo sapiens
gattaagtccctgccctttgtacacacc

SEQ ID NO: 3381 - DNA, 32 bp, Homo sapiens
gattaagtccctgccctttgtacacaccgccc

SEQ ID NO: 3382 - DNA, 33 bp, Homo sapiens
gattaagtccctgccctttgtacacaccgcccg

SEQ ID NO: 3383 - DNA, 23 bp, Homo sapiens
attaagtccctgccctttgtaca

SEQ ID NO: 3384 - DNA, 27 bp, Homo sapiens
attaagtccctgccctttgtacacacc

SEQ ID NO: 3385 - DNA, 31 bp, Homo sapiens
attaagtccctgccctttgtacacaccgccc

SEQ ID NO: 3386 - DNA, 32 bp, Homo sapiens
attaagtccctgccctttgtacacaccgcccg

SEQ ID NO: 3387 - DNA, 26 bp, Homo sapiens
ttaagtccctgccctttgtacacacc

SEQ ID NO: 3388 - DNA, 21 bp, Homo sapiens
taagtccctgccctttgtaca

SEQ ID NO: 3389 - DNA, 25 bp, Homo sapiens
taagtccctgccctttgtacacacc

SEQ ID NO: 3390 - DNA, 29 bp, Homo sapiens
taagtccctgccctttgtacacaccgccc

SEQ ID NO: 3391 - DNA, 30 bp, Homo sapiens
taagtccctgccctttgtacacaccgcccg

SEQ ID NO: 3392 - DNA, 32 bp, Homo sapiens
taagtccctgccctttgtacacaccgcccgtc

SEQ ID NO: 3393 - DNA, 29 bp, Homo sapiens
cctgccctttgtacacaccgcccgtcgct

SEQ ID NO: 3394 - DNA, 32 bp, Homo sapiens
cctgccctttgtacacaccgcccgtcgctact

SEQ ID NO: 3395 - DNA, 33 bp, Homo sapiens
cctgccctttgtacacaccgcccgtcgctacta

SEQ ID NO: 3396 - DNA, 28 bp, Homo sapiens
ctgccctttgtacacaccgcccgtcgct

SEQ ID NO: 3397 - DNA, 16 bp, Homo sapiens
cacaccgcccgtcgct

SEQ ID NO: 3398 - DNA, 19 bp, Homo sapiens
cacaccgcccgtcgctact

SEQ ID NO: 3399 - DNA, 18 bp, Homo sapiens
acaccgcccgtcgctact

SEQ ID NO: 3400 - DNA, 17 bp, Homo sapiens
caccgcccgtcgctact

SEQ ID NO: 3401 - DNA, 20 bp, Homo sapiens
caccgcccgtcgctactacc

SEQ ID NO: 3402 - DNA, 21 bp, Homo sapiens
caccgcccgtcgctactaccg

SEQ ID NO: 3403 - DNA, 16 bp, Homo sapiens
accgcccgtcgctact

SEQ ID NO: 3404 - DNA, 18 bp, Homo sapiens
ccgcccgtcgctactacc

SEQ ID NO: 3405 - DNA, 19 bp, Homo sapiens
ccgcccgtcgctactaccg

SEQ ID NO: 3406 - DNA, 17 bp, Homo sapiens
cgcccgtcgctactacc

SEQ ID NO: 3407 - DNA, 18 bp, Homo sapiens
cgcccgtcgctactaccg

SEQ ID NO: 3408 - DNA, 33 bp, Homo sapiens
taccgattggatggtttagtgaggccctcggat

SEQ ID NO: 3409 - DNA, 32 bp, Homo sapiens
accgattggatggtttagtgaggccctcggat

SEQ ID NO: 3410 - DNA, 30 bp, Homo sapiens
cgattggatggtttagtgaggccctcggat

SEQ ID NO: 3411 - DNA, 29 bp, Homo sapiens
gattggatggtttagtgaggccctcggat

SEQ ID NO: 3412 - DNA, 28 bp, Homo sapiens
attggatggtttagtgaggccctcggat

SEQ ID NO: 3413 - DNA, 25 bp, Homo sapiens
ggatggtttagtgaggccctcggat

SEQ ID NO: 3414 - DNA, 24 bp, Homo sapiens
gatggtttagtgaggccctcggat

SEQ ID NO: 3415 - DNA, 23 bp, Homo sapiens
atggtttagtgaggccctcggat

SEQ ID NO: 3416 - DNA, 21 bp, Homo sapiens
ggtttagtgaggccctcggat

SEQ ID NO: 3417 - DNA, 20 bp, Homo sapiens
gtttagtgaggccctcggat

SEQ ID NO: 3418 - DNA, 19 bp, Homo sapiens
tttagtgaggccctcggat

SEQ ID NO: 3419 - DNA, 18 bp, Homo sapiens
ttagtgaggccctcggat

SEQ ID NO: 3420 - DNA, 16 bp, Homo sapiens
agtgaggccctcggat

SEQ ID NO: 3421 - DNA, 28 bp, Homo sapiens
ccctcggatcggccccgccggggtcggc

SEQ ID NO: 3422 - DNA, 27 bp, Homo sapiens
cctcggatcggccccgccggggtcggc

SEQ ID NO: 3423 - DNA, 28 bp, Homo sapiens
cctcggatcggccccgccggggtcggcc

SEQ ID NO: 3424 - DNA, 22 bp, Homo sapiens
ctcggatcggccccgccggggt

SEQ ID NO: 3425 - DNA, 23 bp, Homo sapiens
ctcggatcggccccgccggggtc

SEQ ID NO: 3426 - DNA, 26 bp, Homo sapiens
ctcggatcggccccgccggggtcggc

SEQ ID NO: 3427 - DNA, 27 bp, Homo sapiens
ctcggatcggccccgccggggtcggcc

SEQ ID NO: 3428 - DNA, 16 bp, Homo sapiens
cggccccgccggggtc

SEQ ID NO: 3429 - DNA, 19 bp, Homo sapiens
cggccccgccggggtcggc

SEQ ID NO: 3430 - DNA, 21 bp, Homo sapiens
cggccccgccggggtcggccc

SEQ ID NO: 3431 - DNA, 17 bp, Homo sapiens
gccccgccggggtcggc

SEQ ID NO: 3432 - DNA, 18 bp, Homo sapiens
gccccgccggggtcggcc

SEQ ID NO: 3433 - DNA, 16 bp, Homo sapiens
ccccgccggggtcggc

SEQ ID NO: 3434 - DNA, 17 bp, Homo sapiens
ccccgccggggtcggcc

SEQ ID NO: 3435 - DNA, 18 bp, Homo sapiens
ccccgccggggtcggccc

SEQ ID NO: 3436 - DNA, 16 bp, Homo sapiens
cccgccggggtcggcc

SEQ ID NO: 3437 - DNA, 16 bp, Homo sapiens
acggccctggcggagc

SEQ ID NO: 3438 - DNA, 17 bp, Homo sapiens
acggccctggcggagcg

SEQ ID NO: 3439 - DNA, 18 bp, Homo sapiens
acggccctggcggagcgc

SEQ ID NO: 3440 - DNA, 19 bp, Homo sapiens
acggccctggcggagcgct

SEQ ID NO: 3441 - DNA, 23 bp, Homo sapiens
acggccctggcggagcgctgaga

SEQ ID NO: 3442 - DNA, 24 bp, Homo sapiens
acggccctggcggagcgctgagaa

SEQ ID NO: 3443 - DNA, 25 bp, Homo sapiens
acggccctggcggagcgctgagaag

SEQ ID NO: 3444 - DNA, 26 bp, Homo sapiens
acggccctggcggagcgctgagaaga

SEQ ID NO: 3445 - DNA, 27 bp, Homo sapiens
acggccctggcggagcgctgagaagac

SEQ ID NO: 3446 - DNA, 28 bp, Homo sapiens
acggccctggcggagcgctgagaagacg

SEQ ID NO: 3447 - DNA, 29 bp, Homo sapiens
acggccctggcggagcgctgagaagacgg

SEQ ID NO: 3448 - DNA, 31 bp, Homo sapiens
acggccctggcggagcgctgagaagacggtc

SEQ ID NO: 3449 - DNA, 32 bp, Homo sapiens
acggccctggcggagcgctgagaagacggtcg

SEQ ID NO: 3450 - DNA, 16 bp, Homo sapiens
cggccctggcggagcg

SEQ ID NO: 3451 - DNA, 17 bp, Homo sapiens
cggccctggcggagcgc

SEQ ID NO: 3452 - DNA, 18 bp, Homo sapiens
cggccctggcggagcgct

SEQ ID NO: 3453 - DNA, 23 bp, Homo sapiens
cggccctggcggagcgctgagaa

SEQ ID NO: 3454 - DNA, 24 bp, Homo sapiens
cggccctggcggagcgctgagaag

SEQ ID NO: 3455 - DNA, 25 bp, Homo sapiens
cggccctggcggagcgctgagaaga

SEQ ID NO: 3456 - DNA, 26 bp, Homo sapiens
cggccctggcggagcgctgagaagac

SEQ ID NO: 3457 - DNA, 27 bp, Homo sapiens
cggccctggcggagcgctgagaagacg

SEQ ID NO: 3458 - DNA, 33 bp, Homo sapiens
cggccctggcggagcgctgagaagacggtcgaa

SEQ ID NO: 3459 - DNA, 26 bp, Homo sapiens
ggccctggcggagcgctgagaagacg

SEQ ID NO: 3460 - DNA, 23 bp, Homo sapiens
cctggcggagcgctgagaagacg

SEQ ID NO: 3461 - DNA, 32 bp, Homo sapiens
tggcggagcgctgagaagacggtcgaacttga

SEQ ID NO: 3462 - DNA, 33 bp, Homo sapiens
ggcggagcgctgagaagacggtcgaacttgact

SEQ ID NO: 3463 - DNA, 31 bp, Homo sapiens
cggagcgctgagaagacggtcgaacttgact

SEQ ID NO: 3464 - DNA, 32 bp, Homo sapiens
agcgctgagaagacggtcgaacttgactatct

SEQ ID NO: 3465 - DNA, 31 bp, Homo sapiens
gcgctgagaagacggtcgaacttgactatct

SEQ ID NO: 3466 - DNA, 30 bp, Homo sapiens
cgctgagaagacggtcgaacttgactatct

SEQ ID NO: 3467 - DNA, 23 bp, Homo sapiens
gctgagaagacggtcgaacttga

SEQ ID NO: 3468 - DNA, 25 bp, Homo sapiens
gctgagaagacggtcgaacttgact

SEQ ID NO: 3469 - DNA, 28 bp, Homo sapiens
gctgagaagacggtcgaacttgactatc

SEQ ID NO: 3470 - DNA, 29 bp, Homo sapiens
gctgagaagacggtcgaacttgactatct

SEQ ID NO: 3471 - DNA, 17 bp, Homo sapiens
ctgagaagacggtcgaa

SEQ ID NO: 3472 - DNA, 18 bp, Homo sapiens
ctgagaagacggtcgaac

SEQ ID NO: 3473 - DNA, 19 bp, Homo sapiens
ctgagaagacggtcgaact

SEQ ID NO: 3474 - DNA, 22 bp, Homo sapiens
ctgagaagacggtcgaacttga

SEQ ID NO: 3475 - DNA, 23 bp, Homo sapiens
ctgagaagacggtcgaacttgac

SEQ ID NO: 3476 - DNA, 24 bp, Homo sapiens
ctgagaagacggtcgaacttgact

SEQ ID NO: 3477 - DNA, 25 bp, Homo sapiens
ctgagaagacggtcgaacttgacta

SEQ ID NO: 3478 - DNA, 26 bp, Homo sapiens
ctgagaagacggtcgaacttgactat

SEQ ID NO: 3479 - DNA, 27 bp, Homo sapiens
ctgagaagacggtcgaacttgactatc

SEQ ID NO: 3480 - DNA, 28 bp, Homo sapiens
ctgagaagacggtcgaacttgactatct

SEQ ID NO: 3481 - DNA, 30 bp, Homo sapiens
ctgagaagacggtcgaacttgactatctag

SEQ ID NO: 3482 - DNA, 33 bp, Homo sapiens
ctgagaagacggtcgaacttgactatctagagg

SEQ ID NO: 3483 - DNA, 17 bp, Homo sapiens
tgagaagacggtcgaac

SEQ ID NO: 3484 - DNA, 18 bp, Homo sapiens
tgagaagacggtcgaact

SEQ ID NO: 3485 - DNA, 21 bp, Homo sapiens
tgagaagacggtcgaacttga

SEQ ID NO: 3486 - DNA, 22 bp, Homo sapiens
tgagaagacggtcgaacttgac

SEQ ID NO: 3487 - DNA, 23 bp, Homo sapiens
tgagaagacggtcgaacttgact

SEQ ID NO: 3488 - DNA, 24 bp, Homo sapiens
tgagaagacggtcgaacttgacta

SEQ ID NO: 3489 - DNA, 25 bp, Homo sapiens
tgagaagacggtcgaacttgactat

SEQ ID NO: 3490 - DNA, 26 bp, Homo sapiens
tgagaagacggtcgaacttgactatc

SEQ ID NO: 3491 - DNA, 27 bp, Homo sapiens
tgagaagacggtcgaacttgactatct

SEQ ID NO: 3492 - DNA, 33 bp, Homo sapiens
tgagaagacggtcgaacttgactatctagagga

SEQ ID NO: 3493 - DNA, 16 bp, Homo sapiens
gagaagacggtcgaac

SEQ ID NO: 3494 - DNA, 17 bp, Homo sapiens
gagaagacggtcgaact

SEQ ID NO: 3495 - DNA, 20 bp, Homo sapiens
gagaagacggtcgaacttga

SEQ ID NO: 3496 - DNA, 21 bp, Homo sapiens
gagaagacggtcgaacttgac

SEQ ID NO: 3497 - DNA, 22 bp, Homo sapiens
gagaagacggtcgaacttgact

SEQ ID NO: 3498 - DNA, 23 bp, Homo sapiens
gagaagacggtcgaacttgacta

SEQ ID NO: 3499 - DNA, 24 bp, Homo sapiens
gagaagacggtcgaacttgactat

SEQ ID NO: 3500 - DNA, 25 bp, Homo sapiens
gagaagacggtcgaacttgactatc

SEQ ID NO: 3501 - DNA, 26 bp, Homo sapiens
gagaagacggtcgaacttgactatct

SEQ ID NO: 3502 - DNA, 32 bp, Homo sapiens
gagaagacggtcgaacttgactatctagagga

SEQ ID NO: 3503 - DNA, 16 bp, Homo sapiens
agaagacggtcgaact

SEQ ID NO: 3504 - DNA, 21 bp, Homo sapiens
agaagacggtcgaacttgact

SEQ ID NO: 3505 - DNA, 19 bp, Homo sapiens
gaagacggtcgaacttgac

SEQ ID NO: 3506 - DNA, 20 bp, Homo sapiens
gaagacggtcgaacttgact

SEQ ID NO: 3507 - DNA, 21 bp, Homo sapiens
gaagacggtcgaacttgacta

SEQ ID NO: 3508 - DNA, 24 bp, Homo sapiens
gaagacggtcgaacttgactatct

SEQ ID NO: 3509 - DNA, 18 bp, Homo sapiens
aagacggtcgaacttgac

SEQ ID NO: 3510 - DNA, 19 bp, Homo sapiens
aagacggtcgaacttgact

SEQ ID NO: 3511 - DNA, 23 bp, Homo sapiens
aagacggtcgaacttgactatct

SEQ ID NO: 3512 - DNA, 17 bp, Homo sapiens
agacggtcgaacttgac

SEQ ID NO: 3513 - DNA, 18 bp, Homo sapiens
agacggtcgaacttgact

SEQ ID NO: 3514 - DNA, 22 bp, Homo sapiens
agacggtcgaacttgactatct

SEQ ID NO: 3515 - DNA, 16 bp, Homo sapiens
gacggtcgaacttgac

SEQ ID NO: 3516 - DNA, 17 bp, Homo sapiens
gacggtcgaacttgact

SEQ ID NO: 3517 - DNA, 25 bp, Homo sapiens
gtcgaacttgactatctagaggaag

SEQ ID NO: 3518 - DNA, 26 bp, Homo sapiens
gtcgaacttgactatctagaggaagt

SEQ ID NO: 3519 - DNA, 33 bp, Homo sapiens
gtcgaacttgactatctagaggaagtaaaagtc

SEQ ID NO: 3520 - DNA, 21 bp, Homo sapiens
tatctagaggaagtaaaagtc

SEQ ID NO: 3521 - DNA, 20 bp, Homo sapiens
atctagaggaagtaaaagtc

SEQ ID NO: 3522 - DNA, 18 bp, Homo sapiens
ctagaggaagtaaaagtc

SEQ ID NO: 3523 - DNA, 17 bp, Homo sapiens
tagaggaagtaaaagtc

SEQ ID NO: 3524 - DNA, 16 bp, Homo sapiens
agaggaagtaaaagtc

SEQ ID NO: 3525 - DNA, 32 bp, Homo sapiens
tttccgtaggtgaacctgcggaaggatcatta

SEQ ID NO: 3526 - DNA, 28 bp, Homo sapiens
cgtaggtgaacctgcggaaggatcatta

SEQ ID NO: 3527 - DNA, 27 bp, Homo sapiens
gtaggtgaacctgcggaaggatcatta

SEQ ID NO: 3528 - DNA, 17 bp, Homo sapiens
ctgcggaaggatcatta

SEQ ID NO: 3529 - DNA, 16 bp, Homo sapiens
tgcggaaggatcatta

SEQ ID NO: 3530 - DNA, 24 bp, Homo sapiens
tgcggaaggatcattaacggagcc

SEQ ID NO: 3531 - DNA, 21 bp, Homo sapiens
ggaaggatcattaacggagcc

SEQ ID NO: 3532 - DNA, 17 bp, Homo sapiens
gaaggatcattaacgga

SEQ ID NO: 3533 - DNA, 18 bp, Homo sapiens
gaaggatcattaacggag

SEQ ID NO: 3534 - DNA, 19 bp, Homo sapiens
gaaggatcattaacggagc

SEQ ID NO: 3535 - DNA, 20 bp, Homo sapiens
gaaggatcattaacggagcc

SEQ ID NO: 3536 - DNA, 19 bp, Homo sapiens
aaggatcattaacggagcc

SEQ ID NO: 3537 - DNA, 18 bp, Homo sapiens
aggatcattaacggagcc

SEQ ID NO: 3538 - DNA, 16 bp, Homo sapiens
gatcattaacggagcc

SEQ ID NO: 3539 - DNA, 24 bp, Homo sapiens
tcgacctcgtacgactcttagcgg

SEQ ID NO: 3540 - DNA, 21 bp, Homo sapiens
acctcgtacgactcttagcgg

SEQ ID NO: 3541 - DNA, 20 bp, Homo sapiens
cctcgtacgactcttagcgg

SEQ ID NO: 3542 - DNA, 17 bp, Homo sapiens
ctcgtacgactcttagc

SEQ ID NO: 3543 - DNA, 18 bp, Homo sapiens
ctcgtacgactcttagcg

SEQ ID NO: 3544 - DNA, 19 bp, Homo sapiens
ctcgtacgactcttagcgg

SEQ ID NO: 3545 - DNA, 24 bp, Homo sapiens
ctcgtacgactcttagcggtggat

SEQ ID NO: 3546 - DNA, 33 bp, Homo sapiens
ctcgtacgactcttagcggtggatcactcggct

SEQ ID NO: 3547 - DNA, 16 bp, Homo sapiens
tcgtacgactcttagc

SEQ ID NO: 3548 - DNA, 17 bp, Homo sapiens
tcgtacgactcttagcg

SEQ ID NO: 3549 - DNA, 18 bp, Homo sapiens
tcgtacgactcttagcgg

SEQ ID NO: 3550 - DNA, 19 bp, Homo sapiens
tcgtacgactcttagcggt

SEQ ID NO: 3551 - DNA, 22 bp, Homo sapiens
tcgtacgactcttagcggtgga

SEQ ID NO: 3552 - DNA, 23 bp, Homo sapiens
tcgtacgactcttagcggtggat

SEQ ID NO: 3553 - DNA, 24 bp, Homo sapiens
tcgtacgactcttagcggtggatc

SEQ ID NO: 3554 - DNA, 27 bp, Homo sapiens
tcgtacgactcttagcggtggatcact

SEQ ID NO: 3555 - DNA, 32 bp, Homo sapiens
tcgtacgactcttagcggtggatcactcggct

SEQ ID NO: 3556 - DNA, 33 bp, Homo sapiens
tcgtacgactcttagcggtggatcactcggctc

SEQ ID NO: 3557 - DNA, 16 bp, Homo sapiens
cgtacgactcttagcg

SEQ ID NO: 3558 - DNA, 17 bp, Homo sapiens
cgtacgactcttagcgg

SEQ ID NO: 3559 - DNA, 22 bp, Homo sapiens
cgtacgactcttagcggtggat

SEQ ID NO: 3560 - DNA, 31 bp, Homo sapiens
cgtacgactcttagcggtggatcactcggct

SEQ ID NO: 3561 - DNA, 33 bp, Homo sapiens
cgtacgactcttagcggtggatcactcggctcg

SEQ ID NO: 3562 - DNA, 16 bp, Homo sapiens
gtacgactcttagcgg

SEQ ID NO: 3563 - DNA, 30 bp, Homo sapiens
gtacgactcttagcggtggatcactcggct

SEQ ID NO: 3564 - DNA, 31 bp, Homo sapiens
gtacgactcttagcggtggatcactcggctc

SEQ ID NO: 3565 - DNA, 32 bp, Homo sapiens
gtacgactcttagcggtggatcactcggctcg

SEQ ID NO: 3566 - DNA, 33 bp, Homo sapiens
gtacgactcttagcggtggatcactcggctcgt

SEQ ID NO: 3567 - DNA, 27 bp, Homo sapiens
acgactcttagcggtggatcactcggc

SEQ ID NO: 3568 - DNA, 28 bp, Homo sapiens
acgactcttagcggtggatcactcggct

SEQ ID NO: 3569 - DNA, 31 bp, Homo sapiens
acgactcttagcggtggatcactcggctcgt

SEQ ID NO: 3570 - DNA, 17 bp, Homo sapiens
cgactcttagcggtgga

SEQ ID NO: 3571 - DNA, 18 bp, Homo sapiens
cgactcttagcggtggat

SEQ ID NO: 3572 - DNA, 19 bp, Homo sapiens
cgactcttagcggtggatc

SEQ ID NO: 3573 - DNA, 22 bp, Homo sapiens
cgactcttagcggtggatcact

SEQ ID NO: 3574 - DNA, 25 bp, Homo sapiens
cgactcttagcggtggatcactcgg

SEQ ID NO: 3575 - DNA, 26 bp, Homo sapiens
cgactcttagcggtggatcactcggc

SEQ ID NO: 3576 - DNA, 27 bp, Homo sapiens
cgactcttagcggtggatcactcggct

SEQ ID NO: 3577 - DNA, 28 bp, Homo sapiens
cgactcttagcggtggatcactcggctc

SEQ ID NO: 3578 - DNA, 29 bp, Homo sapiens
cgactcttagcggtggatcactcggctcg

SEQ ID NO: 3579 - DNA, 30 bp, Homo sapiens
cgactcttagcggtggatcactcggctcgt

SEQ ID NO: 3580 - DNA, 31 bp, Homo sapiens
cgactcttagcggtggatcactcggctcgtg

SEQ ID NO: 3581 - DNA, 32 bp, Homo sapiens
cgactcttagcggtggatcactcggctcgtgc

SEQ ID NO: 3582 - DNA, 33 bp, Homo sapiens
cgactcttagcggtggatcactcggctcgtgcg

SEQ ID NO: 3583 - DNA, 17 bp, Homo sapiens
gactcttagcggtggat

SEQ ID NO: 3584 - DNA, 18 bp, Homo sapiens
gactcttagcggtggatc

SEQ ID NO: 3585 - DNA, 25 bp, Homo sapiens
gactcttagcggtggatcactcggc

SEQ ID NO: 3586 - DNA, 26 bp, Homo sapiens
gactcttagcggtggatcactcggct

SEQ ID NO: 3587 - DNA, 27 bp, Homo sapiens
gactcttagcggtggatcactcggctc

SEQ ID NO: 3588 - DNA, 28 bp, Homo sapiens
gactcttagcggtggatcactcggctcg

SEQ ID NO: 3589 - DNA, 29 bp, Homo sapiens
gactcttagcggtggatcactcggctcgt

SEQ ID NO: 3590 - DNA, 30 bp, Homo sapiens
gactcttagcggtggatcactcggctcgtg

SEQ ID NO: 3591 - DNA, 32 bp, Homo sapiens
gactcttagcggtggatcactcggctcgtgcg

SEQ ID NO: 3592 - DNA, 16 bp, Homo sapiens
actcttagcggtggat

SEQ ID NO: 3593 - DNA, 24 bp, Homo sapiens
actcttagcggtggatcactcggc

SEQ ID NO: 3594 - DNA, 25 bp, Homo sapiens
actcttagcggtggatcactcggct

SEQ ID NO: 3595 - DNA, 33 bp, Homo sapiens
tcttagcggtggatcactcggctcgtgcgtcga

SEQ ID NO: 3596 - DNA, 17 bp, Homo sapiens
cggtggatcactcggct

SEQ ID NO: 3597 - DNA, 27 bp, Homo sapiens
cggtggatcactcggctcgtgcgtcga

SEQ ID NO: 3598 - DNA, 28 bp, Homo sapiens
cggtggatcactcggctcgtgcgtcgat

SEQ ID NO: 3599 - DNA, 29 bp, Homo sapiens
cggtggatcactcggctcgtgcgtcgatg

SEQ ID NO: 3600 - DNA, 32 bp, Homo sapiens
cggtggatcactcggctcgtgcgtcgatgaag

SEQ ID NO: 3601 - DNA, 29 bp, Homo sapiens
cactcggctcgtgcgtcgatgaagaacgc

SEQ ID NO: 3602 - DNA, 30 bp, Homo sapiens
cactcggctcgtgcgtcgatgaagaacgca

SEQ ID NO: 3603 - DNA, 33 bp, Homo sapiens
cactcggctcgtgcgtcgatgaagaacgcagct

SEQ ID NO: 3604 - DNA, 29 bp, Homo sapiens
actcggctcgtgcgtcgatgaagaacgca

SEQ ID NO: 3605 - DNA, 28 bp, Homo sapiens
ctcggctcgtgcgtcgatgaagaacgca

SEQ ID NO: 3606 - DNA, 17 bp, Homo sapiens
tgcgtcgatgaagaacg

SEQ ID NO: 3607 - DNA, 18 bp, Homo sapiens
gaagaacgcagctagctg

SEQ ID NO: 3608 - DNA, 26 bp, Homo sapiens
gaagaacgcagctagctgcgagaatt

SEQ ID NO: 3609 - DNA, 17 bp, Homo sapiens
aagaacgcagctagctg

SEQ ID NO: 3610 - DNA, 16 bp, Homo sapiens
agaacgcagctagctg

SEQ ID NO: 3611 - DNA, 25 bp, Homo sapiens
gcagctagctgcgagaattaatgtg

SEQ ID NO: 3612 - DNA, 31 bp, Homo sapiens
gcagctagctgcgagaattaatgtgaattgc

SEQ ID NO: 3613 - DNA, 27 bp, Homo sapiens
tgcgagaattaatgtgaattgcaggac

SEQ ID NO: 3614 - DNA, 26 bp, Homo sapiens
gcgagaattaatgtgaattgcaggac

SEQ ID NO: 3615 - DNA, 25 bp, Homo sapiens
cgagaattaatgtgaattgcaggac

SEQ ID NO: 3616 - DNA, 24 bp, Homo sapiens
gagaattaatgtgaattgcaggac

SEQ ID NO: 3617 - DNA, 23 bp, Homo sapiens
agaattaatgtgaattgcaggac

SEQ ID NO: 3618 - DNA, 24 bp, Homo sapiens
agaattaatgtgaattgcaggaca

SEQ ID NO: 3619 - DNA, 22 bp, Homo sapiens
gaattaatgtgaattgcaggac

SEQ ID NO: 3620 - DNA, 23 bp, Homo sapiens
gaattaatgtgaattgcaggaca

SEQ ID NO: 3621 - DNA, 21 bp, Homo sapiens
aattaatgtgaattgcaggac

SEQ ID NO: 3622 - DNA, 22 bp, Homo sapiens
aattaatgtgaattgcaggaca

SEQ ID NO: 3623 - DNA, 24 bp, Homo sapiens
aattaatgtgaattgcaggacaca

SEQ ID NO: 3624 - DNA, 20 bp, Homo sapiens
attaatgtgaattgcaggac

SEQ ID NO: 3625 - DNA, 21 bp, Homo sapiens
attaatgtgaattgcaggaca

SEQ ID NO: 3626 - DNA, 23 bp, Homo sapiens
attaatgtgaattgcaggacaca

SEQ ID NO: 3627 - DNA, 19 bp, Homo sapiens
ttaatgtgaattgcaggac

SEQ ID NO: 3628 - DNA, 20 bp, Homo sapiens
ttaatgtgaattgcaggaca

SEQ ID NO: 3629 - DNA, 22 bp, Homo sapiens
ttaatgtgaattgcaggacaca

SEQ ID NO: 3630 - DNA, 18 bp, Homo sapiens
taatgtgaattgcaggac

SEQ ID NO: 3631 - DNA, 19 bp, Homo sapiens
taatgtgaattgcaggaca

SEQ ID NO: 3632 - DNA, 21 bp, Homo sapiens
taatgtgaattgcaggacaca

SEQ ID NO: 3633 - DNA, 18 bp, Homo sapiens
aatgtgaattgcaggaca

SEQ ID NO: 3634 - DNA, 20 bp, Homo sapiens
aatgtgaattgcaggacaca

SEQ ID NO: 3635 - DNA, 17 bp, Homo sapiens
atgtgaattgcaggaca

SEQ ID NO: 3636 - DNA, 17 bp, Homo sapiens
gtgaattgcaggacaca

SEQ ID NO: 3637 - DNA, 25 bp, Homo sapiens
tgaattgcaggacacattgatcatc

SEQ ID NO: 3638 - DNA, 31 bp, Homo sapiens
tgaattgcaggacacattgatcatcgacact

SEQ ID NO: 3639 - DNA, 33 bp, Homo sapiens
tgaattgcaggacacattgatcatcgacacttc

SEQ ID NO: 3640 - DNA, 24 bp, Homo sapiens
gaattgcaggacacattgatcatc

SEQ ID NO: 3641 - DNA, 30 bp, Homo sapiens
gaattgcaggacacattgatcatcgacact

SEQ ID NO: 3642 - DNA, 23 bp, Homo sapiens
aattgcaggacacattgatcatc

SEQ ID NO: 3643 - DNA, 29 bp, Homo sapiens
aattgcaggacacattgatcatcgacact

SEQ ID NO: 3644 - DNA, 32 bp, Homo sapiens
aattgcaggacacattgatcatcgacacttcg

SEQ ID NO: 3645 - DNA, 33 bp, Homo sapiens
aattgcaggacacattgatcatcgacacttcga

SEQ ID NO: 3646 - DNA, 22 bp, Homo sapiens
attgcaggacacattgatcatc

SEQ ID NO: 3647 - DNA, 28 bp, Homo sapiens
attgcaggacacattgatcatcgacact

SEQ ID NO: 3648 - DNA, 32 bp, Homo sapiens
attgcaggacacattgatcatcgacacttcga

SEQ ID NO: 3649 - DNA, 27 bp, Homo sapiens
ttgcaggacacattgatcatcgacact

SEQ ID NO: 3650 - DNA, 31 bp, Homo sapiens
ttgcaggacacattgatcatcgacacttcga

SEQ ID NO: 3651 - DNA, 26 bp, Homo sapiens
tgcaggacacattgatcatcgacact

SEQ ID NO: 3652 - DNA, 20 bp, Homo sapiens
ggacacattgatcatcgaca

SEQ ID NO: 3653 - DNA, 22 bp, Homo sapiens
ggacacattgatcatcgacact

SEQ ID NO: 3654 - DNA, 23 bp, Homo sapiens
ggacacattgatcatcgacactt

SEQ ID NO: 3655 - DNA, 25 bp, Homo sapiens
ggacacattgatcatcgacacttcg

SEQ ID NO: 3656 - DNA, 27 bp, Homo sapiens
ggacacattgatcatcgacacttcgaa

SEQ ID NO: 3657 - DNA, 28 bp, Homo sapiens
ggacacattgatcatcgacacttcgaac

SEQ ID NO: 3658 - DNA, 29 bp, Homo sapiens
ggacacattgatcatcgacacttcgaacg

SEQ ID NO: 3659 - DNA, 31 bp, Homo sapiens
ggacacattgatcatcgacacttcgaacgca

SEQ ID NO: 3660 - DNA, 33 bp, Homo sapiens
ggacacattgatcatcgacacttcgaacgcact

SEQ ID NO: 3661 - DNA, 21 bp, Homo sapiens
gacacattgatcatcgacact

SEQ ID NO: 3662 - DNA, 28 bp, Homo sapiens
gacacattgatcatcgacacttcgaacg

SEQ ID NO: 3663 - DNA, 32 bp, Homo sapiens
gacacattgatcatcgacacttcgaacgcact

SEQ ID NO: 3664 - DNA, 33 bp, Homo sapiens
acacattgatcatcgacacttcgaacgcacttg

SEQ ID NO: 3665 - DNA, 18 bp, Homo sapiens
acattgatcatcgacact

SEQ ID NO: 3666 - DNA, 22 bp, Homo sapiens
acattgatcatcgacacttcga

SEQ ID NO: 3667 - DNA, 25 bp, Homo sapiens
acattgatcatcgacacttcgaacg

SEQ ID NO: 3668 - DNA, 27 bp, Homo sapiens
acattgatcatcgacacttcgaacgca

SEQ ID NO: 3669 - DNA, 29 bp, Homo sapiens
acattgatcatcgacacttcgaacgcact

SEQ ID NO: 3670 - DNA, 30 bp, Homo sapiens
acattgatcatcgacacttcgaacgcactt

SEQ ID NO: 3671 - DNA, 21 bp, Homo sapiens
cattgatcatcgacacttcga

SEQ ID NO: 3672 - DNA, 28 bp, Homo sapiens
cattgatcatcgacacttcgaacgcact

SEQ ID NO: 3673 - DNA, 27 bp, Homo sapiens
attgatcatcgacacttcgaacgcact

SEQ ID NO: 3674 - DNA, 31 bp, Homo sapiens
atcatcgacacttcgaacgcacttgcggccc

SEQ ID NO: 3675 - DNA, 32 bp, Homo sapiens
atcatcgacacttcgaacgcacttgcggcccc

SEQ ID NO: 3676 - DNA, 33 bp, Homo sapiens
atcatcgacacttcgaacgcacttgcggccccg

SEQ ID NO: 3677 - DNA, 32 bp, Homo sapiens
tcatcgacacttcgaacgcacttgcggccccg

SEQ ID NO: 3678 - DNA, 33 bp, Homo sapiens
tcatcgacacttcgaacgcacttgcggccccgg

SEQ ID NO: 3679 - DNA, 30 bp, Homo sapiens
catcgacacttcgaacgcacttgcggcccc

SEQ ID NO: 3680 - DNA, 31 bp, Homo sapiens
catcgacacttcgaacgcacttgcggccccg

SEQ ID NO: 3681 - DNA, 32 bp, Homo sapiens
catcgacacttcgaacgcacttgcggccccgg

SEQ ID NO: 3682 - DNA, 33 bp, Homo sapiens
catcgacacttcgaacgcacttgcggccccggg

SEQ ID NO: 3683 - DNA, 29 bp, Homo sapiens
atcgacacttcgaacgcacttgcggcccc

SEQ ID NO: 3684 - DNA, 30 bp, Homo sapiens
atcgacacttcgaacgcacttgcggccccg

SEQ ID NO: 3685 - DNA, 31 bp, Homo sapiens
atcgacacttcgaacgcacttgcggccccgg

SEQ ID NO: 3686 - DNA, 32 bp, Homo sapiens
atcgacacttcgaacgcacttgcggccccggg

SEQ ID NO: 3687 - DNA, 33 bp, Homo sapiens
atcgacacttcgaacgcacttgcggccccgggt

SEQ ID NO: 3688 - DNA, 28 bp, Homo sapiens
tcgacacttcgaacgcacttgcggcccc

SEQ ID NO: 3689 - DNA, 29 bp, Homo sapiens
tcgacacttcgaacgcacttgcggccccg

SEQ ID NO: 3690 - DNA, 30 bp, Homo sapiens
tcgacacttcgaacgcacttgcggccccgg

SEQ ID NO: 3691 - DNA, 31 bp, Homo sapiens
tcgacacttcgaacgcacttgcggccccggg

SEQ ID NO: 3692 - DNA, 32 bp, Homo sapiens
tcgacacttcgaacgcacttgcggccccgggt

SEQ ID NO: 3693 - DNA, 33 bp, Homo sapiens
tcgacacttcgaacgcacttgcggccccgggtt

SEQ ID NO: 3694 - DNA, 26 bp, Homo sapiens
cgacacttcgaacgcacttgcggccc

SEQ ID NO: 3695 - DNA, 27 bp, Homo sapiens
cgacacttcgaacgcacttgcggcccc

SEQ ID NO: 3696 - DNA, 28 bp, Homo sapiens
cgacacttcgaacgcacttgcggccccg

SEQ ID NO: 3697 - DNA, 29 bp, Homo sapiens
cgacacttcgaacgcacttgcggccccgg

SEQ ID NO: 3698 - DNA, 30 bp, Homo sapiens
cgacacttcgaacgcacttgcggccccggg

SEQ ID NO: 3699 - DNA, 31 bp, Homo sapiens
cgacacttcgaacgcacttgcggccccgggt

SEQ ID NO: 3700 - DNA, 32 bp, Homo sapiens
cgacacttcgaacgcacttgcggccccgggtt

SEQ ID NO: 3701 - DNA, 33 bp, Homo sapiens
cgacacttcgaacgcacttgcggccccgggttc

SEQ ID NO: 3702 - DNA, 26 bp, Homo sapiens
gacacttcgaacgcacttgcggcccc

SEQ ID NO: 3703 - DNA, 27 bp, Homo sapiens
gacacttcgaacgcacttgcggccccg

SEQ ID NO: 3704 - DNA, 28 bp, Homo sapiens
gacacttcgaacgcacttgcggccccgg

SEQ ID NO: 3705 - DNA, 29 bp, Homo sapiens
gacacttcgaacgcacttgcggccccggg

SEQ ID NO: 3706 - DNA, 30 bp, Homo sapiens
gacacttcgaacgcacttgcggccccgggt

SEQ ID NO: 3707 - DNA, 31 bp, Homo sapiens
gacacttcgaacgcacttgcggccccgggtt

SEQ ID NO: 3708 - DNA, 24 bp, Homo sapiens
acacttcgaacgcacttgcggccc

SEQ ID NO: 3709 - DNA, 25 bp, Homo sapiens
acacttcgaacgcacttgcggcccc

SEQ ID NO: 3710 - DNA, 26 bp, Homo sapiens
acacttcgaacgcacttgcggccccg

SEQ ID NO: 3711 - DNA, 27 bp, Homo sapiens
acacttcgaacgcacttgcggccccgg

SEQ ID NO: 3712 - DNA, 28 bp, Homo sapiens
acacttcgaacgcacttgcggccccggg

SEQ ID NO: 3713 - DNA, 29 bp, Homo sapiens
acacttcgaacgcacttgcggccccgggt

SEQ ID NO: 3714 - DNA, 30 bp, Homo sapiens
acacttcgaacgcacttgcggccccgggtt

SEQ ID NO: 3715 - DNA, 32 bp, Homo sapiens
acacttcgaacgcacttgcggccccgggttcc

SEQ ID NO: 3716 - DNA, 33 bp, Homo sapiens
acacttcgaacgcacttgcggccccgggttcct

SEQ ID NO: 3717 - DNA, 25 bp, Homo sapiens
cacttcgaacgcacttgcggccccg

SEQ ID NO: 3718 - DNA, 26 bp, Homo sapiens
cacttcgaacgcacttgcggccccgg

SEQ ID NO: 3719 - DNA, 27 bp, Homo sapiens
cacttcgaacgcacttgcggccccggg

SEQ ID NO: 3720 - DNA, 29 bp, Homo sapiens
cacttcgaacgcacttgcggccccgggtt

SEQ ID NO: 3721 - DNA, 32 bp, Homo sapiens
cacttcgaacgcacttgcggccccgggttcct

SEQ ID NO: 3722 - DNA, 24 bp, Homo sapiens
acttcgaacgcacttgcggccccg

SEQ ID NO: 3723 - DNA, 25 bp, Homo sapiens
acttcgaacgcacttgcggccccgg

SEQ ID NO: 3724 - DNA, 22 bp, Homo sapiens
cttcgaacgcacttgcggcccc

SEQ ID NO: 3725 - DNA, 23 bp, Homo sapiens
cttcgaacgcacttgcggccccg

SEQ ID NO: 3726 - DNA, 24 bp, Homo sapiens
cttcgaacgcacttgcggccccgg

SEQ ID NO: 3727 - DNA, 25 bp, Homo sapiens
cttcgaacgcacttgcggccccggg

SEQ ID NO: 3728 - DNA, 27 bp, Homo sapiens
cttcgaacgcacttgcggccccgggtt

SEQ ID NO: 3729 - DNA, 22 bp, Homo sapiens
ttcgaacgcacttgcggccccg

SEQ ID NO: 3730 - DNA, 21 bp, Homo sapiens
tcgaacgcacttgcggccccg

SEQ ID NO: 3731 - DNA, 22 bp, Homo sapiens
tcgaacgcacttgcggccccgg

SEQ ID NO: 3732 - DNA, 23 bp, Homo sapiens
tcgaacgcacttgcggccccggg

SEQ ID NO: 3733 - DNA, 24 bp, Homo sapiens
tcgaacgcacttgcggccccgggt

SEQ ID NO: 3734 - DNA, 25 bp, Homo sapiens
tcgaacgcacttgcggccccgggtt

SEQ ID NO: 3735 - DNA, 20 bp, Homo sapiens
cgaacgcacttgcggccccg

SEQ ID NO: 3736 - DNA, 31 bp, Homo sapiens
gttcctcccggggctacgcctgtctgagcgt

SEQ ID NO: 3737 - DNA, 31 bp, Homo sapiens
ttcctcccggggctacgcctgtctgagcgtc

SEQ ID NO: 3738 - DNA, 29 bp, Homo sapiens
tcctcccggggctacgcctgtctgagcgt

SEQ ID NO: 3739 - DNA, 30 bp, Homo sapiens
tcctcccggggctacgcctgtctgagcgtc

SEQ ID NO: 3740 - DNA, 31 bp, Homo sapiens
tcctcccggggctacgcctgtctgagcgtcg

SEQ ID NO: 3741 - DNA, 33 bp, Homo sapiens
tcctcccggggctacgcctgtctgagcgtcgct

SEQ ID NO: 3742 - DNA, 29 bp, Homo sapiens
cctcccggggctacgcctgtctgagcgtc

SEQ ID NO: 3743 - DNA, 32 bp, Homo sapiens
cctcccggggctacgcctgtctgagcgtcgct

SEQ ID NO: 3744 - DNA, 27 bp, Homo sapiens
ctcccggggctacgcctgtctgagcgt

SEQ ID NO: 3745 - DNA, 28 bp, Homo sapiens
ctcccggggctacgcctgtctgagcgtc

SEQ ID NO: 3746 - DNA, 29 bp, Homo sapiens
ctcccggggctacgcctgtctgagcgtcg

SEQ ID NO: 3747 - DNA, 31 bp, Homo sapiens
ctcccggggctacgcctgtctgagcgtcgct

SEQ ID NO: 3748 - DNA, 32 bp, Homo sapiens
ctcccggggctacgcctgtctgagcgtcgctt

SEQ ID NO: 3749 - DNA, 24 bp, Homo sapiens
tcccggggctacgcctgtctgagc

SEQ ID NO: 3750 - DNA, 26 bp, Homo sapiens
tcccggggctacgcctgtctgagcgt

SEQ ID NO: 3751 - DNA, 27 bp, Homo sapiens
tcccggggctacgcctgtctgagcgtc

SEQ ID NO: 3752 - DNA, 28 bp, Homo sapiens
tcccggggctacgcctgtctgagcgtcg

SEQ ID NO: 3753 - DNA, 29 bp, Homo sapiens
tcccggggctacgcctgtctgagcgtcgc

SEQ ID NO: 3754 - DNA, 30 bp, Homo sapiens
tcccggggctacgcctgtctgagcgtcgct

SEQ ID NO: 3755 - DNA, 31 bp, Homo sapiens
tcccggggctacgcctgtctgagcgtcgctt

SEQ ID NO: 3756 - DNA, 23 bp, Homo sapiens
cccggggctacgcctgtctgagc

SEQ ID NO: 3757 - DNA, 25 bp, Homo sapiens
cccggggctacgcctgtctgagcgt

SEQ ID NO: 3758 - DNA, 26 bp, Homo sapiens
cccggggctacgcctgtctgagcgtc

SEQ ID NO: 3759 - DNA, 27 bp, Homo sapiens
cccggggctacgcctgtctgagcgtcg

SEQ ID NO: 3760 - DNA, 28 bp, Homo sapiens
cccggggctacgcctgtctgagcgtcgc

SEQ ID NO: 3761 - DNA, 29 bp, Homo sapiens
cccggggctacgcctgtctgagcgtcgct

SEQ ID NO: 3762 - DNA, 30 bp, Homo sapiens
cccggggctacgcctgtctgagcgtcgctt

SEQ ID NO: 3763 - DNA, 24 bp, Homo sapiens
ccggggctacgcctgtctgagcgt

SEQ ID NO: 3764 - DNA, 25 bp, Homo sapiens
ccggggctacgcctgtctgagcgtc

SEQ ID NO: 3765 - DNA, 26 bp, Homo sapiens
ccggggctacgcctgtctgagcgtcg

SEQ ID NO: 3766 - DNA, 27 bp, Homo sapiens
ccggggctacgcctgtctgagcgtcgc

SEQ ID NO: 3767 - DNA, 28 bp, Homo sapiens
ccggggctacgcctgtctgagcgtcgct

SEQ ID NO: 3768 - DNA, 29 bp, Homo sapiens
ccggggctacgcctgtctgagcgtcgctt

SEQ ID NO: 3769 - DNA, 21 bp, Homo sapiens
cggggctacgcctgtctgagc

SEQ ID NO: 3770 - DNA, 22 bp, Homo sapiens
cggggctacgcctgtctgagcg

SEQ ID NO: 3771 - DNA, 23 bp, Homo sapiens
cggggctacgcctgtctgagcgt

SEQ ID NO: 3772 - DNA, 24 bp, Homo sapiens
cggggctacgcctgtctgagcgtc

SEQ ID NO: 3773 - DNA, 25 bp, Homo sapiens
cggggctacgcctgtctgagcgtcg

SEQ ID NO: 3774 - DNA, 26 bp, Homo sapiens
cggggctacgcctgtctgagcgtcgc

SEQ ID NO: 3775 - DNA, 27 bp, Homo sapiens
cggggctacgcctgtctgagcgtcgct

SEQ ID NO: 3776 - DNA, 28 bp, Homo sapiens
cggggctacgcctgtctgagcgtcgctt

SEQ ID NO: 3777 - DNA, 22 bp, Homo sapiens
ggggctacgcctgtctgagcgt

SEQ ID NO: 3778 - DNA, 23 bp, Homo sapiens
ggggctacgcctgtctgagcgtc

SEQ ID NO: 3779 - DNA, 24 bp, Homo sapiens
ggggctacgcctgtctgagcgtcg

SEQ ID NO: 3780 - DNA, 25 bp, Homo sapiens
ggggctacgcctgtctgagcgtcgc

SEQ ID NO: 3781 - DNA, 26 bp, Homo sapiens
ggggctacgcctgtctgagcgtcgct

SEQ ID NO: 3782 - DNA, 27 bp, Homo sapiens
ggggctacgcctgtctgagcgtcgctt

SEQ ID NO: 3783 - DNA, 21 bp, Homo sapiens
gggctacgcctgtctgagcgt

SEQ ID NO: 3784 - DNA, 22 bp, Homo sapiens
gggctacgcctgtctgagcgtc

SEQ ID NO: 3785 - DNA, 23 bp, Homo sapiens
gggctacgcctgtctgagcgtcg

SEQ ID NO: 3786 - DNA, 24 bp, Homo sapiens
gggctacgcctgtctgagcgtcgc

SEQ ID NO: 3787 - DNA, 25 bp, Homo sapiens
gggctacgcctgtctgagcgtcgct

SEQ ID NO: 3788 - DNA, 26 bp, Homo sapiens
gggctacgcctgtctgagcgtcgctt

SEQ ID NO: 3789 - DNA, 23 bp, Homo sapiens
ggctacgcctgtctgagcgtcgc

SEQ ID NO: 3790 - DNA, 24 bp, Homo sapiens
ggctacgcctgtctgagcgtcgct

SEQ ID NO: 3791 - DNA, 17 bp, Homo sapiens
gctacgcctgtctgagc

SEQ ID NO: 3792 - DNA, 20 bp, Homo sapiens
gctacgcctgtctgagcgtc

SEQ ID NO: 3793 - DNA, 23 bp, Homo sapiens
gctacgcctgtctgagcgtcgct

SEQ ID NO: 3794 - DNA, 17 bp, Homo sapiens
ctacgcctgtctgagcg

SEQ ID NO: 3795 - DNA, 21 bp, Homo sapiens
ctacgcctgtctgagcgtcgc

SEQ ID NO: 3796 - DNA, 22 bp, Homo sapiens
ctacgcctgtctgagcgtcgct

SEQ ID NO: 3797 - DNA, 23 bp, Homo sapiens
ctacgcctgtctgagcgtcgctt

SEQ ID NO: 3798 - DNA, 17 bp, Homo sapiens
tacgcctgtctgagcgt

SEQ ID NO: 3799 - DNA, 20 bp, Homo sapiens
tacgcctgtctgagcgtcgc

SEQ ID NO: 3800 - DNA, 21 bp, Homo sapiens
tacgcctgtctgagcgtcgct

SEQ ID NO: 3801 - DNA, 22 bp, Homo sapiens
tacgcctgtctgagcgtcgctt

SEQ ID NO: 3802 - DNA, 20 bp, Homo sapiens
acgcctgtctgagcgtcgct

SEQ ID NO: 3803 - DNA, 21 bp, Homo sapiens
acgcctgtctgagcgtcgctt

SEQ ID NO: 3804 - DNA, 16 bp, Homo sapiens
cgcctgtctgagcgtc

SEQ ID NO: 3805 - DNA, 17 bp, Homo sapiens
cgcctgtctgagcgtcg

SEQ ID NO: 3806 - DNA, 18 bp, Homo sapiens
cgcctgtctgagcgtcgc

SEQ ID NO: 3807 - DNA, 19 bp, Homo sapiens
cgcctgtctgagcgtcgct

SEQ ID NO: 3808 - DNA, 20 bp, Homo sapiens
cgcctgtctgagcgtcgctt

SEQ ID NO: 3809 - DNA, 16 bp, Homo sapiens
gcctgtctgagcgtcg

SEQ ID NO: 3810 - DNA, 17 bp, Homo sapiens
gcctgtctgagcgtcgc

SEQ ID NO: 3811 - DNA, 18 bp, Homo sapiens
gcctgtctgagcgtcgct

SEQ ID NO: 3812 - DNA, 19 bp, Homo sapiens
gcctgtctgagcgtcgctt

SEQ ID NO: 3813 - DNA, 16 bp, Homo sapiens
cctgtctgagcgtcgc

SEQ ID NO: 3814 - DNA, 17 bp, Homo sapiens
cctgtctgagcgtcgct

SEQ ID NO: 3815 - DNA, 18 bp, Homo sapiens
cctgtctgagcgtcgctt

SEQ ID NO: 3816 - DNA, 16 bp, Homo sapiens
ctgtctgagcgtcgct

SEQ ID NO: 3817 - DNA, 17 bp, Homo sapiens
ctgtctgagcgtcgctt

SEQ ID NO: 3818 - DNA, 16 bp, Homo sapiens
tgtctgagcgtcgctt

SEQ ID NO: 3819 - DNA, 22 bp, Homo sapiens
tccgagacgcgacctcagatca

SEQ ID NO: 3820 - DNA, 24 bp, Homo sapiens
tccgagacgcgacctcagatcaga

SEQ ID NO: 3821 - DNA, 30 bp, Homo sapiens
tccgagacgcgacctcagatcagacgtggc

SEQ ID NO: 3822 - DNA, 23 bp, Homo sapiens
ccgagacgcgacctcagatcaga

SEQ ID NO: 3823 - DNA, 33 bp, Homo sapiens
ccgagacgcgacctcagatcagacgtggcgacc

SEQ ID NO: 3824 - DNA, 20 bp, Homo sapiens
cgagacgcgacctcagatca

SEQ ID NO: 3825 - DNA, 25 bp, Homo sapiens
cgagacgcgacctcagatcagacgt

SEQ ID NO: 3826 - DNA, 20 bp, Homo sapiens
agacgcgacctcagatcaga

SEQ ID NO: 3827 - DNA, 16 bp, Homo sapiens
gacgcgacctcagatc

SEQ ID NO: 3828 - DNA, 19 bp, Homo sapiens
gacgcgacctcagatcaga

SEQ ID NO: 3829 - DNA, 21 bp, Homo sapiens
gacgcgacctcagatcagacg

SEQ ID NO: 3830 - DNA, 22 bp, Homo sapiens
gacgcgacctcagatcagacgt

SEQ ID NO: 3831 - DNA, 29 bp, Homo sapiens
gacgcgacctcagatcagacgtggcgacc

SEQ ID NO: 3832 - DNA, 30 bp, Homo sapiens
gacgcgacctcagatcagacgtggcgaccc

SEQ ID NO: 3833 - DNA, 31 bp, Homo sapiens
gacgcgacctcagatcagacgtggcgacccg

SEQ ID NO: 3834 - DNA, 32 bp, Homo sapiens
gacgcgacctcagatcagacgtggcgacccgc

SEQ ID NO: 3835 - DNA, 33 bp, Homo sapiens
gacgcgacctcagatcagacgtggcgacccgct

SEQ ID NO: 3836 - DNA, 16 bp, Homo sapiens
acgcgacctcagatca

SEQ ID NO: 3837 - DNA, 17 bp, Homo sapiens
acgcgacctcagatcag

SEQ ID NO: 3838 - DNA, 18 bp, Homo sapiens
acgcgacctcagatcaga

SEQ ID NO: 3839 - DNA, 19 bp, Homo sapiens
acgcgacctcagatcagac

SEQ ID NO: 3840 - DNA, 20 bp, Homo sapiens
acgcgacctcagatcagacg

SEQ ID NO: 3841 - DNA, 21 bp, Homo sapiens
acgcgacctcagatcagacgt

SEQ ID NO: 3842 - DNA, 23 bp, Homo sapiens
acgcgacctcagatcagacgtgg

SEQ ID NO: 3843 - DNA, 24 bp, Homo sapiens
acgcgacctcagatcagacgtggc

SEQ ID NO: 3844 - DNA, 25 bp, Homo sapiens
acgcgacctcagatcagacgtggcg

SEQ ID NO: 3845 - DNA, 27 bp, Homo sapiens
acgcgacctcagatcagacgtggcgac

SEQ ID NO: 3846 - DNA, 28 bp, Homo sapiens
acgcgacctcagatcagacgtggcgacc

SEQ ID NO: 3847 - DNA, 29 bp, Homo sapiens
acgcgacctcagatcagacgtggcgaccc

SEQ ID NO: 3848 - DNA, 30 bp, Homo sapiens
acgcgacctcagatcagacgtggcgacccg

SEQ ID NO: 3849 - DNA, 31 bp, Homo sapiens
acgcgacctcagatcagacgtggcgacccgc

SEQ ID NO: 3850 - DNA, 32 bp, Homo sapiens
acgcgacctcagatcagacgtggcgacccgct

SEQ ID NO: 3851 - DNA, 33 bp, Homo sapiens
acgcgacctcagatcagacgtggcgacccgctg

SEQ ID NO: 3852 - DNA, 16 bp, Homo sapiens
cgcgacctcagatcag

SEQ ID NO: 3853 - DNA, 17 bp, Homo sapiens
cgcgacctcagatcaga

SEQ ID NO: 3854 - DNA, 18 bp, Homo sapiens
cgcgacctcagatcagac

SEQ ID NO: 3855 - DNA, 19 bp, Homo sapiens
cgcgacctcagatcagacg

SEQ ID NO: 3856 - DNA, 20 bp, Homo sapiens
cgcgacctcagatcagacgt

SEQ ID NO: 3857 - DNA, 21 bp, Homo sapiens
cgcgacctcagatcagacgtg

SEQ ID NO: 3858 - DNA, 22 bp, Homo sapiens
cgcgacctcagatcagacgtgg

SEQ ID NO: 3859 - DNA, 23 bp, Homo sapiens
cgcgacctcagatcagacgtggc

SEQ ID NO: 3860 - DNA, 24 bp, Homo sapiens
cgcgacctcagatcagacgtggcg

SEQ ID NO: 3861 - DNA, 26 bp, Homo sapiens
cgcgacctcagatcagacgtggcgac

SEQ ID NO: 3862 - DNA, 27 bp, Homo sapiens
cgcgacctcagatcagacgtggcgacc

SEQ ID NO: 3863 - DNA, 28 bp, Homo sapiens
cgcgacctcagatcagacgtggcgaccc

SEQ ID NO: 3864 - DNA, 29 bp, Homo sapiens
cgcgacctcagatcagacgtggcgacccg

SEQ ID NO: 3865 - DNA, 30 bp, Homo sapiens
cgcgacctcagatcagacgtggcgacccgc

SEQ ID NO: 3866 - DNA, 31 bp, Homo sapiens
cgcgacctcagatcagacgtggcgacccgct

SEQ ID NO: 3867 - DNA, 32 bp, Homo sapiens
cgcgacctcagatcagacgtggcgacccgctg

SEQ ID NO: 3868 - DNA, 33 bp, Homo sapiens
cgcgacctcagatcagacgtggcgacccgctga

SEQ ID NO: 3869 - DNA, 17 bp, Homo sapiens
gcgacctcagatcagac

SEQ ID NO: 3870 - DNA, 18 bp, Homo sapiens
gcgacctcagatcagacg

SEQ ID NO: 3871 - DNA, 19 bp, Homo sapiens
gcgacctcagatcagacgt

SEQ ID NO: 3872 - DNA, 26 bp, Homo sapiens
gcgacctcagatcagacgtggcgacc

SEQ ID NO: 3873 - DNA, 27 bp, Homo sapiens
gcgacctcagatcagacgtggcgaccc

SEQ ID NO: 3874 - DNA, 28 bp, Homo sapiens
gcgacctcagatcagacgtggcgacccg

SEQ ID NO: 3875 - DNA, 29 bp, Homo sapiens
gcgacctcagatcagacgtggcgacccgc

SEQ ID NO: 3876 - DNA, 30 bp, Homo sapiens
gcgacctcagatcagacgtggcgacccgct

SEQ ID NO: 3877 - DNA, 31 bp, Homo sapiens
gcgacctcagatcagacgtggcgacccgctg

SEQ ID NO: 3878 - DNA, 32 bp, Homo sapiens
gcgacctcagatcagacgtggcgacccgctga

SEQ ID NO: 3879 - DNA, 33 bp, Homo sapiens
gcgacctcagatcagacgtggcgacccgctgaa

SEQ ID NO: 3880 - DNA, 16 bp, Homo sapiens
cgacctcagatcagac

SEQ ID NO: 3881 - DNA, 17 bp, Homo sapiens
cgacctcagatcagacg

SEQ ID NO: 3882 - DNA, 18 bp, Homo sapiens
cgacctcagatcagacgt

SEQ ID NO: 3883 - DNA, 25 bp, Homo sapiens
cgacctcagatcagacgtggcgacc

SEQ ID NO: 3884 - DNA, 26 bp, Homo sapiens
cgacctcagatcagacgtggcgaccc

SEQ ID NO: 3885 - DNA, 27 bp, Homo sapiens
cgacctcagatcagacgtggcgacccg

SEQ ID NO: 3886 - DNA, 28 bp, Homo sapiens
cgacctcagatcagacgtggcgacccgc

SEQ ID NO: 3887 - DNA, 29 bp, Homo sapiens
cgacctcagatcagacgtggcgacccgct

SEQ ID NO: 3888 - DNA, 30 bp, Homo sapiens
cgacctcagatcagacgtggcgacccgctg

SEQ ID NO: 3889 - DNA, 31 bp, Homo sapiens
cgacctcagatcagacgtggcgacccgctga

SEQ ID NO: 3890 - DNA, 32 bp, Homo sapiens
cgacctcagatcagacgtggcgacccgctgaa

SEQ ID NO: 3891 - DNA, 33 bp, Homo sapiens
cgacctcagatcagacgtggcgacccgctgaat

SEQ ID NO: 3892 - DNA, 16 bp, Homo sapiens
gacctcagatcagacg

SEQ ID NO: 3893 - DNA, 17 bp, Homo sapiens
gacctcagatcagacgt

SEQ ID NO: 3894 - DNA, 23 bp, Homo sapiens
acctcagatcagacgtggcgacc

SEQ ID NO: 3895 - DNA, 24 bp, Homo sapiens
acctcagatcagacgtggcgaccc

SEQ ID NO: 3896 - DNA, 28 bp, Homo sapiens
acctcagatcagacgtggcgacccgctg

SEQ ID NO: 3897 - DNA, 32 bp, Homo sapiens
acctcagatcagacgtggcgacccgctgaatt

SEQ ID NO: 3898 - DNA, 33 bp, Homo sapiens
tcagatcagacgtggcgacccgctgaatttaag

SEQ ID NO: 3899 - DNA, 25 bp, Homo sapiens
cgtggcgacccgctgaatttaagca

SEQ ID NO: 3900 - DNA, 26 bp, Homo sapiens
cgtggcgacccgctgaatttaagcat

SEQ ID NO: 3901 - DNA, 27 bp, Homo sapiens
cgtggcgacccgctgaatttaagcata

SEQ ID NO: 3902 - DNA, 28 bp, Homo sapiens
cgtggcgacccgctgaatttaagcatat

SEQ ID NO: 3903 - DNA, 32 bp, Homo sapiens
taagcatattagtcagcggaggagaagaaact

SEQ ID NO: 3904 - DNA, 24 bp, Homo sapiens
aagcatattagtcagcggaggaga

SEQ ID NO: 3905 - DNA, 25 bp, Homo sapiens
aagcatattagtcagcggaggagaa

SEQ ID NO: 3906 - DNA, 30 bp, Homo sapiens
aagcatattagtcagcggaggagaagaaac

SEQ ID NO: 3907 - DNA, 31 bp, Homo sapiens
aagcatattagtcagcggaggagaagaaact

SEQ ID NO: 3908 - DNA, 29 bp, Homo sapiens
agcatattagtcagcggaggagaagaaac

SEQ ID NO: 3909 - DNA, 30 bp, Homo sapiens
agcatattagtcagcggaggagaagaaact

SEQ ID NO: 3910 - DNA, 29 bp, Homo sapiens
gcatattagtcagcggaggagaagaaact

SEQ ID NO: 3911 - DNA, 33 bp, Homo sapiens
gcatattagtcagcggaggagaagaaactaacc

SEQ ID NO: 3912 - DNA, 28 bp, Homo sapiens
catattagtcagcggaggagaagaaact

SEQ ID NO: 3913 - DNA, 32 bp, Homo sapiens
catattagtcagcggaggagaagaaactaacc

SEQ ID NO: 3914 - DNA, 27 bp, Homo sapiens
atattagtcagcggaggagaagaaact

SEQ ID NO: 3915 - DNA, 17 bp, Homo sapiens
tattagtcagcggagga

SEQ ID NO: 3916 - DNA, 18 bp, Homo sapiens
tattagtcagcggaggag

SEQ ID NO: 3917 - DNA, 19 bp, Homo sapiens
tattagtcagcggaggaga

SEQ ID NO: 3918 - DNA, 20 bp, Homo sapiens
tattagtcagcggaggagaa

SEQ ID NO: 3919 - DNA, 21 bp, Homo sapiens
tattagtcagcggaggagaag

SEQ ID NO: 3920 - DNA, 22 bp, Homo sapiens
tattagtcagcggaggagaaga

SEQ ID NO: 3921 - DNA, 23 bp, Homo sapiens
tattagtcagcggaggagaagaa

SEQ ID NO: 3922 - DNA, 24 bp, Homo sapiens
tattagtcagcggaggagaagaaa

SEQ ID NO: 3923 - DNA, 25 bp, Homo sapiens
tattagtcagcggaggagaagaaac

SEQ ID NO: 3924 - DNA, 26 bp, Homo sapiens
tattagtcagcggaggagaagaaact

SEQ ID NO: 3925 - DNA, 27 bp, Homo sapiens
tattagtcagcggaggagaagaaacta

SEQ ID NO: 3926 - DNA, 29 bp, Homo sapiens
tattagtcagcggaggagaagaaactaac

SEQ ID NO: 3927 - DNA, 30 bp, Homo sapiens
tattagtcagcggaggagaagaaactaacc

SEQ ID NO: 3928 - DNA, 31 bp, Homo sapiens
tattagtcagcggaggagaagaaactaacca

SEQ ID NO: 3929 - DNA, 32 bp, Homo sapiens
tattagtcagcggaggagaagaaactaaccag

SEQ ID NO: 3930 - DNA, 33 bp, Homo sapiens
tattagtcagcggaggagaagaaactaaccagg

SEQ ID NO: 3931 - DNA, 18 bp, Homo sapiens
attagtcagcggaggaga

SEQ ID NO: 3932 - DNA, 19 bp, Homo sapiens
attagtcagcggaggagaa

SEQ ID NO: 3933 - DNA, 24 bp, Homo sapiens
attagtcagcggaggagaagaaac

SEQ ID NO: 3934 - DNA, 25 bp, Homo sapiens
attagtcagcggaggagaagaaact

SEQ ID NO: 3935 - DNA, 29 bp, Homo sapiens
attagtcagcggaggagaagaaactaacc

SEQ ID NO: 3936 - DNA, 17 bp, Homo sapiens
ttagtcagcggaggaga

SEQ ID NO: 3937 - DNA, 18 bp, Homo sapiens
ttagtcagcggaggagaa

SEQ ID NO: 3938 - DNA, 19 bp, Homo sapiens
ttagtcagcggaggagaag

SEQ ID NO: 3939 - DNA, 23 bp, Homo sapiens
ttagtcagcggaggagaagaaac

SEQ ID NO: 3940 - DNA, 24 bp, Homo sapiens
ttagtcagcggaggagaagaaact

SEQ ID NO: 3941 - DNA, 25 bp, Homo sapiens
ttagtcagcggaggagaagaaacta

SEQ ID NO: 3942 - DNA, 27 bp, Homo sapiens
ttagtcagcggaggagaagaaactaac

SEQ ID NO: 3943 - DNA, 28 bp, Homo sapiens
ttagtcagcggaggagaagaaactaacc

SEQ ID NO: 3944 - DNA, 16 bp, Homo sapiens
tagtcagcggaggaga

SEQ ID NO: 3945 - DNA, 17 bp, Homo sapiens
tagtcagcggaggagaa

SEQ ID NO: 3946 - DNA, 18 bp, Homo sapiens
tagtcagcggaggagaag

SEQ ID NO: 3947 - DNA, 19 bp, Homo sapiens
tagtcagcggaggagaaga

SEQ ID NO: 3948 - DNA, 20 bp, Homo sapiens
tagtcagcggaggagaagaa

SEQ ID NO: 3949 - DNA, 21 bp, Homo sapiens
tagtcagcggaggagaagaaa

SEQ ID NO: 3950 - DNA, 22 bp, Homo sapiens
tagtcagcggaggagaagaaac

SEQ ID NO: 3951 - DNA, 23 bp, Homo sapiens
tagtcagcggaggagaagaaact

SEQ ID NO: 3952 - DNA, 24 bp, Homo sapiens
tagtcagcggaggagaagaaacta

SEQ ID NO: 3953 - DNA, 26 bp, Homo sapiens
tagtcagcggaggagaagaaactaac

SEQ ID NO: 3954 - DNA, 27 bp, Homo sapiens
tagtcagcggaggagaagaaactaacc

SEQ ID NO: 3955 - DNA, 28 bp, Homo sapiens
tagtcagcggaggagaagaaactaacca

SEQ ID NO: 3956 - DNA, 29 bp, Homo sapiens
tagtcagcggaggagaagaaactaaccag

SEQ ID NO: 3957 - DNA, 30 bp, Homo sapiens
tagtcagcggaggagaagaaactaaccagg

SEQ ID NO: 3958 - DNA, 31 bp, Homo sapiens
tagtcagcggaggagaagaaactaaccagga

SEQ ID NO: 3959 - DNA, 32 bp, Homo sapiens
tagtcagcggaggagaagaaactaaccaggat

SEQ ID NO: 3960 - DNA, 21 bp, Homo sapiens
agtcagcggaggagaagaaac

SEQ ID NO: 3961 - DNA, 22 bp, Homo sapiens
agtcagcggaggagaagaaact

SEQ ID NO: 3962 - DNA, 25 bp, Homo sapiens
agtcagcggaggagaagaaactaac

SEQ ID NO: 3963 - DNA, 26 bp, Homo sapiens
agtcagcggaggagaagaaactaacc

SEQ ID NO: 3964 - DNA, 21 bp, Homo sapiens
gtcagcggaggagaagaaact

SEQ ID NO: 3965 - DNA, 25 bp, Homo sapiens
gtcagcggaggagaagaaactaacc

SEQ ID NO: 3966 - DNA, 20 bp, Homo sapiens
tcagcggaggagaagaaact

SEQ ID NO: 3967 - DNA, 24 bp, Homo sapiens
tcagcggaggagaagaaactaacc

SEQ ID NO: 3968 - DNA, 19 bp, Homo sapiens
cagcggaggagaagaaact

SEQ ID NO: 3969 - DNA, 23 bp, Homo sapiens
cagcggaggagaagaaactaacc

SEQ ID NO: 3970 - DNA, 17 bp, Homo sapiens
agcggaggagaagaaac

SEQ ID NO: 3971 - DNA, 18 bp, Homo sapiens
agcggaggagaagaaact

SEQ ID NO: 3972 - DNA, 22 bp, Homo sapiens
agcggaggagaagaaactaacc

SEQ ID NO: 3973 - DNA, 33 bp, Homo sapiens
agcggaggagaagaaactaaccaggattccctc

SEQ ID NO: 3974 - DNA, 17 bp, Homo sapiens
gcggaggagaagaaact

SEQ ID NO: 3975 - DNA, 21 bp, Homo sapiens
gcggaggagaagaaactaacc

SEQ ID NO: 3976 - DNA, 32 bp, Homo sapiens
gcggaggagaagaaactaaccaggattccctc

SEQ ID NO: 3977 - DNA, 16 bp, Homo sapiens
cggaggagaagaaact

SEQ ID NO: 3978 - DNA, 19 bp, Homo sapiens
cggaggagaagaaactaac

SEQ ID NO: 3979 - DNA, 20 bp, Homo sapiens
cggaggagaagaaactaacc

SEQ ID NO: 3980 - DNA, 28 bp, Homo sapiens
cggaggagaagaaactaaccaggattcc

SEQ ID NO: 3981 - DNA, 29 bp, Homo sapiens
cggaggagaagaaactaaccaggattccc

SEQ ID NO: 3982 - DNA, 31 bp, Homo sapiens
cggaggagaagaaactaaccaggattccctc

SEQ ID NO: 3983 - DNA, 18 bp, Homo sapiens
gaggagaagaaactaacc

SEQ ID NO: 3984 - DNA, 18 bp, Homo sapiens
caggattccctcagtaac

SEQ ID NO: 3985 - DNA, 22 bp, Homo sapiens
caggattccctcagtaacggcg

SEQ ID NO: 3986 - DNA, 32 bp, Homo sapiens
caggattccctcagtaacggcgagtgaacagg

SEQ ID NO: 3987 - DNA, 17 bp, Homo sapiens
aggattccctcagtaac

SEQ ID NO: 3988 - DNA, 20 bp, Homo sapiens
aggattccctcagtaacggc

SEQ ID NO: 3989 - DNA, 21 bp, Homo sapiens
aggattccctcagtaacggcg

SEQ ID NO: 3990 - DNA, 31 bp, Homo sapiens
aggattccctcagtaacggcgagtgaacagg

SEQ ID NO: 3991 - DNA, 32 bp, Homo sapiens
aggattccctcagtaacggcgagtgaacaggg

SEQ ID NO: 3992 - DNA, 21 bp, Homo sapiens
cggcgagtgaacagggaagag

SEQ ID NO: 3993 - DNA, 22 bp, Homo sapiens
cggcgagtgaacagggaagagc

SEQ ID NO: 3994 - DNA, 23 bp, Homo sapiens
cggcgagtgaacagggaagagcc

SEQ ID NO: 3995 - DNA, 25 bp, Homo sapiens
cggcgagtgaacagggaagagccca

SEQ ID NO: 3996 - DNA, 27 bp, Homo sapiens
cggcgagtgaacagggaagagcccagc

SEQ ID NO: 3997 - DNA, 29 bp, Homo sapiens
cggcgagtgaacagggaagagcccagcgc

SEQ ID NO: 3998 - DNA, 30 bp, Homo sapiens
cggcgagtgaacagggaagagcccagcgcc

SEQ ID NO: 3999 - DNA, 25 bp, Homo sapiens
agtgaacagggaagagcccagcgcc

SEQ ID NO: 4000 - DNA, 23 bp, Homo sapiens
tgaacagggaagagcccagcgcc

SEQ ID NO: 4001 - DNA, 21 bp, Homo sapiens
gagcccagcgccgaatccccg

SEQ ID NO: 4002 - DNA, 23 bp, Homo sapiens
gagcccagcgccgaatccccgcc

SEQ ID NO: 4003 - DNA, 24 bp, Homo sapiens
gagcccagcgccgaatccccgccc

SEQ ID NO: 4004 - DNA, 26 bp, Homo sapiens
gagcccagcgccgaatccccgccccg

SEQ ID NO: 4005 - DNA, 27 bp, Homo sapiens
gagcccagcgccgaatccccgccccgc

SEQ ID NO: 4006 - DNA, 25 bp, Homo sapiens
agcccagcgccgaatccccgccccg

SEQ ID NO: 4007 - DNA, 26 bp, Homo sapiens
agcccagcgccgaatccccgccccgc

SEQ ID NO: 4008 - DNA, 33 bp, Homo sapiens
cgcggcggggcgcgggacatgtggcgtacggaa

SEQ ID NO: 4009 - DNA, 23 bp, Homo sapiens
cgcgggacatgtggcgtacggaa

SEQ ID NO: 4010 - DNA, 24 bp, Homo sapiens
cgcgggacatgtggcgtacggaag

SEQ ID NO: 4011 - DNA, 25 bp, Homo sapiens
cgcgggacatgtggcgtacggaaga

SEQ ID NO: 4012 - DNA, 26 bp, Homo sapiens
cgcgggacatgtggcgtacggaagac

SEQ ID NO: 4013 - DNA, 27 bp, Homo sapiens
cgcgggacatgtggcgtacggaagacc

SEQ ID NO: 4014 - DNA, 29 bp, Homo sapiens
cgcgggacatgtggcgtacggaagacccg

SEQ ID NO: 4015 - DNA, 30 bp, Homo sapiens
cgcgggacatgtggcgtacggaagacccgc

SEQ ID NO: 4016 - DNA, 21 bp, Homo sapiens
cgggacatgtggcgtacggaa

SEQ ID NO: 4017 - DNA, 29 bp, Homo sapiens
cgggacatgtggcgtacggaagacccgct

SEQ ID NO: 4018 - DNA, 22 bp, Homo sapiens
gacatgtggcgtacggaagacc

SEQ ID NO: 4019 - DNA, 27 bp, Homo sapiens
gacatgtggcgtacggaagacccgctc

SEQ ID NO: 4020 - DNA, 27 bp, Homo sapiens
cgtacggaagacccgctccccggcgcc

SEQ ID NO: 4021 - DNA, 25 bp, Homo sapiens
tacggaagacccgctccccggcgcc

SEQ ID NO: 4022 - DNA, 24 bp, Homo sapiens
acggaagacccgctccccggcgcc

SEQ ID NO: 4023 - DNA, 33 bp, Homo sapiens
ctcgtggggggcccaagtccttctgatcgaggc

SEQ ID NO: 4024 - DNA, 31 bp, Homo sapiens
tcgtggggggcccaagtccttctgatcgagg

SEQ ID NO: 4025 - DNA, 32 bp, Homo sapiens
tcgtggggggcccaagtccttctgatcgaggc

SEQ ID NO: 4026 - DNA, 33 bp, Homo sapiens
tcgtggggggcccaagtccttctgatcgaggcc

SEQ ID NO: 4027 - DNA, 30 bp, Homo sapiens
cgtggggggcccaagtccttctgatcgagg

SEQ ID NO: 4028 - DNA, 31 bp, Homo sapiens
cgtggggggcccaagtccttctgatcgaggc

SEQ ID NO: 4029 - DNA, 32 bp, Homo sapiens
cgtggggggcccaagtccttctgatcgaggcc

SEQ ID NO: 4030 - DNA, 28 bp, Homo sapiens
gtggggggcccaagtccttctgatcgag

SEQ ID NO: 4031 - DNA, 29 bp, Homo sapiens
gtggggggcccaagtccttctgatcgagg

SEQ ID NO: 4032 - DNA, 30 bp, Homo sapiens
gtggggggcccaagtccttctgatcgaggc

SEQ ID NO: 4033 - DNA, 31 bp, Homo sapiens
gtggggggcccaagtccttctgatcgaggcc

SEQ ID NO: 4034 - DNA, 32 bp, Homo sapiens
gtggggggcccaagtccttctgatcgaggccc

SEQ ID NO: 4035 - DNA, 27 bp, Homo sapiens
tggggggcccaagtccttctgatcgag

SEQ ID NO: 4036 - DNA, 28 bp, Homo sapiens
tggggggcccaagtccttctgatcgagg

SEQ ID NO: 4037 - DNA, 29 bp, Homo sapiens
tggggggcccaagtccttctgatcgaggc

SEQ ID NO: 4038 - DNA, 30 bp, Homo sapiens
tggggggcccaagtccttctgatcgaggcc

SEQ ID NO: 4039 - DNA, 31 bp, Homo sapiens
tggggggcccaagtccttctgatcgaggccc

SEQ ID NO: 4040 - DNA, 29 bp, Homo sapiens
ggggggcccaagtccttctgatcgaggcc

SEQ ID NO: 4041 - DNA, 30 bp, Homo sapiens
ggggggcccaagtccttctgatcgaggccc

SEQ ID NO: 4042 - DNA, 27 bp, Homo sapiens
gggggcccaagtccttctgatcgaggc

SEQ ID NO: 4043 - DNA, 28 bp, Homo sapiens
gggggcccaagtccttctgatcgaggcc

SEQ ID NO: 4044 - DNA, 29 bp, Homo sapiens
gggggcccaagtccttctgatcgaggccc

SEQ ID NO: 4045 - DNA, 26 bp, Homo sapiens
ggggcccaagtccttctgatcgaggc

SEQ ID NO: 4046 - DNA, 27 bp, Homo sapiens
ggggcccaagtccttctgatcgaggcc

SEQ ID NO: 4047 - DNA, 25 bp, Homo sapiens
gggcccaagtccttctgatcgaggc

SEQ ID NO: 4048 - DNA, 26 bp, Homo sapiens
gggcccaagtccttctgatcgaggcc

SEQ ID NO: 4049 - DNA, 24 bp, Homo sapiens
ggcccaagtccttctgatcgaggc

SEQ ID NO: 4050 - DNA, 23 bp, Homo sapiens
gcccaagtccttctgatcgaggc

SEQ ID NO: 4051 - DNA, 24 bp, Homo sapiens
gcccaagtccttctgatcgaggcc

SEQ ID NO: 4052 - DNA, 17 bp, Homo sapiens
cccaagtccttctgatc

SEQ ID NO: 4053 - DNA, 20 bp, Homo sapiens
cccaagtccttctgatcgag

SEQ ID NO: 4054 - DNA, 22 bp, Homo sapiens
cccaagtccttctgatcgaggc

SEQ ID NO: 4055 - DNA, 23 bp, Homo sapiens
cccaagtccttctgatcgaggcc

SEQ ID NO: 4056 - DNA, 24 bp, Homo sapiens
cccaagtccttctgatcgaggccc

SEQ ID NO: 4057 - DNA, 28 bp, Homo sapiens
cccaagtccttctgatcgaggcccagcc

SEQ ID NO: 4058 - DNA, 21 bp, Homo sapiens
ccaagtccttctgatcgaggc

SEQ ID NO: 4059 - DNA, 22 bp, Homo sapiens
ccaagtccttctgatcgaggcc

SEQ ID NO: 4060 - DNA, 23 bp, Homo sapiens
ccaagtccttctgatcgaggccc

SEQ ID NO: 4061 - DNA, 21 bp, Homo sapiens
caagtccttctgatcgaggcc

SEQ ID NO: 4062 - DNA, 22 bp, Homo sapiens
caagtccttctgatcgaggccc

SEQ ID NO: 4063 - DNA, 26 bp, Homo sapiens
caagtccttctgatcgaggcccagcc

SEQ ID NO: 4064 - DNA, 32 bp, Homo sapiens
caagtccttctgatcgaggcccagcccgtgga

SEQ ID NO: 4065 - DNA, 33 bp, Homo sapiens
caagtccttctgatcgaggcccagcccgtggac

SEQ ID NO: 4066 - DNA, 17 bp, Homo sapiens
aagtccttctgatcgag

SEQ ID NO: 4067 - DNA, 20 bp, Homo sapiens
aagtccttctgatcgaggcc

SEQ ID NO: 4068 - DNA, 31 bp, Homo sapiens
aagtccttctgatcgaggcccagcccgtgga

SEQ ID NO: 4069 - DNA, 32 bp, Homo sapiens
aagtccttctgatcgaggcccagcccgtggac

SEQ ID NO: 4070 - DNA, 31 bp, Homo sapiens
agtccttctgatcgaggcccagcccgtggac

SEQ ID NO: 4071 - DNA, 30 bp, Homo sapiens
gtccttctgatcgaggcccagcccgtggac

SEQ ID NO: 4072 - DNA, 17 bp, Homo sapiens
tccttctgatcgaggcc

SEQ ID NO: 4073 - DNA, 18 bp, Homo sapiens
tccttctgatcgaggccc

SEQ ID NO: 4074 - DNA, 22 bp, Homo sapiens
tccttctgatcgaggcccagcc

SEQ ID NO: 4075 - DNA, 29 bp, Homo sapiens
tccttctgatcgaggcccagcccgtggac

SEQ ID NO: 4076 - DNA, 30 bp, Homo sapiens
tccttctgatcgaggcccagcccgtggacg

SEQ ID NO: 4077 - DNA, 16 bp, Homo sapiens
ccttctgatcgaggcc

SEQ ID NO: 4078 - DNA, 17 bp, Homo sapiens
ccttctgatcgaggccc

SEQ ID NO: 4079 - DNA, 20 bp, Homo sapiens
ccttctgatcgaggcccagc

SEQ ID NO: 4080 - DNA, 21 bp, Homo sapiens
ccttctgatcgaggcccagcc

SEQ ID NO: 4081 - DNA, 28 bp, Homo sapiens
ccttctgatcgaggcccagcccgtggac

SEQ ID NO: 4082 - DNA, 16 bp, Homo sapiens
cttctgatcgaggccc

SEQ ID NO: 4083 - DNA, 19 bp, Homo sapiens
cttctgatcgaggcccagc

SEQ ID NO: 4084 - DNA, 20 bp, Homo sapiens
cttctgatcgaggcccagcc

SEQ ID NO: 4085 - DNA, 21 bp, Homo sapiens
cttctgatcgaggcccagccc

SEQ ID NO: 4086 - DNA, 22 bp, Homo sapiens
cttctgatcgaggcccagcccg

SEQ ID NO: 4087 - DNA, 24 bp, Homo sapiens
cttctgatcgaggcccagcccgtg

SEQ ID NO: 4088 - DNA, 26 bp, Homo sapiens
cttctgatcgaggcccagcccgtgga

SEQ ID NO: 4089 - DNA, 27 bp, Homo sapiens
cttctgatcgaggcccagcccgtggac

SEQ ID NO: 4090 - DNA, 28 bp, Homo sapiens
cttctgatcgaggcccagcccgtggacg

SEQ ID NO: 4091 - DNA, 30 bp, Homo sapiens
cttctgatcgaggcccagcccgtggacggt

SEQ ID NO: 4092 - DNA, 17 bp, Homo sapiens
ttctgatcgaggcccag

SEQ ID NO: 4093 - DNA, 18 bp, Homo sapiens
ttctgatcgaggcccagc

SEQ ID NO: 4094 - DNA, 19 bp, Homo sapiens
ttctgatcgaggcccagcc

SEQ ID NO: 4095 - DNA, 20 bp, Homo sapiens
ttctgatcgaggcccagccc

SEQ ID NO: 4096 - DNA, 25 bp, Homo sapiens
ttctgatcgaggcccagcccgtgga

SEQ ID NO: 4097 - DNA, 26 bp, Homo sapiens
ttctgatcgaggcccagcccgtggac

SEQ ID NO: 4098 - DNA, 27 bp, Homo sapiens
ttctgatcgaggcccagcccgtggacg

SEQ ID NO: 4099 - DNA, 28 bp, Homo sapiens
ttctgatcgaggcccagcccgtggacgg

SEQ ID NO: 4100 - DNA, 29 bp, Homo sapiens
ttctgatcgaggcccagcccgtggacggt

SEQ ID NO: 4101 - DNA, 32 bp, Homo sapiens
ttctgatcgaggcccagcccgtggacggtgtg

SEQ ID NO: 4102 - DNA, 25 bp, Homo sapiens
tctgatcgaggcccagcccgtggac

SEQ ID NO: 4103 - DNA, 17 bp, Homo sapiens
ctgatcgaggcccagcc

SEQ ID NO: 4104 - DNA, 24 bp, Homo sapiens
ctgatcgaggcccagcccgtggac

SEQ ID NO: 4105 - DNA, 23 bp, Homo sapiens
tgatcgaggcccagcccgtggac

SEQ ID NO: 4106 - DNA, 24 bp, Homo sapiens
tgatcgaggcccagcccgtggacg

SEQ ID NO: 4107 - DNA, 22 bp, Homo sapiens
gatcgaggcccagcccgtggac

SEQ ID NO: 4108 - DNA, 23 bp, Homo sapiens
gatcgaggcccagcccgtggacg

SEQ ID NO: 4109 - DNA, 24 bp, Homo sapiens
gatcgaggcccagcccgtggacgg

SEQ ID NO: 4110 - DNA, 21 bp, Homo sapiens
atcgaggcccagcccgtggac

SEQ ID NO: 4111 - DNA, 22 bp, Homo sapiens
atcgaggcccagcccgtggacg

SEQ ID NO: 4112 - DNA, 23 bp, Homo sapiens
atcgaggcccagcccgtggacgg

SEQ ID NO: 4113 - DNA, 20 bp, Homo sapiens
tcgaggcccagcccgtggac

SEQ ID NO: 4114 - DNA, 19 bp, Homo sapiens
cgaggcccagcccgtggac

SEQ ID NO: 4115 - DNA, 18 bp, Homo sapiens
gaggcccagcccgtggac

SEQ ID NO: 4116 - DNA, 17 bp, Homo sapiens
aggcccagcccgtggac

SEQ ID NO: 4117 - DNA, 18 bp, Homo sapiens
aggcccagcccgtggacg

SEQ ID NO: 4118 - DNA, 19 bp, Homo sapiens
aggcccagcccgtggacgg

SEQ ID NO: 4119 - DNA, 16 bp, Homo sapiens
ggcccagcccgtggac

SEQ ID NO: 4120 - DNA, 16 bp, Homo sapiens
gcccagcccgtggacg

SEQ ID NO: 4121 - DNA, 25 bp, Homo sapiens
cccagcccgtggacggtgtgaggcc

SEQ ID NO: 4122 - DNA, 24 bp, Homo sapiens
ccagcccgtggacggtgtgaggcc

SEQ ID NO: 4123 - DNA, 23 bp, Homo sapiens
cagcccgtggacggtgtgaggcc

SEQ ID NO: 4124 - DNA, 22 bp, Homo sapiens
agcccgtggacggtgtgaggcc

SEQ ID NO: 4125 - DNA, 20 bp, Homo sapiens
cccgtggacggtgtgaggcc

SEQ ID NO: 4126 - DNA, 17 bp, Homo sapiens
ccgtggacggtgtgagg

SEQ ID NO: 4127 - DNA, 18 bp, Homo sapiens
ccgtggacggtgtgaggc

SEQ ID NO: 4128 - DNA, 19 bp, Homo sapiens
ccgtggacggtgtgaggcc

SEQ ID NO: 4129 - DNA, 22 bp, Homo sapiens
ccgtggacggtgtgaggccggt

SEQ ID NO: 4130 - DNA, 16 bp, Homo sapiens
cgtggacggtgtgagg

SEQ ID NO: 4131 - DNA, 17 bp, Homo sapiens
cgtggacggtgtgaggc

SEQ ID NO: 4132 - DNA, 18 bp, Homo sapiens
cgtggacggtgtgaggcc

SEQ ID NO: 4133 - DNA, 19 bp, Homo sapiens
cgtggacggtgtgaggccg

SEQ ID NO: 4134 - DNA, 21 bp, Homo sapiens
cgtggacggtgtgaggccggt

SEQ ID NO: 4135 - DNA, 24 bp, Homo sapiens
cgtggacggtgtgaggccggtagc

SEQ ID NO: 4136 - DNA, 25 bp, Homo sapiens
cgtggacggtgtgaggccggtagcg

SEQ ID NO: 4137 - DNA, 27 bp, Homo sapiens
cgtggacggtgtgaggccggtagcggc

SEQ ID NO: 4138 - DNA, 28 bp, Homo sapiens
cgtggacggtgtgaggccggtagcggcc

SEQ ID NO: 4139 - DNA, 29 bp, Homo sapiens
cgtggacggtgtgaggccggtagcggccc

SEQ ID NO: 4140 - DNA, 30 bp, Homo sapiens
cgtggacggtgtgaggccggtagcggcccc

SEQ ID NO: 4141 - DNA, 31 bp, Homo sapiens
cgtggacggtgtgaggccggtagcggccccc

SEQ ID NO: 4142 - DNA, 16 bp, Homo sapiens
gtggacggtgtgaggc

SEQ ID NO: 4143 - DNA, 17 bp, Homo sapiens
gtggacggtgtgaggcc

SEQ ID NO: 4144 - DNA, 16 bp, Homo sapiens
tggacggtgtgaggcc

SEQ ID NO: 4145 - DNA, 16 bp, Homo sapiens
gtgtgaggccggtagc

SEQ ID NO: 4146 - DNA, 24 bp, Homo sapiens
gtagcggcccccggcgcgccgggc

SEQ ID NO: 4147 - DNA, 22 bp, Homo sapiens
agcggcccccggcgcgccgggc

SEQ ID NO: 4148 - DNA, 21 bp, Homo sapiens
gcggcccccggcgcgccgggc

SEQ ID NO: 4149 - DNA, 20 bp, Homo sapiens
cggcccccggcgcgccgggc

SEQ ID NO: 4150 - DNA, 21 bp, Homo sapiens
cggcccccggcgcgccgggcc

SEQ ID NO: 4151 - DNA, 23 bp, Homo sapiens
cgcgccgggcccgggtcttcccg

SEQ ID NO: 4152 - DNA, 21 bp, Homo sapiens
cgccgggcccgggtcttcccg

SEQ ID NO: 4153 - DNA, 19 bp, Homo sapiens
ccgggcccgggtcttcccg

SEQ ID NO: 4154 - DNA, 21 bp, Homo sapiens
cgggtcttcccggagtcgggt

SEQ ID NO: 4155 - DNA, 22 bp, Homo sapiens
cgggtcttcccggagtcgggtt

SEQ ID NO: 4156 - DNA, 24 bp, Homo sapiens
cgggtcttcccggagtcgggttgc

SEQ ID NO: 4157 - DNA, 25 bp, Homo sapiens
cgggtcttcccggagtcgggttgct

SEQ ID NO: 4158 - DNA, 21 bp, Homo sapiens
gggtcttcccggagtcgggtt

SEQ ID NO: 4159 - DNA, 20 bp, Homo sapiens
ttcccggagtcgggttgctt

SEQ ID NO: 4160 - DNA, 27 bp, Homo sapiens
gcttgggaatgcagcccaaagcgggtg

SEQ ID NO: 4161 - DNA, 24 bp, Homo sapiens
tgggaatgcagcccaaagcgggtg

SEQ ID NO: 4162 - DNA, 22 bp, Homo sapiens
aaagcgggtggtaaactccatc

SEQ ID NO: 4163 - DNA, 16 bp, Homo sapiens
aagcgggtggtaaact

SEQ ID NO: 4164 - DNA, 17 bp, Homo sapiens
aagcgggtggtaaactc

SEQ ID NO: 4165 - DNA, 18 bp, Homo sapiens
aagcgggtggtaaactcc

SEQ ID NO: 4166 - DNA, 21 bp, Homo sapiens
aagcgggtggtaaactccatc

SEQ ID NO: 4167 - DNA, 20 bp, Homo sapiens
ggtaaactccatctaaggct

SEQ ID NO: 4168 - DNA, 19 bp, Homo sapiens
gtaaactccatctaaggct

SEQ ID NO: 4169 - DNA, 18 bp, Homo sapiens
taaactccatctaaggct

SEQ ID NO: 4170 - DNA, 16 bp, Homo sapiens
aactccatctaaggct

SEQ ID NO: 4171 - DNA, 21 bp, Homo sapiens
agaccgatagtcaacaagtac

SEQ ID NO: 4172 - DNA, 20 bp, Homo sapiens
gaccgatagtcaacaagtac

SEQ ID NO: 4173 - DNA, 19 bp, Homo sapiens
accgatagtcaacaagtac

SEQ ID NO: 4174 - DNA, 18 bp, Homo sapiens
ccgatagtcaacaagtac

SEQ ID NO: 4175 - DNA, 23 bp, Homo sapiens
cgtaagggaaagttgaaaagaac

SEQ ID NO: 4176 - DNA, 24 bp, Homo sapiens
cgtaagggaaagttgaaaagaact

SEQ ID NO: 4177 - DNA, 25 bp, Homo sapiens
cgtaagggaaagttgaaaagaactt

SEQ ID NO: 4178 - DNA, 23 bp, Homo sapiens
gtaagggaaagttgaaaagaact

SEQ ID NO: 4179 - DNA, 33 bp, Homo sapiens
gggaaagttgaaaagaactttgaagagagagtt

SEQ ID NO: 4180 - DNA, 32 bp, Homo sapiens
ggaaagttgaaaagaactttgaagagagagtt

SEQ ID NO: 4181 - DNA, 21 bp, Homo sapiens
tgaaaagaactttgaagagag

SEQ ID NO: 4182 - DNA, 22 bp, Homo sapiens
tgaaaagaactttgaagagaga

SEQ ID NO: 4183 - DNA, 23 bp, Homo sapiens
tgaaaagaactttgaagagagag

SEQ ID NO: 4184 - DNA, 24 bp, Homo sapiens
tgaaaagaactttgaagagagagt

SEQ ID NO: 4185 - DNA, 25 bp, Homo sapiens
tgaaaagaactttgaagagagagtt

SEQ ID NO: 4186 - DNA, 29 bp, Homo sapiens
tgaaaagaactttgaagagagagttcaag

SEQ ID NO: 4187 - DNA, 23 bp, Homo sapiens
gaaaagaactttgaagagagagt

SEQ ID NO: 4188 - DNA, 26 bp, Homo sapiens
aagagggcgtgaaaccgttaagaggt

SEQ ID NO: 4189 - DNA, 32 bp, Homo sapiens
tcaacccggcggcgggtccggccgtgtcggcg

SEQ ID NO: 4190 - DNA, 33 bp, Homo sapiens
tcaacccggcggcgggtccggccgtgtcggcgg

SEQ ID NO: 4191 - DNA, 31 bp, Homo sapiens
caacccggcggcgggtccggccgtgtcggcg

SEQ ID NO: 4192 - DNA, 32 bp, Homo sapiens
caacccggcggcgggtccggccgtgtcggcgg

SEQ ID NO: 4193 - DNA, 21 bp, Homo sapiens
aacccggcggcgggtccggcc

SEQ ID NO: 4194 - DNA, 22 bp, Homo sapiens
aacccggcggcgggtccggccg

SEQ ID NO: 4195 - DNA, 17 bp, Homo sapiens
gtccggccgtgtcggcg

SEQ ID NO: 4196 - DNA, 18 bp, Homo sapiens
gtccggccgtgtcggcgg

SEQ ID NO: 4197 - DNA, 17 bp, Homo sapiens
tccggccgtgtcggcgg

SEQ ID NO: 4198 - DNA, 16 bp, Homo sapiens
cggcggcccggcggat

SEQ ID NO: 4199 - DNA, 20 bp, Homo sapiens
cccgccgcccctcctcctcc

SEQ ID NO: 4200 - DNA, 20 bp, Homo sapiens
cctccccggagggggcgggc

SEQ ID NO: 4201 - DNA, 22 bp, Homo sapiens
gggggaccgtcccccgaccggc

SEQ ID NO: 4202 - DNA, 25 bp, Homo sapiens
gggggaccgtcccccgaccggcgac

SEQ ID NO: 4203 - DNA, 26 bp, Homo sapiens
gggggaccgtcccccgaccggcgacc

SEQ ID NO: 4204 - DNA, 24 bp, Homo sapiens
ggggaccgtcccccgaccggcgac

SEQ ID NO: 4205 - DNA, 25 bp, Homo sapiens
ggggaccgtcccccgaccggcgacc

SEQ ID NO: 4206 - DNA, 18 bp, Homo sapiens
tcccccgaccggcgaccg

SEQ ID NO: 4207 - DNA, 17 bp, Homo sapiens
cccccgaccggcgaccg

SEQ ID NO: 4208 - DNA, 22 bp, Homo sapiens
cggcgaccggccgccgccgggc

SEQ ID NO: 4209 - DNA, 23 bp, Homo sapiens
cggcgaccggccgccgccgggcg

SEQ ID NO: 4210 - DNA, 21 bp, Homo sapiens
ggcgaccggccgccgccgggc

SEQ ID NO: 4211 - DNA, 22 bp, Homo sapiens
ggcgaccggccgccgccgggcg

SEQ ID NO: 4212 - DNA, 20 bp, Homo sapiens
cgaccggccgccgccgggcg

SEQ ID NO: 4213 - DNA, 22 bp, Homo sapiens
gcgccgcgaccggctccgggac

SEQ ID NO: 4214 - DNA, 21 bp, Homo sapiens
cgccgcgaccggctccgggac

SEQ ID NO: 4215 - DNA, 23 bp, Homo sapiens
ccgcgaccggctccgggacggct

SEQ ID NO: 4216 - DNA, 22 bp, Homo sapiens
cgcgaccggctccgggacggct

SEQ ID NO: 4217 - DNA, 19 bp, Homo sapiens
gaccggctccgggacggct

SEQ ID NO: 4218 - DNA, 17 bp, Homo sapiens
ccggctccgggacggct

SEQ ID NO: 4219 - DNA, 22 bp, Homo sapiens
gggaaggcccggcggggaaggt

SEQ ID NO: 4220 - DNA, 32 bp, Homo sapiens
cccgtctccgccccccggccccgcgtcctccc

SEQ ID NO: 4221 - DNA, 30 bp, Homo sapiens
ccgtctccgccccccggccccgcgtcctcc

SEQ ID NO: 4222 - DNA, 31 bp, Homo sapiens
ccgtctccgccccccggccccgcgtcctccc

SEQ ID NO: 4223 - DNA, 28 bp, Homo sapiens
gtctccgccccccggccccgcgtcctcc

SEQ ID NO: 4224 - DNA, 29 bp, Homo sapiens
gtctccgccccccggccccgcgtcctccc

SEQ ID NO: 4225 - DNA, 30 bp, Homo sapiens
gtctccgccccccggccccgcgtcctccct

SEQ ID NO: 4226 - DNA, 26 bp, Homo sapiens
tccgccccccggccccgcgtcctccc

SEQ ID NO: 4227 - DNA, 24 bp, Homo sapiens
ccgccccccggccccgcgtcctcc

SEQ ID NO: 4228 - DNA, 25 bp, Homo sapiens
ccgccccccggccccgcgtcctccc

SEQ ID NO: 4229 - DNA, 26 bp, Homo sapiens
ccgccccccggccccgcgtcctccct

SEQ ID NO: 4230 - DNA, 23 bp, Homo sapiens
cgccccccggccccgcgtcctcc

SEQ ID NO: 4231 - DNA, 24 bp, Homo sapiens
cgccccccggccccgcgtcctccc

SEQ ID NO: 4232 - DNA, 22 bp, Homo sapiens
gccccccggccccgcgtcctcc

SEQ ID NO: 4233 - DNA, 23 bp, Homo sapiens
gccccccggccccgcgtcctccc

SEQ ID NO: 4234 - DNA, 22 bp, Homo sapiens
ccccccggccccgcgtcctccc

SEQ ID NO: 4235 - DNA, 21 bp, Homo sapiens
cccccggccccgcgtcctccc

SEQ ID NO: 4236 - DNA, 20 bp, Homo sapiens
ccccggccccgcgtcctccc

SEQ ID NO: 4237 - DNA, 18 bp, Homo sapiens
ccggccccgcgtcctccc

SEQ ID NO: 4238 - DNA, 22 bp, Homo sapiens
agcccccccggcagcagcactc

SEQ ID NO: 4239 - DNA, 25 bp, Homo sapiens
agcccccccggcagcagcactcgcc

SEQ ID NO: 4240 - DNA, 23 bp, Homo sapiens
gcagcactcgccgaatcccgggg

SEQ ID NO: 4241 - DNA, 28 bp, Homo sapiens
gcagcactcgccgaatcccggggccgag

SEQ ID NO: 4242 - DNA, 22 bp, Homo sapiens
cagcactcgccgaatcccgggg

SEQ ID NO: 4243 - DNA, 25 bp, Homo sapiens
cagcactcgccgaatcccggggccg

SEQ ID NO: 4244 - DNA, 27 bp, Homo sapiens
cagcactcgccgaatcccggggccgag

SEQ ID NO: 4245 - DNA, 32 bp, Homo sapiens
cagcactcgccgaatcccggggccgagggagc

SEQ ID NO: 4246 - DNA, 23 bp, Homo sapiens
gcactcgccgaatcccggggccg

SEQ ID NO: 4247 - DNA, 25 bp, Homo sapiens
gcactcgccgaatcccggggccgag

SEQ ID NO: 4248 - DNA, 26 bp, Homo sapiens
gcactcgccgaatcccggggccgagg

SEQ ID NO: 4249 - DNA, 29 bp, Homo sapiens
gcactcgccgaatcccggggccgagggag

SEQ ID NO: 4250 - DNA, 25 bp, Homo sapiens
cgccgaatcccggggccgagggagc

SEQ ID NO: 4251 - DNA, 24 bp, Homo sapiens
gccgaatcccggggccgagggagc

SEQ ID NO: 4252 - DNA, 24 bp, Homo sapiens
cggggccgagggagcgagacccgt

SEQ ID NO: 4253 - DNA, 29 bp, Homo sapiens
cggggccgagggagcgagacccgtcgccg

SEQ ID NO: 4254 - DNA, 31 bp, Homo sapiens
cggggccgagggagcgagacccgtcgccgcg

SEQ ID NO: 4255 - DNA, 32 bp, Homo sapiens
cggggccgagggagcgagacccgtcgccgcgc

SEQ ID NO: 4256 - DNA, 17 bp, Homo sapiens
gagacccgtcgccgcgc

SEQ ID NO: 4257 - DNA, 16 bp, Homo sapiens
agacccgtcgccgcgc

SEQ ID NO: 4258 - DNA, 17 bp, Homo sapiens
cccccctcccggcgccc

SEQ ID NO: 4259 - DNA, 22 bp, Homo sapiens
tcccccgcgggggcgcgccggc

SEQ ID NO: 4260 - DNA, 20 bp, Homo sapiens
cccccgcgggggcgcgccgg

SEQ ID NO: 4261 - DNA, 21 bp, Homo sapiens
cccccgcgggggcgcgccggc

SEQ ID NO: 4262 - DNA, 17 bp, Homo sapiens
ctcccacggcgcgaccg

SEQ ID NO: 4263 - DNA, 22 bp, Homo sapiens
ctcccacggcgcgaccgctctc

SEQ ID NO: 4264 - DNA, 16 bp, Homo sapiens
cccgcgcccccgcccc

SEQ ID NO: 4265 - DNA, 17 bp, Homo sapiens
cccgcgcccccgccccg

SEQ ID NO: 4266 - DNA, 32 bp, Homo sapiens
gcgcgcgggtcggggggcggggcggactgtcc

SEQ ID NO: 4267 - DNA, 18 bp, Homo sapiens
gggcggggcggactgtcc

SEQ ID NO: 4268 - DNA, 20 bp, Homo sapiens
cggactgtccccagtgcgcc

SEQ ID NO: 4269 - DNA, 21 bp, Homo sapiens
cggactgtccccagtgcgccc

SEQ ID NO: 4270 - DNA, 16 bp, Homo sapiens
ccagtgcgccccgggc

SEQ ID NO: 4271 - DNA, 33 bp, Homo sapiens
ccagtgcgccccgggcgggtcgcgccgtcgggc

SEQ ID NO: 4272 - DNA, 16 bp, Homo sapiens
cagtgcgccccgggcg

SEQ ID NO: 4273 - DNA, 32 bp, Homo sapiens
cagtgcgccccgggcgggtcgcgccgtcgggc

SEQ ID NO: 4274 - DNA, 33 bp, Homo sapiens
cagtgcgccccgggcgggtcgcgccgtcgggcc

SEQ ID NO: 4275 - DNA, 31 bp, Homo sapiens
agtgcgccccgggcgggtcgcgccgtcgggc

SEQ ID NO: 4276 - DNA, 32 bp, Homo sapiens
agtgcgccccgggcgggtcgcgccgtcgggcc

SEQ ID NO: 4277 - DNA, 33 bp, Homo sapiens
agtgcgccccgggcgggtcgcgccgtcgggccc

SEQ ID NO: 4278 - DNA, 20 bp, Homo sapiens
cgccccgggcgggtcgcgcc

SEQ ID NO: 4279 - DNA, 21 bp, Homo sapiens
cgccccgggcgggtcgcgccg

SEQ ID NO: 4280 - DNA, 20 bp, Homo sapiens
gccccgggcgggtcgcgccg

SEQ ID NO: 4281 - DNA, 23 bp, Homo sapiens
cgggcgggtcgcgccgtcgggcc

SEQ ID NO: 4282 - DNA, 22 bp, Homo sapiens
gggcgggtcgcgccgtcgggcc

SEQ ID NO: 4283 - DNA, 23 bp, Homo sapiens
gggcgggtcgcgccgtcgggccc

SEQ ID NO: 4284 - DNA, 24 bp, Homo sapiens
gggcgggtcgcgccgtcgggcccg

SEQ ID NO: 4285 - DNA, 18 bp, Homo sapiens
gggtcgcgccgtcgggcc

SEQ ID NO: 4286 - DNA, 17 bp, Homo sapiens
ggtcgcgccgtcgggcc

SEQ ID NO: 4287 - DNA, 18 bp, Homo sapiens
ggtcgcgccgtcgggccc

SEQ ID NO: 4288 - DNA, 19 bp, Homo sapiens
ggtcgcgccgtcgggcccg

SEQ ID NO: 4289 - DNA, 21 bp, Homo sapiens
ggtcgcgccgtcgggcccggg

SEQ ID NO: 4290 - DNA, 32 bp, Homo sapiens
ggtcgcgccgtcgggcccgggggaggttctct

SEQ ID NO: 4291 - DNA, 16 bp, Homo sapiens
gtcgcgccgtcgggcc

SEQ ID NO: 4292 - DNA, 17 bp, Homo sapiens
gtcgcgccgtcgggccc

SEQ ID NO: 4293 - DNA, 16 bp, Homo sapiens
tcgcgccgtcgggccc

SEQ ID NO: 4294 - DNA, 22 bp, Homo sapiens
tcgcgccgtcgggcccggggga

SEQ ID NO: 4295 - DNA, 16 bp, Homo sapiens
gcgccgtcgggcccgg

SEQ ID NO: 4296 - DNA, 27 bp, Homo sapiens
gcgccgtcgggcccgggggaggttctc

SEQ ID NO: 4297 - DNA, 28 bp, Homo sapiens
gcgccgtcgggcccgggggaggttctct

SEQ ID NO: 4298 - DNA, 32 bp, Homo sapiens
gcgccgtcgggcccgggggaggttctctcggg

SEQ ID NO: 4299 - DNA, 33 bp, Homo sapiens
gcgccgtcgggcccgggggaggttctctcgggg

SEQ ID NO: 4300 - DNA, 16 bp, Homo sapiens
cgccgtcgggcccggg

SEQ ID NO: 4301 - DNA, 18 bp, Homo sapiens
cgccgtcgggcccggggg

SEQ ID NO: 4302 - DNA, 19 bp, Homo sapiens
cgccgtcgggcccggggga

SEQ ID NO: 4303 - DNA, 26 bp, Homo sapiens
cgccgtcgggcccgggggaggttctc

SEQ ID NO: 4304 - DNA, 27 bp, Homo sapiens
cgccgtcgggcccgggggaggttctct

SEQ ID NO: 4305 - DNA, 21 bp, Homo sapiens
cgcacggggtcggcggcgacg

SEQ ID NO: 4306 - DNA, 19 bp, Homo sapiens
gcacggggtcggcggcgac

SEQ ID NO: 4307 - DNA, 20 bp, Homo sapiens
gcacggggtcggcggcgacg

SEQ ID NO: 4308 - DNA, 22 bp, Homo sapiens
gcacggggtcggcggcgacgtc

SEQ ID NO: 4309 - DNA, 21 bp, Homo sapiens
cacggggtcggcggcgacgtc

SEQ ID NO: 4310 - DNA, 20 bp, Homo sapiens
acggggtcggcggcgacgtc

SEQ ID NO: 4311 - DNA, 19 bp, Homo sapiens
cggggtcggcggcgacgtc

SEQ ID NO: 4312 - DNA, 17 bp, Homo sapiens
cggcggcgacgtcggct

SEQ ID NO: 4313 - DNA, 16 bp, Homo sapiens
ggcggcgacgtcggct

SEQ ID NO: 4314 - DNA, 27 bp, Homo sapiens
gcggcgacgtcggctacccacccgacc

SEQ ID NO: 4315 - DNA, 25 bp, Homo sapiens
ggcgacgtcggctacccacccgacc

SEQ ID NO: 4316 - DNA, 16 bp, Homo sapiens
gcgacgtcggctaccc

SEQ ID NO: 4317 - DNA, 23 bp, Homo sapiens
gcgacgtcggctacccacccgac

SEQ ID NO: 4318 - DNA, 24 bp, Homo sapiens
gcgacgtcggctacccacccgacc

SEQ ID NO: 4319 - DNA, 25 bp, Homo sapiens
gcgacgtcggctacccacccgaccc

SEQ ID NO: 4320 - DNA, 16 bp, Homo sapiens
cgacgtcggctaccca

SEQ ID NO: 4321 - DNA, 17 bp, Homo sapiens
cgacgtcggctacccac

SEQ ID NO: 4322 - DNA, 18 bp, Homo sapiens
cgacgtcggctacccacc

SEQ ID NO: 4323 - DNA, 19 bp, Homo sapiens
cgacgtcggctacccaccc

SEQ ID NO: 4324 - DNA, 21 bp, Homo sapiens
cgacgtcggctacccacccga

SEQ ID NO: 4325 - DNA, 22 bp, Homo sapiens
cgacgtcggctacccacccgac

SEQ ID NO: 4326 - DNA, 23 bp, Homo sapiens
cgacgtcggctacccacccgacc

SEQ ID NO: 4327 - DNA, 24 bp, Homo sapiens
cgacgtcggctacccacccgaccc

SEQ ID NO: 4328 - DNA, 22 bp, Homo sapiens
gacgtcggctacccacccgacc

SEQ ID NO: 4329 - DNA, 23 bp, Homo sapiens
aaggagtctaacacgtgcgcgag

SEQ ID NO: 4330 - DNA, 24 bp, Homo sapiens
aaggagtctaacacgtgcgcgagt

SEQ ID NO: 4331 - DNA, 32 bp, Homo sapiens
aaggagtctaacacgtgcgcgagtcgggggct

SEQ ID NO: 4332 - DNA, 33 bp, Homo sapiens
aaggagtctaacacgtgcgcgagtcgggggctc

SEQ ID NO: 4333 - DNA, 29 bp, Homo sapiens
gagtctaacacgtgcgcgagtcgggggct

SEQ ID NO: 4334 - DNA, 23 bp, Homo sapiens
aacacgtgcgcgagtcgggggct

SEQ ID NO: 4335 - DNA, 25 bp, Homo sapiens
aacacgtgcgcgagtcgggggctcg

SEQ ID NO: 4336 - DNA, 20 bp, Homo sapiens
cgcacgaaagccgccgtggc

SEQ ID NO: 4337 - DNA, 17 bp, Homo sapiens
caatgaaggtgaaggcc

SEQ ID NO: 4338 - DNA, 21 bp, Homo sapiens
aaggtgaaggccggcgcgctc

SEQ ID NO: 4339 - DNA, 17 bp, Homo sapiens
gtgaaggccggcgcgct

SEQ ID NO: 4340 - DNA, 18 bp, Homo sapiens
gtgaaggccggcgcgctc

SEQ ID NO: 4341 - DNA, 16 bp, Homo sapiens
ggcgcgctcgccggcc

SEQ ID NO: 4342 - DNA, 32 bp, Homo sapiens
ggcgcgctcgccggccgaggtgggatcccgag

SEQ ID NO: 4343 - DNA, 31 bp, Homo sapiens
gcgcgctcgccggccgaggtgggatcccgag

SEQ ID NO: 4344 - DNA, 32 bp, Homo sapiens
gcgcgctcgccggccgaggtgggatcccgagg

SEQ ID NO: 4345 - DNA, 30 bp, Homo sapiens
cgcgctcgccggccgaggtgggatcccgag

SEQ ID NO: 4346 - DNA, 31 bp, Homo sapiens
cgcgctcgccggccgaggtgggatcccgagg

SEQ ID NO: 4347 - DNA, 16 bp, Homo sapiens
gcgctcgccggccgag

SEQ ID NO: 4348 - DNA, 17 bp, Homo sapiens
gcgctcgccggccgagg

SEQ ID NO: 4349 - DNA, 29 bp, Homo sapiens
gcgctcgccggccgaggtgggatcccgag

SEQ ID NO: 4350 - DNA, 28 bp, Homo sapiens
cgctcgccggccgaggtgggatcccgag

SEQ ID NO: 4351 - DNA, 31 bp, Homo sapiens
cgctcgccggccgaggtgggatcccgaggcc

SEQ ID NO: 4352 - DNA, 26 bp, Homo sapiens
ctcgccggccgaggtgggatcccgag

SEQ ID NO: 4353 - DNA, 24 bp, Homo sapiens
cgccggccgaggtgggatcccgag

SEQ ID NO: 4354 - DNA, 27 bp, Homo sapiens
cagtccgccgagggcgcaccaccggcc

SEQ ID NO: 4355 - DNA, 26 bp, Homo sapiens
agtccgccgagggcgcaccaccggcc

SEQ ID NO: 4356 - DNA, 25 bp, Homo sapiens
gtccgccgagggcgcaccaccggcc

SEQ ID NO: 4357 - DNA, 31 bp, Homo sapiens
cgccgagggcgcaccaccggcccgtctcgcc

SEQ ID NO: 4358 - DNA, 16 bp, Homo sapiens
caccggcccgtctcgc

SEQ ID NO: 4359 - DNA, 17 bp, Homo sapiens
caccggcccgtctcgcc

SEQ ID NO: 4360 - DNA, 16 bp, Homo sapiens
accggcccgtctcgcc

SEQ ID NO: 4361 - DNA, 18 bp, Homo sapiens
cgtctcgcccgccgcgcc

SEQ ID NO: 4362 - DNA, 26 bp, Homo sapiens
ggagcacgagcgcacgtgttaggacc

SEQ ID NO: 4363 - DNA, 33 bp, Homo sapiens
ggagcacgagcgcacgtgttaggacccgaaaga

SEQ ID NO: 4364 - DNA, 25 bp, Homo sapiens
gagcacgagcgcacgtgttaggacc

SEQ ID NO: 4365 - DNA, 24 bp, Homo sapiens
agcacgagcgcacgtgttaggacc

SEQ ID NO: 4366 - DNA, 23 bp, Homo sapiens
gcacgagcgcacgtgttaggacc

SEQ ID NO: 4367 - DNA, 22 bp, Homo sapiens
cacgagcgcacgtgttaggacc

SEQ ID NO: 4368 - DNA, 23 bp, Homo sapiens
cacgagcgcacgtgttaggaccc

SEQ ID NO: 4369 - DNA, 29 bp, Homo sapiens
cacgagcgcacgtgttaggacccgaaaga

SEQ ID NO: 4370 - DNA, 21 bp, Homo sapiens
acgagcgcacgtgttaggacc

SEQ ID NO: 4371 - DNA, 24 bp, Homo sapiens
acgagcgcacgtgttaggacccga

SEQ ID NO: 4372 - DNA, 28 bp, Homo sapiens
acgagcgcacgtgttaggacccgaaaga

SEQ ID NO: 4373 - DNA, 29 bp, Homo sapiens
acgagcgcacgtgttaggacccgaaagat

SEQ ID NO: 4374 - DNA, 20 bp, Homo sapiens
cgagcgcacgtgttaggacc

SEQ ID NO: 4375 - DNA, 23 bp, Homo sapiens
cgagcgcacgtgttaggacccga

SEQ ID NO: 4376 - DNA, 27 bp, Homo sapiens
cgagcgcacgtgttaggacccgaaaga

SEQ ID NO: 4377 - DNA, 18 bp, Homo sapiens
gagcgcacgtgttaggac

SEQ ID NO: 4378 - DNA, 19 bp, Homo sapiens
gagcgcacgtgttaggacc

SEQ ID NO: 4379 - DNA, 20 bp, Homo sapiens
gagcgcacgtgttaggaccc

SEQ ID NO: 4380 - DNA, 24 bp, Homo sapiens
gagcgcacgtgttaggacccgaaa

SEQ ID NO: 4381 - DNA, 26 bp, Homo sapiens
gagcgcacgtgttaggacccgaaaga

SEQ ID NO: 4382 - DNA, 27 bp, Homo sapiens
gagcgcacgtgttaggacccgaaagat

SEQ ID NO: 4383 - DNA, 18 bp, Homo sapiens
agcgcacgtgttaggacc

SEQ ID NO: 4384 - DNA, 19 bp, Homo sapiens
agcgcacgtgttaggaccc

SEQ ID NO: 4385 - DNA, 21 bp, Homo sapiens
agcgcacgtgttaggacccga

SEQ ID NO: 4386 - DNA, 16 bp, Homo sapiens
cgcacgtgttaggacc

SEQ ID NO: 4387 - DNA, 19 bp, Homo sapiens
cgcacgtgttaggacccga

SEQ ID NO: 4388 - DNA, 17 bp, Homo sapiens
cacgtgttaggacccga

SEQ ID NO: 4389 - DNA, 21 bp, Homo sapiens
cacgtgttaggacccgaaaga

SEQ ID NO: 4390 - DNA, 33 bp, Homo sapiens
cgtgttaggacccgaaagatggtgaactatgcc

SEQ ID NO: 4391 - DNA, 21 bp, Homo sapiens
cgaaagatggtgaactatgcc

SEQ ID NO: 4392 - DNA, 26 bp, Homo sapiens
cgaaagatggtgaactatgcctgggc

SEQ ID NO: 4393 - DNA, 27 bp, Homo sapiens
cgaaagatggtgaactatgcctgggca

SEQ ID NO: 4394 - DNA, 28 bp, Homo sapiens
cgaaagatggtgaactatgcctgggcag

SEQ ID NO: 4395 - DNA, 30 bp, Homo sapiens
cgaaagatggtgaactatgcctgggcaggg

SEQ ID NO: 4396 - DNA, 26 bp, Homo sapiens
gaaagatggtgaactatgcctgggca

SEQ ID NO: 4397 - DNA, 25 bp, Homo sapiens
aaagatggtgaactatgcctgggca

SEQ ID NO: 4398 - DNA, 21 bp, Homo sapiens
atggtgaactatgcctgggca

SEQ ID NO: 4399 - DNA, 19 bp, Homo sapiens
ggtgaactatgcctgggca

SEQ ID NO: 4400 - DNA, 17 bp, Homo sapiens
gtgaactatgcctgggc

SEQ ID NO: 4401 - DNA, 18 bp, Homo sapiens
gtgaactatgcctgggca

SEQ ID NO: 4402 - DNA, 22 bp, Homo sapiens
agaggaaactctggtggaggtc

SEQ ID NO: 4403 - DNA, 21 bp, Homo sapiens
gaggaaactctggtggaggtc

SEQ ID NO: 4404 - DNA, 25 bp, Homo sapiens
ggtggaggtccgtagcggtcctgac

SEQ ID NO: 4405 - DNA, 16 bp, Homo sapiens
gaggtccgtagcggtc

SEQ ID NO: 4406 - DNA, 16 bp, Homo sapiens
gtccgtagcggtcctg

SEQ ID NO: 4407 - DNA, 17 bp, Homo sapiens
gtccgtagcggtcctga

SEQ ID NO: 4408 - DNA, 18 bp, Homo sapiens
gtccgtagcggtcctgac

SEQ ID NO: 4409 - DNA, 19 bp, Homo sapiens
gtccgtagcggtcctgacg

SEQ ID NO: 4410 - DNA, 21 bp, Homo sapiens
gtccgtagcggtcctgacgtg

SEQ ID NO: 4411 - DNA, 17 bp, Homo sapiens
tccgtagcggtcctgac

SEQ ID NO: 4412 - DNA, 18 bp, Homo sapiens
tccgtagcggtcctgacg

SEQ ID NO: 4413 - DNA, 16 bp, Homo sapiens
ccgtagcggtcctgac

SEQ ID NO: 4414 - DNA, 17 bp, Homo sapiens
ccgtagcggtcctgacg

SEQ ID NO: 4415 - DNA, 21 bp, Homo sapiens
ccgtagcggtcctgacgtgca

SEQ ID NO: 4416 - DNA, 16 bp, Homo sapiens
cgtagcggtcctgacg

SEQ ID NO: 4417 - DNA, 17 bp, Homo sapiens
cgtagcggtcctgacgt

SEQ ID NO: 4418 - DNA, 18 bp, Homo sapiens
cgtagcggtcctgacgtg

SEQ ID NO: 4419 - DNA, 19 bp, Homo sapiens
cgtagcggtcctgacgtgc

SEQ ID NO: 4420 - DNA, 20 bp, Homo sapiens
cgtagcggtcctgacgtgca

SEQ ID NO: 4421 - DNA, 24 bp, Homo sapiens
cgtagcggtcctgacgtgcaaatc

SEQ ID NO: 4422 - DNA, 28 bp, Homo sapiens
cgtagcggtcctgacgtgcaaatcggtc

SEQ ID NO: 4423 - DNA, 32 bp, Homo sapiens
cgtagcggtcctgacgtgcaaatcggtcgtcc

SEQ ID NO: 4424 - DNA, 33 bp, Homo sapiens
cgtagcggtcctgacgtgcaaatcggtcgtccg

SEQ ID NO: 4425 - DNA, 19 bp, Homo sapiens
gtagcggtcctgacgtgca

SEQ ID NO: 4426 - DNA, 27 bp, Homo sapiens
gtagcggtcctgacgtgcaaatcggtc

SEQ ID NO: 4427 - DNA, 32 bp, Homo sapiens
gtagcggtcctgacgtgcaaatcggtcgtccg

SEQ ID NO: 4428 - DNA, 32 bp, Homo sapiens
ctgacgtgcaaatcggtcgtccgacctgggta

SEQ ID NO: 4429 - DNA, 31 bp, Homo sapiens
tgacgtgcaaatcggtcgtccgacctgggta

SEQ ID NO: 4430 - DNA, 30 bp, Homo sapiens
gacgtgcaaatcggtcgtccgacctgggta

SEQ ID NO: 4431 - DNA, 29 bp, Homo sapiens
gtgcaaatcggtcgtccgacctgggtata

SEQ ID NO: 4432 - DNA, 33 bp, Homo sapiens
tgcaaatcggtcgtccgacctgggtataggggc

SEQ ID NO: 4433 - DNA, 31 bp, Homo sapiens
caaatcggtcgtccgacctgggtataggggc

SEQ ID NO: 4434 - DNA, 32 bp, Homo sapiens
caaatcggtcgtccgacctgggtataggggcg

SEQ ID NO: 4435 - DNA, 29 bp, Homo sapiens
aaatcggtcgtccgacctgggtatagggg

SEQ ID NO: 4436 - DNA, 30 bp, Homo sapiens
aaatcggtcgtccgacctgggtataggggc

SEQ ID NO: 4437 - DNA, 31 bp, Homo sapiens
aaatcggtcgtccgacctgggtataggggcg

SEQ ID NO: 4438 - DNA, 32 bp, Homo sapiens
aaatcggtcgtccgacctgggtataggggcga

SEQ ID NO: 4439 - DNA, 16 bp, Homo sapiens
aatcggtcgtccgacc

SEQ ID NO: 4440 - DNA, 22 bp, Homo sapiens
aatcggtcgtccgacctgggta

SEQ ID NO: 4441 - DNA, 24 bp, Homo sapiens
aatcggtcgtccgacctgggtata

SEQ ID NO: 4442 - DNA, 28 bp, Homo sapiens
aatcggtcgtccgacctgggtatagggg

SEQ ID NO: 4443 - DNA, 29 bp, Homo sapiens
aatcggtcgtccgacctgggtataggggc

SEQ ID NO: 4444 - DNA, 30 bp, Homo sapiens
aatcggtcgtccgacctgggtataggggcg

SEQ ID NO: 4445 - DNA, 31 bp, Homo sapiens
aatcggtcgtccgacctgggtataggggcga

SEQ ID NO: 4446 - DNA, 32 bp, Homo sapiens
aatcggtcgtccgacctgggtataggggcgaa

SEQ ID NO: 4447 - DNA, 33 bp, Homo sapiens
aatcggtcgtccgacctgggtataggggcgaaa

SEQ ID NO: 4448 - DNA, 27 bp, Homo sapiens
atcggtcgtccgacctgggtatagggg

SEQ ID NO: 4449 - DNA, 28 bp, Homo sapiens
atcggtcgtccgacctgggtataggggc

SEQ ID NO: 4450 - DNA, 29 bp, Homo sapiens
atcggtcgtccgacctgggtataggggcg

SEQ ID NO: 4451 - DNA, 30 bp, Homo sapiens
atcggtcgtccgacctgggtataggggcga

SEQ ID NO: 4452 - DNA, 26 bp, Homo sapiens
cggtcgtccgacctgggtataggggc

SEQ ID NO: 4453 - DNA, 27 bp, Homo sapiens
cggtcgtccgacctgggtataggggcg

SEQ ID NO: 4454 - DNA, 28 bp, Homo sapiens
cggtcgtccgacctgggtataggggcga

SEQ ID NO: 4455 - DNA, 33 bp, Homo sapiens
cggtcgtccgacctgggtataggggcgaaagac

SEQ ID NO: 4456 - DNA, 26 bp, Homo sapiens
cgacctgggtataggggcgaaagact

SEQ ID NO: 4457 - DNA, 23 bp, Homo sapiens
aggggcgaaagactaatcgaacc

SEQ ID NO: 4458 - DNA, 27 bp, Homo sapiens
aggggcgaaagactaatcgaaccatct

SEQ ID NO: 4459 - DNA, 22 bp, Homo sapiens
ggggcgaaagactaatcgaacc

SEQ ID NO: 4460 - DNA, 28 bp, Homo sapiens
gaaagactaatcgaaccatctagtagct

SEQ ID NO: 4461 - DNA, 16 bp, Homo sapiens
aaagactaatcgaacc

SEQ ID NO: 4462 - DNA, 27 bp, Homo sapiens
aaagactaatcgaaccatctagtagct

SEQ ID NO: 4463 - DNA, 26 bp, Homo sapiens
aagactaatcgaaccatctagtagct

SEQ ID NO: 4464 - DNA, 25 bp, Homo sapiens
agactaatcgaaccatctagtagct

SEQ ID NO: 4465 - DNA, 21 bp, Homo sapiens
taatcgaaccatctagtagct

SEQ ID NO: 4466 - DNA, 20 bp, Homo sapiens
aatcgaaccatctagtagct

SEQ ID NO: 4467 - DNA, 19 bp, Homo sapiens
atcgaaccatctagtagct

SEQ ID NO: 4468 - DNA, 29 bp, Homo sapiens
tccctcaggatagctggcgctctcgcaga

SEQ ID NO: 4469 - DNA, 31 bp, Homo sapiens
tccctcaggatagctggcgctctcgcagacc

SEQ ID NO: 4470 - DNA, 32 bp, Homo sapiens
tccctcaggatagctggcgctctcgcagaccc

SEQ ID NO: 4471 - DNA, 33 bp, Homo sapiens
tccctcaggatagctggcgctctcgcagacccg

SEQ ID NO: 4472 - DNA, 28 bp, Homo sapiens
ccctcaggatagctggcgctctcgcaga

SEQ ID NO: 4473 - DNA, 30 bp, Homo sapiens
ccctcaggatagctggcgctctcgcagacc

SEQ ID NO: 4474 - DNA, 31 bp, Homo sapiens
ccctcaggatagctggcgctctcgcagaccc

SEQ ID NO: 4475 - DNA, 32 bp, Homo sapiens
ccctcaggatagctggcgctctcgcagacccg

SEQ ID NO: 4476 - DNA, 33 bp, Homo sapiens
ccctcaggatagctggcgctctcgcagacccga

SEQ ID NO: 4477 - DNA, 28 bp, Homo sapiens
ctcaggatagctggcgctctcgcagacc

SEQ ID NO: 4478 - DNA, 30 bp, Homo sapiens
ctcaggatagctggcgctctcgcagacccg

SEQ ID NO: 4479 - DNA, 31 bp, Homo sapiens
ctcaggatagctggcgctctcgcagacccga

SEQ ID NO: 4480 - DNA, 27 bp, Homo sapiens
tcaggatagctggcgctctcgcagacc

SEQ ID NO: 4481 - DNA, 26 bp, Homo sapiens
caggatagctggcgctctcgcagacc

SEQ ID NO: 4482 - DNA, 27 bp, Homo sapiens
caggatagctggcgctctcgcagaccc

SEQ ID NO: 4483 - DNA, 28 bp, Homo sapiens
caggatagctggcgctctcgcagacccg

SEQ ID NO: 4484 - DNA, 29 bp, Homo sapiens
caggatagctggcgctctcgcagacccga

SEQ ID NO: 4485 - DNA, 16 bp, Homo sapiens
aggatagctggcgctc

SEQ ID NO: 4486 - DNA, 18 bp, Homo sapiens
aggatagctggcgctctc

SEQ ID NO: 4487 - DNA, 23 bp, Homo sapiens
aggatagctggcgctctcgcaga

SEQ ID NO: 4488 - DNA, 24 bp, Homo sapiens
aggatagctggcgctctcgcagac

SEQ ID NO: 4489 - DNA, 25 bp, Homo sapiens
aggatagctggcgctctcgcagacc

SEQ ID NO: 4490 - DNA, 26 bp, Homo sapiens
aggatagctggcgctctcgcagaccc

SEQ ID NO: 4491 - DNA, 27 bp, Homo sapiens
aggatagctggcgctctcgcagacccg

SEQ ID NO: 4492 - DNA, 28 bp, Homo sapiens
aggatagctggcgctctcgcagacccga

SEQ ID NO: 4493 - DNA, 29 bp, Homo sapiens
aggatagctggcgctctcgcagacccgac

SEQ ID NO: 4494 - DNA, 30 bp, Homo sapiens
aggatagctggcgctctcgcagacccgacg

SEQ ID NO: 4495 - DNA, 32 bp, Homo sapiens
aggatagctggcgctctcgcagacccgacgca

SEQ ID NO: 4496 - DNA, 33 bp, Homo sapiens
aggatagctggcgctctcgcagacccgacgcac

SEQ ID NO: 4497 - DNA, 24 bp, Homo sapiens
ggatagctggcgctctcgcagacc

SEQ ID NO: 4498 - DNA, 33 bp, Homo sapiens
ggatagctggcgctctcgcagacccgacgcacc

SEQ ID NO: 4499 - DNA, 32 bp, Homo sapiens
gatagctggcgctctcgcagacccgacgcacc

SEQ ID NO: 4500 - DNA, 33 bp, Homo sapiens
gatagctggcgctctcgcagacccgacgcaccc

SEQ ID NO: 4501 - DNA, 24 bp, Homo sapiens
atagctggcgctctcgcagacccg

SEQ ID NO: 4502 - DNA, 25 bp, Homo sapiens
atagctggcgctctcgcagacccga

SEQ ID NO: 4503 - DNA, 27 bp, Homo sapiens
atagctggcgctctcgcagacccgacg

SEQ ID NO: 4504 - DNA, 31 bp, Homo sapiens
atagctggcgctctcgcagacccgacgcacc

SEQ ID NO: 4505 - DNA, 32 bp, Homo sapiens
atagctggcgctctcgcagacccgacgcaccc

SEQ ID NO: 4506 - DNA, 33 bp, Homo sapiens
atagctggcgctctcgcagacccgacgcacccc

SEQ ID NO: 4507 - DNA, 30 bp, Homo sapiens
tagctggcgctctcgcagacccgacgcacc

SEQ ID NO: 4508 - DNA, 31 bp, Homo sapiens
tagctggcgctctcgcagacccgacgcaccc

SEQ ID NO: 4509 - DNA, 32 bp, Homo sapiens
tagctggcgctctcgcagacccgacgcacccc

SEQ ID NO: 4510 - DNA, 25 bp, Homo sapiens
agctggcgctctcgcagacccgacg

SEQ ID NO: 4511 - DNA, 29 bp, Homo sapiens
agctggcgctctcgcagacccgacgcacc

SEQ ID NO: 4512 - DNA, 30 bp, Homo sapiens
agctggcgctctcgcagacccgacgcaccc

SEQ ID NO: 4513 - DNA, 31 bp, Homo sapiens
agctggcgctctcgcagacccgacgcacccc

SEQ ID NO: 4514 - DNA, 32 bp, Homo sapiens
agctggcgctctcgcagacccgacgcaccccc

SEQ ID NO: 4515 - DNA, 28 bp, Homo sapiens
gctggcgctctcgcagacccgacgcacc

SEQ ID NO: 4516 - DNA, 29 bp, Homo sapiens
gctggcgctctcgcagacccgacgcaccc

SEQ ID NO: 4517 - DNA, 30 bp, Homo sapiens
gctggcgctctcgcagacccgacgcacccc

SEQ ID NO: 4518 - DNA, 27 bp, Homo sapiens
ctggcgctctcgcagacccgacgcacc

SEQ ID NO: 4519 - DNA, 28 bp, Homo sapiens
ctggcgctctcgcagacccgacgcaccc

SEQ ID NO: 4520 - DNA, 29 bp, Homo sapiens
ctggcgctctcgcagacccgacgcacccc

SEQ ID NO: 4521 - DNA, 30 bp, Homo sapiens
ctggcgctctcgcagacccgacgcaccccc

SEQ ID NO: 4522 - DNA, 17 bp, Homo sapiens
tggcgctctcgcagacc

SEQ ID NO: 4523 - DNA, 26 bp, Homo sapiens
tggcgctctcgcagacccgacgcacc

SEQ ID NO: 4524 - DNA, 27 bp, Homo sapiens
tggcgctctcgcagacccgacgcaccc

SEQ ID NO: 4525 - DNA, 28 bp, Homo sapiens
tggcgctctcgcagacccgacgcacccc

SEQ ID NO: 4526 - DNA, 22 bp, Homo sapiens
ctctcgcagacccgacgcaccc

SEQ ID NO: 4527 - DNA, 19 bp, Homo sapiens
ctcgcagacccgacgcacc

SEQ ID NO: 4528 - DNA, 20 bp, Homo sapiens
ctcgcagacccgacgcaccc

SEQ ID NO: 4529 - DNA, 21 bp, Homo sapiens
ctcgcagacccgacgcacccc

SEQ ID NO: 4530 - DNA, 33 bp, Homo sapiens
gttttatccggtaaagcgaatgattagaggtct

SEQ ID NO: 4531 - DNA, 32 bp, Homo sapiens
ttttatccggtaaagcgaatgattagaggtct

SEQ ID NO: 4532 - DNA, 33 bp, Homo sapiens
ttttatccggtaaagcgaatgattagaggtctt

SEQ ID NO: 4533 - DNA, 30 bp, Homo sapiens
ttatccggtaaagcgaatgattagaggtct

SEQ ID NO: 4534 - DNA, 31 bp, Homo sapiens
ttatccggtaaagcgaatgattagaggtctt

SEQ ID NO: 4535 - DNA, 29 bp, Homo sapiens
tatccggtaaagcgaatgattagaggtct

SEQ ID NO: 4536 - DNA, 30 bp, Homo sapiens
tatccggtaaagcgaatgattagaggtctt

SEQ ID NO: 4537 - DNA, 28 bp, Homo sapiens
atccggtaaagcgaatgattagaggtct

SEQ ID NO: 4538 - DNA, 29 bp, Homo sapiens
atccggtaaagcgaatgattagaggtctt

SEQ ID NO: 4539 - DNA, 33 bp, Homo sapiens
ccggtaaagcgaatgattagaggtcttggggcc

SEQ ID NO: 4540 - DNA, 32 bp, Homo sapiens
cggtaaagcgaatgattagaggtcttggggcc

SEQ ID NO: 4541 - DNA, 31 bp, Homo sapiens
ggtaaagcgaatgattagaggtcttggggcc

SEQ ID NO: 4542 - DNA, 23 bp, Homo sapiens
gtaaagcgaatgattagaggtct

SEQ ID NO: 4543 - DNA, 24 bp, Homo sapiens
gtaaagcgaatgattagaggtctt

SEQ ID NO: 4544 - DNA, 30 bp, Homo sapiens
gtaaagcgaatgattagaggtcttggggcc

SEQ ID NO: 4545 - DNA, 29 bp, Homo sapiens
taaagcgaatgattagaggtcttggggcc

SEQ ID NO: 4546 - DNA, 28 bp, Homo sapiens
aaagcgaatgattagaggtcttggggcc

SEQ ID NO: 4547 - DNA, 20 bp, Homo sapiens
aagcgaatgattagaggtct

SEQ ID NO: 4548 - DNA, 21 bp, Homo sapiens
aagcgaatgattagaggtctt

SEQ ID NO: 4549 - DNA, 26 bp, Homo sapiens
aagcgaatgattagaggtcttggggc

SEQ ID NO: 4550 - DNA, 27 bp, Homo sapiens
aagcgaatgattagaggtcttggggcc

SEQ ID NO: 4551 - DNA, 28 bp, Homo sapiens
aagcgaatgattagaggtcttggggccg

SEQ ID NO: 4552 - DNA, 26 bp, Homo sapiens
agcgaatgattagaggtcttggggcc

SEQ ID NO: 4553 - DNA, 25 bp, Homo sapiens
gcgaatgattagaggtcttggggcc

SEQ ID NO: 4554 - DNA, 24 bp, Homo sapiens
cgaatgattagaggtcttggggcc

SEQ ID NO: 4555 - DNA, 22 bp, Homo sapiens
gaatgattagaggtcttggggc

SEQ ID NO: 4556 - DNA, 23 bp, Homo sapiens
gaatgattagaggtcttggggcc

SEQ ID NO: 4557 - DNA, 21 bp, Homo sapiens
aatgattagaggtcttggggc

SEQ ID NO: 4558 - DNA, 22 bp, Homo sapiens
aatgattagaggtcttggggcc

SEQ ID NO: 4559 - DNA, 23 bp, Homo sapiens
aatgattagaggtcttggggccg

SEQ ID NO: 4560 - DNA, 19 bp, Homo sapiens
tgattagaggtcttggggc

SEQ ID NO: 4561 - DNA, 18 bp, Homo sapiens
gattagaggtcttggggc

SEQ ID NO: 4562 - DNA, 19 bp, Homo sapiens
gattagaggtcttggggcc

SEQ ID NO: 4563 - DNA, 17 bp, Homo sapiens
attagaggtcttggggc

SEQ ID NO: 4564 - DNA, 18 bp, Homo sapiens
attagaggtcttggggcc

SEQ ID NO: 4565 - DNA, 33 bp, Homo sapiens
attagaggtcttggggccgaaacgatctcaacc

SEQ ID NO: 4566 - DNA, 32 bp, Homo sapiens
ttagaggtcttggggccgaaacgatctcaacc

SEQ ID NO: 4567 - DNA, 33 bp, Homo sapiens
ttagaggtcttggggccgaaacgatctcaacct

SEQ ID NO: 4568 - DNA, 16 bp, Homo sapiens
tagaggtcttggggcc

SEQ ID NO: 4569 - DNA, 31 bp, Homo sapiens
tagaggtcttggggccgaaacgatctcaacc

SEQ ID NO: 4570 - DNA, 32 bp, Homo sapiens
tagaggtcttggggccgaaacgatctcaacct

SEQ ID NO: 4571 - DNA, 26 bp, Homo sapiens
agaggtcttggggccgaaacgatctc

SEQ ID NO: 4572 - DNA, 30 bp, Homo sapiens
agaggtcttggggccgaaacgatctcaacc

SEQ ID NO: 4573 - DNA, 31 bp, Homo sapiens
agaggtcttggggccgaaacgatctcaacct

SEQ ID NO: 4574 - DNA, 27 bp, Homo sapiens
gtcttggggccgaaacgatctcaacct

SEQ ID NO: 4575 - DNA, 21 bp, Homo sapiens
tcttggggccgaaacgatctc

SEQ ID NO: 4576 - DNA, 20 bp, Homo sapiens
cttggggccgaaacgatctc

SEQ ID NO: 4577 - DNA, 24 bp, Homo sapiens
cttggggccgaaacgatctcaacc

SEQ ID NO: 4578 - DNA, 23 bp, Homo sapiens
ttggggccgaaacgatctcaacc

SEQ ID NO: 4579 - DNA, 22 bp, Homo sapiens
tggggccgaaacgatctcaacc

SEQ ID NO: 4580 - DNA, 23 bp, Homo sapiens
tggggccgaaacgatctcaacct

SEQ ID NO: 4581 - DNA, 28 bp, Homo sapiens
tggggccgaaacgatctcaacctattct

SEQ ID NO: 4582 - DNA, 21 bp, Homo sapiens
ggggccgaaacgatctcaacc

SEQ ID NO: 4583 - DNA, 22 bp, Homo sapiens
ggggccgaaacgatctcaacct

SEQ ID NO: 4584 - DNA, 20 bp, Homo sapiens
gggccgaaacgatctcaacc

SEQ ID NO: 4585 - DNA, 21 bp, Homo sapiens
gggccgaaacgatctcaacct

SEQ ID NO: 4586 - DNA, 17 bp, Homo sapiens
cgaaacgatctcaacct

SEQ ID NO: 4587 - DNA, 28 bp, Homo sapiens
cgaaacgatctcaacctattctcaaact

SEQ ID NO: 4588 - DNA, 33 bp, Homo sapiens
cgaaacgatctcaacctattctcaaactttaaa

SEQ ID NO: 4589 - DNA, 16 bp, Homo sapiens
gaaacgatctcaacct

SEQ ID NO: 4590 - DNA, 27 bp, Homo sapiens
gaaacgatctcaacctattctcaaact

SEQ ID NO: 4591 - DNA, 20 bp, Homo sapiens
aaacgatctcaacctattct

SEQ ID NO: 4592 - DNA, 22 bp, Homo sapiens
aaacgatctcaacctattctca

SEQ ID NO: 4593 - DNA, 26 bp, Homo sapiens
aaacgatctcaacctattctcaaact

SEQ ID NO: 4594 - DNA, 27 bp, Homo sapiens
aaacgatctcaacctattctcaaactt

SEQ ID NO: 4595 - DNA, 29 bp, Homo sapiens
aaacgatctcaacctattctcaaacttta

SEQ ID NO: 4596 - DNA, 28 bp, Homo sapiens
aatgggtaagaagcccggctcgctggcg

SEQ ID NO: 4597 - DNA, 27 bp, Homo sapiens
atgggtaagaagcccggctcgctggcg

SEQ ID NO: 4598 - DNA, 20 bp, Homo sapiens
gtaagaagcccggctcgctg

SEQ ID NO: 4599 - DNA, 16 bp, Homo sapiens
aagaagcccggctcgc

SEQ ID NO: 4600 - DNA, 17 bp, Homo sapiens
aagaagcccggctcgct

SEQ ID NO: 4601 - DNA, 18 bp, Homo sapiens
aagaagcccggctcgctg

SEQ ID NO: 4602 - DNA, 17 bp, Homo sapiens
agaagcccggctcgctg

SEQ ID NO: 4603 - DNA, 19 bp, Homo sapiens
gcgtggaatgcgagtgcct

SEQ ID NO: 4604 - DNA, 18 bp, Homo sapiens
cgtggaatgcgagtgcct

SEQ ID NO: 4605 - DNA, 30 bp, Homo sapiens
cctagtgggccacttttggtaagcagaact

SEQ ID NO: 4606 - DNA, 28 bp, Homo sapiens
tagtgggccacttttggtaagcagaact

SEQ ID NO: 4607 - DNA, 27 bp, Homo sapiens
agtgggccacttttggtaagcagaact

SEQ ID NO: 4608 - DNA, 26 bp, Homo sapiens
gtgggccacttttggtaagcagaact

SEQ ID NO: 4609 - DNA, 25 bp, Homo sapiens
tgggccacttttggtaagcagaact

SEQ ID NO: 4610 - DNA, 24 bp, Homo sapiens
ggccacttttggtaagcagaactg

SEQ ID NO: 4611 - DNA, 20 bp, Homo sapiens
cacttttggtaagcagaact

SEQ ID NO: 4612 - DNA, 19 bp, Homo sapiens
acttttggtaagcagaact

SEQ ID NO: 4613 - DNA, 17 bp, Homo sapiens
ttttggtaagcagaact

SEQ ID NO: 4614 - DNA, 16 bp, Homo sapiens
tttggtaagcagaact

SEQ ID NO: 4615 - DNA, 29 bp, Homo sapiens
tttggtaagcagaactggcgctgcgggat

SEQ ID NO: 4616 - DNA, 30 bp, Homo sapiens
tttggtaagcagaactggcgctgcgggatg

SEQ ID NO: 4617 - DNA, 33 bp, Homo sapiens
tttggtaagcagaactggcgctgcgggatgaac

SEQ ID NO: 4618 - DNA, 33 bp, Homo sapiens
ttggtaagcagaactggcgctgcgggatgaacc

SEQ ID NO: 4619 - DNA, 25 bp, Homo sapiens
cagaactggcgctgcgggatgaacc

SEQ ID NO: 4620 - DNA, 20 bp, Homo sapiens
ctggcgctgcgggatgaacc

SEQ ID NO: 4621 - DNA, 19 bp, Homo sapiens
tggcgctgcgggatgaacc

SEQ ID NO: 4622 - DNA, 21 bp, Homo sapiens
ctgcgggatgaaccgaacgcc

SEQ ID NO: 4623 - DNA, 26 bp, Homo sapiens
ctgcgggatgaaccgaacgccgggtt

SEQ ID NO: 4624 - DNA, 19 bp, Homo sapiens
gcgggatgaaccgaacgcc

SEQ ID NO: 4625 - DNA, 18 bp, Homo sapiens
cgggatgaaccgaacgcc

SEQ ID NO: 4626 - DNA, 17 bp, Homo sapiens
gggatgaaccgaacgcc

SEQ ID NO: 4627 - DNA, 21 bp, Homo sapiens
gggatgaaccgaacgccgggt

SEQ ID NO: 4628 - DNA, 22 bp, Homo sapiens
gggatgaaccgaacgccgggtt

SEQ ID NO: 4629 - DNA, 16 bp, Homo sapiens
ggatgaaccgaacgcc

SEQ ID NO: 4630 - DNA, 20 bp, Homo sapiens
ggatgaaccgaacgccgggt

SEQ ID NO: 4631 - DNA, 21 bp, Homo sapiens
ggatgaaccgaacgccgggtt

SEQ ID NO: 4632 - DNA, 22 bp, Homo sapiens
ggatgaaccgaacgccgggtta

SEQ ID NO: 4633 - DNA, 32 bp, Homo sapiens
ggatgaaccgaacgccgggttaaggcgcccga

SEQ ID NO: 4634 - DNA, 29 bp, Homo sapiens
gatgaaccgaacgccgggttaaggcgccc

SEQ ID NO: 4635 - DNA, 31 bp, Homo sapiens
gatgaaccgaacgccgggttaaggcgcccga

SEQ ID NO: 4636 - DNA, 17 bp, Homo sapiens
gaaccgaacgccgggtt

SEQ ID NO: 4637 - DNA, 32 bp, Homo sapiens
gttaaggcgcccgatgccgacgctcatcagac

SEQ ID NO: 4638 - DNA, 29 bp, Homo sapiens
aaggcgcccgatgccgacgctcatcagac

SEQ ID NO: 4639 - DNA, 28 bp, Homo sapiens
aggcgcccgatgccgacgctcatcagac

SEQ ID NO: 4640 - DNA, 27 bp, Homo sapiens
ggcgcccgatgccgacgctcatcagac

SEQ ID NO: 4641 - DNA, 21 bp, Homo sapiens
cgatgccgacgctcatcagac

SEQ ID NO: 4642 - DNA, 22 bp, Homo sapiens
cgatgccgacgctcatcagacc

SEQ ID NO: 4643 - DNA, 19 bp, Homo sapiens
atgccgacgctcatcagac

SEQ ID NO: 4644 - DNA, 20 bp, Homo sapiens
atgccgacgctcatcagacc

SEQ ID NO: 4645 - DNA, 21 bp, Homo sapiens
atgccgacgctcatcagaccc

SEQ ID NO: 4646 - DNA, 18 bp, Homo sapiens
tgccgacgctcatcagac

SEQ ID NO: 4647 - DNA, 19 bp, Homo sapiens
tgccgacgctcatcagacc

SEQ ID NO: 4648 - DNA, 17 bp, Homo sapiens
cagaaaaggtgttggtt

SEQ ID NO: 4649 - DNA, 16 bp, Homo sapiens
agaaaaggtgttggtt

SEQ ID NO: 4650 - DNA, 33 bp, Homo sapiens
aaaaggtgttggttgatatagacagcaggacgg

SEQ ID NO: 4651 - DNA, 24 bp, Homo sapiens
gatatagacagcaggacggtggcc

SEQ ID NO: 4652 - DNA, 25 bp, Homo sapiens
gatatagacagcaggacggtggcca

SEQ ID NO: 4653 - DNA, 33 bp, Homo sapiens
gatatagacagcaggacggtggccatggaagtc

SEQ ID NO: 4654 - DNA, 27 bp, Homo sapiens
acagcaggacggtggccatggaagtcg

SEQ ID NO: 4655 - DNA, 33 bp, Homo sapiens
acagcaggacggtggccatggaagtcggaatcc

SEQ ID NO: 4656 - DNA, 32 bp, Homo sapiens
cagcaggacggtggccatggaagtcggaatcc

SEQ ID NO: 4657 - DNA, 16 bp, Homo sapiens
agcaggacggtggcca

SEQ ID NO: 4658 - DNA, 25 bp, Homo sapiens
agcaggacggtggccatggaagtcg

SEQ ID NO: 4659 - DNA, 31 bp, Homo sapiens
agcaggacggtggccatggaagtcggaatcc

SEQ ID NO: 4660 - DNA, 33 bp, Homo sapiens
agcaggacggtggccatggaagtcggaatccgc

SEQ ID NO: 4661 - DNA, 30 bp, Homo sapiens
gcaggacggtggccatggaagtcggaatcc

SEQ ID NO: 4662 - DNA, 29 bp, Homo sapiens
caggacggtggccatggaagtcggaatcc

SEQ ID NO: 4663 - DNA, 32 bp, Homo sapiens
caggacggtggccatggaagtcggaatccgct

SEQ ID NO: 4664 - DNA, 21 bp, Homo sapiens
gtggccatggaagtcggaatc

SEQ ID NO: 4665 - DNA, 22 bp, Homo sapiens
gtggccatggaagtcggaatcc

SEQ ID NO: 4666 - DNA, 20 bp, Homo sapiens
tggccatggaagtcggaatc

SEQ ID NO: 4667 - DNA, 21 bp, Homo sapiens
tggccatggaagtcggaatcc

SEQ ID NO: 4668 - DNA, 20 bp, Homo sapiens
ggccatggaagtcggaatcc

SEQ ID NO: 4669 - DNA, 19 bp, Homo sapiens
gccatggaagtcggaatcc

SEQ ID NO: 4670 - DNA, 20 bp, Homo sapiens
gccatggaagtcggaatccg

SEQ ID NO: 4671 - DNA, 27 bp, Homo sapiens
gccatggaagtcggaatccgctaagga

SEQ ID NO: 4672 - DNA, 30 bp, Homo sapiens
gccatggaagtcggaatccgctaaggagtg

SEQ ID NO: 4673 - DNA, 17 bp, Homo sapiens
catggaagtcggaatcc

SEQ ID NO: 4674 - DNA, 25 bp, Homo sapiens
catggaagtcggaatccgctaagga

SEQ ID NO: 4675 - DNA, 27 bp, Homo sapiens
catggaagtcggaatccgctaaggagt

SEQ ID NO: 4676 - DNA, 28 bp, Homo sapiens
catggaagtcggaatccgctaaggagtg

SEQ ID NO: 4677 - DNA, 16 bp, Homo sapiens
atggaagtcggaatcc

SEQ ID NO: 4678 - DNA, 19 bp, Homo sapiens
atggaagtcggaatccgct

SEQ ID NO: 4679 - DNA, 24 bp, Homo sapiens
atggaagtcggaatccgctaagga

SEQ ID NO: 4680 - DNA, 25 bp, Homo sapiens
atggaagtcggaatccgctaaggag

SEQ ID NO: 4681 - DNA, 26 bp, Homo sapiens
atggaagtcggaatccgctaaggagt

SEQ ID NO: 4682 - DNA, 27 bp, Homo sapiens
atggaagtcggaatccgctaaggagtg

SEQ ID NO: 4683 - DNA, 17 bp, Homo sapiens
ggaagtcggaatccgct

SEQ ID NO: 4684 - DNA, 22 bp, Homo sapiens
ggaagtcggaatccgctaagga

SEQ ID NO: 4685 - DNA, 21 bp, Homo sapiens
gaagtcggaatccgctaagga

SEQ ID NO: 4686 - DNA, 21 bp, Homo sapiens
gctaaggagtgtgtaacaact

SEQ ID NO: 4687 - DNA, 28 bp, Homo sapiens
aaaatggatggcgctggagcgtcgggcc

SEQ ID NO: 4688 - DNA, 27 bp, Homo sapiens
aaatggatggcgctggagcgtcgggcc

SEQ ID NO: 4689 - DNA, 18 bp, Homo sapiens
aatggatggcgctggagc

SEQ ID NO: 4690 - DNA, 26 bp, Homo sapiens
aatggatggcgctggagcgtcgggcc

SEQ ID NO: 4691 - DNA, 27 bp, Homo sapiens
aatggatggcgctggagcgtcgggccc

SEQ ID NO: 4692 - DNA, 28 bp, Homo sapiens
aatggatggcgctggagcgtcgggccca

SEQ ID NO: 4693 - DNA, 29 bp, Homo sapiens
aatggatggcgctggagcgtcgggcccat

SEQ ID NO: 4694 - DNA, 16 bp, Homo sapiens
atggatggcgctggag

SEQ ID NO: 4695 - DNA, 17 bp, Homo sapiens
atggatggcgctggagc

SEQ ID NO: 4696 - DNA, 25 bp, Homo sapiens
atggatggcgctggagcgtcgggcc

SEQ ID NO: 4697 - DNA, 26 bp, Homo sapiens
atggatggcgctggagcgtcgggccc

SEQ ID NO: 4698 - DNA, 27 bp, Homo sapiens
atggatggcgctggagcgtcgggccca

SEQ ID NO: 4699 - DNA, 23 bp, Homo sapiens
ggatggcgctggagcgtcgggcc

SEQ ID NO: 4700 - DNA, 24 bp, Homo sapiens
ggatggcgctggagcgtcgggccc

SEQ ID NO: 4701 - DNA, 22 bp, Homo sapiens
gatggcgctggagcgtcgggcc

SEQ ID NO: 4702 - DNA, 23 bp, Homo sapiens
gatggcgctggagcgtcgggccc

SEQ ID NO: 4703 - DNA, 24 bp, Homo sapiens
gatggcgctggagcgtcgggccca

SEQ ID NO: 4704 - DNA, 25 bp, Homo sapiens
gatggcgctggagcgtcgggcccat

SEQ ID NO: 4705 - DNA, 21 bp, Homo sapiens
atggcgctggagcgtcgggcc

SEQ ID NO: 4706 - DNA, 22 bp, Homo sapiens
atggcgctggagcgtcgggccc

SEQ ID NO: 4707 - DNA, 20 bp, Homo sapiens
tggcgctggagcgtcgggcc

SEQ ID NO: 4708 - DNA, 21 bp, Homo sapiens
tggcgctggagcgtcgggccc

SEQ ID NO: 4709 - DNA, 19 bp, Homo sapiens
ggcgctggagcgtcgggcc

SEQ ID NO: 4710 - DNA, 20 bp, Homo sapiens
ggcgctggagcgtcgggccc

SEQ ID NO: 4711 - DNA, 19 bp, Homo sapiens
gcgctggagcgtcgggccc

SEQ ID NO: 4712 - DNA, 26 bp, Homo sapiens
cgtcgggcccatacccggccgtcgcc

SEQ ID NO: 4713 - DNA, 33 bp, Homo sapiens
cgtcgggcccatacccggccgtcgccggcagtc

SEQ ID NO: 4714 - DNA, 32 bp, Homo sapiens
gtcgggcccatacccggccgtcgccggcagtc

SEQ ID NO: 4715 - DNA, 24 bp, Homo sapiens
gggcccatacccggccgtcgccgg

SEQ ID NO: 4716 - DNA, 28 bp, Homo sapiens
gggcccatacccggccgtcgccggcagt

SEQ ID NO: 4717 - DNA, 27 bp, Homo sapiens
ggcccatacccggccgtcgccggcagt

SEQ ID NO: 4718 - DNA, 28 bp, Homo sapiens
ggcccatacccggccgtcgccggcagtc

SEQ ID NO: 4719 - DNA, 33 bp, Homo sapiens
ggcccatacccggccgtcgccggcagtcgagag

SEQ ID NO: 4720 - DNA, 27 bp, Homo sapiens
gcccatacccggccgtcgccggcagtc

SEQ ID NO: 4721 - DNA, 17 bp, Homo sapiens
catacccggccgtcgcc

SEQ ID NO: 4722 - DNA, 18 bp, Homo sapiens
catacccggccgtcgccg

SEQ ID NO: 4723 - DNA, 16 bp, Homo sapiens
atacccggccgtcgcc

SEQ ID NO: 4724 - DNA, 17 bp, Homo sapiens
atacccggccgtcgccg

SEQ ID NO: 4725 - DNA, 16 bp, Homo sapiens
tacccggccgtcgccg

SEQ ID NO: 4726 - DNA, 30 bp, Homo sapiens
cccggccgtcgccggcagtcgagagtggac

SEQ ID NO: 4727 - DNA, 17 bp, Homo sapiens
ggcagtcgagagtggac

SEQ ID NO: 4728 - DNA, 18 bp, Homo sapiens
ggcagtcgagagtggacg

SEQ ID NO: 4729 - DNA, 19 bp, Homo sapiens
ggcagtcgagagtggacgg

SEQ ID NO: 4730 - DNA, 16 bp, Homo sapiens
gcagtcgagagtggac

SEQ ID NO: 4731 - DNA, 17 bp, Homo sapiens
gcagtcgagagtggacg

SEQ ID NO: 4732 - DNA, 32 bp, Homo sapiens
gccccgctccccgcccccggagccccgcggac

SEQ ID NO: 4733 - DNA, 28 bp, Homo sapiens
cgctccccgcccccggagccccgcggac

SEQ ID NO: 4734 - DNA, 27 bp, Homo sapiens
gctccccgcccccggagccccgcggac

SEQ ID NO: 4735 - DNA, 26 bp, Homo sapiens
tccccgcccccggagccccgcggacg

SEQ ID NO: 4736 - DNA, 23 bp, Homo sapiens
cccgcccccggagccccgcggac

SEQ ID NO: 4737 - DNA, 22 bp, Homo sapiens
ccgcccccggagccccgcggac

SEQ ID NO: 4738 - DNA, 21 bp, Homo sapiens
cgcccccggagccccgcggac

SEQ ID NO: 4739 - DNA, 16 bp, Homo sapiens
ccggagccccgcggac

SEQ ID NO: 4740 - DNA, 17 bp, Homo sapiens
aggagggccgctgcggt

SEQ ID NO: 4741 - DNA, 31 bp, Homo sapiens
agggccgctgcggtgagccttgaagcctagg

SEQ ID NO: 4742 - DNA, 32 bp, Homo sapiens
agggccgctgcggtgagccttgaagcctaggg

SEQ ID NO: 4743 - DNA, 33 bp, Homo sapiens
agggccgctgcggtgagccttgaagcctagggc

SEQ ID NO: 4744 - DNA, 25 bp, Homo sapiens
gccgctgcggtgagccttgaagcct

SEQ ID NO: 4745 - DNA, 33 bp, Homo sapiens
caaatattcaaacgagaactttgaaggccgaag

SEQ ID NO: 4746 - DNA, 32 bp, Homo sapiens
aaatattcaaacgagaactttgaaggccgaag

SEQ ID NO: 4747 - DNA, 27 bp, Homo sapiens
aatattcaaacgagaactttgaaggcc

SEQ ID NO: 4748 - DNA, 31 bp, Homo sapiens
aatattcaaacgagaactttgaaggccgaag

SEQ ID NO: 4749 - DNA, 26 bp, Homo sapiens
atattcaaacgagaactttgaaggcc

SEQ ID NO: 4750 - DNA, 27 bp, Homo sapiens
atattcaaacgagaactttgaaggccg

SEQ ID NO: 4751 - DNA, 30 bp, Homo sapiens
atattcaaacgagaactttgaaggccgaag

SEQ ID NO: 4752 - DNA, 25 bp, Homo sapiens
tattcaaacgagaactttgaaggcc

SEQ ID NO: 4753 - DNA, 26 bp, Homo sapiens
tattcaaacgagaactttgaaggccg

SEQ ID NO: 4754 - DNA, 29 bp, Homo sapiens
tattcaaacgagaactttgaaggccgaag

SEQ ID NO: 4755 - DNA, 24 bp, Homo sapiens
attcaaacgagaactttgaaggcc

SEQ ID NO: 4756 - DNA, 25 bp, Homo sapiens
attcaaacgagaactttgaaggccg

SEQ ID NO: 4757 - DNA, 28 bp, Homo sapiens
attcaaacgagaactttgaaggccgaag

SEQ ID NO: 4758 - DNA, 29 bp, Homo sapiens
attcaaacgagaactttgaaggccgaagt

SEQ ID NO: 4759 - DNA, 30 bp, Homo sapiens
attcaaacgagaactttgaaggccgaagtg

SEQ ID NO: 4760 - DNA, 22 bp, Homo sapiens
ttcaaacgagaactttgaaggc

SEQ ID NO: 4761 - DNA, 23 bp, Homo sapiens
ttcaaacgagaactttgaaggcc

SEQ ID NO: 4762 - DNA, 24 bp, Homo sapiens
ttcaaacgagaactttgaaggccg

SEQ ID NO: 4763 - DNA, 26 bp, Homo sapiens
ttcaaacgagaactttgaaggccgaa

SEQ ID NO: 4764 - DNA, 27 bp, Homo sapiens
ttcaaacgagaactttgaaggccgaag

SEQ ID NO: 4765 - DNA, 28 bp, Homo sapiens
ttcaaacgagaactttgaaggccgaagt

SEQ ID NO: 4766 - DNA, 29 bp, Homo sapiens
ttcaaacgagaactttgaaggccgaagtg

SEQ ID NO: 4767 - DNA, 33 bp, Homo sapiens
ttcaaacgagaactttgaaggccgaagtggaga

SEQ ID NO: 4768 - DNA, 18 bp, Homo sapiens
tcaaacgagaactttgaa

SEQ ID NO: 4769 - DNA, 21 bp, Homo sapiens
tcaaacgagaactttgaaggc

SEQ ID NO: 4770 - DNA, 22 bp, Homo sapiens
tcaaacgagaactttgaaggcc

SEQ ID NO: 4771 - DNA, 23 bp, Homo sapiens
tcaaacgagaactttgaaggccg

SEQ ID NO: 4772 - DNA, 24 bp, Homo sapiens
tcaaacgagaactttgaaggccga

SEQ ID NO: 4773 - DNA, 25 bp, Homo sapiens
tcaaacgagaactttgaaggccgaa

SEQ ID NO: 4774 - DNA, 26 bp, Homo sapiens
tcaaacgagaactttgaaggccgaag

SEQ ID NO: 4775 - DNA, 27 bp, Homo sapiens
tcaaacgagaactttgaaggccgaagt

SEQ ID NO: 4776 - DNA, 29 bp, Homo sapiens
tcaaacgagaactttgaaggccgaagtgg

SEQ ID NO: 4777 - DNA, 32 bp, Homo sapiens
tcaaacgagaactttgaaggccgaagtggaga

SEQ ID NO: 4778 - DNA, 33 bp, Homo sapiens
tcaaacgagaactttgaaggccgaagtggagaa

SEQ ID NO: 4779 - DNA, 17 bp, Homo sapiens
caaacgagaactttgaa

SEQ ID NO: 4780 - DNA, 18 bp, Homo sapiens
caaacgagaactttgaag

SEQ ID NO: 4781 - DNA, 20 bp, Homo sapiens
caaacgagaactttgaaggc

SEQ ID NO: 4782 - DNA, 21 bp, Homo sapiens
caaacgagaactttgaaggcc

SEQ ID NO: 4783 - DNA, 22 bp, Homo sapiens
caaacgagaactttgaaggccg

SEQ ID NO: 4784 - DNA, 23 bp, Homo sapiens
caaacgagaactttgaaggccga

SEQ ID NO: 4785 - DNA, 24 bp, Homo sapiens
caaacgagaactttgaaggccgaa

SEQ ID NO: 4786 - DNA, 25 bp, Homo sapiens
caaacgagaactttgaaggccgaag

SEQ ID NO: 4787 - DNA, 26 bp, Homo sapiens
caaacgagaactttgaaggccgaagt

SEQ ID NO: 4788 - DNA, 27 bp, Homo sapiens
caaacgagaactttgaaggccgaagtg

SEQ ID NO: 4789 - DNA, 28 bp, Homo sapiens
caaacgagaactttgaaggccgaagtgg

SEQ ID NO: 4790 - DNA, 29 bp, Homo sapiens
caaacgagaactttgaaggccgaagtgga

SEQ ID NO: 4791 - DNA, 31 bp, Homo sapiens
caaacgagaactttgaaggccgaagtggaga

SEQ ID NO: 4792 - DNA, 32 bp, Homo sapiens
caaacgagaactttgaaggccgaagtggagaa

SEQ ID NO: 4793 - DNA, 33 bp, Homo sapiens
caaacgagaactttgaaggccgaagtggagaag

SEQ ID NO: 4794 - DNA, 16 bp, Homo sapiens
aaacgagaactttgaa

SEQ ID NO: 4795 - DNA, 17 bp, Homo sapiens
aaacgagaactttgaag

SEQ ID NO: 4796 - DNA, 18 bp, Homo sapiens
aaacgagaactttgaagg

SEQ ID NO: 4797 - DNA, 19 bp, Homo sapiens
aaacgagaactttgaaggc

SEQ ID NO: 4798 - DNA, 20 bp, Homo sapiens
aaacgagaactttgaaggcc

SEQ ID NO: 4799 - DNA, 21 bp, Homo sapiens
aaacgagaactttgaaggccg

SEQ ID NO: 4800 - DNA, 22 bp, Homo sapiens
aaacgagaactttgaaggccga

SEQ ID NO: 4801 - DNA, 23 bp, Homo sapiens
aaacgagaactttgaaggccgaa

SEQ ID NO: 4802 - DNA, 24 bp, Homo sapiens
aaacgagaactttgaaggccgaag

SEQ ID NO: 4803 - DNA, 25 bp, Homo sapiens
aaacgagaactttgaaggccgaagt

SEQ ID NO: 4804 - DNA, 26 bp, Homo sapiens
aaacgagaactttgaaggccgaagtg

SEQ ID NO: 4805 - DNA, 27 bp, Homo sapiens
aaacgagaactttgaaggccgaagtgg

SEQ ID NO: 4806 - DNA, 28 bp, Homo sapiens
aaacgagaactttgaaggccgaagtgga

SEQ ID NO: 4807 - DNA, 29 bp, Homo sapiens
aaacgagaactttgaaggccgaagtggag

SEQ ID NO: 4808 - DNA, 30 bp, Homo sapiens
aaacgagaactttgaaggccgaagtggaga

SEQ ID NO: 4809 - DNA, 31 bp, Homo sapiens
aaacgagaactttgaaggccgaagtggagaa

SEQ ID NO: 4810 - DNA, 32 bp, Homo sapiens
aaacgagaactttgaaggccgaagtggagaag

SEQ ID NO: 4811 - DNA, 33 bp, Homo sapiens
aaacgagaactttgaaggccgaagtggagaagg

SEQ ID NO: 4812 - DNA, 16 bp, Homo sapiens
aacgagaactttgaag

SEQ ID NO: 4813 - DNA, 17 bp, Homo sapiens
aacgagaactttgaagg

SEQ ID NO: 4814 - DNA, 18 bp, Homo sapiens
aacgagaactttgaaggc

SEQ ID NO: 4815 - DNA, 19 bp, Homo sapiens
aacgagaactttgaaggcc

SEQ ID NO: 4816 - DNA, 20 bp, Homo sapiens
aacgagaactttgaaggccg

SEQ ID NO: 4817 - DNA, 21 bp, Homo sapiens
aacgagaactttgaaggccga

SEQ ID NO: 4818 - DNA, 22 bp, Homo sapiens
aacgagaactttgaaggccgaa

SEQ ID NO: 4819 - DNA, 23 bp, Homo sapiens
aacgagaactttgaaggccgaag

SEQ ID NO: 4820 - DNA, 24 bp, Homo sapiens
aacgagaactttgaaggccgaagt

SEQ ID NO: 4821 - DNA, 25 bp, Homo sapiens
aacgagaactttgaaggccgaagtg

SEQ ID NO: 4822 - DNA, 26 bp, Homo sapiens
aacgagaactttgaaggccgaagtgg

SEQ ID NO: 4823 - DNA, 27 bp, Homo sapiens
aacgagaactttgaaggccgaagtgga

SEQ ID NO: 4824 - DNA, 28 bp, Homo sapiens
aacgagaactttgaaggccgaagtggag

SEQ ID NO: 4825 - DNA, 29 bp, Homo sapiens
aacgagaactttgaaggccgaagtggaga

SEQ ID NO: 4826 - DNA, 30 bp, Homo sapiens
aacgagaactttgaaggccgaagtggagaa

SEQ ID NO: 4827 - DNA, 31 bp, Homo sapiens
aacgagaactttgaaggccgaagtggagaag

SEQ ID NO: 4828 - DNA, 32 bp, Homo sapiens
aacgagaactttgaaggccgaagtggagaagg

SEQ ID NO: 4829 - DNA, 33 bp, Homo sapiens
aacgagaactttgaaggccgaagtggagaaggg

SEQ ID NO: 4830 - DNA, 16 bp, Homo sapiens
acgagaactttgaagg

SEQ ID NO: 4831 - DNA, 17 bp, Homo sapiens
acgagaactttgaaggc

SEQ ID NO: 4832 - DNA, 18 bp, Homo sapiens
acgagaactttgaaggcc

SEQ ID NO: 4833 - DNA, 19 bp, Homo sapiens
acgagaactttgaaggccg

SEQ ID NO: 4834 - DNA, 20 bp, Homo sapiens
acgagaactttgaaggccga

SEQ ID NO: 4835 - DNA, 21 bp, Homo sapiens
acgagaactttgaaggccgaa

SEQ ID NO: 4836 - DNA, 22 bp, Homo sapiens
acgagaactttgaaggccgaag

SEQ ID NO: 4837 - DNA, 23 bp, Homo sapiens
acgagaactttgaaggccgaagt

SEQ ID NO: 4838 - DNA, 24 bp, Homo sapiens
acgagaactttgaaggccgaagtg

SEQ ID NO: 4839 - DNA, 25 bp, Homo sapiens
acgagaactttgaaggccgaagtgg

SEQ ID NO: 4840 - DNA, 26 bp, Homo sapiens
acgagaactttgaaggccgaagtgga

SEQ ID NO: 4841 - DNA, 28 bp, Homo sapiens
acgagaactttgaaggccgaagtggaga

SEQ ID NO: 4842 - DNA, 29 bp, Homo sapiens
acgagaactttgaaggccgaagtggagaa

SEQ ID NO: 4843 - DNA, 30 bp, Homo sapiens
acgagaactttgaaggccgaagtggagaag

SEQ ID NO: 4844 - DNA, 31 bp, Homo sapiens
acgagaactttgaaggccgaagtggagaagg

SEQ ID NO: 4845 - DNA, 32 bp, Homo sapiens
acgagaactttgaaggccgaagtggagaaggg

SEQ ID NO: 4846 - DNA, 33 bp, Homo sapiens
acgagaactttgaaggccgaagtggagaagggt

SEQ ID NO: 4847 - DNA, 16 bp, Homo sapiens
cgagaactttgaaggc

SEQ ID NO: 4848 - DNA, 17 bp, Homo sapiens
cgagaactttgaaggcc

SEQ ID NO: 4849 - DNA, 18 bp, Homo sapiens
cgagaactttgaaggccg

SEQ ID NO: 4850 - DNA, 19 bp, Homo sapiens
cgagaactttgaaggccga

SEQ ID NO: 4851 - DNA, 20 bp, Homo sapiens
cgagaactttgaaggccgaa

SEQ ID NO: 4852 - DNA, 21 bp, Homo sapiens
cgagaactttgaaggccgaag

SEQ ID NO: 4853 - DNA, 22 bp, Homo sapiens
cgagaactttgaaggccgaagt

SEQ ID NO: 4854 - DNA, 27 bp, Homo sapiens
cgagaactttgaaggccgaagtggaga

SEQ ID NO: 4855 - DNA, 29 bp, Homo sapiens
cgagaactttgaaggccgaagtggagaag

SEQ ID NO: 4856 - DNA, 30 bp, Homo sapiens
cgagaactttgaaggccgaagtggagaagg

SEQ ID NO: 4857 - DNA, 32 bp, Homo sapiens
cgagaactttgaaggccgaagtggagaagggt

SEQ ID NO: 4858 - DNA, 33 bp, Homo sapiens
cgagaactttgaaggccgaagtggagaagggtt

SEQ ID NO: 4859 - DNA, 16 bp, Homo sapiens
gagaactttgaaggcc

SEQ ID NO: 4860 - DNA, 19 bp, Homo sapiens
gagaactttgaaggccgaa

SEQ ID NO: 4861 - DNA, 20 bp, Homo sapiens
gagaactttgaaggccgaag

SEQ ID NO: 4862 - DNA, 21 bp, Homo sapiens
gagaactttgaaggccgaagt

SEQ ID NO: 4863 - DNA, 19 bp, Homo sapiens
agaactttgaaggccgaag

SEQ ID NO: 4864 - DNA, 20 bp, Homo sapiens
agaactttgaaggccgaagt

SEQ ID NO: 4865 - DNA, 30 bp, Homo sapiens
agaactttgaaggccgaagtggagaagggt

SEQ ID NO: 4866 - DNA, 24 bp, Homo sapiens
ttgaaggccgaagtggagaagggt

SEQ ID NO: 4867 - DNA, 33 bp, Homo sapiens
ttgaaggccgaagtggagaagggttccatgtga

SEQ ID NO: 4868 - DNA, 22 bp, Homo sapiens
tccatgtgaacagcagttgaac

SEQ ID NO: 4869 - DNA, 30 bp, Homo sapiens
acagcagttgaacatgggtcagtcggtcct

SEQ ID NO: 4870 - DNA, 23 bp, Homo sapiens
cagcagttgaacatgggtcagtc

SEQ ID NO: 4871 - DNA, 29 bp, Homo sapiens
cagcagttgaacatgggtcagtcggtcct

SEQ ID NO: 4872 - DNA, 30 bp, Homo sapiens
cagcagttgaacatgggtcagtcggtcctg

SEQ ID NO: 4873 - DNA, 26 bp, Homo sapiens
agcagttgaacatgggtcagtcggtc

SEQ ID NO: 4874 - DNA, 28 bp, Homo sapiens
agcagttgaacatgggtcagtcggtcct

SEQ ID NO: 4875 - DNA, 29 bp, Homo sapiens
agcagttgaacatgggtcagtcggtcctg

SEQ ID NO: 4876 - DNA, 33 bp, Homo sapiens
agcagttgaacatgggtcagtcggtcctgagag

SEQ ID NO: 4877 - DNA, 27 bp, Homo sapiens
gcagttgaacatgggtcagtcggtcct

SEQ ID NO: 4878 - DNA, 28 bp, Homo sapiens
gcagttgaacatgggtcagtcggtcctg

SEQ ID NO: 4879 - DNA, 31 bp, Homo sapiens
gcagttgaacatgggtcagtcggtcctgaga

SEQ ID NO: 4880 - DNA, 32 bp, Homo sapiens
gcagttgaacatgggtcagtcggtcctgagag

SEQ ID NO: 4881 - DNA, 33 bp, Homo sapiens
gcagttgaacatgggtcagtcggtcctgagaga

SEQ ID NO: 4882 - DNA, 26 bp, Homo sapiens
cagttgaacatgggtcagtcggtcct

SEQ ID NO: 4883 - DNA, 33 bp, Homo sapiens
cagttgaacatgggtcagtcggtcctgagagat

SEQ ID NO: 4884 - DNA, 20 bp, Homo sapiens
gaacatgggtcagtcggtcc

SEQ ID NO: 4885 - DNA, 21 bp, Homo sapiens
gaacatgggtcagtcggtcct

SEQ ID NO: 4886 - DNA, 22 bp, Homo sapiens
gaacatgggtcagtcggtcctg

SEQ ID NO: 4887 - DNA, 25 bp, Homo sapiens
gaacatgggtcagtcggtcctgaga

SEQ ID NO: 4888 - DNA, 26 bp, Homo sapiens
gaacatgggtcagtcggtcctgagag

SEQ ID NO: 4889 - DNA, 27 bp, Homo sapiens
gaacatgggtcagtcggtcctgagaga

SEQ ID NO: 4890 - DNA, 28 bp, Homo sapiens
gaacatgggtcagtcggtcctgagagat

SEQ ID NO: 4891 - DNA, 29 bp, Homo sapiens
gaacatgggtcagtcggtcctgagagatg

SEQ ID NO: 4892 - DNA, 32 bp, Homo sapiens
gaacatgggtcagtcggtcctgagagatgggc

SEQ ID NO: 4893 - DNA, 20 bp, Homo sapiens
aacatgggtcagtcggtcct

SEQ ID NO: 4894 - DNA, 31 bp, Homo sapiens
aacatgggtcagtcggtcctgagagatgggc

SEQ ID NO: 4895 - DNA, 32 bp, Homo sapiens
ggtcagtcggtcctgagagatgggcgagcgcc

SEQ ID NO: 4896 - DNA, 17 bp, Homo sapiens
gtcagtcggtcctgaga

SEQ ID NO: 4897 - DNA, 24 bp, Homo sapiens
gtcagtcggtcctgagagatgggc

SEQ ID NO: 4898 - DNA, 28 bp, Homo sapiens
gtcagtcggtcctgagagatgggcgagc

SEQ ID NO: 4899 - DNA, 31 bp, Homo sapiens
gtcagtcggtcctgagagatgggcgagcgcc

SEQ ID NO: 4900 - DNA, 32 bp, Homo sapiens
gtcagtcggtcctgagagatgggcgagcgccg

SEQ ID NO: 4901 - DNA, 30 bp, Homo sapiens
tcagtcggtcctgagagatgggcgagcgcc

SEQ ID NO: 4902 - DNA, 17 bp, Homo sapiens
cagtcggtcctgagaga

SEQ ID NO: 4903 - DNA, 29 bp, Homo sapiens
cagtcggtcctgagagatgggcgagcgcc

SEQ ID NO: 4904 - DNA, 28 bp, Homo sapiens
agtcggtcctgagagatgggcgagcgcc

SEQ ID NO: 4905 - DNA, 27 bp, Homo sapiens
gtcggtcctgagagatgggcgagcgcc

SEQ ID NO: 4906 - DNA, 17 bp, Homo sapiens
ggtcctgagagatgggc

SEQ ID NO: 4907 - DNA, 28 bp, Homo sapiens
ggtcctgagagatgggcgagcgccgttc

SEQ ID NO: 4908 - DNA, 33 bp, Homo sapiens
ggtcctgagagatgggcgagcgccgttccgaag

SEQ ID NO: 4909 - DNA, 28 bp, Homo sapiens
gtcctgagagatgggcgagcgccgttcc

SEQ ID NO: 4910 - DNA, 32 bp, Homo sapiens
gtcctgagagatgggcgagcgccgttccgaag

SEQ ID NO: 4911 - DNA, 17 bp, Homo sapiens
agagatgggcgagcgcc

SEQ ID NO: 4912 - DNA, 30 bp, Homo sapiens
atgggcgagcgccgttccgaagggacgggc

SEQ ID NO: 4913 - DNA, 17 bp, Homo sapiens
gttccgaagggacgggc

SEQ ID NO: 4914 - DNA, 28 bp, Homo sapiens
cgggcgatggcctccgttgccctcggcc

SEQ ID NO: 4915 - DNA, 23 bp, Homo sapiens
gatggcctccgttgccctcggcc

SEQ ID NO: 4916 - DNA, 24 bp, Homo sapiens
gatggcctccgttgccctcggccg

SEQ ID NO: 4917 - DNA, 28 bp, Homo sapiens
gatggcctccgttgccctcggccgatcg

SEQ ID NO: 4918 - DNA, 21 bp, Homo sapiens
atggcctccgttgccctcggc

SEQ ID NO: 4919 - DNA, 22 bp, Homo sapiens
atggcctccgttgccctcggcc

SEQ ID NO: 4920 - DNA, 21 bp, Homo sapiens
tggcctccgttgccctcggcc

SEQ ID NO: 4921 - DNA, 16 bp, Homo sapiens
tccgttgccctcggcc

SEQ ID NO: 4922 - DNA, 31 bp, Homo sapiens
tccgttgccctcggccgatcgaaagggagtc

SEQ ID NO: 4923 - DNA, 28 bp, Homo sapiens
gttgccctcggccgatcgaaagggagtc

SEQ ID NO: 4924 - DNA, 30 bp, Homo sapiens
gttgccctcggccgatcgaaagggagtcgg

SEQ ID NO: 4925 - DNA, 16 bp, Homo sapiens
ttgccctcggccgatc

SEQ ID NO: 4926 - DNA, 17 bp, Homo sapiens
ttgccctcggccgatcg

SEQ ID NO: 4927 - DNA, 27 bp, Homo sapiens
ttgccctcggccgatcgaaagggagtc

SEQ ID NO: 4928 - DNA, 29 bp, Homo sapiens
ttgccctcggccgatcgaaagggagtcgg

SEQ ID NO: 4929 - DNA, 30 bp, Homo sapiens
ttgccctcggccgatcgaaagggagtcggg

SEQ ID NO: 4930 - DNA, 28 bp, Homo sapiens
tgccctcggccgatcgaaagggagtcgg

SEQ ID NO: 4931 - DNA, 29 bp, Homo sapiens
tgccctcggccgatcgaaagggagtcggg

SEQ ID NO: 4932 - DNA, 25 bp, Homo sapiens
gccctcggccgatcgaaagggagtc

SEQ ID NO: 4933 - DNA, 24 bp, Homo sapiens
ctcggccgatcgaaagggagtcgg

SEQ ID NO: 4934 - DNA, 22 bp, Homo sapiens
aaagggagtcgggttcagatcc

SEQ ID NO: 4935 - DNA, 20 bp, Homo sapiens
agggagtcgggttcagatcc

SEQ ID NO: 4936 - DNA, 19 bp, Homo sapiens
gggagtcgggttcagatcc

SEQ ID NO: 4937 - DNA, 33 bp, Homo sapiens
gggttcagatccccgaatccggagtggcggaga

SEQ ID NO: 4938 - DNA, 26 bp, Homo sapiens
ccgaatccggagtggcggagatgggc

SEQ ID NO: 4939 - DNA, 27 bp, Homo sapiens
gaatccggagtggcggagatgggcgcc

SEQ ID NO: 4940 - DNA, 23 bp, Homo sapiens
aatccggagtggcggagatgggc

SEQ ID NO: 4941 - DNA, 29 bp, Homo sapiens
gcgaggcgtccagtgcggtaacgcgaccg

SEQ ID NO: 4942 - DNA, 27 bp, Homo sapiens
cagtgcggtaacgcgaccgatcccgga

SEQ ID NO: 4943 - DNA, 29 bp, Homo sapiens
cagtgcggtaacgcgaccgatcccggaga

SEQ ID NO: 4944 - DNA, 30 bp, Homo sapiens
cagtgcggtaacgcgaccgatcccggagaa

SEQ ID NO: 4945 - DNA, 32 bp, Homo sapiens
cagtgcggtaacgcgaccgatcccggagaagc

SEQ ID NO: 4946 - DNA, 33 bp, Homo sapiens
cagtgcggtaacgcgaccgatcccggagaagcc

SEQ ID NO: 4947 - DNA, 16 bp, Homo sapiens
agtgcggtaacgcgac

SEQ ID NO: 4948 - DNA, 26 bp, Homo sapiens
agtgcggtaacgcgaccgatcccgga

SEQ ID NO: 4949 - DNA, 28 bp, Homo sapiens
agtgcggtaacgcgaccgatcccggaga

SEQ ID NO: 4950 - DNA, 30 bp, Homo sapiens
agtgcggtaacgcgaccgatcccggagaag

SEQ ID NO: 4951 - DNA, 31 bp, Homo sapiens
agtgcggtaacgcgaccgatcccggagaagc

SEQ ID NO: 4952 - DNA, 32 bp, Homo sapiens
agtgcggtaacgcgaccgatcccggagaagcc

SEQ ID NO: 4953 - DNA, 33 bp, Homo sapiens
agtgcggtaacgcgaccgatcccggagaagccg

SEQ ID NO: 4954 - DNA, 25 bp, Homo sapiens
gtgcggtaacgcgaccgatcccgga

SEQ ID NO: 4955 - DNA, 27 bp, Homo sapiens
gtgcggtaacgcgaccgatcccggaga

SEQ ID NO: 4956 - DNA, 30 bp, Homo sapiens
gtgcggtaacgcgaccgatcccggagaagc

SEQ ID NO: 4957 - DNA, 31 bp, Homo sapiens
gtgcggtaacgcgaccgatcccggagaagcc

SEQ ID NO: 4958 - DNA, 23 bp, Homo sapiens
ggtaacgcgaccgatcccggaga

SEQ ID NO: 4959 - DNA, 25 bp, Homo sapiens
ggtaacgcgaccgatcccggagaag

SEQ ID NO: 4960 - DNA, 26 bp, Homo sapiens
ggtaacgcgaccgatcccggagaagc

SEQ ID NO: 4961 - DNA, 18 bp, Homo sapiens
aacgcgaccgatcccgga

SEQ ID NO: 4962 - DNA, 20 bp, Homo sapiens
cgaccgatcccggagaagcc

SEQ ID NO: 4963 - DNA, 19 bp, Homo sapiens
gaccgatcccggagaagcc

SEQ ID NO: 4964 - DNA, 30 bp, Homo sapiens
gaccgatcccggagaagccggcgggagccc

SEQ ID NO: 4965 - DNA, 28 bp, Homo sapiens
agaagccggcgggagccccggggagagt

SEQ ID NO: 4966 - DNA, 20 bp, Homo sapiens
gccggcgggagccccgggga

SEQ ID NO: 4967 - DNA, 19 bp, Homo sapiens
ccggcgggagccccgggga

SEQ ID NO: 4968 - DNA, 32 bp, Homo sapiens
tgaagggcagggcgccctggaatgggttcgcc

SEQ ID NO: 4969 - DNA, 33 bp, Homo sapiens
tgaagggcagggcgccctggaatgggttcgccc

SEQ ID NO: 4970 - DNA, 22 bp, Homo sapiens
aagggcagggcgccctggaatg

SEQ ID NO: 4971 - DNA, 30 bp, Homo sapiens
aagggcagggcgccctggaatgggttcgcc

SEQ ID NO: 4972 - DNA, 31 bp, Homo sapiens
aagggcagggcgccctggaatgggttcgccc

SEQ ID NO: 4973 - DNA, 31 bp, Homo sapiens
tgggttcgccccgagagaggggcccgtgcct

SEQ ID NO: 4974 - DNA, 18 bp, Homo sapiens
cccgagagaggggcccgt

SEQ ID NO: 4975 - DNA, 16 bp, Homo sapiens
ccgagagaggggcccg

SEQ ID NO: 4976 - DNA, 32 bp, Homo sapiens
ccgagagaggggcccgtgccttggaaagcgtc

SEQ ID NO: 4977 - DNA, 31 bp, Homo sapiens
cgagagaggggcccgtgccttggaaagcgtc

SEQ ID NO: 4978 - DNA, 32 bp, Homo sapiens
cgagagaggggcccgtgccttggaaagcgtcg

SEQ ID NO: 4979 - DNA, 33 bp, Homo sapiens
cgagagaggggcccgtgccttggaaagcgtcgc

SEQ ID NO: 4980 - DNA, 30 bp, Homo sapiens
gagagaggggcccgtgccttggaaagcgtc

SEQ ID NO: 4981 - DNA, 32 bp, Homo sapiens
gagagaggggcccgtgccttggaaagcgtcgc

SEQ ID NO: 4982 - DNA, 33 bp, Homo sapiens
gagagaggggcccgtgccttggaaagcgtcgcg

SEQ ID NO: 4983 - DNA, 29 bp, Homo sapiens
agagaggggcccgtgccttggaaagcgtc

SEQ ID NO: 4984 - DNA, 30 bp, Homo sapiens
agagaggggcccgtgccttggaaagcgtcg

SEQ ID NO: 4985 - DNA, 31 bp, Homo sapiens
agagaggggcccgtgccttggaaagcgtcgc

SEQ ID NO: 4986 - DNA, 32 bp, Homo sapiens
agagaggggcccgtgccttggaaagcgtcgcg

SEQ ID NO: 4987 - DNA, 31 bp, Homo sapiens
gagaggggcccgtgccttggaaagcgtcgcg

SEQ ID NO: 4988 - DNA, 27 bp, Homo sapiens
agaggggcccgtgccttggaaagcgtc

SEQ ID NO: 4989 - DNA, 29 bp, Homo sapiens
agaggggcccgtgccttggaaagcgtcgc

SEQ ID NO: 4990 - DNA, 30 bp, Homo sapiens
agaggggcccgtgccttggaaagcgtcgcg

SEQ ID NO: 4991 - DNA, 29 bp, Homo sapiens
gaggggcccgtgccttggaaagcgtcgcg

SEQ ID NO: 4992 - DNA, 27 bp, Homo sapiens
aggggcccgtgccttggaaagcgtcgc

SEQ ID NO: 4993 - DNA, 28 bp, Homo sapiens
aggggcccgtgccttggaaagcgtcgcg

SEQ ID NO: 4994 - DNA, 24 bp, Homo sapiens
gtgccttggaaagcgtcgcggttc

SEQ ID NO: 4995 - DNA, 25 bp, Homo sapiens
gtgccttggaaagcgtcgcggttcc

SEQ ID NO: 4996 - DNA, 26 bp, Homo sapiens
gtgccttggaaagcgtcgcggttccg

SEQ ID NO: 4997 - DNA, 19 bp, Homo sapiens
tgccttggaaagcgtcgcg

SEQ ID NO: 4998 - DNA, 21 bp, Homo sapiens
tgccttggaaagcgtcgcggt

SEQ ID NO: 4999 - DNA, 22 bp, Homo sapiens
tgccttggaaagcgtcgcggtt

SEQ ID NO: 5000 - DNA, 23 bp, Homo sapiens
tgccttggaaagcgtcgcggttc

SEQ ID NO: 5001 - DNA, 24 bp, Homo sapiens
tgccttggaaagcgtcgcggttcc

SEQ ID NO: 5002 - DNA, 25 bp, Homo sapiens
tgccttggaaagcgtcgcggttccg

SEQ ID NO: 5003 - DNA, 21 bp, Homo sapiens
gccttggaaagcgtcgcggtt

SEQ ID NO: 5004 - DNA, 22 bp, Homo sapiens
gccttggaaagcgtcgcggttc

SEQ ID NO: 5005 - DNA, 23 bp, Homo sapiens
gccttggaaagcgtcgcggttcc

SEQ ID NO: 5006 - DNA, 24 bp, Homo sapiens
gccttggaaagcgtcgcggttccg

SEQ ID NO: 5007 - DNA, 16 bp, Homo sapiens
ccttggaaagcgtcgc

SEQ ID NO: 5008 - DNA, 19 bp, Homo sapiens
ccttggaaagcgtcgcggt

SEQ ID NO: 5009 - DNA, 20 bp, Homo sapiens
ccttggaaagcgtcgcggtt

SEQ ID NO: 5010 - DNA, 21 bp, Homo sapiens
ccttggaaagcgtcgcggttc

SEQ ID NO: 5011 - DNA, 22 bp, Homo sapiens
ccttggaaagcgtcgcggttcc

SEQ ID NO: 5012 - DNA, 23 bp, Homo sapiens
ccttggaaagcgtcgcggttccg

SEQ ID NO: 5013 - DNA, 19 bp, Homo sapiens
cttggaaagcgtcgcggtt

SEQ ID NO: 5014 - DNA, 20 bp, Homo sapiens
cttggaaagcgtcgcggttc

SEQ ID NO: 5015 - DNA, 21 bp, Homo sapiens
cttggaaagcgtcgcggttcc

SEQ ID NO: 5016 - DNA, 19 bp, Homo sapiens
ttggaaagcgtcgcggttc

SEQ ID NO: 5017 - DNA, 20 bp, Homo sapiens
ttggaaagcgtcgcggttcc

SEQ ID NO: 5018 - DNA, 17 bp, Homo sapiens
ggaaagcgtcgcggttc

SEQ ID NO: 5019 - DNA, 17 bp, Homo sapiens
gaaagcgtcgcggttcc

SEQ ID NO: 5020 - DNA, 16 bp, Homo sapiens
aaagcgtcgcggttcc

SEQ ID NO: 5021 - DNA, 31 bp, Homo sapiens
gcggttccggcggcgtccggtgagctctcgc

SEQ ID NO: 5022 - DNA, 32 bp, Homo sapiens
gcggttccggcggcgtccggtgagctctcgct

SEQ ID NO: 5023 - DNA, 30 bp, Homo sapiens
cggttccggcggcgtccggtgagctctcgc

SEQ ID NO: 5024 - DNA, 31 bp, Homo sapiens
cggttccggcggcgtccggtgagctctcgct

SEQ ID NO: 5025 - DNA, 30 bp, Homo sapiens
ggttccggcggcgtccggtgagctctcgct

SEQ ID NO: 5026 - DNA, 29 bp, Homo sapiens
gttccggcggcgtccggtgagctctcgct

SEQ ID NO: 5027 - DNA, 33 bp, Homo sapiens
gttccggcggcgtccggtgagctctcgctggcc

SEQ ID NO: 5028 - DNA, 32 bp, Homo sapiens
ttccggcggcgtccggtgagctctcgctggcc

SEQ ID NO: 5029 - DNA, 33 bp, Homo sapiens
ttccggcggcgtccggtgagctctcgctggccc

SEQ ID NO: 5030 - DNA, 31 bp, Homo sapiens
tccggcggcgtccggtgagctctcgctggcc

SEQ ID NO: 5031 - DNA, 32 bp, Homo sapiens
tccggcggcgtccggtgagctctcgctggccc

SEQ ID NO: 5032 - DNA, 33 bp, Homo sapiens
tccggcggcgtccggtgagctctcgctggccct

SEQ ID NO: 5033 - DNA, 30 bp, Homo sapiens
ccggcggcgtccggtgagctctcgctggcc

SEQ ID NO: 5034 - DNA, 31 bp, Homo sapiens
ccggcggcgtccggtgagctctcgctggccc

SEQ ID NO: 5035 - DNA, 32 bp, Homo sapiens
ccggcggcgtccggtgagctctcgctggccct

SEQ ID NO: 5036 - DNA, 25 bp, Homo sapiens
cggcggcgtccggtgagctctcgct

SEQ ID NO: 5037 - DNA, 26 bp, Homo sapiens
cggcggcgtccggtgagctctcgctg

SEQ ID NO: 5038 - DNA, 27 bp, Homo sapiens
cggcggcgtccggtgagctctcgctgg

SEQ ID NO: 5039 - DNA, 28 bp, Homo sapiens
cggcggcgtccggtgagctctcgctggc

SEQ ID NO: 5040 - DNA, 29 bp, Homo sapiens
cggcggcgtccggtgagctctcgctggcc

SEQ ID NO: 5041 - DNA, 30 bp, Homo sapiens
cggcggcgtccggtgagctctcgctggccc

SEQ ID NO: 5042 - DNA, 31 bp, Homo sapiens
cggcggcgtccggtgagctctcgctggccct

SEQ ID NO: 5043 - DNA, 21 bp, Homo sapiens
ggcggcgtccggtgagctctc

SEQ ID NO: 5044 - DNA, 23 bp, Homo sapiens
ggcggcgtccggtgagctctcgc

SEQ ID NO: 5045 - DNA, 24 bp, Homo sapiens
ggcggcgtccggtgagctctcgct

SEQ ID NO: 5046 - DNA, 25 bp, Homo sapiens
ggcggcgtccggtgagctctcgctg

SEQ ID NO: 5047 - DNA, 26 bp, Homo sapiens
ggcggcgtccggtgagctctcgctgg

SEQ ID NO: 5048 - DNA, 27 bp, Homo sapiens
ggcggcgtccggtgagctctcgctggc

SEQ ID NO: 5049 - DNA, 28 bp, Homo sapiens
ggcggcgtccggtgagctctcgctggcc

SEQ ID NO: 5050 - DNA, 29 bp, Homo sapiens
ggcggcgtccggtgagctctcgctggccc

SEQ ID NO: 5051 - DNA, 30 bp, Homo sapiens
ggcggcgtccggtgagctctcgctggccct

SEQ ID NO: 5052 - DNA, 31 bp, Homo sapiens
ggcggcgtccggtgagctctcgctggccctt

SEQ ID NO: 5053 - DNA, 20 bp, Homo sapiens
gcggcgtccggtgagctctc

SEQ ID NO: 5054 - DNA, 21 bp, Homo sapiens
gcggcgtccggtgagctctcg

SEQ ID NO: 5055 - DNA, 22 bp, Homo sapiens
gcggcgtccggtgagctctcgc

SEQ ID NO: 5056 - DNA, 23 bp, Homo sapiens
gcggcgtccggtgagctctcgct

SEQ ID NO: 5057 - DNA, 24 bp, Homo sapiens
gcggcgtccggtgagctctcgctg

SEQ ID NO: 5058 - DNA, 25 bp, Homo sapiens
gcggcgtccggtgagctctcgctgg

SEQ ID NO: 5059 - DNA, 26 bp, Homo sapiens
gcggcgtccggtgagctctcgctggc

SEQ ID NO: 5060 - DNA, 27 bp, Homo sapiens
gcggcgtccggtgagctctcgctggcc

SEQ ID NO: 5061 - DNA, 28 bp, Homo sapiens
gcggcgtccggtgagctctcgctggccc

SEQ ID NO: 5062 - DNA, 29 bp, Homo sapiens
gcggcgtccggtgagctctcgctggccct

SEQ ID NO: 5063 - DNA, 31 bp, Homo sapiens
gcggcgtccggtgagctctcgctggcccttg

SEQ ID NO: 5064 - DNA, 21 bp, Homo sapiens
cggcgtccggtgagctctcgc

SEQ ID NO: 5065 - DNA, 22 bp, Homo sapiens
cggcgtccggtgagctctcgct

SEQ ID NO: 5066 - DNA, 25 bp, Homo sapiens
cggcgtccggtgagctctcgctggc

SEQ ID NO: 5067 - DNA, 26 bp, Homo sapiens
cggcgtccggtgagctctcgctggcc

SEQ ID NO: 5068 - DNA, 27 bp, Homo sapiens
cggcgtccggtgagctctcgctggccc

SEQ ID NO: 5069 - DNA, 25 bp, Homo sapiens
ggcgtccggtgagctctcgctggcc

SEQ ID NO: 5070 - DNA, 22 bp, Homo sapiens
gtccggtgagctctcgctggcc

SEQ ID NO: 5071 - DNA, 23 bp, Homo sapiens
gtccggtgagctctcgctggccc

SEQ ID NO: 5072 - DNA, 21 bp, Homo sapiens
tccggtgagctctcgctggcc

SEQ ID NO: 5073 - DNA, 22 bp, Homo sapiens
tccggtgagctctcgctggccc

SEQ ID NO: 5074 - DNA, 19 bp, Homo sapiens
ccggtgagctctcgctggc

SEQ ID NO: 5075 - DNA, 20 bp, Homo sapiens
ccggtgagctctcgctggcc

SEQ ID NO: 5076 - DNA, 21 bp, Homo sapiens
ccggtgagctctcgctggccc

SEQ ID NO: 5077 - DNA, 22 bp, Homo sapiens
ccggtgagctctcgctggccct

SEQ ID NO: 5078 - DNA, 20 bp, Homo sapiens
cggtgagctctcgctggccc

SEQ ID NO: 5079 - DNA, 18 bp, Homo sapiens
ggtgagctctcgctggcc

SEQ ID NO: 5080 - DNA, 19 bp, Homo sapiens
ggtgagctctcgctggccc

SEQ ID NO: 5081 - DNA, 17 bp, Homo sapiens
gtgagctctcgctggcc

SEQ ID NO: 5082 - DNA, 18 bp, Homo sapiens
gtgagctctcgctggccc

SEQ ID NO: 5083 - DNA, 16 bp, Homo sapiens
tgagctctcgctggcc

SEQ ID NO: 5084 - DNA, 17 bp, Homo sapiens
tgagctctcgctggccc

SEQ ID NO: 5085 - DNA, 16 bp, Homo sapiens
gagctctcgctggccc

SEQ ID NO: 5086 - DNA, 16 bp, Homo sapiens
aaaatccgggggagag

SEQ ID NO: 5087 - DNA, 29 bp, Homo sapiens
aaaatccgggggagagggtgtaaatctcg

SEQ ID NO: 5088 - DNA, 32 bp, Homo sapiens
gagagggtgtaaatctcgcgccgggccgtacc

SEQ ID NO: 5089 - DNA, 26 bp, Homo sapiens
agagggtgtaaatctcgcgccgggcc

SEQ ID NO: 5090 - DNA, 31 bp, Homo sapiens
agagggtgtaaatctcgcgccgggccgtacc

SEQ ID NO: 5091 - DNA, 30 bp, Homo sapiens
gagggtgtaaatctcgcgccgggccgtacc

SEQ ID NO: 5092 - DNA, 19 bp, Homo sapiens
agggtgtaaatctcgcgcc

SEQ ID NO: 5093 - DNA, 23 bp, Homo sapiens
agggtgtaaatctcgcgccgggc

SEQ ID NO: 5094 - DNA, 24 bp, Homo sapiens
agggtgtaaatctcgcgccgggcc

SEQ ID NO: 5095 - DNA, 29 bp, Homo sapiens
agggtgtaaatctcgcgccgggccgtacc

SEQ ID NO: 5096 - DNA, 26 bp, Homo sapiens
gtgtaaatctcgcgccgggccgtacc

SEQ ID NO: 5097 - DNA, 25 bp, Homo sapiens
tgtaaatctcgcgccgggccgtacc

SEQ ID NO: 5098 - DNA, 31 bp, Homo sapiens
tgtaaatctcgcgccgggccgtacccatatc

SEQ ID NO: 5099 - DNA, 24 bp, Homo sapiens
gtaaatctcgcgccgggccgtacc

SEQ ID NO: 5100 - DNA, 30 bp, Homo sapiens
gtaaatctcgcgccgggccgtacccatatc

SEQ ID NO: 5101 - DNA, 17 bp, Homo sapiens
taaatctcgcgccgggc

SEQ ID NO: 5102 - DNA, 18 bp, Homo sapiens
taaatctcgcgccgggcc

SEQ ID NO: 5103 - DNA, 23 bp, Homo sapiens
taaatctcgcgccgggccgtacc

SEQ ID NO: 5104 - DNA, 24 bp, Homo sapiens
taaatctcgcgccgggccgtaccc

SEQ ID NO: 5105 - DNA, 29 bp, Homo sapiens
taaatctcgcgccgggccgtacccatatc

SEQ ID NO: 5106 - DNA, 16 bp, Homo sapiens
aaatctcgcgccgggc

SEQ ID NO: 5107 - DNA, 17 bp, Homo sapiens
aaatctcgcgccgggcc

SEQ ID NO: 5108 - DNA, 18 bp, Homo sapiens
aaatctcgcgccgggccg

SEQ ID NO: 5109 - DNA, 19 bp, Homo sapiens
aaatctcgcgccgggccgt

SEQ ID NO: 5110 - DNA, 22 bp, Homo sapiens
aaatctcgcgccgggccgtacc

SEQ ID NO: 5111 - DNA, 16 bp, Homo sapiens
aatctcgcgccgggcc

SEQ ID NO: 5112 - DNA, 21 bp, Homo sapiens
aatctcgcgccgggccgtacc

SEQ ID NO: 5113 - DNA, 22 bp, Homo sapiens
aatctcgcgccgggccgtaccc

SEQ ID NO: 5114 - DNA, 27 bp, Homo sapiens
aatctcgcgccgggccgtacccatatc

SEQ ID NO: 5115 - DNA, 20 bp, Homo sapiens
atctcgcgccgggccgtacc

SEQ ID NO: 5116 - DNA, 26 bp, Homo sapiens
atctcgcgccgggccgtacccatatc

SEQ ID NO: 5117 - DNA, 19 bp, Homo sapiens
tctcgcgccgggccgtacc

SEQ ID NO: 5118 - DNA, 18 bp, Homo sapiens
ctcgcgccgggccgtacc

SEQ ID NO: 5119 - DNA, 17 bp, Homo sapiens
tcgcgccgggccgtacc

SEQ ID NO: 5120 - DNA, 16 bp, Homo sapiens
cgcgccgggccgtacc

SEQ ID NO: 5121 - DNA, 22 bp, Homo sapiens
cgcgccgggccgtacccatatc

SEQ ID NO: 5122 - DNA, 20 bp, Homo sapiens
cgccgggccgtacccatatc

SEQ ID NO: 5123 - DNA, 20 bp, Homo sapiens
cgcagcaggtctccaaggtg

SEQ ID NO: 5124 - DNA, 26 bp, Homo sapiens
cgcagcaggtctccaaggtgaacagc

SEQ ID NO: 5125 - DNA, 27 bp, Homo sapiens
cgcagcaggtctccaaggtgaacagcc

SEQ ID NO: 5126 - DNA, 31 bp, Homo sapiens
cgcagcaggtctccaaggtgaacagcctctg

SEQ ID NO: 5127 - DNA, 25 bp, Homo sapiens
gcagcaggtctccaaggtgaacagc

SEQ ID NO: 5128 - DNA, 30 bp, Homo sapiens
gcagcaggtctccaaggtgaacagcctctg

SEQ ID NO: 5129 - DNA, 24 bp, Homo sapiens
cagcaggtctccaaggtgaacagc

SEQ ID NO: 5130 - DNA, 25 bp, Homo sapiens
cagcaggtctccaaggtgaacagcc

SEQ ID NO: 5131 - DNA, 27 bp, Homo sapiens
gcaggtctccaaggtgaacagcctctg

SEQ ID NO: 5132 - DNA, 33 bp, Homo sapiens
gcaggtctccaaggtgaacagcctctggcatgt

SEQ ID NO: 5133 - DNA, 22 bp, Homo sapiens
caggtctccaaggtgaacagcc

SEQ ID NO: 5134 - DNA, 32 bp, Homo sapiens
caggtctccaaggtgaacagcctctggcatgt

SEQ ID NO: 5135 - DNA, 31 bp, Homo sapiens
aggtctccaaggtgaacagcctctggcatgt

SEQ ID NO: 5136 - DNA, 22 bp, Homo sapiens
acagcctctggcatgttggaac

SEQ ID NO: 5137 - DNA, 21 bp, Homo sapiens
cagcctctggcatgttggaac

SEQ ID NO: 5138 - DNA, 22 bp, Homo sapiens
cagcctctggcatgttggaaca

SEQ ID NO: 5139 - DNA, 20 bp, Homo sapiens
agcctctggcatgttggaac

SEQ ID NO: 5140 - DNA, 17 bp, Homo sapiens
ctctggcatgttggaac

SEQ ID NO: 5141 - DNA, 18 bp, Homo sapiens
ctctggcatgttggaaca

SEQ ID NO: 5142 - DNA, 16 bp, Homo sapiens
tctggcatgttggaac

SEQ ID NO: 5143 - DNA, 17 bp, Homo sapiens
tctggcatgttggaaca

SEQ ID NO: 5144 - DNA, 16 bp, Homo sapiens
ctggcatgttggaaca

SEQ ID NO: 5145 - DNA, 25 bp, Homo sapiens
gcatgttggaacaatgtaggtaagg

SEQ ID NO: 5146 - DNA, 31 bp, Homo sapiens
gcatgttggaacaatgtaggtaagggaagtc

SEQ ID NO: 5147 - DNA, 32 bp, Homo sapiens
gcatgttggaacaatgtaggtaagggaagtcg

SEQ ID NO: 5148 - DNA, 17 bp, Homo sapiens
aatgtaggtaagggaag

SEQ ID NO: 5149 - DNA, 18 bp, Homo sapiens
aatgtaggtaagggaagt

SEQ ID NO: 5150 - DNA, 19 bp, Homo sapiens
aatgtaggtaagggaagtc

SEQ ID NO: 5151 - DNA, 22 bp, Homo sapiens
aatgtaggtaagggaagtcggc

SEQ ID NO: 5152 - DNA, 26 bp, Homo sapiens
aatgtaggtaagggaagtcggcaagc

SEQ ID NO: 5153 - DNA, 22 bp, Homo sapiens
atgtaggtaagggaagtcggca

SEQ ID NO: 5154 - DNA, 28 bp, Homo sapiens
atgtaggtaagggaagtcggcaagccgg

SEQ ID NO: 5155 - DNA, 17 bp, Homo sapiens
ggaagtcggcaagccgg

SEQ ID NO: 5156 - DNA, 20 bp, Homo sapiens
ggaagtcggcaagccggatc

SEQ ID NO: 5157 - DNA, 16 bp, Homo sapiens
gaagtcggcaagccgg

SEQ ID NO: 5158 - DNA, 19 bp, Homo sapiens
gaagtcggcaagccggatc

SEQ ID NO: 5159 - DNA, 26 bp, Homo sapiens
gaagtcggcaagccggatccgtaact

SEQ ID NO: 5160 - DNA, 21 bp, Homo sapiens
ggcaagccggatccgtaactt

SEQ ID NO: 5161 - DNA, 22 bp, Homo sapiens
ggcaagccggatccgtaacttc

SEQ ID NO: 5162 - DNA, 30 bp, Homo sapiens
ggcaagccggatccgtaacttcgggataag

SEQ ID NO: 5163 - DNA, 31 bp, Homo sapiens
ggcaagccggatccgtaacttcgggataagg

SEQ ID NO: 5164 - DNA, 32 bp, Homo sapiens
ggcaagccggatccgtaacttcgggataagga

SEQ ID NO: 5165 - DNA, 33 bp, Homo sapiens
ggcaagccggatccgtaacttcgggataaggat

SEQ ID NO: 5166 - DNA, 19 bp, Homo sapiens
gcaagccggatccgtaact

SEQ ID NO: 5167 - DNA, 20 bp, Homo sapiens
gcaagccggatccgtaactt

SEQ ID NO: 5168 - DNA, 21 bp, Homo sapiens
gcaagccggatccgtaacttc

SEQ ID NO: 5169 - DNA, 30 bp, Homo sapiens
gcaagccggatccgtaacttcgggataagg

SEQ ID NO: 5170 - DNA, 18 bp, Homo sapiens
caagccggatccgtaact

SEQ ID NO: 5171 - DNA, 17 bp, Homo sapiens
aagccggatccgtaact

SEQ ID NO: 5172 - DNA, 33 bp, Homo sapiens
aagccggatccgtaacttcgggataaggattgg

SEQ ID NO: 5173 - DNA, 16 bp, Homo sapiens
agccggatccgtaact

SEQ ID NO: 5174 - DNA, 17 bp, Homo sapiens
agccggatccgtaactt

SEQ ID NO: 5175 - DNA, 18 bp, Homo sapiens
agccggatccgtaacttc

SEQ ID NO: 5176 - DNA, 27 bp, Homo sapiens
agccggatccgtaacttcgggataagg

SEQ ID NO: 5177 - DNA, 29 bp, Homo sapiens
agccggatccgtaacttcgggataaggat

SEQ ID NO: 5178 - DNA, 31 bp, Homo sapiens
agccggatccgtaacttcgggataaggattg

SEQ ID NO: 5179 - DNA, 32 bp, Homo sapiens
agccggatccgtaacttcgggataaggattgg

SEQ ID NO: 5180 - DNA, 30 bp, Homo sapiens
gccggatccgtaacttcgggataaggattg

SEQ ID NO: 5181 - DNA, 31 bp, Homo sapiens
gccggatccgtaacttcgggataaggattgg

SEQ ID NO: 5182 - DNA, 25 bp, Homo sapiens
ccggatccgtaacttcgggataagg

SEQ ID NO: 5183 - DNA, 32 bp, Homo sapiens
ccggatccgtaacttcgggataaggattggct

SEQ ID NO: 5184 - DNA, 33 bp, Homo sapiens
ccggatccgtaacttcgggataaggattggctc

SEQ ID NO: 5185 - DNA, 26 bp, Homo sapiens
cggatccgtaacttcgggataaggat

SEQ ID NO: 5186 - DNA, 28 bp, Homo sapiens
cggatccgtaacttcgggataaggattg

SEQ ID NO: 5187 - DNA, 31 bp, Homo sapiens
cggatccgtaacttcgggataaggattggct

SEQ ID NO: 5188 - DNA, 32 bp, Homo sapiens
cggatccgtaacttcgggataaggattggctc

SEQ ID NO: 5189 - DNA, 28 bp, Homo sapiens
atccgtaacttcgggataaggattggct

SEQ ID NO: 5190 - DNA, 29 bp, Homo sapiens
atccgtaacttcgggataaggattggctc

SEQ ID NO: 5191 - DNA, 30 bp, Homo sapiens
atccgtaacttcgggataaggattggctct

SEQ ID NO: 5192 - DNA, 31 bp, Homo sapiens
atccgtaacttcgggataaggattggctcta

SEQ ID NO: 5193 - DNA, 33 bp, Homo sapiens
atccgtaacttcgggataaggattggctctaag

SEQ ID NO: 5194 - DNA, 28 bp, Homo sapiens
tccgtaacttcgggataaggattggctc

SEQ ID NO: 5195 - DNA, 26 bp, Homo sapiens
ccgtaacttcgggataaggattggct

SEQ ID NO: 5196 - DNA, 27 bp, Homo sapiens
ccgtaacttcgggataaggattggctc

SEQ ID NO: 5197 - DNA, 28 bp, Homo sapiens
ccgtaacttcgggataaggattggctct

SEQ ID NO: 5198 - DNA, 29 bp, Homo sapiens
ccgtaacttcgggataaggattggctcta

SEQ ID NO: 5199 - DNA, 25 bp, Homo sapiens
cgtaacttcgggataaggattggct

SEQ ID NO: 5200 - DNA, 26 bp, Homo sapiens
cgtaacttcgggataaggattggctc

SEQ ID NO: 5201 - DNA, 27 bp, Homo sapiens
cgtaacttcgggataaggattggctct

SEQ ID NO: 5202 - DNA, 28 bp, Homo sapiens
cgtaacttcgggataaggattggctcta

SEQ ID NO: 5203 - DNA, 29 bp, Homo sapiens
cgtaacttcgggataaggattggctctaa

SEQ ID NO: 5204 - DNA, 33 bp, Homo sapiens
cgtaacttcgggataaggattggctctaagggc

SEQ ID NO: 5205 - DNA, 22 bp, Homo sapiens
acttcgggataaggattggctc

SEQ ID NO: 5206 - DNA, 23 bp, Homo sapiens
acttcgggataaggattggctct

SEQ ID NO: 5207 - DNA, 22 bp, Homo sapiens
cttcgggataaggattggctct

SEQ ID NO: 5208 - DNA, 20 bp, Homo sapiens
ttcgggataaggattggctc

SEQ ID NO: 5209 - DNA, 21 bp, Homo sapiens
ttcgggataaggattggctct

SEQ ID NO: 5210 - DNA, 22 bp, Homo sapiens
ttcgggataaggattggctcta

SEQ ID NO: 5211 - DNA, 27 bp, Homo sapiens
ttcgggataaggattggctctaagggc

SEQ ID NO: 5212 - DNA, 28 bp, Homo sapiens
ttcgggataaggattggctctaagggct

SEQ ID NO: 5213 - DNA, 19 bp, Homo sapiens
tcgggataaggattggctc

SEQ ID NO: 5214 - DNA, 20 bp, Homo sapiens
tcgggataaggattggctct

SEQ ID NO: 5215 - DNA, 26 bp, Homo sapiens
tcgggataaggattggctctaagggc

SEQ ID NO: 5216 - DNA, 27 bp, Homo sapiens
tcgggataaggattggctctaagggct

SEQ ID NO: 5217 - DNA, 18 bp, Homo sapiens
cgggataaggattggctc

SEQ ID NO: 5218 - DNA, 19 bp, Homo sapiens
cgggataaggattggctct

SEQ ID NO: 5219 - DNA, 19 bp, Homo sapiens
aaggattggctctaagggc

SEQ ID NO: 5220 - DNA, 33 bp, Homo sapiens
aaggattggctctaagggctgggtcggtcgggc

SEQ ID NO: 5221 - DNA, 16 bp, Homo sapiens
aagggctgggtcggtc

SEQ ID NO: 5222 - DNA, 21 bp, Homo sapiens
aagggctgggtcggtcgggct

SEQ ID NO: 5223 - DNA, 22 bp, Homo sapiens
aagggctgggtcggtcgggctg

SEQ ID NO: 5224 - DNA, 24 bp, Homo sapiens
aagggctgggtcggtcgggctggg

SEQ ID NO: 5225 - DNA, 25 bp, Homo sapiens
agggctgggtcggtcgggctggggc

SEQ ID NO: 5226 - DNA, 26 bp, Homo sapiens
agggctgggtcggtcgggctggggcg

SEQ ID NO: 5227 - DNA, 30 bp, Homo sapiens
gtcggtcgggctggggcgcgaagcggggct

SEQ ID NO: 5228 - DNA, 28 bp, Homo sapiens
cggtcgggctggggcgcgaagcggggct

SEQ ID NO: 5229 - DNA, 23 bp, Homo sapiens
tcgggctggggcgcgaagcgggg

SEQ ID NO: 5230 - DNA, 24 bp, Homo sapiens
tcgggctggggcgcgaagcggggc

SEQ ID NO: 5231 - DNA, 23 bp, Homo sapiens
cgggctggggcgcgaagcggggc

SEQ ID NO: 5232 - DNA, 16 bp, Homo sapiens
ggcgcgaagcggggct

SEQ ID NO: 5233 - DNA, 21 bp, Homo sapiens
gctggacgaggcgccgccgcc

SEQ ID NO: 5234 - DNA, 16 bp, Homo sapiens
cgccgccgcccccccc

SEQ ID NO: 5235 - DNA, 20 bp, Homo sapiens
cggggcacccccctcgcggc

SEQ ID NO: 5236 - DNA, 21 bp, Homo sapiens
cggggcacccccctcgcggcc

SEQ ID NO: 5237 - DNA, 16 bp, Homo sapiens
cacccccctcgcggcc

SEQ ID NO: 5238 - DNA, 27 bp, Homo sapiens
acggtcccccgcgaggggggcccgggc

SEQ ID NO: 5239 - DNA, 26 bp, Homo sapiens
cggtcccccgcgaggggggcccgggc

SEQ ID NO: 5240 - DNA, 23 bp, Homo sapiens
tcccccgcgaggggggcccgggc

SEQ ID NO: 5241 - DNA, 22 bp, Homo sapiens
cccccgcgaggggggcccgggc

SEQ ID NO: 5242 - DNA, 23 bp, Homo sapiens
cccccgcgaggggggcccgggca

SEQ ID NO: 5243 - DNA, 21 bp, Homo sapiens
ccccgcgaggggggcccgggc

SEQ ID NO: 5244 - DNA, 22 bp, Homo sapiens
ccccgcgaggggggcccgggca

SEQ ID NO: 5245 - DNA, 20 bp, Homo sapiens
cccgcgaggggggcccgggc

SEQ ID NO: 5246 - DNA, 21 bp, Homo sapiens
cccgcgaggggggcccgggca

SEQ ID NO: 5247 - DNA, 22 bp, Homo sapiens
cccgcgaggggggcccgggcac

SEQ ID NO: 5248 - DNA, 19 bp, Homo sapiens
ccgcgaggggggcccgggc

SEQ ID NO: 5249 - DNA, 21 bp, Homo sapiens
ccgcgaggggggcccgggcac

SEQ ID NO: 5250 - DNA, 17 bp, Homo sapiens
gcgaggggggcccgggc

SEQ ID NO: 5251 - DNA, 25 bp, Homo sapiens
ggggggccggcggcggcggcgactc

SEQ ID NO: 5252 - DNA, 33 bp, Homo sapiens
gcggcggcggcgactctggacgcgagccgggcc

SEQ ID NO: 5253 - DNA, 32 bp, Homo sapiens
cggcggcggcgactctggacgcgagccgggcc

SEQ ID NO: 5254 - DNA, 33 bp, Homo sapiens
cggcggcggcgactctggacgcgagccgggccc

SEQ ID NO: 5255 - DNA, 32 bp, Homo sapiens
ggcggcggcgactctggacgcgagccgggccc

SEQ ID NO: 5256 - DNA, 33 bp, Homo sapiens
ggcggcggcgactctggacgcgagccgggccct

SEQ ID NO: 5257 - DNA, 30 bp, Homo sapiens
gcggcggcgactctggacgcgagccgggcc

SEQ ID NO: 5258 - DNA, 31 bp, Homo sapiens
gcggcggcgactctggacgcgagccgggccc

SEQ ID NO: 5259 - DNA, 32 bp, Homo sapiens
gcggcggcgactctggacgcgagccgggccct

SEQ ID NO: 5260 - DNA, 30 bp, Homo sapiens
cggcggcgactctggacgcgagccgggccc

SEQ ID NO: 5261 - DNA, 31 bp, Homo sapiens
cggcggcgactctggacgcgagccgggccct

SEQ ID NO: 5262 - DNA, 29 bp, Homo sapiens
ggcggcgactctggacgcgagccgggccc

SEQ ID NO: 5263 - DNA, 27 bp, Homo sapiens
gcggcgactctggacgcgagccgggcc

SEQ ID NO: 5264 - DNA, 28 bp, Homo sapiens
gcggcgactctggacgcgagccgggccc

SEQ ID NO: 5265 - DNA, 29 bp, Homo sapiens
gcggcgactctggacgcgagccgggccct

SEQ ID NO: 5266 - DNA, 30 bp, Homo sapiens
gcggcgactctggacgcgagccgggccctt

SEQ ID NO: 5267 - DNA, 27 bp, Homo sapiens
cggcgactctggacgcgagccgggccc

SEQ ID NO: 5268 - DNA, 33 bp, Homo sapiens
cggcgactctggacgcgagccgggcccttcccg

SEQ ID NO: 5269 - DNA, 25 bp, Homo sapiens
gcgactctggacgcgagccgggccc

SEQ ID NO: 5270 - DNA, 19 bp, Homo sapiens
tctggacgcgagccgggcc

SEQ ID NO: 5271 - DNA, 20 bp, Homo sapiens
tctggacgcgagccgggccc

SEQ ID NO: 5272 - DNA, 21 bp, Homo sapiens
tctggacgcgagccgggccct

SEQ ID NO: 5273 - DNA, 22 bp, Homo sapiens
tctggacgcgagccgggccctt

SEQ ID NO: 5274 - DNA, 26 bp, Homo sapiens
tctggacgcgagccgggcccttcccg

SEQ ID NO: 5275 - DNA, 30 bp, Homo sapiens
tctggacgcgagccgggcccttcccgtgga

SEQ ID NO: 5276 - DNA, 31 bp, Homo sapiens
tctggacgcgagccgggcccttcccgtggat

SEQ ID NO: 5277 - DNA, 17 bp, Homo sapiens
ctggacgcgagccgggc

SEQ ID NO: 5278 - DNA, 18 bp, Homo sapiens
ctggacgcgagccgggcc

SEQ ID NO: 5279 - DNA, 19 bp, Homo sapiens
ctggacgcgagccgggccc

SEQ ID NO: 5280 - DNA, 20 bp, Homo sapiens
ctggacgcgagccgggccct

SEQ ID NO: 5281 - DNA, 21 bp, Homo sapiens
ctggacgcgagccgggccctt

SEQ ID NO: 5282 - DNA, 22 bp, Homo sapiens
ctggacgcgagccgggcccttc

SEQ ID NO: 5283 - DNA, 25 bp, Homo sapiens
ctggacgcgagccgggcccttcccg

SEQ ID NO: 5284 - DNA, 29 bp, Homo sapiens
ctggacgcgagccgggcccttcccgtgga

SEQ ID NO: 5285 - DNA, 30 bp, Homo sapiens
ctggacgcgagccgggcccttcccgtggat

SEQ ID NO: 5286 - DNA, 31 bp, Homo sapiens
ctggacgcgagccgggcccttcccgtggatc

SEQ ID NO: 5287 - DNA, 32 bp, Homo sapiens
ctggacgcgagccgggcccttcccgtggatcg

SEQ ID NO: 5288 - DNA, 29 bp, Homo sapiens
tggacgcgagccgggcccttcccgtggat

SEQ ID NO: 5289 - DNA, 30 bp, Homo sapiens
tggacgcgagccgggcccttcccgtggatc

SEQ ID NO: 5290 - DNA, 16 bp, Homo sapiens
ggacgcgagccgggcc

SEQ ID NO: 5291 - DNA, 25 bp, Homo sapiens
ccttcccgtggatcgccccagctgc

SEQ ID NO: 5292 - DNA, 21 bp, Homo sapiens
cttcccgtggatcgccccagc

SEQ ID NO: 5293 - DNA, 22 bp, Homo sapiens
cttcccgtggatcgccccagct

SEQ ID NO: 5294 - DNA, 23 bp, Homo sapiens
cttcccgtggatcgccccagctg

SEQ ID NO: 5295 - DNA, 24 bp, Homo sapiens
cttcccgtggatcgccccagctgc

SEQ ID NO: 5296 - DNA, 20 bp, Homo sapiens
ttcccgtggatcgccccagc

SEQ ID NO: 5297 - DNA, 22 bp, Homo sapiens
ttcccgtggatcgccccagctg

SEQ ID NO: 5298 - DNA, 23 bp, Homo sapiens
ttcccgtggatcgccccagctgc

SEQ ID NO: 5299 - DNA, 19 bp, Homo sapiens
tcccgtggatcgccccagc

SEQ ID NO: 5300 - DNA, 21 bp, Homo sapiens
tcccgtggatcgccccagctg

SEQ ID NO: 5301 - DNA, 22 bp, Homo sapiens
tcccgtggatcgccccagctgc

SEQ ID NO: 5302 - DNA, 20 bp, Homo sapiens
cccgtggatcgccccagctg

SEQ ID NO: 5303 - DNA, 21 bp, Homo sapiens
cccgtggatcgccccagctgc

SEQ ID NO: 5304 - DNA, 17 bp, Homo sapiens
cgtggatcgccccagct

SEQ ID NO: 5305 - DNA, 19 bp, Homo sapiens
cgtggatcgccccagctgc

SEQ ID NO: 5306 - DNA, 19 bp, Homo sapiens
cgccccagctgcggcgggc

SEQ ID NO: 5307 - DNA, 29 bp, Homo sapiens
cgcggccgcccccggggagcccggcgggc

SEQ ID NO: 5308 - DNA, 20 bp, Homo sapiens
ccccggggagcccggcgggc

SEQ ID NO: 5309 - DNA, 19 bp, Homo sapiens
cccggggagcccggcgggc

SEQ ID NO: 5310 - DNA, 20 bp, Homo sapiens
cccggggagcccggcgggcg

SEQ ID NO: 5311 - DNA, 18 bp, Homo sapiens
ccggggagcccggcgggc

SEQ ID NO: 5312 - DNA, 16 bp, Homo sapiens
ggggagcccggcgggc

SEQ ID NO: 5313 - DNA, 25 bp, Homo sapiens
cccaccccacgtctcgtcgcgcgcg

SEQ ID NO: 5314 - DNA, 27 bp, Homo sapiens
cccaccccacgtctcgtcgcgcgcgcg

SEQ ID NO: 5315 - DNA, 22 bp, Homo sapiens
ccaccccacgtctcgtcgcgcg

SEQ ID NO: 5316 - DNA, 24 bp, Homo sapiens
ccaccccacgtctcgtcgcgcgcg

SEQ ID NO: 5317 - DNA, 26 bp, Homo sapiens
ccaccccacgtctcgtcgcgcgcgcg

SEQ ID NO: 5318 - DNA, 19 bp, Homo sapiens
caccccacgtctcgtcgcg

SEQ ID NO: 5319 - DNA, 21 bp, Homo sapiens
caccccacgtctcgtcgcgcg

SEQ ID NO: 5320 - DNA, 23 bp, Homo sapiens
caccccacgtctcgtcgcgcgcg

SEQ ID NO: 5321 - DNA, 25 bp, Homo sapiens
caccccacgtctcgtcgcgcgcgcg

SEQ ID NO: 5322 - DNA, 20 bp, Homo sapiens
accccacgtctcgtcgcgcg

SEQ ID NO: 5323 - DNA, 22 bp, Homo sapiens
accccacgtctcgtcgcgcgcg

SEQ ID NO: 5324 - DNA, 24 bp, Homo sapiens
accccacgtctcgtcgcgcgcgcg

SEQ ID NO: 5325 - DNA, 21 bp, Homo sapiens
ccccacgtctcgtcgcgcgcg

SEQ ID NO: 5326 - DNA, 23 bp, Homo sapiens
ccccacgtctcgtcgcgcgcgcg

SEQ ID NO: 5327 - DNA, 21 bp, Homo sapiens
ccacgtctcgtcgcgcgcgcg

SEQ ID NO: 5328 - DNA, 19 bp, Homo sapiens
acgtctcgtcgcgcgcgcg

SEQ ID NO: 5329 - DNA, 16 bp, Homo sapiens
cgtctcgtcgcgcgcg

SEQ ID NO: 5330 - DNA, 18 bp, Homo sapiens
cgtctcgtcgcgcgcgcg

SEQ ID NO: 5331 - DNA, 22 bp, Homo sapiens
cgtctcgtcgcgcgcgcgtccg

SEQ ID NO: 5332 - DNA, 26 bp, Homo sapiens
ccccccgccctacccccccggccccg

SEQ ID NO: 5333 - DNA, 25 bp, Homo sapiens
cccccgccctacccccccggccccg

SEQ ID NO: 5334 - DNA, 24 bp, Homo sapiens
ccccgccctacccccccggccccg

SEQ ID NO: 5335 - DNA, 23 bp, Homo sapiens
cccgccctacccccccggccccg

SEQ ID NO: 5336 - DNA, 22 bp, Homo sapiens
ccgccctacccccccggccccg

SEQ ID NO: 5337 - DNA, 21 bp, Homo sapiens
cgccctacccccccggccccg

SEQ ID NO: 5338 - DNA, 18 bp, Homo sapiens
ccgccccccgttcccccc

SEQ ID NO: 5339 - DNA, 19 bp, Homo sapiens
ctcggcgcgcggcggcggc

SEQ ID NO: 5340 - DNA, 18 bp, Homo sapiens
tcggcgcgcggcggcggc

SEQ ID NO: 5341 - DNA, 17 bp, Homo sapiens
cggcgcgcggcggcggc

SEQ ID NO: 5342 - DNA, 16 bp, Homo sapiens
ggcgcgcggcggcggc

SEQ ID NO: 5343 - DNA, 31 bp, Homo sapiens
cccgccgggtccgcccccggggccgcggttc

SEQ ID NO: 5344 - DNA, 33 bp, Homo sapiens
cccgccgggtccgcccccggggccgcggttccg

SEQ ID NO: 5345 - DNA, 25 bp, Homo sapiens
cgcgcggcgcctcgcctcggccggc

SEQ ID NO: 5346 - DNA, 24 bp, Homo sapiens
gcgcggcgcctcgcctcggccggc

SEQ ID NO: 5347 - DNA, 19 bp, Homo sapiens
cgcggcgcctcgcctcggc

SEQ ID NO: 5348 - DNA, 23 bp, Homo sapiens
cgcggcgcctcgcctcggccggc

SEQ ID NO: 5349 - DNA, 24 bp, Homo sapiens
cgcggcgcctcgcctcggccggcg

SEQ ID NO: 5350 - DNA, 18 bp, Homo sapiens
cggcgcctcgcctcggcc

SEQ ID NO: 5351 - DNA, 21 bp, Homo sapiens
cggcgcctcgcctcggccggc

SEQ ID NO: 5352 - DNA, 33 bp, Homo sapiens
gcctcggccggcgcctagcagccgacttagaac

SEQ ID NO: 5353 - DNA, 16 bp, Homo sapiens
cctcggccggcgccta

SEQ ID NO: 5354 - DNA, 17 bp, Homo sapiens
cctcggccggcgcctag

SEQ ID NO: 5355 - DNA, 22 bp, Homo sapiens
cctcggccggcgcctagcagcc

SEQ ID NO: 5356 - DNA, 23 bp, Homo sapiens
cctcggccggcgcctagcagccg

SEQ ID NO: 5357 - DNA, 29 bp, Homo sapiens
cctcggccggcgcctagcagccgacttag

SEQ ID NO: 5358 - DNA, 32 bp, Homo sapiens
cctcggccggcgcctagcagccgacttagaac

SEQ ID NO: 5359 - DNA, 33 bp, Homo sapiens
cctcggccggcgcctagcagccgacttagaact

SEQ ID NO: 5360 - DNA, 26 bp, Homo sapiens
cggcgcctagcagccgacttagaact

SEQ ID NO: 5361 - DNA, 21 bp, Homo sapiens
gcctagcagccgacttagaac

SEQ ID NO: 5362 - DNA, 22 bp, Homo sapiens
gcctagcagccgacttagaact

SEQ ID NO: 5363 - DNA, 27 bp, Homo sapiens
gcctagcagccgacttagaactggtgc

SEQ ID NO: 5364 - DNA, 32 bp, Homo sapiens
gcctagcagccgacttagaactggtgcggacc

SEQ ID NO: 5365 - DNA, 20 bp, Homo sapiens
cctagcagccgacttagaac

SEQ ID NO: 5366 - DNA, 21 bp, Homo sapiens
cctagcagccgacttagaact

SEQ ID NO: 5367 - DNA, 26 bp, Homo sapiens
cctagcagccgacttagaactggtgc

SEQ ID NO: 5368 - DNA, 18 bp, Homo sapiens
tagcagccgacttagaac

SEQ ID NO: 5369 - DNA, 19 bp, Homo sapiens
tagcagccgacttagaact

SEQ ID NO: 5370 - DNA, 20 bp, Homo sapiens
tagcagccgacttagaactg

SEQ ID NO: 5371 - DNA, 22 bp, Homo sapiens
tagcagccgacttagaactggt

SEQ ID NO: 5372 - DNA, 24 bp, Homo sapiens
tagcagccgacttagaactggtgc

SEQ ID NO: 5373 - DNA, 29 bp, Homo sapiens
tagcagccgacttagaactggtgcggacc

SEQ ID NO: 5374 - DNA, 31 bp, Homo sapiens
tagcagccgacttagaactggtgcggaccag

SEQ ID NO: 5375 - DNA, 17 bp, Homo sapiens
agcagccgacttagaac

SEQ ID NO: 5376 - DNA, 18 bp, Homo sapiens
agcagccgacttagaact

SEQ ID NO: 5377 - DNA, 19 bp, Homo sapiens
agcagccgacttagaactg

SEQ ID NO: 5378 - DNA, 21 bp, Homo sapiens
agcagccgacttagaactggt

SEQ ID NO: 5379 - DNA, 22 bp, Homo sapiens
agcagccgacttagaactggtg

SEQ ID NO: 5380 - DNA, 23 bp, Homo sapiens
agcagccgacttagaactggtgc

SEQ ID NO: 5381 - DNA, 28 bp, Homo sapiens
agcagccgacttagaactggtgcggacc

SEQ ID NO: 5382 - DNA, 29 bp, Homo sapiens
agcagccgacttagaactggtgcggacca

SEQ ID NO: 5383 - DNA, 30 bp, Homo sapiens
agcagccgacttagaactggtgcggaccag

SEQ ID NO: 5384 - DNA, 33 bp, Homo sapiens
agcagccgacttagaactggtgcggaccagggg

SEQ ID NO: 5385 - DNA, 16 bp, Homo sapiens
gcagccgacttagaac

SEQ ID NO: 5386 - DNA, 17 bp, Homo sapiens
gcagccgacttagaact

SEQ ID NO: 5387 - DNA, 18 bp, Homo sapiens
gcagccgacttagaactg

SEQ ID NO: 5388 - DNA, 20 bp, Homo sapiens
gcagccgacttagaactggt

SEQ ID NO: 5389 - DNA, 27 bp, Homo sapiens
gcagccgacttagaactggtgcggacc

SEQ ID NO: 5390 - DNA, 29 bp, Homo sapiens
gcagccgacttagaactggtgcggaccag

SEQ ID NO: 5391 - DNA, 32 bp, Homo sapiens
gcagccgacttagaactggtgcggaccagggg

SEQ ID NO: 5392 - DNA, 33 bp, Homo sapiens
gcagccgacttagaactggtgcggaccagggga

SEQ ID NO: 5393 - DNA, 16 bp, Homo sapiens
cagccgacttagaact

SEQ ID NO: 5394 - DNA, 26 bp, Homo sapiens
cagccgacttagaactggtgcggacc

SEQ ID NO: 5395 - DNA, 32 bp, Homo sapiens
cagccgacttagaactggtgcggaccagggga

SEQ ID NO: 5396 - DNA, 25 bp, Homo sapiens
agccgacttagaactggtgcggacc

SEQ ID NO: 5397 - DNA, 16 bp, Homo sapiens
gccgacttagaactgg

SEQ ID NO: 5398 - DNA, 21 bp, Homo sapiens
gccgacttagaactggtgcgg

SEQ ID NO: 5399 - DNA, 24 bp, Homo sapiens
gccgacttagaactggtgcggacc

SEQ ID NO: 5400 - DNA, 26 bp, Homo sapiens
gccgacttagaactggtgcggaccag

SEQ ID NO: 5401 - DNA, 30 bp, Homo sapiens
gccgacttagaactggtgcggaccagggga

SEQ ID NO: 5402 - DNA, 31 bp, Homo sapiens
gccgacttagaactggtgcggaccaggggaa

SEQ ID NO: 5403 - DNA, 32 bp, Homo sapiens
gccgacttagaactggtgcggaccaggggaat

SEQ ID NO: 5404 - DNA, 33 bp, Homo sapiens
gccgacttagaactggtgcggaccaggggaatc

SEQ ID NO: 5405 - DNA, 23 bp, Homo sapiens
ccgacttagaactggtgcggacc

SEQ ID NO: 5406 - DNA, 22 bp, Homo sapiens
cgacttagaactggtgcggacc

SEQ ID NO: 5407 - DNA, 20 bp, Homo sapiens
acttagaactggtgcggacc

SEQ ID NO: 5408 - DNA, 33 bp, Homo sapiens
acttagaactggtgcggaccaggggaatccgac

SEQ ID NO: 5409 - DNA, 19 bp, Homo sapiens
cttagaactggtgcggacc

SEQ ID NO: 5410 - DNA, 33 bp, Homo sapiens
cttagaactggtgcggaccaggggaatccgact

SEQ ID NO: 5411 - DNA, 18 bp, Homo sapiens
ttagaactggtgcggacc

SEQ ID NO: 5412 - DNA, 32 bp, Homo sapiens
ttagaactggtgcggaccaggggaatccgact

SEQ ID NO: 5413 - DNA, 17 bp, Homo sapiens
tagaactggtgcggacc

SEQ ID NO: 5414 - DNA, 30 bp, Homo sapiens
tagaactggtgcggaccaggggaatccgac

SEQ ID NO: 5415 - DNA, 31 bp, Homo sapiens
tagaactggtgcggaccaggggaatccgact

SEQ ID NO: 5416 - DNA, 16 bp, Homo sapiens
agaactggtgcggacc

SEQ ID NO: 5417 - DNA, 29 bp, Homo sapiens
agaactggtgcggaccaggggaatccgac

SEQ ID NO: 5418 - DNA, 30 bp, Homo sapiens
agaactggtgcggaccaggggaatccgact

SEQ ID NO: 5419 - DNA, 33 bp, Homo sapiens
agaactggtgcggaccaggggaatccgactgtt

SEQ ID NO: 5420 - DNA, 25 bp, Homo sapiens
gaactggtgcggaccaggggaatcc

SEQ ID NO: 5421 - DNA, 28 bp, Homo sapiens
gaactggtgcggaccaggggaatccgac

SEQ ID NO: 5422 - DNA, 29 bp, Homo sapiens
gaactggtgcggaccaggggaatccgact

SEQ ID NO: 5423 - DNA, 32 bp, Homo sapiens
gaactggtgcggaccaggggaatccgactgtt

SEQ ID NO: 5424 - DNA, 24 bp, Homo sapiens
aactggtgcggaccaggggaatcc

SEQ ID NO: 5425 - DNA, 26 bp, Homo sapiens
aactggtgcggaccaggggaatccga

SEQ ID NO: 5426 - DNA, 27 bp, Homo sapiens
aactggtgcggaccaggggaatccgac

SEQ ID NO: 5427 - DNA, 28 bp, Homo sapiens
aactggtgcggaccaggggaatccgact

SEQ ID NO: 5428 - DNA, 29 bp, Homo sapiens
aactggtgcggaccaggggaatccgactg

SEQ ID NO: 5429 - DNA, 30 bp, Homo sapiens
aactggtgcggaccaggggaatccgactgt

SEQ ID NO: 5430 - DNA, 31 bp, Homo sapiens
aactggtgcggaccaggggaatccgactgtt

SEQ ID NO: 5431 - DNA, 32 bp, Homo sapiens
aactggtgcggaccaggggaatccgactgttt

SEQ ID NO: 5432 - DNA, 21 bp, Homo sapiens
actggtgcggaccaggggaat

SEQ ID NO: 5433 - DNA, 25 bp, Homo sapiens
actggtgcggaccaggggaatccga

SEQ ID NO: 5434 - DNA, 26 bp, Homo sapiens
actggtgcggaccaggggaatccgac

SEQ ID NO: 5435 - DNA, 27 bp, Homo sapiens
actggtgcggaccaggggaatccgact

SEQ ID NO: 5436 - DNA, 30 bp, Homo sapiens
actggtgcggaccaggggaatccgactgtt

SEQ ID NO: 5437 - DNA, 31 bp, Homo sapiens
actggtgcggaccaggggaatccgactgttt

SEQ ID NO: 5438 - DNA, 20 bp, Homo sapiens
ctggtgcggaccaggggaat

SEQ ID NO: 5439 - DNA, 24 bp, Homo sapiens
ctggtgcggaccaggggaatccga

SEQ ID NO: 5440 - DNA, 25 bp, Homo sapiens
ctggtgcggaccaggggaatccgac

SEQ ID NO: 5441 - DNA, 26 bp, Homo sapiens
ctggtgcggaccaggggaatccgact

SEQ ID NO: 5442 - DNA, 27 bp, Homo sapiens
ctggtgcggaccaggggaatccgactg

SEQ ID NO: 5443 - DNA, 28 bp, Homo sapiens
ctggtgcggaccaggggaatccgactgt

SEQ ID NO: 5444 - DNA, 29 bp, Homo sapiens
ctggtgcggaccaggggaatccgactgtt

SEQ ID NO: 5445 - DNA, 30 bp, Homo sapiens
ctggtgcggaccaggggaatccgactgttt

SEQ ID NO: 5446 - DNA, 31 bp, Homo sapiens
ctggtgcggaccaggggaatccgactgttta

SEQ ID NO: 5447 - DNA, 32 bp, Homo sapiens
ctggtgcggaccaggggaatccgactgtttaa

SEQ ID NO: 5448 - DNA, 33 bp, Homo sapiens
ctggtgcggaccaggggaatccgactgtttaat

SEQ ID NO: 5449 - DNA, 18 bp, Homo sapiens
tggtgcggaccaggggaa

SEQ ID NO: 5450 - DNA, 19 bp, Homo sapiens
tggtgcggaccaggggaat

SEQ ID NO: 5451 - DNA, 24 bp, Homo sapiens
tggtgcggaccaggggaatccgac

SEQ ID NO: 5452 - DNA, 25 bp, Homo sapiens
tggtgcggaccaggggaatccgact

SEQ ID NO: 5453 - DNA, 28 bp, Homo sapiens
tggtgcggaccaggggaatccgactgtt

SEQ ID NO: 5454 - DNA, 29 bp, Homo sapiens
tggtgcggaccaggggaatccgactgttt

SEQ ID NO: 5455 - DNA, 16 bp, Homo sapiens
ggtgcggaccagggga

SEQ ID NO: 5456 - DNA, 17 bp, Homo sapiens
ggtgcggaccaggggaa

SEQ ID NO: 5457 - DNA, 18 bp, Homo sapiens
ggtgcggaccaggggaat

SEQ ID NO: 5458 - DNA, 19 bp, Homo sapiens
ggtgcggaccaggggaatc

SEQ ID NO: 5459 - DNA, 20 bp, Homo sapiens
ggtgcggaccaggggaatcc

SEQ ID NO: 5460 - DNA, 23 bp, Homo sapiens
ggtgcggaccaggggaatccgac

SEQ ID NO: 5461 - DNA, 24 bp, Homo sapiens
ggtgcggaccaggggaatccgact

SEQ ID NO: 5462 - DNA, 25 bp, Homo sapiens
ggtgcggaccaggggaatccgactg

SEQ ID NO: 5463 - DNA, 27 bp, Homo sapiens
ggtgcggaccaggggaatccgactgtt

SEQ ID NO: 5464 - DNA, 28 bp, Homo sapiens
ggtgcggaccaggggaatccgactgttt

SEQ ID NO: 5465 - DNA, 32 bp, Homo sapiens
ggtgcggaccaggggaatccgactgtttaatt

SEQ ID NO: 5466 - DNA, 33 bp, Homo sapiens
ggtgcggaccaggggaatccgactgtttaatta

SEQ ID NO: 5467 - DNA, 16 bp, Homo sapiens
gtgcggaccaggggaa

SEQ ID NO: 5468 - DNA, 17 bp, Homo sapiens
gtgcggaccaggggaat

SEQ ID NO: 5469 - DNA, 18 bp, Homo sapiens
gtgcggaccaggggaatc

SEQ ID NO: 5470 - DNA, 19 bp, Homo sapiens
gtgcggaccaggggaatcc

SEQ ID NO: 5471 - DNA, 22 bp, Homo sapiens
gtgcggaccaggggaatccgac

SEQ ID NO: 5472 - DNA, 26 bp, Homo sapiens
gtgcggaccaggggaatccgactgtt

SEQ ID NO: 5473 - DNA, 27 bp, Homo sapiens
gtgcggaccaggggaatccgactgttt

SEQ ID NO: 5474 - DNA, 31 bp, Homo sapiens
gtgcggaccaggggaatccgactgtttaatt

SEQ ID NO: 5475 - DNA, 32 bp, Homo sapiens
gtgcggaccaggggaatccgactgtttaatta

SEQ ID NO: 5476 - DNA, 16 bp, Homo sapiens
tgcggaccaggggaat

SEQ ID NO: 5477 - DNA, 17 bp, Homo sapiens
tgcggaccaggggaatc

SEQ ID NO: 5478 - DNA, 18 bp, Homo sapiens
tgcggaccaggggaatcc

SEQ ID NO: 5479 - DNA, 21 bp, Homo sapiens
tgcggaccaggggaatccgac

SEQ ID NO: 5480 - DNA, 22 bp, Homo sapiens
tgcggaccaggggaatccgact

SEQ ID NO: 5481 - DNA, 25 bp, Homo sapiens
tgcggaccaggggaatccgactgtt

SEQ ID NO: 5482 - DNA, 26 bp, Homo sapiens
tgcggaccaggggaatccgactgttt

SEQ ID NO: 5483 - DNA, 30 bp, Homo sapiens
tgcggaccaggggaatccgactgtttaatt

SEQ ID NO: 5484 - DNA, 31 bp, Homo sapiens
tgcggaccaggggaatccgactgtttaatta

SEQ ID NO: 5485 - DNA, 16 bp, Homo sapiens
gcggaccaggggaatc

SEQ ID NO: 5486 - DNA, 17 bp, Homo sapiens
gcggaccaggggaatcc

SEQ ID NO: 5487 - DNA, 20 bp, Homo sapiens
gcggaccaggggaatccgac

SEQ ID NO: 5488 - DNA, 21 bp, Homo sapiens
gcggaccaggggaatccgact

SEQ ID NO: 5489 - DNA, 24 bp, Homo sapiens
gcggaccaggggaatccgactgtt

SEQ ID NO: 5490 - DNA, 25 bp, Homo sapiens
gcggaccaggggaatccgactgttt

SEQ ID NO: 5491 - DNA, 26 bp, Homo sapiens
gcggaccaggggaatccgactgttta

SEQ ID NO: 5492 - DNA, 28 bp, Homo sapiens
gcggaccaggggaatccgactgtttaat

SEQ ID NO: 5493 - DNA, 29 bp, Homo sapiens
gcggaccaggggaatccgactgtttaatt

SEQ ID NO: 5494 - DNA, 30 bp, Homo sapiens
gcggaccaggggaatccgactgtttaatta

SEQ ID NO: 5495 - DNA, 16 bp, Homo sapiens
cggaccaggggaatcc

SEQ ID NO: 5496 - DNA, 19 bp, Homo sapiens
cggaccaggggaatccgac

SEQ ID NO: 5497 - DNA, 20 bp, Homo sapiens
cggaccaggggaatccgact

SEQ ID NO: 5498 - DNA, 23 bp, Homo sapiens
cggaccaggggaatccgactgtt

SEQ ID NO: 5499 - DNA, 24 bp, Homo sapiens
cggaccaggggaatccgactgttt

SEQ ID NO: 5500 - DNA, 25 bp, Homo sapiens
cggaccaggggaatccgactgttta

SEQ ID NO: 5501 - DNA, 27 bp, Homo sapiens
cggaccaggggaatccgactgtttaat

SEQ ID NO: 5502 - DNA, 28 bp, Homo sapiens
cggaccaggggaatccgactgtttaatt

SEQ ID NO: 5503 - DNA, 29 bp, Homo sapiens
cggaccaggggaatccgactgtttaatta

SEQ ID NO: 5504 - DNA, 30 bp, Homo sapiens
cggaccaggggaatccgactgtttaattaa

SEQ ID NO: 5505 - DNA, 19 bp, Homo sapiens
gaccaggggaatccgactg

SEQ ID NO: 5506 - DNA, 20 bp, Homo sapiens
gaccaggggaatccgactgt

SEQ ID NO: 5507 - DNA, 21 bp, Homo sapiens
gaccaggggaatccgactgtt

SEQ ID NO: 5508 - DNA, 22 bp, Homo sapiens
gaccaggggaatccgactgttt

SEQ ID NO: 5509 - DNA, 27 bp, Homo sapiens
gaccaggggaatccgactgtttaatta

SEQ ID NO: 5510 - DNA, 18 bp, Homo sapiens
accaggggaatccgactg

SEQ ID NO: 5511 - DNA, 20 bp, Homo sapiens
accaggggaatccgactgtt

SEQ ID NO: 5512 - DNA, 19 bp, Homo sapiens
ccaggggaatccgactgtt

SEQ ID NO: 5513 - DNA, 20 bp, Homo sapiens
ccaggggaatccgactgttt

SEQ ID NO: 5514 - DNA, 22 bp, Homo sapiens
ccaggggaatccgactgtttaa

SEQ ID NO: 5515 - DNA, 24 bp, Homo sapiens
ccaggggaatccgactgtttaatt

SEQ ID NO: 5516 - DNA, 25 bp, Homo sapiens
ccaggggaatccgactgtttaatta

SEQ ID NO: 5517 - DNA, 16 bp, Homo sapiens
caggggaatccgactg

SEQ ID NO: 5518 - DNA, 17 bp, Homo sapiens
caggggaatccgactgt

SEQ ID NO: 5519 - DNA, 18 bp, Homo sapiens
caggggaatccgactgtt

SEQ ID NO: 5520 - DNA, 19 bp, Homo sapiens
caggggaatccgactgttt

SEQ ID NO: 5521 - DNA, 20 bp, Homo sapiens
caggggaatccgactgttta

SEQ ID NO: 5522 - DNA, 21 bp, Homo sapiens
caggggaatccgactgtttaa

SEQ ID NO: 5523 - DNA, 22 bp, Homo sapiens
caggggaatccgactgtttaat

SEQ ID NO: 5524 - DNA, 23 bp, Homo sapiens
caggggaatccgactgtttaatt

SEQ ID NO: 5525 - DNA, 24 bp, Homo sapiens
caggggaatccgactgtttaatta

SEQ ID NO: 5526 - DNA, 16 bp, Homo sapiens
aggggaatccgactgt

SEQ ID NO: 5527 - DNA, 17 bp, Homo sapiens
aggggaatccgactgtt

SEQ ID NO: 5528 - DNA, 18 bp, Homo sapiens
aggggaatccgactgttt

SEQ ID NO: 5529 - DNA, 19 bp, Homo sapiens
aggggaatccgactgttta

SEQ ID NO: 5530 - DNA, 20 bp, Homo sapiens
aggggaatccgactgtttaa

SEQ ID NO: 5531 - DNA, 21 bp, Homo sapiens
aggggaatccgactgtttaat

SEQ ID NO: 5532 - DNA, 22 bp, Homo sapiens
aggggaatccgactgtttaatt

SEQ ID NO: 5533 - DNA, 23 bp, Homo sapiens
aggggaatccgactgtttaatta

SEQ ID NO: 5534 - DNA, 24 bp, Homo sapiens
aggggaatccgactgtttaattaa

SEQ ID NO: 5535 - DNA, 25 bp, Homo sapiens
aggggaatccgactgtttaattaaa

SEQ ID NO: 5536 - DNA, 16 bp, Homo sapiens
ggggaatccgactgtt

SEQ ID NO: 5537 - DNA, 17 bp, Homo sapiens
ggggaatccgactgttt

SEQ ID NO: 5538 - DNA, 18 bp, Homo sapiens
ggggaatccgactgttta

SEQ ID NO: 5539 - DNA, 19 bp, Homo sapiens
ggggaatccgactgtttaa

SEQ ID NO: 5540 - DNA, 20 bp, Homo sapiens
ggggaatccgactgtttaat

SEQ ID NO: 5541 - DNA, 21 bp, Homo sapiens
ggggaatccgactgtttaatt

SEQ ID NO: 5542 - DNA, 22 bp, Homo sapiens
ggggaatccgactgtttaatta

SEQ ID NO: 5543 - DNA, 23 bp, Homo sapiens
ggggaatccgactgtttaattaa

SEQ ID NO: 5544 - DNA, 16 bp, Homo sapiens
gggaatccgactgttt

SEQ ID NO: 5545 - DNA, 17 bp, Homo sapiens
gggaatccgactgttta

SEQ ID NO: 5546 - DNA, 18 bp, Homo sapiens
gggaatccgactgtttaa

SEQ ID NO: 5547 - DNA, 20 bp, Homo sapiens
gggaatccgactgtttaatt

SEQ ID NO: 5548 - DNA, 21 bp, Homo sapiens
gggaatccgactgtttaatta

SEQ ID NO: 5549 - DNA, 19 bp, Homo sapiens
ggaatccgactgtttaatt

SEQ ID NO: 5550 - DNA, 20 bp, Homo sapiens
ggaatccgactgtttaatta

SEQ ID NO: 5551 - DNA, 16 bp, Homo sapiens
atccgactgtttaatt

SEQ ID NO: 5552 - DNA, 17 bp, Homo sapiens
atccgactgtttaatta

SEQ ID NO: 5553 - DNA, 18 bp, Homo sapiens
atccgactgtttaattaa

SEQ ID NO: 5554 - DNA, 19 bp, Homo sapiens
atccgactgtttaattaaa

SEQ ID NO: 5555 - DNA, 20 bp, Homo sapiens
atccgactgtttaattaaaa

SEQ ID NO: 5556 - DNA, 21 bp, Homo sapiens
atccgactgtttaattaaaac

SEQ ID NO: 5557 - DNA, 22 bp, Homo sapiens
atccgactgtttaattaaaaca

SEQ ID NO: 5558 - DNA, 19 bp, Homo sapiens
ccgactgtttaattaaaac

SEQ ID NO: 5559 - DNA, 20 bp, Homo sapiens
ccgactgtttaattaaaaca

SEQ ID NO: 5560 - DNA, 33 bp, Homo sapiens
actgtttaattaaaacaaagcatcgcgaaggcc

SEQ ID NO: 5561 - DNA, 29 bp, Homo sapiens
gtttaattaaaacaaagcatcgcgaaggc

SEQ ID NO: 5562 - DNA, 30 bp, Homo sapiens
gtttaattaaaacaaagcatcgcgaaggcc

SEQ ID NO: 5563 - DNA, 29 bp, Homo sapiens
tttaattaaaacaaagcatcgcgaaggcc

SEQ ID NO: 5564 - DNA, 30 bp, Homo sapiens
tttaattaaaacaaagcatcgcgaaggccc

SEQ ID NO: 5565 - DNA, 28 bp, Homo sapiens
ttaattaaaacaaagcatcgcgaaggcc

SEQ ID NO: 5566 - DNA, 26 bp, Homo sapiens
taattaaaacaaagcatcgcgaaggc

SEQ ID NO: 5567 - DNA, 27 bp, Homo sapiens
taattaaaacaaagcatcgcgaaggcc

SEQ ID NO: 5568 - DNA, 28 bp, Homo sapiens
taattaaaacaaagcatcgcgaaggccc

SEQ ID NO: 5569 - DNA, 29 bp, Homo sapiens
taattaaaacaaagcatcgcgaaggcccg

SEQ ID NO: 5570 - DNA, 25 bp, Homo sapiens
aattaaaacaaagcatcgcgaaggc

SEQ ID NO: 5571 - DNA, 26 bp, Homo sapiens
aattaaaacaaagcatcgcgaaggcc

SEQ ID NO: 5572 - DNA, 27 bp, Homo sapiens
aattaaaacaaagcatcgcgaaggccc

SEQ ID NO: 5573 - DNA, 28 bp, Homo sapiens
aattaaaacaaagcatcgcgaaggcccg

SEQ ID NO: 5574 - DNA, 24 bp, Homo sapiens
attaaaacaaagcatcgcgaaggc

SEQ ID NO: 5575 - DNA, 25 bp, Homo sapiens
attaaaacaaagcatcgcgaaggcc

SEQ ID NO: 5576 - DNA, 26 bp, Homo sapiens
attaaaacaaagcatcgcgaaggccc

SEQ ID NO: 5577 - DNA, 24 bp, Homo sapiens
ttaaaacaaagcatcgcgaaggcc

SEQ ID NO: 5578 - DNA, 25 bp, Homo sapiens
ttaaaacaaagcatcgcgaaggccc

SEQ ID NO: 5579 - DNA, 22 bp, Homo sapiens
taaaacaaagcatcgcgaaggc

SEQ ID NO: 5580 - DNA, 23 bp, Homo sapiens
taaaacaaagcatcgcgaaggcc

SEQ ID NO: 5581 - DNA, 24 bp, Homo sapiens
taaaacaaagcatcgcgaaggccc

SEQ ID NO: 5582 - DNA, 21 bp, Homo sapiens
aaaacaaagcatcgcgaaggc

SEQ ID NO: 5583 - DNA, 22 bp, Homo sapiens
aaaacaaagcatcgcgaaggcc

SEQ ID NO: 5584 - DNA, 23 bp, Homo sapiens
aaaacaaagcatcgcgaaggccc

SEQ ID NO: 5585 - DNA, 24 bp, Homo sapiens
aaaacaaagcatcgcgaaggcccg

SEQ ID NO: 5586 - DNA, 18 bp, Homo sapiens
aaacaaagcatcgcgaag

SEQ ID NO: 5587 - DNA, 20 bp, Homo sapiens
aaacaaagcatcgcgaaggc

SEQ ID NO: 5588 - DNA, 21 bp, Homo sapiens
aaacaaagcatcgcgaaggcc

SEQ ID NO: 5589 - DNA, 22 bp, Homo sapiens
aaacaaagcatcgcgaaggccc

SEQ ID NO: 5590 - DNA, 23 bp, Homo sapiens
aaacaaagcatcgcgaaggcccg

SEQ ID NO: 5591 - DNA, 17 bp, Homo sapiens
aacaaagcatcgcgaag

SEQ ID NO: 5592 - DNA, 19 bp, Homo sapiens
aacaaagcatcgcgaaggc

SEQ ID NO: 5593 - DNA, 20 bp, Homo sapiens
aacaaagcatcgcgaaggcc

SEQ ID NO: 5594 - DNA, 21 bp, Homo sapiens
aacaaagcatcgcgaaggccc

SEQ ID NO: 5595 - DNA, 22 bp, Homo sapiens
aacaaagcatcgcgaaggcccg

SEQ ID NO: 5596 - DNA, 16 bp, Homo sapiens
acaaagcatcgcgaag

SEQ ID NO: 5597 - DNA, 18 bp, Homo sapiens
acaaagcatcgcgaaggc

SEQ ID NO: 5598 - DNA, 19 bp, Homo sapiens
acaaagcatcgcgaaggcc

SEQ ID NO: 5599 - DNA, 20 bp, Homo sapiens
acaaagcatcgcgaaggccc

SEQ ID NO: 5600 - DNA, 21 bp, Homo sapiens
acaaagcatcgcgaaggcccg

SEQ ID NO: 5601 - DNA, 17 bp, Homo sapiens
caaagcatcgcgaaggc

SEQ ID NO: 5602 - DNA, 18 bp, Homo sapiens
caaagcatcgcgaaggcc

SEQ ID NO: 5603 - DNA, 19 bp, Homo sapiens
caaagcatcgcgaaggccc

SEQ ID NO: 5604 - DNA, 20 bp, Homo sapiens
caaagcatcgcgaaggcccg

SEQ ID NO: 5605 - DNA, 16 bp, Homo sapiens
aaagcatcgcgaaggc

SEQ ID NO: 5606 - DNA, 17 bp, Homo sapiens
aaagcatcgcgaaggcc

SEQ ID NO: 5607 - DNA, 18 bp, Homo sapiens
aaagcatcgcgaaggccc

SEQ ID NO: 5608 - DNA, 19 bp, Homo sapiens
aaagcatcgcgaaggcccg

SEQ ID NO: 5609 - DNA, 16 bp, Homo sapiens
aagcatcgcgaaggcc

SEQ ID NO: 5610 - DNA, 17 bp, Homo sapiens
aagcatcgcgaaggccc

SEQ ID NO: 5611 - DNA, 18 bp, Homo sapiens
aagcatcgcgaaggcccg

SEQ ID NO: 5612 - DNA, 17 bp, Homo sapiens
gaaggcccgcggcgggt

SEQ ID NO: 5613 - DNA, 32 bp, Homo sapiens
gtgttgacgcgatgtgatttctgcccagtgct

SEQ ID NO: 5614 - DNA, 18 bp, Homo sapiens
ttgacgcgatgtgatttc

SEQ ID NO: 5615 - DNA, 16 bp, Homo sapiens
gacgcgatgtgatttc

SEQ ID NO: 5616 - DNA, 23 bp, Homo sapiens
gacgcgatgtgatttctgcccag

SEQ ID NO: 5617 - DNA, 24 bp, Homo sapiens
gacgcgatgtgatttctgcccagt

SEQ ID NO: 5618 - DNA, 33 bp, Homo sapiens
gacgcgatgtgatttctgcccagtgctctgaat

SEQ ID NO: 5619 - DNA, 26 bp, Homo sapiens
acgcgatgtgatttctgcccagtgct

SEQ ID NO: 5620 - DNA, 28 bp, Homo sapiens
acgcgatgtgatttctgcccagtgctct

SEQ ID NO: 5621 - DNA, 32 bp, Homo sapiens
acgcgatgtgatttctgcccagtgctctgaat

SEQ ID NO: 5622 - DNA, 33 bp, Homo sapiens
acgcgatgtgatttctgcccagtgctctgaatg

SEQ ID NO: 5623 - DNA, 33 bp, Homo sapiens
gcgatgtgatttctgcccagtgctctgaatgtc

SEQ ID NO: 5624 - DNA, 31 bp, Homo sapiens
atgtgatttctgcccagtgctctgaatgtca

SEQ ID NO: 5625 - DNA, 29 bp, Homo sapiens
gtgatttctgcccagtgctctgaatgtca

SEQ ID NO: 5626 - DNA, 27 bp, Homo sapiens
tgatttctgcccagtgctctgaatgtc

SEQ ID NO: 5627 - DNA, 26 bp, Homo sapiens
gatttctgcccagtgctctgaatgtc

SEQ ID NO: 5628 - DNA, 25 bp, Homo sapiens
atttctgcccagtgctctgaatgtc

SEQ ID NO: 5629 - DNA, 23 bp, Homo sapiens
ttctgcccagtgctctgaatgtc

SEQ ID NO: 5630 - DNA, 27 bp, Homo sapiens
ttctgcccagtgctctgaatgtcaaag

SEQ ID NO: 5631 - DNA, 29 bp, Homo sapiens
ttctgcccagtgctctgaatgtcaaagtg

SEQ ID NO: 5632 - DNA, 32 bp, Homo sapiens
ttctgcccagtgctctgaatgtcaaagtgaag

SEQ ID NO: 5633 - DNA, 33 bp, Homo sapiens
ttctgcccagtgctctgaatgtcaaagtgaaga

SEQ ID NO: 5634 - DNA, 19 bp, Homo sapiens
tctgcccagtgctctgaat

SEQ ID NO: 5635 - DNA, 22 bp, Homo sapiens
tctgcccagtgctctgaatgtc

SEQ ID NO: 5636 - DNA, 23 bp, Homo sapiens
tctgcccagtgctctgaatgtca

SEQ ID NO: 5637 - DNA, 26 bp, Homo sapiens
tctgcccagtgctctgaatgtcaaag

SEQ ID NO: 5638 - DNA, 28 bp, Homo sapiens
tctgcccagtgctctgaatgtcaaagtg

SEQ ID NO: 5639 - DNA, 31 bp, Homo sapiens
tctgcccagtgctctgaatgtcaaagtgaag

SEQ ID NO: 5640 - DNA, 32 bp, Homo sapiens
tctgcccagtgctctgaatgtcaaagtgaaga

SEQ ID NO: 5641 - DNA, 21 bp, Homo sapiens
ctgcccagtgctctgaatgtc

SEQ ID NO: 5642 - DNA, 22 bp, Homo sapiens
ctgcccagtgctctgaatgtca

SEQ ID NO: 5643 - DNA, 25 bp, Homo sapiens
ctgcccagtgctctgaatgtcaaag

SEQ ID NO: 5644 - DNA, 26 bp, Homo sapiens
ctgcccagtgctctgaatgtcaaagt

SEQ ID NO: 5645 - DNA, 27 bp, Homo sapiens
ctgcccagtgctctgaatgtcaaagtg

SEQ ID NO: 5646 - DNA, 30 bp, Homo sapiens
ctgcccagtgctctgaatgtcaaagtgaag

SEQ ID NO: 5647 - DNA, 31 bp, Homo sapiens
ctgcccagtgctctgaatgtcaaagtgaaga

SEQ ID NO: 5648 - DNA, 16 bp, Homo sapiens
tgcccagtgctctgaa

SEQ ID NO: 5649 - DNA, 17 bp, Homo sapiens
tgcccagtgctctgaat

SEQ ID NO: 5650 - DNA, 18 bp, Homo sapiens
tgcccagtgctctgaatg

SEQ ID NO: 5651 - DNA, 19 bp, Homo sapiens
tgcccagtgctctgaatgt

SEQ ID NO: 5652 - DNA, 20 bp, Homo sapiens
tgcccagtgctctgaatgtc

SEQ ID NO: 5653 - DNA, 21 bp, Homo sapiens
tgcccagtgctctgaatgtca

SEQ ID NO: 5654 - DNA, 23 bp, Homo sapiens
tgcccagtgctctgaatgtcaaa

SEQ ID NO: 5655 - DNA, 24 bp, Homo sapiens
tgcccagtgctctgaatgtcaaag

SEQ ID NO: 5656 - DNA, 25 bp, Homo sapiens
tgcccagtgctctgaatgtcaaagt

SEQ ID NO: 5657 - DNA, 26 bp, Homo sapiens
tgcccagtgctctgaatgtcaaagtg

SEQ ID NO: 5658 - DNA, 29 bp, Homo sapiens
tgcccagtgctctgaatgtcaaagtgaag

SEQ ID NO: 5659 - DNA, 30 bp, Homo sapiens
tgcccagtgctctgaatgtcaaagtgaaga

SEQ ID NO: 5660 - DNA, 31 bp, Homo sapiens
tgcccagtgctctgaatgtcaaagtgaagaa

SEQ ID NO: 5661 - DNA, 32 bp, Homo sapiens
tgcccagtgctctgaatgtcaaagtgaagaaa

SEQ ID NO: 5662 - DNA, 33 bp, Homo sapiens
tgcccagtgctctgaatgtcaaagtgaagaaat

SEQ ID NO: 5663 - DNA, 16 bp, Homo sapiens
gcccagtgctctgaat

SEQ ID NO: 5664 - DNA, 17 bp, Homo sapiens
gcccagtgctctgaatg

SEQ ID NO: 5665 - DNA, 18 bp, Homo sapiens
gcccagtgctctgaatgt

SEQ ID NO: 5666 - DNA, 19 bp, Homo sapiens
gcccagtgctctgaatgtc

SEQ ID NO: 5667 - DNA, 20 bp, Homo sapiens
gcccagtgctctgaatgtca

SEQ ID NO: 5668 - DNA, 23 bp, Homo sapiens
gcccagtgctctgaatgtcaaag

SEQ ID NO: 5669 - DNA, 24 bp, Homo sapiens
gcccagtgctctgaatgtcaaagt

SEQ ID NO: 5670 - DNA, 25 bp, Homo sapiens
gcccagtgctctgaatgtcaaagtg

SEQ ID NO: 5671 - DNA, 28 bp, Homo sapiens
gcccagtgctctgaatgtcaaagtgaag

SEQ ID NO: 5672 - DNA, 30 bp, Homo sapiens
gcccagtgctctgaatgtcaaagtgaagaa

SEQ ID NO: 5673 - DNA, 31 bp, Homo sapiens
gcccagtgctctgaatgtcaaagtgaagaaa

SEQ ID NO: 5674 - DNA, 32 bp, Homo sapiens
gcccagtgctctgaatgtcaaagtgaagaaat

SEQ ID NO: 5675 - DNA, 33 bp, Homo sapiens
gcccagtgctctgaatgtcaaagtgaagaaatt

SEQ ID NO: 5676 - DNA, 18 bp, Homo sapiens
cccagtgctctgaatgtc

SEQ ID NO: 5677 - DNA, 24 bp, Homo sapiens
cccagtgctctgaatgtcaaagtg

SEQ ID NO: 5678 - DNA, 28 bp, Homo sapiens
cccagtgctctgaatgtcaaagtgaaga

SEQ ID NO: 5679 - DNA, 33 bp, Homo sapiens
cccagtgctctgaatgtcaaagtgaagaaattc

SEQ ID NO: 5680 - DNA, 17 bp, Homo sapiens
ccagtgctctgaatgtc

SEQ ID NO: 5681 - DNA, 16 bp, Homo sapiens
cagtgctctgaatgtc

SEQ ID NO: 5682 - DNA, 29 bp, Homo sapiens
tgctctgaatgtcaaagtgaagaaattca

SEQ ID NO: 5683 - DNA, 32 bp, Homo sapiens
tgctctgaatgtcaaagtgaagaaattcaatg

SEQ ID NO: 5684 - DNA, 33 bp, Homo sapiens
tgctctgaatgtcaaagtgaagaaattcaatga

SEQ ID NO: 5685 - DNA, 24 bp, Homo sapiens
ctgaatgtcaaagtgaagaaattc

SEQ ID NO: 5686 - DNA, 22 bp, Homo sapiens
gaatgtcaaagtgaagaaattc

SEQ ID NO: 5687 - DNA, 26 bp, Homo sapiens
gaatgtcaaagtgaagaaattcaatg

SEQ ID NO: 5688 - DNA, 25 bp, Homo sapiens
aatgtcaaagtgaagaaattcaatg

SEQ ID NO: 5689 - DNA, 22 bp, Homo sapiens
atgtcaaagtgaagaaattcaa

SEQ ID NO: 5690 - DNA, 27 bp, Homo sapiens
aagaaattcaatgaagcgcgggtaaac

SEQ ID NO: 5691 - DNA, 28 bp, Homo sapiens
aagaaattcaatgaagcgcgggtaaacg

SEQ ID NO: 5692 - DNA, 19 bp, Homo sapiens
aatgaagcgcgggtaaacg

SEQ ID NO: 5693 - DNA, 29 bp, Homo sapiens
gggtaaacggcgggagtaactatgactct

SEQ ID NO: 5694 - DNA, 27 bp, Homo sapiens
ggtaaacggcgggagtaactatgactc

SEQ ID NO: 5695 - DNA, 28 bp, Homo sapiens
ggtaaacggcgggagtaactatgactct

SEQ ID NO: 5696 - DNA, 30 bp, Homo sapiens
ggtaaacggcgggagtaactatgactctct

SEQ ID NO: 5697 - DNA, 27 bp, Homo sapiens
gtaaacggcgggagtaactatgactct

SEQ ID NO: 5698 - DNA, 24 bp, Homo sapiens
aacggcgggagtaactatgactct

SEQ ID NO: 5699 - DNA, 23 bp, Homo sapiens
acggcgggagtaactatgactct

SEQ ID NO: 5700 - DNA, 20 bp, Homo sapiens
ggcgggagtaactatgactc

SEQ ID NO: 5701 - DNA, 17 bp, Homo sapiens
gcgggagtaactatgac

SEQ ID NO: 5702 - DNA, 18 bp, Homo sapiens
gcgggagtaactatgact

SEQ ID NO: 5703 - DNA, 19 bp, Homo sapiens
gcgggagtaactatgactc

SEQ ID NO: 5704 - DNA, 20 bp, Homo sapiens
gcgggagtaactatgactct

SEQ ID NO: 5705 - DNA, 32 bp, Homo sapiens
gcgggagtaactatgactctcttaaggtagcc

SEQ ID NO: 5706 - DNA, 16 bp, Homo sapiens
ggagtaactatgactc

SEQ ID NO: 5707 - DNA, 28 bp, Homo sapiens
gagtaactatgactctcttaaggtagcc

SEQ ID NO: 5708 - DNA, 16 bp, Homo sapiens
agtaactatgactctc

SEQ ID NO: 5709 - DNA, 17 bp, Homo sapiens
agtaactatgactctct

SEQ ID NO: 5710 - DNA, 18 bp, Homo sapiens
agtaactatgactctctt

SEQ ID NO: 5711 - DNA, 19 bp, Homo sapiens
agtaactatgactctctta

SEQ ID NO: 5712 - DNA, 23 bp, Homo sapiens
agtaactatgactctcttaaggt

SEQ ID NO: 5713 - DNA, 24 bp, Homo sapiens
agtaactatgactctcttaaggta

SEQ ID NO: 5714 - DNA, 26 bp, Homo sapiens
agtaactatgactctcttaaggtagc

SEQ ID NO: 5715 - DNA, 27 bp, Homo sapiens
agtaactatgactctcttaaggtagcc

SEQ ID NO: 5716 - DNA, 28 bp, Homo sapiens
agtaactatgactctcttaaggtagcca

SEQ ID NO: 5717 - DNA, 33 bp, Homo sapiens
agtaactatgactctcttaaggtagccaaatgc

SEQ ID NO: 5718 - DNA, 16 bp, Homo sapiens
gtaactatgactctct

SEQ ID NO: 5719 - DNA, 32 bp, Homo sapiens
taactatgactctcttaaggtagccaaatgcc

SEQ ID NO: 5720 - DNA, 33 bp, Homo sapiens
taactatgactctcttaaggtagccaaatgcct

SEQ ID NO: 5721 - DNA, 27 bp, Homo sapiens
cttaaggtagccaaatgcctcgtcatc

SEQ ID NO: 5722 - DNA, 28 bp, Homo sapiens
cttaaggtagccaaatgcctcgtcatct

SEQ ID NO: 5723 - DNA, 26 bp, Homo sapiens
ttaaggtagccaaatgcctcgtcatc

SEQ ID NO: 5724 - DNA, 27 bp, Homo sapiens
ttaaggtagccaaatgcctcgtcatct

SEQ ID NO: 5725 - DNA, 25 bp, Homo sapiens
taaggtagccaaatgcctcgtcatc

SEQ ID NO: 5726 - DNA, 26 bp, Homo sapiens
taaggtagccaaatgcctcgtcatct

SEQ ID NO: 5727 - DNA, 24 bp, Homo sapiens
aaggtagccaaatgcctcgtcatc

SEQ ID NO: 5728 - DNA, 25 bp, Homo sapiens
aaggtagccaaatgcctcgtcatct

SEQ ID NO: 5729 - DNA, 23 bp, Homo sapiens
aggtagccaaatgcctcgtcatc

SEQ ID NO: 5730 - DNA, 24 bp, Homo sapiens
aggtagccaaatgcctcgtcatct

SEQ ID NO: 5731 - DNA, 22 bp, Homo sapiens
ggtagccaaatgcctcgtcatc

SEQ ID NO: 5732 - DNA, 21 bp, Homo sapiens
gtagccaaatgcctcgtcatc

SEQ ID NO: 5733 - DNA, 22 bp, Homo sapiens
gtagccaaatgcctcgtcatct

SEQ ID NO: 5734 - DNA, 23 bp, Homo sapiens
gtagccaaatgcctcgtcatcta

SEQ ID NO: 5735 - DNA, 20 bp, Homo sapiens
tagccaaatgcctcgtcatc

SEQ ID NO: 5736 - DNA, 21 bp, Homo sapiens
tagccaaatgcctcgtcatct

SEQ ID NO: 5737 - DNA, 19 bp, Homo sapiens
agccaaatgcctcgtcatc

SEQ ID NO: 5738 - DNA, 20 bp, Homo sapiens
agccaaatgcctcgtcatct

SEQ ID NO: 5739 - DNA, 18 bp, Homo sapiens
gccaaatgcctcgtcatc

SEQ ID NO: 5740 - DNA, 19 bp, Homo sapiens
gccaaatgcctcgtcatct

SEQ ID NO: 5741 - DNA, 20 bp, Homo sapiens
gccaaatgcctcgtcatcta

SEQ ID NO: 5742 - DNA, 26 bp, Homo sapiens
gccaaatgcctcgtcatctaattagt

SEQ ID NO: 5743 - DNA, 17 bp, Homo sapiens
ccaaatgcctcgtcatc

SEQ ID NO: 5744 - DNA, 18 bp, Homo sapiens
ccaaatgcctcgtcatct

SEQ ID NO: 5745 - DNA, 19 bp, Homo sapiens
ccaaatgcctcgtcatcta

SEQ ID NO: 5746 - DNA, 16 bp, Homo sapiens
caaatgcctcgtcatc

SEQ ID NO: 5747 - DNA, 16 bp, Homo sapiens
aaatgcctcgtcatct

SEQ ID NO: 5748 - DNA, 16 bp, Homo sapiens
aatgcctcgtcatcta

SEQ ID NO: 5749 - DNA, 22 bp, Homo sapiens
aatgcctcgtcatctaattagt

SEQ ID NO: 5750 - DNA, 22 bp, Homo sapiens
taattagtgacgcgcatgaatg

SEQ ID NO: 5751 - DNA, 26 bp, Homo sapiens
taattagtgacgcgcatgaatggatg

SEQ ID NO: 5752 - DNA, 21 bp, Homo sapiens
aattagtgacgcgcatgaatg

SEQ ID NO: 5753 - DNA, 24 bp, Homo sapiens
aattagtgacgcgcatgaatggat

SEQ ID NO: 5754 - DNA, 25 bp, Homo sapiens
aattagtgacgcgcatgaatggatg

SEQ ID NO: 5755 - DNA, 33 bp, Homo sapiens
aattagtgacgcgcatgaatggatgaacgagat

SEQ ID NO: 5756 - DNA, 20 bp, Homo sapiens
attagtgacgcgcatgaatg

SEQ ID NO: 5757 - DNA, 24 bp, Homo sapiens
attagtgacgcgcatgaatggatg

SEQ ID NO: 5758 - DNA, 33 bp, Homo sapiens
attagtgacgcgcatgaatggatgaacgagatt

SEQ ID NO: 5759 - DNA, 23 bp, Homo sapiens
ttagtgacgcgcatgaatggatg

SEQ ID NO: 5760 - DNA, 32 bp, Homo sapiens
ttagtgacgcgcatgaatggatgaacgagatt

SEQ ID NO: 5761 - DNA, 22 bp, Homo sapiens
tagtgacgcgcatgaatggatg

SEQ ID NO: 5762 - DNA, 31 bp, Homo sapiens
tagtgacgcgcatgaatggatgaacgagatt

SEQ ID NO: 5763 - DNA, 33 bp, Homo sapiens
tagtgacgcgcatgaatggatgaacgagattcc

SEQ ID NO: 5764 - DNA, 17 bp, Homo sapiens
agtgacgcgcatgaatg

SEQ ID NO: 5765 - DNA, 20 bp, Homo sapiens
agtgacgcgcatgaatggat

SEQ ID NO: 5766 - DNA, 21 bp, Homo sapiens
agtgacgcgcatgaatggatg

SEQ ID NO: 5767 - DNA, 30 bp, Homo sapiens
agtgacgcgcatgaatggatgaacgagatt

SEQ ID NO: 5768 - DNA, 31 bp, Homo sapiens
agtgacgcgcatgaatggatgaacgagattc

SEQ ID NO: 5769 - DNA, 32 bp, Homo sapiens
agtgacgcgcatgaatggatgaacgagattcc

SEQ ID NO: 5770 - DNA, 33 bp, Homo sapiens
agtgacgcgcatgaatggatgaacgagattccc

SEQ ID NO: 5771 - DNA, 20 bp, Homo sapiens
gtgacgcgcatgaatggatg

SEQ ID NO: 5772 - DNA, 29 bp, Homo sapiens
gtgacgcgcatgaatggatgaacgagatt

SEQ ID NO: 5773 - DNA, 31 bp, Homo sapiens
gtgacgcgcatgaatggatgaacgagattcc

SEQ ID NO: 5774 - DNA, 32 bp, Homo sapiens
gtgacgcgcatgaatggatgaacgagattccc

SEQ ID NO: 5775 - DNA, 33 bp, Homo sapiens
gtgacgcgcatgaatggatgaacgagattccca

SEQ ID NO: 5776 - DNA, 19 bp, Homo sapiens
tgacgcgcatgaatggatg

SEQ ID NO: 5777 - DNA, 28 bp, Homo sapiens
tgacgcgcatgaatggatgaacgagatt

SEQ ID NO: 5778 - DNA, 30 bp, Homo sapiens
tgacgcgcatgaatggatgaacgagattcc

SEQ ID NO: 5779 - DNA, 31 bp, Homo sapiens
tgacgcgcatgaatggatgaacgagattccc

SEQ ID NO: 5780 - DNA, 32 bp, Homo sapiens
tgacgcgcatgaatggatgaacgagattccca

SEQ ID NO: 5781 - DNA, 33 bp, Homo sapiens
tgacgcgcatgaatggatgaacgagattcccac

SEQ ID NO: 5782 - DNA, 18 bp, Homo sapiens
gacgcgcatgaatggatg

SEQ ID NO: 5783 - DNA, 29 bp, Homo sapiens
gacgcgcatgaatggatgaacgagattcc

SEQ ID NO: 5784 - DNA, 30 bp, Homo sapiens
gacgcgcatgaatggatgaacgagattccc

SEQ ID NO: 5785 - DNA, 31 bp, Homo sapiens
gacgcgcatgaatggatgaacgagattccca

SEQ ID NO: 5786 - DNA, 32 bp, Homo sapiens
gacgcgcatgaatggatgaacgagattcccac

SEQ ID NO: 5787 - DNA, 33 bp, Homo sapiens
gacgcgcatgaatggatgaacgagattcccact

SEQ ID NO: 5788 - DNA, 17 bp, Homo sapiens
acgcgcatgaatggatg

SEQ ID NO: 5789 - DNA, 28 bp, Homo sapiens
acgcgcatgaatggatgaacgagattcc

SEQ ID NO: 5790 - DNA, 29 bp, Homo sapiens
acgcgcatgaatggatgaacgagattccc

SEQ ID NO: 5791 - DNA, 30 bp, Homo sapiens
acgcgcatgaatggatgaacgagattccca

SEQ ID NO: 5792 - DNA, 31 bp, Homo sapiens
acgcgcatgaatggatgaacgagattcccac

SEQ ID NO: 5793 - DNA, 32 bp, Homo sapiens
acgcgcatgaatggatgaacgagattcccact

SEQ ID NO: 5794 - DNA, 33 bp, Homo sapiens
acgcgcatgaatggatgaacgagattcccactg

SEQ ID NO: 5795 - DNA, 16 bp, Homo sapiens
cgcgcatgaatggatg

SEQ ID NO: 5796 - DNA, 30 bp, Homo sapiens
cgcgcatgaatggatgaacgagattcccac

SEQ ID NO: 5797 - DNA, 31 bp, Homo sapiens
cgcgcatgaatggatgaacgagattcccact

SEQ ID NO: 5798 - DNA, 32 bp, Homo sapiens
cgcgcatgaatggatgaacgagattcccactg

SEQ ID NO: 5799 - DNA, 20 bp, Homo sapiens
catgaatggatgaacgagat

SEQ ID NO: 5800 - DNA, 21 bp, Homo sapiens
catgaatggatgaacgagatt

SEQ ID NO: 5801 - DNA, 25 bp, Homo sapiens
catgaatggatgaacgagattccca

SEQ ID NO: 5802 - DNA, 26 bp, Homo sapiens
catgaatggatgaacgagattcccac

SEQ ID NO: 5803 - DNA, 27 bp, Homo sapiens
catgaatggatgaacgagattcccact

SEQ ID NO: 5804 - DNA, 28 bp, Homo sapiens
catgaatggatgaacgagattcccactg

SEQ ID NO: 5805 - DNA, 20 bp, Homo sapiens
atgaatggatgaacgagatt

SEQ ID NO: 5806 - DNA, 26 bp, Homo sapiens
atgaatggatgaacgagattcccact

SEQ ID NO: 5807 - DNA, 19 bp, Homo sapiens
tgaatggatgaacgagatt

SEQ ID NO: 5808 - DNA, 31 bp, Homo sapiens
aacgagattcccactgtccctacctactatc

SEQ ID NO: 5809 - DNA, 32 bp, Homo sapiens
aacgagattcccactgtccctacctactatcc

SEQ ID NO: 5810 - DNA, 18 bp, Homo sapiens
aagaagaccctgttgagc

SEQ ID NO: 5811 - DNA, 19 bp, Homo sapiens
aagaagaccctgttgagct

SEQ ID NO: 5812 - DNA, 20 bp, Homo sapiens
aagaagaccctgttgagctt

SEQ ID NO: 5813 - DNA, 26 bp, Homo sapiens
aagaagaccctgttgagcttgactct

SEQ ID NO: 5814 - DNA, 29 bp, Homo sapiens
aagaagaccctgttgagcttgactctagt

SEQ ID NO: 5815 - DNA, 17 bp, Homo sapiens
agaagaccctgttgagc

SEQ ID NO: 5816 - DNA, 18 bp, Homo sapiens
agaagaccctgttgagct

SEQ ID NO: 5817 - DNA, 25 bp, Homo sapiens
agaagaccctgttgagcttgactct

SEQ ID NO: 5818 - DNA, 28 bp, Homo sapiens
agaagaccctgttgagcttgactctagt

SEQ ID NO: 5819 - DNA, 24 bp, Homo sapiens
gaagaccctgttgagcttgactct

SEQ ID NO: 5820 - DNA, 26 bp, Homo sapiens
gaagaccctgttgagcttgactctag

SEQ ID NO: 5821 - DNA, 27 bp, Homo sapiens
gaagaccctgttgagcttgactctagt

SEQ ID NO: 5822 - DNA, 23 bp, Homo sapiens
aagaccctgttgagcttgactct

SEQ ID NO: 5823 - DNA, 22 bp, Homo sapiens
agaccctgttgagcttgactct

SEQ ID NO: 5824 - DNA, 21 bp, Homo sapiens
gaccctgttgagcttgactct

SEQ ID NO: 5825 - DNA, 26 bp, Homo sapiens
gaccctgttgagcttgactctagtct

SEQ ID NO: 5826 - DNA, 28 bp, Homo sapiens
gaccctgttgagcttgactctagtctgg

SEQ ID NO: 5827 - DNA, 20 bp, Homo sapiens
accctgttgagcttgactct

SEQ ID NO: 5828 - DNA, 25 bp, Homo sapiens
accctgttgagcttgactctagtct

SEQ ID NO: 5829 - DNA, 27 bp, Homo sapiens
accctgttgagcttgactctagtctgg

SEQ ID NO: 5830 - DNA, 26 bp, Homo sapiens
ttgactctagtctggcacggtgaaga

SEQ ID NO: 5831 - DNA, 26 bp, Homo sapiens
agaggtgtagaataagtgggaggccc

SEQ ID NO: 5832 - DNA, 25 bp, Homo sapiens
gaggtgtagaataagtgggaggccc

SEQ ID NO: 5833 - DNA, 27 bp, Homo sapiens
gaggggcccggggcggggtccgccggc

SEQ ID NO: 5834 - DNA, 27 bp, Homo sapiens
aggggcccggggcggggtccgccggcc

SEQ ID NO: 5835 - DNA, 32 bp, Homo sapiens
tgcgggccgccggtgaaataccactactctga

SEQ ID NO: 5836 - DNA, 33 bp, Homo sapiens
tgcgggccgccggtgaaataccactactctgat

SEQ ID NO: 5837 - DNA, 26 bp, Homo sapiens
gcgggccgccggtgaaataccactac

SEQ ID NO: 5838 - DNA, 27 bp, Homo sapiens
gcgggccgccggtgaaataccactact

SEQ ID NO: 5839 - DNA, 28 bp, Homo sapiens
gcgggccgccggtgaaataccactactc

SEQ ID NO: 5840 - DNA, 29 bp, Homo sapiens
gcgggccgccggtgaaataccactactct

SEQ ID NO: 5841 - DNA, 30 bp, Homo sapiens
gcgggccgccggtgaaataccactactctg

SEQ ID NO: 5842 - DNA, 31 bp, Homo sapiens
gcgggccgccggtgaaataccactactctga

SEQ ID NO: 5843 - DNA, 32 bp, Homo sapiens
gcgggccgccggtgaaataccactactctgat

SEQ ID NO: 5844 - DNA, 25 bp, Homo sapiens
cgggccgccggtgaaataccactac

SEQ ID NO: 5845 - DNA, 26 bp, Homo sapiens
cgggccgccggtgaaataccactact

SEQ ID NO: 5846 - DNA, 27 bp, Homo sapiens
cgggccgccggtgaaataccactactc

SEQ ID NO: 5847 - DNA, 29 bp, Homo sapiens
cgggccgccggtgaaataccactactctg

SEQ ID NO: 5848 - DNA, 30 bp, Homo sapiens
cgggccgccggtgaaataccactactctga

SEQ ID NO: 5849 - DNA, 31 bp, Homo sapiens
cgggccgccggtgaaataccactactctgat

SEQ ID NO: 5850 - DNA, 33 bp, Homo sapiens
cgggccgccggtgaaataccactactctgatcg

SEQ ID NO: 5851 - DNA, 29 bp, Homo sapiens
gggccgccggtgaaataccactactctga

SEQ ID NO: 5852 - DNA, 30 bp, Homo sapiens
gggccgccggtgaaataccactactctgat

SEQ ID NO: 5853 - DNA, 24 bp, Homo sapiens
ggccgccggtgaaataccactact

SEQ ID NO: 5854 - DNA, 25 bp, Homo sapiens
ggccgccggtgaaataccactactc

SEQ ID NO: 5855 - DNA, 28 bp, Homo sapiens
ggccgccggtgaaataccactactctga

SEQ ID NO: 5856 - DNA, 29 bp, Homo sapiens
ggccgccggtgaaataccactactctgat

SEQ ID NO: 5857 - DNA, 30 bp, Homo sapiens
ggccgccggtgaaataccactactctgatc

SEQ ID NO: 5858 - DNA, 31 bp, Homo sapiens
ggccgccggtgaaataccactactctgatcg

SEQ ID NO: 5859 - DNA, 32 bp, Homo sapiens
ggccgccggtgaaataccactactctgatcgt

SEQ ID NO: 5860 - DNA, 23 bp, Homo sapiens
gccgccggtgaaataccactact

SEQ ID NO: 5861 - DNA, 27 bp, Homo sapiens
gccgccggtgaaataccactactctga

SEQ ID NO: 5862 - DNA, 28 bp, Homo sapiens
gccgccggtgaaataccactactctgat

SEQ ID NO: 5863 - DNA, 29 bp, Homo sapiens
gccgccggtgaaataccactactctgatc

SEQ ID NO: 5864 - DNA, 30 bp, Homo sapiens
gccgccggtgaaataccactactctgatcg

SEQ ID NO: 5865 - DNA, 31 bp, Homo sapiens
gccgccggtgaaataccactactctgatcgt

SEQ ID NO: 5866 - DNA, 33 bp, Homo sapiens
gccgccggtgaaataccactactctgatcgttt

SEQ ID NO: 5867 - DNA, 32 bp, Homo sapiens
accactactctgatcgttttttcactgacccg

SEQ ID NO: 5868 - DNA, 28 bp, Homo sapiens
actactctgatcgttttttcactgaccc

SEQ ID NO: 5869 - DNA, 29 bp, Homo sapiens
actactctgatcgttttttcactgacccg

SEQ ID NO: 5870 - DNA, 27 bp, Homo sapiens
ccccgaggggctctcgcttctggcgcc

SEQ ID NO: 5871 - DNA, 28 bp, Homo sapiens
ccccgaggggctctcgcttctggcgcca

SEQ ID NO: 5872 - DNA, 26 bp, Homo sapiens
cccgaggggctctcgcttctggcgcc

SEQ ID NO: 5873 - DNA, 27 bp, Homo sapiens
cccgaggggctctcgcttctggcgcca

SEQ ID NO: 5874 - DNA, 16 bp, Homo sapiens
ccgaggggctctcgct

SEQ ID NO: 5875 - DNA, 24 bp, Homo sapiens
ccgaggggctctcgcttctggcgc

SEQ ID NO: 5876 - DNA, 25 bp, Homo sapiens
ccgaggggctctcgcttctggcgcc

SEQ ID NO: 5877 - DNA, 26 bp, Homo sapiens
ccgaggggctctcgcttctggcgcca

SEQ ID NO: 5878 - DNA, 32 bp, Homo sapiens
ccgaggggctctcgcttctggcgccaagcgcc

SEQ ID NO: 5879 - DNA, 33 bp, Homo sapiens
ccgaggggctctcgcttctggcgccaagcgccc

SEQ ID NO: 5880 - DNA, 24 bp, Homo sapiens
cgaggggctctcgcttctggcgcc

SEQ ID NO: 5881 - DNA, 23 bp, Homo sapiens
gaggggctctcgcttctggcgcc

SEQ ID NO: 5882 - DNA, 33 bp, Homo sapiens
gaggggctctcgcttctggcgccaagcgcccgg

SEQ ID NO: 5883 - DNA, 22 bp, Homo sapiens
aggggctctcgcttctggcgcc

SEQ ID NO: 5884 - DNA, 32 bp, Homo sapiens
aggggctctcgcttctggcgccaagcgcccgg

SEQ ID NO: 5885 - DNA, 33 bp, Homo sapiens
aggggctctcgcttctggcgccaagcgcccggc

SEQ ID NO: 5886 - DNA, 33 bp, Homo sapiens
ggggctctcgcttctggcgccaagcgcccggcc

SEQ ID NO: 5887 - DNA, 26 bp, Homo sapiens
ctctcgcttctggcgccaagcgcccg

SEQ ID NO: 5888 - DNA, 27 bp, Homo sapiens
ctctcgcttctggcgccaagcgcccgg

SEQ ID NO: 5889 - DNA, 28 bp, Homo sapiens
ctctcgcttctggcgccaagcgcccggc

SEQ ID NO: 5890 - DNA, 24 bp, Homo sapiens
ctcgcttctggcgccaagcgcccg

SEQ ID NO: 5891 - DNA, 25 bp, Homo sapiens
ctcgcttctggcgccaagcgcccgg

SEQ ID NO: 5892 - DNA, 26 bp, Homo sapiens
ctcgcttctggcgccaagcgcccggc

SEQ ID NO: 5893 - DNA, 23 bp, Homo sapiens
cttctggcgccaagcgcccggcc

SEQ ID NO: 5894 - DNA, 24 bp, Homo sapiens
cttctggcgccaagcgcccggccg

SEQ ID NO: 5895 - DNA, 19 bp, Homo sapiens
tggcgccaagcgcccggcc

SEQ ID NO: 5896 - DNA, 17 bp, Homo sapiens
ccgcgcgccggccgggc

SEQ ID NO: 5897 - DNA, 17 bp, Homo sapiens
cgcgcgccggccgggcg

SEQ ID NO: 5898 - DNA, 16 bp, Homo sapiens
gcgcgccggccgggcg

SEQ ID NO: 5899 - DNA, 16 bp, Homo sapiens
ccggccgggcgcgacc

SEQ ID NO: 5900 - DNA, 27 bp, Homo sapiens
cggccgggcgcgacccgctccggggac

SEQ ID NO: 5901 - DNA, 21 bp, Homo sapiens
gtaacgcaggtgtcctaaggc

SEQ ID NO: 5902 - DNA, 32 bp, Homo sapiens
gtaacgcaggtgtcctaaggcgagctcaggga

SEQ ID NO: 5903 - DNA, 29 bp, Homo sapiens
taaggcgagctcagggaggacagaaacct

SEQ ID NO: 5904 - DNA, 33 bp, Homo sapiens
taaggcgagctcagggaggacagaaacctcccg

SEQ ID NO: 5905 - DNA, 19 bp, Homo sapiens
aaggcgagctcagggagga

SEQ ID NO: 5906 - DNA, 20 bp, Homo sapiens
aaggcgagctcagggaggac

SEQ ID NO: 5907 - DNA, 32 bp, Homo sapiens
aaggcgagctcagggaggacagaaacctcccg

SEQ ID NO: 5908 - DNA, 21 bp, Homo sapiens
agctcagggaggacagaaacc

SEQ ID NO: 5909 - DNA, 19 bp, Homo sapiens
ctcagggaggacagaaacc

SEQ ID NO: 5910 - DNA, 17 bp, Homo sapiens
cagggaggacagaaacc

SEQ ID NO: 5911 - DNA, 18 bp, Homo sapiens
agggaggacagaaacctc

SEQ ID NO: 5912 - DNA, 17 bp, Homo sapiens
gggaggacagaaacctc

SEQ ID NO: 5913 - DNA, 22 bp, Homo sapiens
gaggacagaaacctcccgtgga

SEQ ID NO: 5914 - DNA, 24 bp, Homo sapiens
gaggacagaaacctcccgtggagc

SEQ ID NO: 5915 - DNA, 17 bp, Homo sapiens
aggacagaaacctcccg

SEQ ID NO: 5916 - DNA, 19 bp, Homo sapiens
aggacagaaacctcccgtg

SEQ ID NO: 5917 - DNA, 21 bp, Homo sapiens
aggacagaaacctcccgtgga

SEQ ID NO: 5918 - DNA, 22 bp, Homo sapiens
aggacagaaacctcccgtggag

SEQ ID NO: 5919 - DNA, 23 bp, Homo sapiens
aggacagaaacctcccgtggagc

SEQ ID NO: 5920 - DNA, 28 bp, Homo sapiens
aggacagaaacctcccgtggagcagaag

SEQ ID NO: 5921 - DNA, 21 bp, Homo sapiens
ggacagaaacctcccgtggag

SEQ ID NO: 5922 - DNA, 22 bp, Homo sapiens
ggacagaaacctcccgtggagc

SEQ ID NO: 5923 - DNA, 29 bp, Homo sapiens
gacagaaacctcccgtggagcagaagggc

SEQ ID NO: 5924 - DNA, 28 bp, Homo sapiens
acagaaacctcccgtggagcagaagggc

SEQ ID NO: 5925 - DNA, 22 bp, Homo sapiens
acctcccgtggagcagaagggc

SEQ ID NO: 5926 - DNA, 32 bp, Homo sapiens
cgtggagcagaagggcaaaagctcgcttgatc

SEQ ID NO: 5927 - DNA, 28 bp, Homo sapiens
agcagaagggcaaaagctcgcttgatct

SEQ ID NO: 5928 - DNA, 20 bp, Homo sapiens
cagaagggcaaaagctcgct

SEQ ID NO: 5929 - DNA, 25 bp, Homo sapiens
cagaagggcaaaagctcgcttgatc

SEQ ID NO: 5930 - DNA, 26 bp, Homo sapiens
cagaagggcaaaagctcgcttgatct

SEQ ID NO: 5931 - DNA, 31 bp, Homo sapiens
cagaagggcaaaagctcgcttgatcttgatt

SEQ ID NO: 5932 - DNA, 32 bp, Homo sapiens
cagaagggcaaaagctcgcttgatcttgattt

SEQ ID NO: 5933 - DNA, 19 bp, Homo sapiens
agaagggcaaaagctcgct

SEQ ID NO: 5934 - DNA, 24 bp, Homo sapiens
agaagggcaaaagctcgcttgatc

SEQ ID NO: 5935 - DNA, 25 bp, Homo sapiens
agaagggcaaaagctcgcttgatct

SEQ ID NO: 5936 - DNA, 30 bp, Homo sapiens
agaagggcaaaagctcgcttgatcttgatt

SEQ ID NO: 5937 - DNA, 31 bp, Homo sapiens
agaagggcaaaagctcgcttgatcttgattt

SEQ ID NO: 5938 - DNA, 23 bp, Homo sapiens
gaagggcaaaagctcgcttgatc

SEQ ID NO: 5939 - DNA, 24 bp, Homo sapiens
gaagggcaaaagctcgcttgatct

SEQ ID NO: 5940 - DNA, 29 bp, Homo sapiens
gaagggcaaaagctcgcttgatcttgatt

SEQ ID NO: 5941 - DNA, 30 bp, Homo sapiens
gaagggcaaaagctcgcttgatcttgattt

SEQ ID NO: 5942 - DNA, 31 bp, Homo sapiens
gaagggcaaaagctcgcttgatcttgatttt

SEQ ID NO: 5943 - DNA, 23 bp, Homo sapiens
aagggcaaaagctcgcttgatct

SEQ ID NO: 5944 - DNA, 25 bp, Homo sapiens
ggcaaaagctcgcttgatcttgatt

SEQ ID NO: 5945 - DNA, 26 bp, Homo sapiens
ggcaaaagctcgcttgatcttgattt

SEQ ID NO: 5946 - DNA, 25 bp, Homo sapiens
gcaaaagctcgcttgatcttgattt

SEQ ID NO: 5947 - DNA, 17 bp, Homo sapiens
aaaagctcgcttgatct

SEQ ID NO: 5948 - DNA, 31 bp, Homo sapiens
aaaagctcgcttgatcttgattttcagtacg

SEQ ID NO: 5949 - DNA, 16 bp, Homo sapiens
aaagctcgcttgatct

SEQ ID NO: 5950 - DNA, 21 bp, Homo sapiens
aaagctcgcttgatcttgatt

SEQ ID NO: 5951 - DNA, 30 bp, Homo sapiens
aaagctcgcttgatcttgattttcagtacg

SEQ ID NO: 5952 - DNA, 29 bp, Homo sapiens
aagctcgcttgatcttgattttcagtacg

SEQ ID NO: 5953 - DNA, 24 bp, Homo sapiens
cgcttgatcttgattttcagtacg

SEQ ID NO: 5954 - DNA, 17 bp, Homo sapiens
tcagtacgaatacagac

SEQ ID NO: 5955 - DNA, 25 bp, Homo sapiens
cagtacgaatacagaccgtgaaagc

SEQ ID NO: 5956 - DNA, 32 bp, Homo sapiens
cagtacgaatacagaccgtgaaagcggggcct

SEQ ID NO: 5957 - DNA, 18 bp, Homo sapiens
aatacagaccgtgaaagc

SEQ ID NO: 5958 - DNA, 33 bp, Homo sapiens
accgtgaaagcggggcctcacgatccttctgac

SEQ ID NO: 5959 - DNA, 31 bp, Homo sapiens
cgtgaaagcggggcctcacgatccttctgac

SEQ ID NO: 5960 - DNA, 32 bp, Homo sapiens
cgtgaaagcggggcctcacgatccttctgacc

SEQ ID NO: 5961 - DNA, 33 bp, Homo sapiens
cgtgaaagcggggcctcacgatccttctgacct

SEQ ID NO: 5962 - DNA, 31 bp, Homo sapiens
gtgaaagcggggcctcacgatccttctgacc

SEQ ID NO: 5963 - DNA, 32 bp, Homo sapiens
gtgaaagcggggcctcacgatccttctgacct

SEQ ID NO: 5964 - DNA, 30 bp, Homo sapiens
tgaaagcggggcctcacgatccttctgacc

SEQ ID NO: 5965 - DNA, 31 bp, Homo sapiens
tgaaagcggggcctcacgatccttctgacct

SEQ ID NO: 5966 - DNA, 28 bp, Homo sapiens
aaagcggggcctcacgatccttctgacc

SEQ ID NO: 5967 - DNA, 29 bp, Homo sapiens
aaagcggggcctcacgatccttctgacct

SEQ ID NO: 5968 - DNA, 28 bp, Homo sapiens
aagcggggcctcacgatccttctgacct

SEQ ID NO: 5969 - DNA, 26 bp, Homo sapiens
agcggggcctcacgatccttctgacc

SEQ ID NO: 5970 - DNA, 27 bp, Homo sapiens
agcggggcctcacgatccttctgacct

SEQ ID NO: 5971 - DNA, 25 bp, Homo sapiens
gcggggcctcacgatccttctgacc

SEQ ID NO: 5972 - DNA, 26 bp, Homo sapiens
gcggggcctcacgatccttctgacct

SEQ ID NO: 5973 - DNA, 24 bp, Homo sapiens
cggggcctcacgatccttctgacc

SEQ ID NO: 5974 - DNA, 25 bp, Homo sapiens
cggggcctcacgatccttctgacct

SEQ ID NO: 5975 - DNA, 23 bp, Homo sapiens
ggggcctcacgatccttctgacc

SEQ ID NO: 5976 - DNA, 24 bp, Homo sapiens
ggggcctcacgatccttctgacct

SEQ ID NO: 5977 - DNA, 22 bp, Homo sapiens
gggcctcacgatccttctgacc

SEQ ID NO: 5978 - DNA, 23 bp, Homo sapiens
gggcctcacgatccttctgacct

SEQ ID NO: 5979 - DNA, 18 bp, Homo sapiens
ctcacgatccttctgacc

SEQ ID NO: 5980 - DNA, 19 bp, Homo sapiens
ctcacgatccttctgacct

SEQ ID NO: 5981 - DNA, 17 bp, Homo sapiens
tcacgatccttctgacc

SEQ ID NO: 5982 - DNA, 18 bp, Homo sapiens
tcacgatccttctgacct

SEQ ID NO: 5983 - DNA, 16 bp, Homo sapiens
cacgatccttctgacc

SEQ ID NO: 5984 - DNA, 17 bp, Homo sapiens
cacgatccttctgacct

SEQ ID NO: 5985 - DNA, 16 bp, Homo sapiens
acgatccttctgacct

SEQ ID NO: 5986 - DNA, 24 bp, Homo sapiens
ttttgggttttaagcaggaggtgt

SEQ ID NO: 5987 - DNA, 25 bp, Homo sapiens
ttttgggttttaagcaggaggtgtc

SEQ ID NO: 5988 - DNA, 29 bp, Homo sapiens
acagggataactggcttgtggcggccaag

SEQ ID NO: 5989 - DNA, 16 bp, Homo sapiens
actggcttgtggcggc

SEQ ID NO: 5990 - DNA, 16 bp, Homo sapiens
cgttcatagcgacgtc

SEQ ID NO: 5991 - DNA, 18 bp, Homo sapiens
cgttcatagcgacgtcgc

SEQ ID NO: 5992 - DNA, 19 bp, Homo sapiens
cgttcatagcgacgtcgct

SEQ ID NO: 5993 - DNA, 20 bp, Homo sapiens
cgttcatagcgacgtcgctt

SEQ ID NO: 5994 - DNA, 21 bp, Homo sapiens
cgttcatagcgacgtcgcttt

SEQ ID NO: 5995 - DNA, 24 bp, Homo sapiens
cgttcatagcgacgtcgctttttg

SEQ ID NO: 5996 - DNA, 27 bp, Homo sapiens
cgttcatagcgacgtcgctttttgatc

SEQ ID NO: 5997 - DNA, 17 bp, Homo sapiens
gttcatagcgacgtcgc

SEQ ID NO: 5998 - DNA, 18 bp, Homo sapiens
gttcatagcgacgtcgct

SEQ ID NO: 5999 - DNA, 19 bp, Homo sapiens
gttcatagcgacgtcgctt

SEQ ID NO: 6000 - DNA, 16 bp, Homo sapiens
ttcatagcgacgtcgc

SEQ ID NO: 6001 - DNA, 17 bp, Homo sapiens
ttcatagcgacgtcgct

SEQ ID NO: 6002 - DNA, 18 bp, Homo sapiens
ttcatagcgacgtcgctt

SEQ ID NO: 6003 - DNA, 17 bp, Homo sapiens
tcatagcgacgtcgctt

SEQ ID NO: 6004 - DNA, 16 bp, Homo sapiens
atagcgacgtcgcttt

SEQ ID NO: 6005 - DNA, 22 bp, Homo sapiens
atagcgacgtcgctttttgatc

SEQ ID NO: 6006 - DNA, 24 bp, Homo sapiens
atagcgacgtcgctttttgatcct

SEQ ID NO: 6007 - DNA, 31 bp, Homo sapiens
atagcgacgtcgctttttgatccttcgatgt

SEQ ID NO: 6008 - DNA, 21 bp, Homo sapiens
tagcgacgtcgctttttgatc

SEQ ID NO: 6009 - DNA, 22 bp, Homo sapiens
tagcgacgtcgctttttgatcc

SEQ ID NO: 6010 - DNA, 23 bp, Homo sapiens
tagcgacgtcgctttttgatcct

SEQ ID NO: 6011 - DNA, 30 bp, Homo sapiens
tagcgacgtcgctttttgatccttcgatgt

SEQ ID NO: 6012 - DNA, 20 bp, Homo sapiens
agcgacgtcgctttttgatc

SEQ ID NO: 6013 - DNA, 21 bp, Homo sapiens
agcgacgtcgctttttgatcc

SEQ ID NO: 6014 - DNA, 22 bp, Homo sapiens
agcgacgtcgctttttgatcct

SEQ ID NO: 6015 - DNA, 25 bp, Homo sapiens
agcgacgtcgctttttgatccttcg

SEQ ID NO: 6016 - DNA, 29 bp, Homo sapiens
agcgacgtcgctttttgatccttcgatgt

SEQ ID NO: 6017 - DNA, 19 bp, Homo sapiens
gcgacgtcgctttttgatc

SEQ ID NO: 6018 - DNA, 20 bp, Homo sapiens
gcgacgtcgctttttgatcc

SEQ ID NO: 6019 - DNA, 21 bp, Homo sapiens
gcgacgtcgctttttgatcct

SEQ ID NO: 6020 - DNA, 24 bp, Homo sapiens
gcgacgtcgctttttgatccttcg

SEQ ID NO: 6021 - DNA, 16 bp, Homo sapiens
cgacgtcgctttttga

SEQ ID NO: 6022 - DNA, 18 bp, Homo sapiens
cgacgtcgctttttgatc

SEQ ID NO: 6023 - DNA, 19 bp, Homo sapiens
cgacgtcgctttttgatcc

SEQ ID NO: 6024 - DNA, 20 bp, Homo sapiens
cgacgtcgctttttgatcct

SEQ ID NO: 6025 - DNA, 26 bp, Homo sapiens
cgacgtcgctttttgatccttcgatg

SEQ ID NO: 6026 - DNA, 25 bp, Homo sapiens
gacgtcgctttttgatccttcgatg

SEQ ID NO: 6027 - DNA, 16 bp, Homo sapiens
acgtcgctttttgatc

SEQ ID NO: 6028 - DNA, 24 bp, Homo sapiens
acgtcgctttttgatccttcgatg

SEQ ID NO: 6029 - DNA, 30 bp, Homo sapiens
gctttttgatccttcgatgtcggctcttcc

SEQ ID NO: 6030 - DNA, 31 bp, Homo sapiens
gctttttgatccttcgatgtcggctcttcct

SEQ ID NO: 6031 - DNA, 30 bp, Homo sapiens
ctttttgatccttcgatgtcggctcttcct

SEQ ID NO: 6032 - DNA, 29 bp, Homo sapiens
tttttgatccttcgatgtcggctcttcct

SEQ ID NO: 6033 - DNA, 27 bp, Homo sapiens
ttttgatccttcgatgtcggctcttcc

SEQ ID NO: 6034 - DNA, 28 bp, Homo sapiens
ttttgatccttcgatgtcggctcttcct

SEQ ID NO: 6035 - DNA, 27 bp, Homo sapiens
tttgatccttcgatgtcggctcttcct

SEQ ID NO: 6036 - DNA, 25 bp, Homo sapiens
ttgatccttcgatgtcggctcttcc

SEQ ID NO: 6037 - DNA, 26 bp, Homo sapiens
ttgatccttcgatgtcggctcttcct

SEQ ID NO: 6038 - DNA, 33 bp, Homo sapiens
ttgatccttcgatgtcggctcttcctatcattg

SEQ ID NO: 6039 - DNA, 25 bp, Homo sapiens
tgatccttcgatgtcggctcttcct

SEQ ID NO: 6040 - DNA, 32 bp, Homo sapiens
tgatccttcgatgtcggctcttcctatcattg

SEQ ID NO: 6041 - DNA, 24 bp, Homo sapiens
gatccttcgatgtcggctcttcct

SEQ ID NO: 6042 - DNA, 27 bp, Homo sapiens
gatccttcgatgtcggctcttcctatc

SEQ ID NO: 6043 - DNA, 28 bp, Homo sapiens
gatccttcgatgtcggctcttcctatca

SEQ ID NO: 6044 - DNA, 31 bp, Homo sapiens
gatccttcgatgtcggctcttcctatcattg

SEQ ID NO: 6045 - DNA, 33 bp, Homo sapiens
gatccttcgatgtcggctcttcctatcattgtg

SEQ ID NO: 6046 - DNA, 18 bp, Homo sapiens
atccttcgatgtcggctc

SEQ ID NO: 6047 - DNA, 22 bp, Homo sapiens
atccttcgatgtcggctcttcc

SEQ ID NO: 6048 - DNA, 23 bp, Homo sapiens
atccttcgatgtcggctcttcct

SEQ ID NO: 6049 - DNA, 26 bp, Homo sapiens
atccttcgatgtcggctcttcctatc

SEQ ID NO: 6050 - DNA, 27 bp, Homo sapiens
atccttcgatgtcggctcttcctatca

SEQ ID NO: 6051 - DNA, 30 bp, Homo sapiens
atccttcgatgtcggctcttcctatcattg

SEQ ID NO: 6052 - DNA, 32 bp, Homo sapiens
atccttcgatgtcggctcttcctatcattgtg

SEQ ID NO: 6053 - DNA, 33 bp, Homo sapiens
atccttcgatgtcggctcttcctatcattgtga

SEQ ID NO: 6054 - DNA, 31 bp, Homo sapiens
tccttcgatgtcggctcttcctatcattgtg

SEQ ID NO: 6055 - DNA, 20 bp, Homo sapiens
ccttcgatgtcggctcttcc

SEQ ID NO: 6056 - DNA, 21 bp, Homo sapiens
ccttcgatgtcggctcttcct

SEQ ID NO: 6057 - DNA, 25 bp, Homo sapiens
ccttcgatgtcggctcttcctatca

SEQ ID NO: 6058 - DNA, 29 bp, Homo sapiens
ccttcgatgtcggctcttcctatcattgt

SEQ ID NO: 6059 - DNA, 30 bp, Homo sapiens
ccttcgatgtcggctcttcctatcattgtg

SEQ ID NO: 6060 - DNA, 16 bp, Homo sapiens
cttcgatgtcggctct

SEQ ID NO: 6061 - DNA, 19 bp, Homo sapiens
cttcgatgtcggctcttcc

SEQ ID NO: 6062 - DNA, 20 bp, Homo sapiens
cttcgatgtcggctcttcct

SEQ ID NO: 6063 - DNA, 23 bp, Homo sapiens
cttcgatgtcggctcttcctatc

SEQ ID NO: 6064 - DNA, 24 bp, Homo sapiens
cttcgatgtcggctcttcctatca

SEQ ID NO: 6065 - DNA, 27 bp, Homo sapiens
cttcgatgtcggctcttcctatcattg

SEQ ID NO: 6066 - DNA, 28 bp, Homo sapiens
cttcgatgtcggctcttcctatcattgt

SEQ ID NO: 6067 - DNA, 29 bp, Homo sapiens
cttcgatgtcggctcttcctatcattgtg

SEQ ID NO: 6068 - DNA, 33 bp, Homo sapiens
cttcgatgtcggctcttcctatcattgtgaagc

SEQ ID NO: 6069 - DNA, 17 bp, Homo sapiens
ttcgatgtcggctcttc

SEQ ID NO: 6070 - DNA, 18 bp, Homo sapiens
ttcgatgtcggctcttcc

SEQ ID NO: 6071 - DNA, 19 bp, Homo sapiens
ttcgatgtcggctcttcct

SEQ ID NO: 6072 - DNA, 22 bp, Homo sapiens
ttcgatgtcggctcttcctatc

SEQ ID NO: 6073 - DNA, 23 bp, Homo sapiens
ttcgatgtcggctcttcctatca

SEQ ID NO: 6074 - DNA, 24 bp, Homo sapiens
ttcgatgtcggctcttcctatcat

SEQ ID NO: 6075 - DNA, 25 bp, Homo sapiens
ttcgatgtcggctcttcctatcatt

SEQ ID NO: 6076 - DNA, 26 bp, Homo sapiens
ttcgatgtcggctcttcctatcattg

SEQ ID NO: 6077 - DNA, 28 bp, Homo sapiens
ttcgatgtcggctcttcctatcattgtg

SEQ ID NO: 6078 - DNA, 31 bp, Homo sapiens
ttcgatgtcggctcttcctatcattgtgaag

SEQ ID NO: 6079 - DNA, 32 bp, Homo sapiens
ttcgatgtcggctcttcctatcattgtgaagc

SEQ ID NO: 6080 - DNA, 33 bp, Homo sapiens
ttcgatgtcggctcttcctatcattgtgaagca

SEQ ID NO: 6081 - DNA, 17 bp, Homo sapiens
tcgatgtcggctcttcc

SEQ ID NO: 6082 - DNA, 18 bp, Homo sapiens
tcgatgtcggctcttcct

SEQ ID NO: 6083 - DNA, 21 bp, Homo sapiens
tcgatgtcggctcttcctatc

SEQ ID NO: 6084 - DNA, 22 bp, Homo sapiens
tcgatgtcggctcttcctatca

SEQ ID NO: 6085 - DNA, 27 bp, Homo sapiens
tcgatgtcggctcttcctatcattgtg

SEQ ID NO: 6086 - DNA, 31 bp, Homo sapiens
tcgatgtcggctcttcctatcattgtgaagc

SEQ ID NO: 6087 - DNA, 32 bp, Homo sapiens
tcgatgtcggctcttcctatcattgtgaagca

SEQ ID NO: 6088 - DNA, 16 bp, Homo sapiens
cgatgtcggctcttcc

SEQ ID NO: 6089 - DNA, 17 bp, Homo sapiens
cgatgtcggctcttcct

SEQ ID NO: 6090 - DNA, 20 bp, Homo sapiens
cgatgtcggctcttcctatc

SEQ ID NO: 6091 - DNA, 24 bp, Homo sapiens
cgatgtcggctcttcctatcattg

SEQ ID NO: 6092 - DNA, 31 bp, Homo sapiens
cgatgtcggctcttcctatcattgtgaagca

SEQ ID NO: 6093 - DNA, 16 bp, Homo sapiens
gatgtcggctcttcct

SEQ ID NO: 6094 - DNA, 19 bp, Homo sapiens
gatgtcggctcttcctatc

SEQ ID NO: 6095 - DNA, 20 bp, Homo sapiens
gatgtcggctcttcctatca

SEQ ID NO: 6096 - DNA, 22 bp, Homo sapiens
gatgtcggctcttcctatcatt

SEQ ID NO: 6097 - DNA, 23 bp, Homo sapiens
gatgtcggctcttcctatcattg

SEQ ID NO: 6098 - DNA, 25 bp, Homo sapiens
gatgtcggctcttcctatcattgtg

SEQ ID NO: 6099 - DNA, 26 bp, Homo sapiens
gatgtcggctcttcctatcattgtga

SEQ ID NO: 6100 - DNA, 29 bp, Homo sapiens
gatgtcggctcttcctatcattgtgaagc

SEQ ID NO: 6101 - DNA, 30 bp, Homo sapiens
gatgtcggctcttcctatcattgtgaagca

SEQ ID NO: 6102 - DNA, 31 bp, Homo sapiens
gatgtcggctcttcctatcattgtgaagcag

SEQ ID NO: 6103 - DNA, 32 bp, Homo sapiens
gatgtcggctcttcctatcattgtgaagcaga

SEQ ID NO: 6104 - DNA, 18 bp, Homo sapiens
atgtcggctcttcctatc

SEQ ID NO: 6105 - DNA, 19 bp, Homo sapiens
atgtcggctcttcctatca

SEQ ID NO: 6106 - DNA, 21 bp, Homo sapiens
atgtcggctcttcctatcatt

SEQ ID NO: 6107 - DNA, 24 bp, Homo sapiens
atgtcggctcttcctatcattgtg

SEQ ID NO: 6108 - DNA, 25 bp, Homo sapiens
atgtcggctcttcctatcattgtga

SEQ ID NO: 6109 - DNA, 28 bp, Homo sapiens
atgtcggctcttcctatcattgtgaagc

SEQ ID NO: 6110 - DNA, 29 bp, Homo sapiens
atgtcggctcttcctatcattgtgaagca

SEQ ID NO: 6111 - DNA, 30 bp, Homo sapiens
atgtcggctcttcctatcattgtgaagcag

SEQ ID NO: 6112 - DNA, 31 bp, Homo sapiens
atgtcggctcttcctatcattgtgaagcaga

SEQ ID NO: 6113 - DNA, 33 bp, Homo sapiens
tcctatcattgtgaagcagaattcaccaagcgt

SEQ ID NO: 6114 - DNA, 32 bp, Homo sapiens
cctatcattgtgaagcagaattcaccaagcgt

SEQ ID NO: 6115 - DNA, 29 bp, Homo sapiens
ttgtgaagcagaattcaccaagcgttgga

SEQ ID NO: 6116 - DNA, 33 bp, Homo sapiens
tgtgaagcagaattcaccaagcgttggattgtt

SEQ ID NO: 6117 - DNA, 32 bp, Homo sapiens
gtgaagcagaattcaccaagcgttggattgtt

SEQ ID NO: 6118 - DNA, 33 bp, Homo sapiens
gtgaagcagaattcaccaagcgttggattgttc

SEQ ID NO: 6119 - DNA, 32 bp, Homo sapiens
tgaagcagaattcaccaagcgttggattgttc

SEQ ID NO: 6120 - DNA, 30 bp, Homo sapiens
aagcagaattcaccaagcgttggattgttc

SEQ ID NO: 6121 - DNA, 33 bp, Homo sapiens
aagcagaattcaccaagcgttggattgttcacc

SEQ ID NO: 6122 - DNA, 29 bp, Homo sapiens
agcagaattcaccaagcgttggattgttc

SEQ ID NO: 6123 - DNA, 32 bp, Homo sapiens
agcagaattcaccaagcgttggattgttcacc

SEQ ID NO: 6124 - DNA, 33 bp, Homo sapiens
agcagaattcaccaagcgttggattgttcaccc

SEQ ID NO: 6125 - DNA, 28 bp, Homo sapiens
gcagaattcaccaagcgttggattgttc

SEQ ID NO: 6126 - DNA, 31 bp, Homo sapiens
gcagaattcaccaagcgttggattgttcacc

SEQ ID NO: 6127 - DNA, 32 bp, Homo sapiens
gcagaattcaccaagcgttggattgttcaccc

SEQ ID NO: 6128 - DNA, 33 bp, Homo sapiens
gcagaattcaccaagcgttggattgttcaccca

SEQ ID NO: 6129 - DNA, 27 bp, Homo sapiens
cagaattcaccaagcgttggattgttc

SEQ ID NO: 6130 - DNA, 30 bp, Homo sapiens
cagaattcaccaagcgttggattgttcacc

SEQ ID NO: 6131 - DNA, 31 bp, Homo sapiens
cagaattcaccaagcgttggattgttcaccc

SEQ ID NO: 6132 - DNA, 32 bp, Homo sapiens
cagaattcaccaagcgttggattgttcaccca

SEQ ID NO: 6133 - DNA, 29 bp, Homo sapiens
agaattcaccaagcgttggattgttcacc

SEQ ID NO: 6134 - DNA, 30 bp, Homo sapiens
agaattcaccaagcgttggattgttcaccc

SEQ ID NO: 6135 - DNA, 31 bp, Homo sapiens
agaattcaccaagcgttggattgttcaccca

SEQ ID NO: 6136 - DNA, 33 bp, Homo sapiens
agaattcaccaagcgttggattgttcacccact

SEQ ID NO: 6137 - DNA, 19 bp, Homo sapiens
gaattcaccaagcgttgga

SEQ ID NO: 6138 - DNA, 24 bp, Homo sapiens
gaattcaccaagcgttggattgtt

SEQ ID NO: 6139 - DNA, 25 bp, Homo sapiens
gaattcaccaagcgttggattgttc

SEQ ID NO: 6140 - DNA, 28 bp, Homo sapiens
gaattcaccaagcgttggattgttcacc

SEQ ID NO: 6141 - DNA, 29 bp, Homo sapiens
gaattcaccaagcgttggattgttcaccc

SEQ ID NO: 6142 - DNA, 30 bp, Homo sapiens
gaattcaccaagcgttggattgttcaccca

SEQ ID NO: 6143 - DNA, 31 bp, Homo sapiens
gaattcaccaagcgttggattgttcacccac

SEQ ID NO: 6144 - DNA, 32 bp, Homo sapiens
gaattcaccaagcgttggattgttcacccact

SEQ ID NO: 6145 - DNA, 33 bp, Homo sapiens
gaattcaccaagcgttggattgttcacccacta

SEQ ID NO: 6146 - DNA, 23 bp, Homo sapiens
aattcaccaagcgttggattgtt

SEQ ID NO: 6147 - DNA, 27 bp, Homo sapiens
aattcaccaagcgttggattgttcacc

SEQ ID NO: 6148 - DNA, 28 bp, Homo sapiens
aattcaccaagcgttggattgttcaccc

SEQ ID NO: 6149 - DNA, 29 bp, Homo sapiens
aattcaccaagcgttggattgttcaccca

SEQ ID NO: 6150 - DNA, 30 bp, Homo sapiens
aattcaccaagcgttggattgttcacccac

SEQ ID NO: 6151 - DNA, 31 bp, Homo sapiens
aattcaccaagcgttggattgttcacccact

SEQ ID NO: 6152 - DNA, 32 bp, Homo sapiens
aattcaccaagcgttggattgttcacccacta

SEQ ID NO: 6153 - DNA, 33 bp, Homo sapiens
aattcaccaagcgttggattgttcacccactaa

SEQ ID NO: 6154 - DNA, 26 bp, Homo sapiens
attcaccaagcgttggattgttcacc

SEQ ID NO: 6155 - DNA, 27 bp, Homo sapiens
attcaccaagcgttggattgttcaccc

SEQ ID NO: 6156 - DNA, 29 bp, Homo sapiens
attcaccaagcgttggattgttcacccac

SEQ ID NO: 6157 - DNA, 30 bp, Homo sapiens
attcaccaagcgttggattgttcacccact

SEQ ID NO: 6158 - DNA, 33 bp, Homo sapiens
attcaccaagcgttggattgttcacccactaat

SEQ ID NO: 6159 - DNA, 25 bp, Homo sapiens
ttcaccaagcgttggattgttcacc

SEQ ID NO: 6160 - DNA, 26 bp, Homo sapiens
ttcaccaagcgttggattgttcaccc

SEQ ID NO: 6161 - DNA, 27 bp, Homo sapiens
ttcaccaagcgttggattgttcaccca

SEQ ID NO: 6162 - DNA, 29 bp, Homo sapiens
ttcaccaagcgttggattgttcacccact

SEQ ID NO: 6163 - DNA, 20 bp, Homo sapiens
tcaccaagcgttggattgtt

SEQ ID NO: 6164 - DNA, 24 bp, Homo sapiens
tcaccaagcgttggattgttcacc

SEQ ID NO: 6165 - DNA, 25 bp, Homo sapiens
tcaccaagcgttggattgttcaccc

SEQ ID NO: 6166 - DNA, 26 bp, Homo sapiens
tcaccaagcgttggattgttcaccca

SEQ ID NO: 6167 - DNA, 27 bp, Homo sapiens
tcaccaagcgttggattgttcacccac

SEQ ID NO: 6168 - DNA, 28 bp, Homo sapiens
tcaccaagcgttggattgttcacccact

SEQ ID NO: 6169 - DNA, 31 bp, Homo sapiens
tcaccaagcgttggattgttcacccactaat

SEQ ID NO: 6170 - DNA, 32 bp, Homo sapiens
tcaccaagcgttggattgttcacccactaata

SEQ ID NO: 6171 - DNA, 33 bp, Homo sapiens
tcaccaagcgttggattgttcacccactaatag

SEQ ID NO: 6172 - DNA, 19 bp, Homo sapiens
caccaagcgttggattgtt

SEQ ID NO: 6173 - DNA, 23 bp, Homo sapiens
caccaagcgttggattgttcacc

SEQ ID NO: 6174 - DNA, 24 bp, Homo sapiens
caccaagcgttggattgttcaccc

SEQ ID NO: 6175 - DNA, 25 bp, Homo sapiens
caccaagcgttggattgttcaccca

SEQ ID NO: 6176 - DNA, 26 bp, Homo sapiens
caccaagcgttggattgttcacccac

SEQ ID NO: 6177 - DNA, 27 bp, Homo sapiens
caccaagcgttggattgttcacccact

SEQ ID NO: 6178 - DNA, 30 bp, Homo sapiens
caccaagcgttggattgttcacccactaat

SEQ ID NO: 6179 - DNA, 31 bp, Homo sapiens
caccaagcgttggattgttcacccactaata

SEQ ID NO: 6180 - DNA, 32 bp, Homo sapiens
caccaagcgttggattgttcacccactaatag

SEQ ID NO: 6181 - DNA, 33 bp, Homo sapiens
caccaagcgttggattgttcacccactaatagg

SEQ ID NO: 6182 - DNA, 18 bp, Homo sapiens
accaagcgttggattgtt

SEQ ID NO: 6183 - DNA, 22 bp, Homo sapiens
accaagcgttggattgttcacc

SEQ ID NO: 6184 - DNA, 23 bp, Homo sapiens
accaagcgttggattgttcaccc

SEQ ID NO: 6185 - DNA, 24 bp, Homo sapiens
accaagcgttggattgttcaccca

SEQ ID NO: 6186 - DNA, 25 bp, Homo sapiens
accaagcgttggattgttcacccac

SEQ ID NO: 6187 - DNA, 26 bp, Homo sapiens
accaagcgttggattgttcacccact

SEQ ID NO: 6188 - DNA, 29 bp, Homo sapiens
accaagcgttggattgttcacccactaat

SEQ ID NO: 6189 - DNA, 30 bp, Homo sapiens
accaagcgttggattgttcacccactaata

SEQ ID NO: 6190 - DNA, 31 bp, Homo sapiens
accaagcgttggattgttcacccactaatag

SEQ ID NO: 6191 - DNA, 32 bp, Homo sapiens
accaagcgttggattgttcacccactaatagg

SEQ ID NO: 6192 - DNA, 33 bp, Homo sapiens
accaagcgttggattgttcacccactaataggg

SEQ ID NO: 6193 - DNA, 21 bp, Homo sapiens
ccaagcgttggattgttcacc

SEQ ID NO: 6194 - DNA, 22 bp, Homo sapiens
ccaagcgttggattgttcaccc

SEQ ID NO: 6195 - DNA, 23 bp, Homo sapiens
ccaagcgttggattgttcaccca

SEQ ID NO: 6196 - DNA, 25 bp, Homo sapiens
ccaagcgttggattgttcacccact

SEQ ID NO: 6197 - DNA, 30 bp, Homo sapiens
ccaagcgttggattgttcacccactaatag

SEQ ID NO: 6198 - DNA, 31 bp, Homo sapiens
ccaagcgttggattgttcacccactaatagg

SEQ ID NO: 6199 - DNA, 32 bp, Homo sapiens
ccaagcgttggattgttcacccactaataggg

SEQ ID NO: 6200 - DNA, 17 bp, Homo sapiens
caagcgttggattgttc

SEQ ID NO: 6201 - DNA, 20 bp, Homo sapiens
caagcgttggattgttcacc

SEQ ID NO: 6202 - DNA, 21 bp, Homo sapiens
caagcgttggattgttcaccc

SEQ ID NO: 6203 - DNA, 22 bp, Homo sapiens
caagcgttggattgttcaccca

SEQ ID NO: 6204 - DNA, 24 bp, Homo sapiens
caagcgttggattgttcacccact

SEQ ID NO: 6205 - DNA, 30 bp, Homo sapiens
caagcgttggattgttcacccactaatagg

SEQ ID NO: 6206 - DNA, 31 bp, Homo sapiens
caagcgttggattgttcacccactaataggg

SEQ ID NO: 6207 - DNA, 16 bp, Homo sapiens
aagcgttggattgttc

SEQ ID NO: 6208 - DNA, 17 bp, Homo sapiens
aagcgttggattgttca

SEQ ID NO: 6209 - DNA, 18 bp, Homo sapiens
aagcgttggattgttcac

SEQ ID NO: 6210 - DNA, 19 bp, Homo sapiens
aagcgttggattgttcacc

SEQ ID NO: 6211 - DNA, 20 bp, Homo sapiens
aagcgttggattgttcaccc

SEQ ID NO: 6212 - DNA, 21 bp, Homo sapiens
aagcgttggattgttcaccca

SEQ ID NO: 6213 - DNA, 22 bp, Homo sapiens
aagcgttggattgttcacccac

SEQ ID NO: 6214 - DNA, 23 bp, Homo sapiens
aagcgttggattgttcacccact

SEQ ID NO: 6215 - DNA, 26 bp, Homo sapiens
aagcgttggattgttcacccactaat

SEQ ID NO: 6216 - DNA, 27 bp, Homo sapiens
aagcgttggattgttcacccactaata

SEQ ID NO: 6217 - DNA, 28 bp, Homo sapiens
aagcgttggattgttcacccactaatag

SEQ ID NO: 6218 - DNA, 29 bp, Homo sapiens
aagcgttggattgttcacccactaatagg

SEQ ID NO: 6219 - DNA, 30 bp, Homo sapiens
aagcgttggattgttcacccactaataggg

SEQ ID NO: 6220 - DNA, 31 bp, Homo sapiens
aagcgttggattgttcacccactaataggga

SEQ ID NO: 6221 - DNA, 32 bp, Homo sapiens
aagcgttggattgttcacccactaatagggaa

SEQ ID NO: 6222 - DNA, 18 bp, Homo sapiens
agcgttggattgttcacc

SEQ ID NO: 6223 - DNA, 19 bp, Homo sapiens
agcgttggattgttcaccc

SEQ ID NO: 6224 - DNA, 20 bp, Homo sapiens
agcgttggattgttcaccca

SEQ ID NO: 6225 - DNA, 28 bp, Homo sapiens
agcgttggattgttcacccactaatagg

SEQ ID NO: 6226 - DNA, 18 bp, Homo sapiens
gcgttggattgttcaccc

SEQ ID NO: 6227 - DNA, 17 bp, Homo sapiens
cgttggattgttcaccc

SEQ ID NO: 6228 - DNA, 16 bp, Homo sapiens
ttggattgttcaccca

SEQ ID NO: 6229 - DNA, 18 bp, Homo sapiens
ttggattgttcacccact

SEQ ID NO: 6230 - DNA, 24 bp, Homo sapiens
ttggattgttcacccactaatagg

SEQ ID NO: 6231 - DNA, 25 bp, Homo sapiens
ttggattgttcacccactaataggg

SEQ ID NO: 6232 - DNA, 26 bp, Homo sapiens
ttggattgttcacccactaataggga

SEQ ID NO: 6233 - DNA, 19 bp, Homo sapiens
ctaatagggaacgtgagct

SEQ ID NO: 6234 - DNA, 17 bp, Homo sapiens
aatagggaacgtgagct

SEQ ID NO: 6235 - DNA, 16 bp, Homo sapiens
tagaccgtcgtgagac

SEQ ID NO: 6236 - DNA, 17 bp, Homo sapiens
tagaccgtcgtgagaca

SEQ ID NO: 6237 - DNA, 16 bp, Homo sapiens
agaccgtcgtgagaca

SEQ ID NO: 6238 - DNA, 27 bp, Homo sapiens
ttaccctactgatgatgtgttgttgcc

SEQ ID NO: 6239 - DNA, 30 bp, Homo sapiens
ttaccctactgatgatgtgttgttgccatg

SEQ ID NO: 6240 - DNA, 25 bp, Homo sapiens
accctactgatgatgtgttgttgcc

SEQ ID NO: 6241 - DNA, 16 bp, Homo sapiens
cagtacgagaggaacc

SEQ ID NO: 6242 - DNA, 30 bp, Homo sapiens
gagaggaaccgcaggttcagacatttggtg

SEQ ID NO: 6243 - DNA, 16 bp, Homo sapiens
aaccgcaggttcagac

SEQ ID NO: 6244 - DNA, 28 bp, Homo sapiens
atttggtgtatgtgcttggctgaggagc

SEQ ID NO: 6245 - DNA, 29 bp, Homo sapiens
atttggtgtatgtgcttggctgaggagcc

SEQ ID NO: 6246 - DNA, 24 bp, Homo sapiens
ggtgtatgtgcttggctgaggagc

SEQ ID NO: 6247 - DNA, 25 bp, Homo sapiens
ggtgtatgtgcttggctgaggagcc

SEQ ID NO: 6248 - DNA, 23 bp, Homo sapiens
gtgtatgtgcttggctgaggagc

SEQ ID NO: 6249 - DNA, 24 bp, Homo sapiens
gtgtatgtgcttggctgaggagcc

SEQ ID NO: 6250 - DNA, 22 bp, Homo sapiens
tgtatgtgcttggctgaggagc

SEQ ID NO: 6251 - DNA, 23 bp, Homo sapiens
tgtatgtgcttggctgaggagcc

SEQ ID NO: 6252 - DNA, 21 bp, Homo sapiens
gtatgtgcttggctgaggagc

SEQ ID NO: 6253 - DNA, 22 bp, Homo sapiens
gtatgtgcttggctgaggagcc

SEQ ID NO: 6254 - DNA, 20 bp, Homo sapiens
tatgtgcttggctgaggagc

SEQ ID NO: 6255 - DNA, 21 bp, Homo sapiens
tatgtgcttggctgaggagcc

SEQ ID NO: 6256 - DNA, 18 bp, Homo sapiens
tgtgcttggctgaggagc

SEQ ID NO: 6257 - DNA, 19 bp, Homo sapiens
tgtgcttggctgaggagcc

SEQ ID NO: 6258 - DNA, 27 bp, Homo sapiens
tgtgcttggctgaggagccaatggggc

SEQ ID NO: 6259 - DNA, 33 bp, Homo sapiens
tgtgcttggctgaggagccaatggggcgaagct

SEQ ID NO: 6260 - DNA, 17 bp, Homo sapiens
gtgcttggctgaggagc

SEQ ID NO: 6261 - DNA, 18 bp, Homo sapiens
gtgcttggctgaggagcc

SEQ ID NO: 6262 - DNA, 26 bp, Homo sapiens
gtgcttggctgaggagccaatggggc

SEQ ID NO: 6263 - DNA, 16 bp, Homo sapiens
tgcttggctgaggagc

SEQ ID NO: 6264 - DNA, 17 bp, Homo sapiens
tgcttggctgaggagcc

SEQ ID NO: 6265 - DNA, 23 bp, Homo sapiens
cttggctgaggagccaatggggc

SEQ ID NO: 6266 - DNA, 21 bp, Homo sapiens
tggctgaggagccaatggggc

SEQ ID NO: 6267 - DNA, 33 bp, Homo sapiens
gctgaggagccaatggggcgaagctaccatctg

SEQ ID NO: 6268 - DNA, 17 bp, Homo sapiens
aatggggcgaagctacc

SEQ ID NO: 6269 - DNA, 26 bp, Homo sapiens
aagctaccatctgtgggattatgact

SEQ ID NO: 6270 - DNA, 32 bp, Homo sapiens
aagctaccatctgtgggattatgactgaacgc

SEQ ID NO: 6271 - DNA, 33 bp, Homo sapiens
aagctaccatctgtgggattatgactgaacgcc

SEQ ID NO: 6272 - DNA, 32 bp, Homo sapiens
agctaccatctgtgggattatgactgaacgcc

SEQ ID NO: 6273 - DNA, 33 bp, Homo sapiens
agctaccatctgtgggattatgactgaacgcct

SEQ ID NO: 6274 - DNA, 24 bp, Homo sapiens
gctaccatctgtgggattatgact

SEQ ID NO: 6275 - DNA, 31 bp, Homo sapiens
gctaccatctgtgggattatgactgaacgcc

SEQ ID NO: 6276 - DNA, 32 bp, Homo sapiens
gctaccatctgtgggattatgactgaacgcct

SEQ ID NO: 6277 - DNA, 30 bp, Homo sapiens
ctaccatctgtgggattatgactgaacgcc

SEQ ID NO: 6278 - DNA, 31 bp, Homo sapiens
ctaccatctgtgggattatgactgaacgcct

SEQ ID NO: 6279 - DNA, 29 bp, Homo sapiens
taccatctgtgggattatgactgaacgcc

SEQ ID NO: 6280 - DNA, 30 bp, Homo sapiens
taccatctgtgggattatgactgaacgcct

SEQ ID NO: 6281 - DNA, 21 bp, Homo sapiens
accatctgtgggattatgact

SEQ ID NO: 6282 - DNA, 23 bp, Homo sapiens
accatctgtgggattatgactga

SEQ ID NO: 6283 - DNA, 24 bp, Homo sapiens
accatctgtgggattatgactgaa

SEQ ID NO: 6284 - DNA, 26 bp, Homo sapiens
accatctgtgggattatgactgaacg

SEQ ID NO: 6285 - DNA, 27 bp, Homo sapiens
accatctgtgggattatgactgaacgc

SEQ ID NO: 6286 - DNA, 28 bp, Homo sapiens
accatctgtgggattatgactgaacgcc

SEQ ID NO: 6287 - DNA, 29 bp, Homo sapiens
accatctgtgggattatgactgaacgcct

SEQ ID NO: 6288 - DNA, 30 bp, Homo sapiens
accatctgtgggattatgactgaacgcctc

SEQ ID NO: 6289 - DNA, 31 bp, Homo sapiens
accatctgtgggattatgactgaacgcctct

SEQ ID NO: 6290 - DNA, 32 bp, Homo sapiens
accatctgtgggattatgactgaacgcctcta

SEQ ID NO: 6291 - DNA, 33 bp, Homo sapiens
accatctgtgggattatgactgaacgcctctaa

SEQ ID NO: 6292 - DNA, 27 bp, Homo sapiens
ccatctgtgggattatgactgaacgcc

SEQ ID NO: 6293 - DNA, 28 bp, Homo sapiens
ccatctgtgggattatgactgaacgcct

SEQ ID NO: 6294 - DNA, 26 bp, Homo sapiens
catctgtgggattatgactgaacgcc

SEQ ID NO: 6295 - DNA, 27 bp, Homo sapiens
catctgtgggattatgactgaacgcct

SEQ ID NO: 6296 - DNA, 25 bp, Homo sapiens
atctgtgggattatgactgaacgcc

SEQ ID NO: 6297 - DNA, 26 bp, Homo sapiens
atctgtgggattatgactgaacgcct

SEQ ID NO: 6298 - DNA, 27 bp, Homo sapiens
atctgtgggattatgactgaacgcctc

SEQ ID NO: 6299 - DNA, 24 bp, Homo sapiens
tctgtgggattatgactgaacgcc

SEQ ID NO: 6300 - DNA, 25 bp, Homo sapiens
tctgtgggattatgactgaacgcct

SEQ ID NO: 6301 - DNA, 23 bp, Homo sapiens
ctgtgggattatgactgaacgcc

SEQ ID NO: 6302 - DNA, 24 bp, Homo sapiens
ctgtgggattatgactgaacgcct

SEQ ID NO: 6303 - DNA, 22 bp, Homo sapiens
tgtgggattatgactgaacgcc

SEQ ID NO: 6304 - DNA, 23 bp, Homo sapiens
tgtgggattatgactgaacgcct

SEQ ID NO: 6305 - DNA, 18 bp, Homo sapiens
gtgggattatgactgaac

SEQ ID NO: 6306 - DNA, 21 bp, Homo sapiens
gtgggattatgactgaacgcc

SEQ ID NO: 6307 - DNA, 22 bp, Homo sapiens
gtgggattatgactgaacgcct

SEQ ID NO: 6308 - DNA, 21 bp, Homo sapiens
tgggattatgactgaacgcct

SEQ ID NO: 6309 - DNA, 19 bp, Homo sapiens
gggattatgactgaacgcc

SEQ ID NO: 6310 - DNA, 20 bp, Homo sapiens
gggattatgactgaacgcct

SEQ ID NO: 6311 - DNA, 17 bp, Homo sapiens
gattatgactgaacgcc

SEQ ID NO: 6312 - DNA, 18 bp, Homo sapiens
gattatgactgaacgcct

SEQ ID NO: 6313 - DNA, 16 bp, Homo sapiens
attatgactgaacgcc

SEQ ID NO: 6314 - DNA, 17 bp, Homo sapiens
attatgactgaacgcct

SEQ ID NO: 6315 - DNA, 16 bp, Homo sapiens
atgactgaacgcctct

SEQ ID NO: 6316 - DNA, 18 bp, Homo sapiens
gactgaacgcctctaagt

SEQ ID NO: 6317 - DNA, 18 bp, Homo sapiens
ctaagtcagaatcccgcc

SEQ ID NO: 6318 - DNA, 19 bp, Homo sapiens
ctaagtcagaatcccgccc

SEQ ID NO: 6319 - DNA, 22 bp, Homo sapiens
ctaagtcagaatcccgcccagg

SEQ ID NO: 6320 - DNA, 16 bp, Homo sapiens
gcagcgccgcggagcc

SEQ ID NO: 6321 - DNA, 31 bp, Homo sapiens
gcagcgccgcggagcctcggttggcctcgga

SEQ ID NO: 6322 - DNA, 30 bp, Homo sapiens
cagcgccgcggagcctcggttggcctcgga

SEQ ID NO: 6323 - DNA, 25 bp, Homo sapiens
agcgccgcggagcctcggttggcct

SEQ ID NO: 6324 - DNA, 29 bp, Homo sapiens
agcgccgcggagcctcggttggcctcgga

SEQ ID NO: 6325 - DNA, 26 bp, Homo sapiens
gcgccgcggagcctcggttggcctcg

SEQ ID NO: 6326 - DNA, 22 bp, Homo sapiens
cgcggagcctcggttggcctcg

SEQ ID NO: 6327 - DNA, 20 bp, Homo sapiens
gcggagcctcggttggcctc

SEQ ID NO: 6328 - DNA, 21 bp, Homo sapiens
gcggagcctcggttggcctcg

SEQ ID NO: 6329 - DNA, 17 bp, Homo sapiens
cggagcctcggttggcc

SEQ ID NO: 6330 - DNA, 19 bp, Homo sapiens
cggagcctcggttggcctc

SEQ ID NO: 6331 - DNA, 32 bp, Homo sapiens
cggagcctcggttggcctcggatagccggtcc

SEQ ID NO: 6332 - DNA, 33 bp, Homo sapiens
cggagcctcggttggcctcggatagccggtccc

SEQ ID NO: 6333 - DNA, 16 bp, Homo sapiens
ggagcctcggttggcc

SEQ ID NO: 6334 - DNA, 30 bp, Homo sapiens
ggagcctcggttggcctcggatagccggtc

SEQ ID NO: 6335 - DNA, 32 bp, Homo sapiens
ggagcctcggttggcctcggatagccggtccc

SEQ ID NO: 6336 - DNA, 29 bp, Homo sapiens
gagcctcggttggcctcggatagccggtc

SEQ ID NO: 6337 - DNA, 33 bp, Homo sapiens
agcctcggttggcctcggatagccggtcccccg

SEQ ID NO: 6338 - DNA, 16 bp, Homo sapiens
tcggttggcctcggat

SEQ ID NO: 6339 - DNA, 23 bp, Homo sapiens
cggttggcctcggatagccggtc

SEQ ID NO: 6340 - DNA, 21 bp, Homo sapiens
tcggatagccggtcccccgcc

SEQ ID NO: 6341 - DNA, 22 bp, Homo sapiens
tcggatagccggtcccccgcct

SEQ ID NO: 6342 - DNA, 16 bp, Homo sapiens
gatagccggtcccccg

SEQ ID NO: 6343 - DNA, 17 bp, Homo sapiens
gatagccggtcccccgc

SEQ ID NO: 6344 - DNA, 18 bp, Homo sapiens
gatagccggtcccccgcc

SEQ ID NO: 6345 - DNA, 19 bp, Homo sapiens
gatagccggtcccccgcct

SEQ ID NO: 6346 - DNA, 17 bp, Homo sapiens
atagccggtcccccgcc

SEQ ID NO: 6347 - DNA, 18 bp, Homo sapiens
atagccggtcccccgcct

SEQ ID NO: 6348 - DNA, 16 bp, Homo sapiens
agccggtcccccgcct

SEQ ID NO: 6349 - DNA, 18 bp, Homo sapiens
tgtccccgccggcgggcc

SEQ ID NO: 6350 - DNA, 21 bp, Homo sapiens
tgtccccgccggcgggccgcc

SEQ ID NO: 6351 - DNA, 22 bp, Homo sapiens
tgtccccgccggcgggccgccc

SEQ ID NO: 6352 - DNA, 17 bp, Homo sapiens
gtccccgccggcgggcc

SEQ ID NO: 6353 - DNA, 16 bp, Homo sapiens
tccccgccggcgggcc

SEQ ID NO: 6354 - DNA, 25 bp, Homo sapiens
acgcgccccgcgcgcgcgggagggc

SEQ ID NO: 6355 - DNA, 20 bp, Homo sapiens
ccccgcgcgcgcgggagggc

SEQ ID NO: 6356 - DNA, 33 bp, Homo sapiens
accggggtccggtgcggagtgcccttcgtcctg

SEQ ID NO: 6357 - DNA, 27 bp, Homo sapiens
gtccggtgcggagtgcccttcgtcctg

SEQ ID NO: 6358 - DNA, 21 bp, Homo sapiens
cggtgcggagtgcccttcgtc

SEQ ID NO: 6359 - DNA, 20 bp, Homo sapiens
ggtgcggagtgcccttcgtc

SEQ ID NO: 6360 - DNA, 17 bp, Homo sapiens
gagtgcccttcgtcctg

SEQ ID NO: 6361 - DNA, 18 bp, Homo sapiens
gagtgcccttcgtcctgg

SEQ ID NO: 6362 - DNA, 16 bp, Homo sapiens
cgcccgtcacgcaccg

SEQ ID NO: 6363 - DNA, 32 bp, Homo sapiens
acgcaccgcacgttcgtggggaacctggcgct

SEQ ID NO: 6364 - DNA, 31 bp, Homo sapiens
cgcaccgcacgttcgtggggaacctggcgct

SEQ ID NO: 6365 - DNA, 29 bp, Homo sapiens
caccgcacgttcgtggggaacctggcgct

SEQ ID NO: 6366 - DNA, 33 bp, Homo sapiens
caccgcacgttcgtggggaacctggcgctaaac

SEQ ID NO: 6367 - DNA, 27 bp, Homo sapiens
ccgcacgttcgtggggaacctggcgct

SEQ ID NO: 6368 - DNA, 31 bp, Homo sapiens
ccgcacgttcgtggggaacctggcgctaaac

SEQ ID NO: 6369 - DNA, 32 bp, Homo sapiens
ccgcacgttcgtggggaacctggcgctaaacc

SEQ ID NO: 6370 - DNA, 26 bp, Homo sapiens
cgcacgttcgtggggaacctggcgct

SEQ ID NO: 6371 - DNA, 31 bp, Homo sapiens
cgcacgttcgtggggaacctggcgctaaacc

SEQ ID NO: 6372 - DNA, 25 bp, Homo sapiens
gcacgttcgtggggaacctggcgct

SEQ ID NO: 6373 - DNA, 30 bp, Homo sapiens
gcacgttcgtggggaacctggcgctaaacc

SEQ ID NO: 6374 - DNA, 31 bp, Homo sapiens
gcacgttcgtggggaacctggcgctaaacca

SEQ ID NO: 6375 - DNA, 33 bp, Homo sapiens
gcacgttcgtggggaacctggcgctaaaccatt

SEQ ID NO: 6376 - DNA, 24 bp, Homo sapiens
cacgttcgtggggaacctggcgct

SEQ ID NO: 6377 - DNA, 29 bp, Homo sapiens
cacgttcgtggggaacctggcgctaaacc

SEQ ID NO: 6378 - DNA, 30 bp, Homo sapiens
cacgttcgtggggaacctggcgctaaacca

SEQ ID NO: 6379 - DNA, 22 bp, Homo sapiens
cgttcgtggggaacctggcgct

SEQ ID NO: 6380 - DNA, 27 bp, Homo sapiens
cgttcgtggggaacctggcgctaaacc

SEQ ID NO: 6381 - DNA, 20 bp, Homo sapiens
ttcgtggggaacctggcgct

SEQ ID NO: 6382 - DNA, 25 bp, Homo sapiens
ttcgtggggaacctggcgctaaacc

SEQ ID NO: 6383 - DNA, 26 bp, Homo sapiens
ttcgtggggaacctggcgctaaacca

SEQ ID NO: 6384 - DNA, 28 bp, Homo sapiens
ttcgtggggaacctggcgctaaaccatt

SEQ ID NO: 6385 - DNA, 24 bp, Homo sapiens
tcgtggggaacctggcgctaaacc

SEQ ID NO: 6386 - DNA, 18 bp, Homo sapiens
cgtggggaacctggcgct

SEQ ID NO: 6387 - DNA, 23 bp, Homo sapiens
cgtggggaacctggcgctaaacc

SEQ ID NO: 6388 - DNA, 26 bp, Homo sapiens
cgtggggaacctggcgctaaaccatt

SEQ ID NO: 6389 - DNA, 22 bp, Homo sapiens
gtggggaacctggcgctaaacc

SEQ ID NO: 6390 - DNA, 16 bp, Homo sapiens
tggggaacctggcgct

SEQ ID NO: 6391 - DNA, 21 bp, Homo sapiens
tggggaacctggcgctaaacc

SEQ ID NO: 6392 - DNA, 25 bp, Homo sapiens
acctggcgctaaaccattcgtagac

SEQ ID NO: 6393 - DNA, 24 bp, Homo sapiens
cctggcgctaaaccattcgtagac

SEQ ID NO: 6394 - DNA, 25 bp, Homo sapiens
cctggcgctaaaccattcgtagacg

SEQ ID NO: 6395 - DNA, 24 bp, Homo sapiens
ctggcgctaaaccattcgtagacg

SEQ ID NO: 6396 - DNA, 26 bp, Homo sapiens
ctggcgctaaaccattcgtagacgac

SEQ ID NO: 6397 - DNA, 27 bp, Homo sapiens
ctggcgctaaaccattcgtagacgacc

SEQ ID NO: 6398 - DNA, 31 bp, Homo sapiens
ctggcgctaaaccattcgtagacgacctgct

SEQ ID NO: 6399 - DNA, 22 bp, Homo sapiens
tggcgctaaaccattcgtagac

SEQ ID NO: 6400 - DNA, 23 bp, Homo sapiens
tggcgctaaaccattcgtagacg

SEQ ID NO: 6401 - DNA, 26 bp, Homo sapiens
tggcgctaaaccattcgtagacgacc

SEQ ID NO: 6402 - DNA, 21 bp, Homo sapiens
ggcgctaaaccattcgtagac

SEQ ID NO: 6403 - DNA, 22 bp, Homo sapiens
ggcgctaaaccattcgtagacg

SEQ ID NO: 6404 - DNA, 24 bp, Homo sapiens
ggcgctaaaccattcgtagacgac

SEQ ID NO: 6405 - DNA, 19 bp, Homo sapiens
cgctaaaccattcgtagac

SEQ ID NO: 6406 - DNA, 22 bp, Homo sapiens
cgctaaaccattcgtagacgac

SEQ ID NO: 6407 - DNA, 23 bp, Homo sapiens
cgctaaaccattcgtagacgacc

SEQ ID NO: 6408 - DNA, 24 bp, Homo sapiens
cgctaaaccattcgtagacgacct

SEQ ID NO: 6409 - DNA, 27 bp, Homo sapiens
cgctaaaccattcgtagacgacctgct

SEQ ID NO: 6410 - DNA, 28 bp, Homo sapiens
cgctaaaccattcgtagacgacctgctt

SEQ ID NO: 6411 - DNA, 29 bp, Homo sapiens
cgctaaaccattcgtagacgacctgcttc

SEQ ID NO: 6412 - DNA, 18 bp, Homo sapiens
gctaaaccattcgtagac

SEQ ID NO: 6413 - DNA, 19 bp, Homo sapiens
gctaaaccattcgtagacg

SEQ ID NO: 6414 - DNA, 21 bp, Homo sapiens
gctaaaccattcgtagacgac

SEQ ID NO: 6415 - DNA, 22 bp, Homo sapiens
gctaaaccattcgtagacgacc

SEQ ID NO: 6416 - DNA, 23 bp, Homo sapiens
gctaaaccattcgtagacgacct

SEQ ID NO: 6417 - DNA, 26 bp, Homo sapiens
gctaaaccattcgtagacgacctgct

SEQ ID NO: 6418 - DNA, 27 bp, Homo sapiens
gctaaaccattcgtagacgacctgctt

SEQ ID NO: 6419 - DNA, 28 bp, Homo sapiens
gctaaaccattcgtagacgacctgcttc

SEQ ID NO: 6420 - DNA, 20 bp, Homo sapiens
ctaaaccattcgtagacgac

SEQ ID NO: 6421 - DNA, 21 bp, Homo sapiens
ctaaaccattcgtagacgacc

SEQ ID NO: 6422 - DNA, 22 bp, Homo sapiens
ctaaaccattcgtagacgacct

SEQ ID NO: 6423 - DNA, 25 bp, Homo sapiens
ctaaaccattcgtagacgacctgct

SEQ ID NO: 6424 - DNA, 26 bp, Homo sapiens
ctaaaccattcgtagacgacctgctt

SEQ ID NO: 6425 - DNA, 27 bp, Homo sapiens
ctaaaccattcgtagacgacctgcttc

SEQ ID NO: 6426 - DNA, 20 bp, Homo sapiens
taaaccattcgtagacgacc

SEQ ID NO: 6427 - DNA, 21 bp, Homo sapiens
taaaccattcgtagacgacct

SEQ ID NO: 6428 - DNA, 24 bp, Homo sapiens
taaaccattcgtagacgacctgct

SEQ ID NO: 6429 - DNA, 25 bp, Homo sapiens
taaaccattcgtagacgacctgctt

SEQ ID NO: 6430 - DNA, 26 bp, Homo sapiens
taaaccattcgtagacgacctgcttc

SEQ ID NO: 6431 - DNA, 16 bp, Homo sapiens
aaaccattcgtagacg

SEQ ID NO: 6432 - DNA, 18 bp, Homo sapiens
aaaccattcgtagacgac

SEQ ID NO: 6433 - DNA, 19 bp, Homo sapiens
aaaccattcgtagacgacc

SEQ ID NO: 6434 - DNA, 20 bp, Homo sapiens
aaaccattcgtagacgacct

SEQ ID NO: 6435 - DNA, 23 bp, Homo sapiens
aaaccattcgtagacgacctgct

SEQ ID NO: 6436 - DNA, 24 bp, Homo sapiens
aaaccattcgtagacgacctgctt

SEQ ID NO: 6437 - DNA, 25 bp, Homo sapiens
aaaccattcgtagacgacctgcttc

SEQ ID NO: 6438 - DNA, 26 bp, Homo sapiens
aaaccattcgtagacgacctgcttct

SEQ ID NO: 6439 - DNA, 17 bp, Homo sapiens
aaccattcgtagacgac

SEQ ID NO: 6440 - DNA, 18 bp, Homo sapiens
aaccattcgtagacgacc

SEQ ID NO: 6441 - DNA, 19 bp, Homo sapiens
aaccattcgtagacgacct

SEQ ID NO: 6442 - DNA, 22 bp, Homo sapiens
aaccattcgtagacgacctgct

SEQ ID NO: 6443 - DNA, 23 bp, Homo sapiens
aaccattcgtagacgacctgctt

SEQ ID NO: 6444 - DNA, 24 bp, Homo sapiens
aaccattcgtagacgacctgcttc

SEQ ID NO: 6445 - DNA, 25 bp, Homo sapiens
aaccattcgtagacgacctgcttct

SEQ ID NO: 6446 - DNA, 16 bp, Homo sapiens
accattcgtagacgac

SEQ ID NO: 6447 - DNA, 17 bp, Homo sapiens
accattcgtagacgacc

SEQ ID NO: 6448 - DNA, 21 bp, Homo sapiens
accattcgtagacgacctgct

SEQ ID NO: 6449 - DNA, 22 bp, Homo sapiens
accattcgtagacgacctgctt

SEQ ID NO: 6450 - DNA, 23 bp, Homo sapiens
accattcgtagacgacctgcttc

SEQ ID NO: 6451 - DNA, 16 bp, Homo sapiens
ccattcgtagacgacc

SEQ ID NO: 6452 - DNA, 21 bp, Homo sapiens
ccattcgtagacgacctgctt

SEQ ID NO: 6453 - DNA, 22 bp, Homo sapiens
ccattcgtagacgacctgcttc

SEQ ID NO: 6454 - DNA, 16 bp, Homo sapiens
cattcgtagacgacct

SEQ ID NO: 6455 - DNA, 19 bp, Homo sapiens
cattcgtagacgacctgct

SEQ ID NO: 6456 - DNA, 18 bp, Homo sapiens
attcgtagacgacctgct

SEQ ID NO: 6457 - DNA, 19 bp, Homo sapiens
attcgtagacgacctgctt

SEQ ID NO: 6458 - DNA, 20 bp, Homo sapiens
attcgtagacgacctgcttc

SEQ ID NO: 6459 - DNA, 21 bp, Homo sapiens
attcgtagacgacctgcttct

SEQ ID NO: 6460 - DNA, 18 bp, Homo sapiens
cgtagacgacctgcttct

SEQ ID NO: 6461 - DNA, 30 bp, Homo sapiens
tctgggtcggggtttcgtacgtagcagagc

SEQ ID NO: 6462 - DNA, 33 bp, Homo sapiens
ctgggtcggggtttcgtacgtagcagagcagct

SEQ ID NO: 6463 - DNA, 24 bp, Homo sapiens
tgggtcggggtttcgtacgtagca

SEQ ID NO: 6464 - DNA, 28 bp, Homo sapiens
tgggtcggggtttcgtacgtagcagagc

SEQ ID NO: 6465 - DNA, 29 bp, Homo sapiens
tgggtcggggtttcgtacgtagcagagca

SEQ ID NO: 6466 - DNA, 33 bp, Homo sapiens
tgggtcggggtttcgtacgtagcagagcagctc

SEQ ID NO: 6467 - DNA, 21 bp, Homo sapiens
tcgtacgtagcagagcagctc

SEQ ID NO: 6468 - DNA, 22 bp, Homo sapiens
tcgtacgtagcagagcagctcc

SEQ ID NO: 6469 - DNA, 24 bp, Homo sapiens
tcgtacgtagcagagcagctccct

SEQ ID NO: 6470 - DNA, 20 bp, Homo sapiens
cgtacgtagcagagcagctc

SEQ ID NO: 6471 - DNA, 21 bp, Homo sapiens
cgtacgtagcagagcagctcc

SEQ ID NO: 6472 - DNA, 22 bp, Homo sapiens
cgtacgtagcagagcagctccc

SEQ ID NO: 6473 - DNA, 23 bp, Homo sapiens
cgtacgtagcagagcagctccct

SEQ ID NO: 6474 - DNA, 24 bp, Homo sapiens
cgtacgtagcagagcagctccctc

SEQ ID NO: 6475 - DNA, 19 bp, Homo sapiens
gtacgtagcagagcagctc

SEQ ID NO: 6476 - DNA, 21 bp, Homo sapiens
gtacgtagcagagcagctccc

SEQ ID NO: 6477 - DNA, 22 bp, Homo sapiens
gtacgtagcagagcagctccct

SEQ ID NO: 6478 - DNA, 18 bp, Homo sapiens
tacgtagcagagcagctc

SEQ ID NO: 6479 - DNA, 19 bp, Homo sapiens
tacgtagcagagcagctcc

SEQ ID NO: 6480 - DNA, 20 bp, Homo sapiens
tacgtagcagagcagctccc

SEQ ID NO: 6481 - DNA, 21 bp, Homo sapiens
tacgtagcagagcagctccct

SEQ ID NO: 6482 - DNA, 22 bp, Homo sapiens
tacgtagcagagcagctccctc

SEQ ID NO: 6483 - DNA, 26 bp, Homo sapiens
tacgtagcagagcagctccctcgctg

SEQ ID NO: 6484 - DNA, 19 bp, Homo sapiens
cgtagcagagcagctccct

SEQ ID NO: 6485 - DNA, 18 bp, Homo sapiens
gctccctcgctgcgatct

SEQ ID NO: 6486 - DNA, 26 bp, Homo sapiens
gctccctcgctgcgatctattgaaag

SEQ ID NO: 6487 - DNA, 28 bp, Homo sapiens
gctccctcgctgcgatctattgaaagtc

SEQ ID NO: 6488 - DNA, 27 bp, Homo sapiens
ctccctcgctgcgatctattgaaagtc

SEQ ID NO: 6489 - DNA, 26 bp, Homo sapiens
tccctcgctgcgatctattgaaagtc

SEQ ID NO: 6490 - DNA, 23 bp, Homo sapiens
ctcgctgcgatctattgaaagtc

SEQ ID NO: 6491 - DNA, 16 bp, Homo sapiens
tcgctgcgatctattg

SEQ ID NO: 6492 - DNA, 20 bp, Homo sapiens
tcgctgcgatctattgaaag

SEQ ID NO: 6493 - DNA, 21 bp, Homo sapiens
tcgctgcgatctattgaaagt

SEQ ID NO: 6494 - DNA, 22 bp, Homo sapiens
tcgctgcgatctattgaaagtc

SEQ ID NO: 6495 - DNA, 32 bp, Homo sapiens
tcgctgcgatctattgaaagtcagccctcgac

SEQ ID NO: 6496 - DNA, 16 bp, Homo sapiens
cgctgcgatctattga

SEQ ID NO: 6497 - DNA, 19 bp, Homo sapiens
cgctgcgatctattgaaag

SEQ ID NO: 6498 - DNA, 20 bp, Homo sapiens
cgctgcgatctattgaaagt

SEQ ID NO: 6499 - DNA, 21 bp, Homo sapiens
cgctgcgatctattgaaagtc

SEQ ID NO: 6500 - DNA, 31 bp, Homo sapiens
cgctgcgatctattgaaagtcagccctcgac

SEQ ID NO: 6501 - DNA, 18 bp, Homo sapiens
gctgcgatctattgaaag

SEQ ID NO: 6502 - DNA, 19 bp, Homo sapiens
gctgcgatctattgaaagt

SEQ ID NO: 6503 - DNA, 20 bp, Homo sapiens
gctgcgatctattgaaagtc

SEQ ID NO: 6504 - DNA, 19 bp, Homo sapiens
ctgcgatctattgaaagtc

SEQ ID NO: 6505 - DNA, 16 bp, Homo sapiens
tattgaaagtcagccc

SEQ ID NO: 6506 - DNA, 21 bp, Homo sapiens
tattgaaagtcagccctcgac

SEQ ID NO: 6507 - DNA, 32 bp, Homo sapiens
tattgaaagtcagccctcgacacaagggtttg

SEQ ID NO: 6508 - DNA, 33 bp, Homo sapiens
tattgaaagtcagccctcgacacaagggtttgt

SEQ ID NO: 6509 - DNA, 20 bp, Homo sapiens
attgaaagtcagccctcgac

SEQ ID NO: 6510 - DNA, 31 bp, Homo sapiens
attgaaagtcagccctcgacacaagggtttg

SEQ ID NO: 6511 - DNA, 32 bp, Homo sapiens
attgaaagtcagccctcgacacaagggtttgt

SEQ ID NO: 6512 - DNA, 30 bp, Homo sapiens
ttgaaagtcagccctcgacacaagggtttg

SEQ ID NO: 6513 - DNA, 31 bp, Homo sapiens
ttgaaagtcagccctcgacacaagggtttgt

SEQ ID NO: 6514 - DNA, 28 bp, Homo sapiens
gaaagtcagccctcgacacaagggtttg

SEQ ID NO: 6515 - DNA, 29 bp, Homo sapiens
gaaagtcagccctcgacacaagggtttgt

SEQ ID NO: 6516 - DNA, 22 bp, Homo sapiens
agccctcgacacaagggtttgt

SEQ ID NO: 6517 - DNA, 18 bp, Homo sapiens
cctcgacacaagggtttg

SEQ ID NO: 6518 - DNA, 19 bp, Homo sapiens
cctcgacacaagggtttgt

SEQ ID NO: 6519 - DNA, 17 bp, Homo sapiens
ctcgacacaagggtttg

SEQ ID NO: 6520 - DNA, 18 bp, Homo sapiens
ctcgacacaagggtttgt

SEQ ID NO: 6521 - DNA, 16 bp, Homo sapiens
tcgacacaagggtttg

SEQ ID NO: 6522 - DNA, 17 bp, Homo sapiens
tcgacacaagggtttgt

SEQ ID NO: 6523 - DNA, 16 bp, Homo sapiens
cgacacaagggtttgt

SEQ ID NO: 6524 - DNA, 18 bp, Homo sapiens
cgggcgtggtggtggggg

SEQ ID NO: 6525 - DNA, 28 bp, Homo sapiens
agcgtctacggccataccaccctgaacg

SEQ ID NO: 6526 - DNA, 42 bp, Homo sapiens
agcgtctacggccataccaccctgaacgcgcccgatctcgtc

SEQ ID NO: 6527 - DNA, 18 bp, Homo sapiens
gtctacggccataccacc

SEQ ID NO: 6528 - DNA, 19 bp, Homo sapiens
gtctacggccataccaccc

SEQ ID NO: 6529 - DNA, 20 bp, Homo sapiens
gtctacggccataccaccct

SEQ ID NO: 6530 - DNA, 22 bp, Homo sapiens
gtctacggccataccaccctga

SEQ ID NO: 6531 - DNA, 23 bp, Homo sapiens
gtctacggccataccaccctgaa

SEQ ID NO: 6532 - DNA, 24 bp, Homo sapiens
gtctacggccataccaccctgaac

SEQ ID NO: 6533 - DNA, 25 bp, Homo sapiens
gtctacggccataccaccctgaacg

SEQ ID NO: 6534 - DNA, 26 bp, Homo sapiens
gtctacggccataccaccctgaacgc

SEQ ID NO: 6535 - DNA, 27 bp, Homo sapiens
gtctacggccataccaccctgaacgcg

SEQ ID NO: 6536 - DNA, 28 bp, Homo sapiens
gtctacggccataccaccctgaacgcgc

SEQ ID NO: 6537 - DNA, 29 bp, Homo sapiens
gtctacggccataccaccctgaacgcgcc

SEQ ID NO: 6538 - DNA, 30 bp, Homo sapiens; identical to SEQ ID NO: 8

SEQ ID NO: 6539 - DNA, 31 bp, Homo sapiens; identical to SEQ ID NO: 9

SEQ ID NO: 6540 - DNA, 32 bp, Homo sapiens; identical to SEQ ID NO: 10

SEQ ID NO: 6541 - DNA, 33 bp, Homo sapiens; identical to SEQ ID NO: 11

SEQ ID NO: 6542 - DNA, 34 bp, Homo sapiens
gtctacggccataccaccctgaacgcgcccgatc

SEQ ID NO: 6543 - DNA, 35 bp, Homo sapiens
gtctacggccataccaccctgaacgcgcccgatct

SEQ ID NO: 6544 - DNA, 36 bp, Homo sapiens
gtctacggccataccaccctgaacgcgcccgatctc

SEQ ID NO: 6545 - DNA, 37 bp, Homo sapiens
gtctacggccataccaccctgaacgcgcccgatctcg

SEQ ID NO: 6546 - DNA, 38 bp, Homo sapiens
gtctacggccataccaccctgaacgcgcccgatctcgt

SEQ ID NO: 6547 - DNA, 39 bp, Homo sapiens
gtctacggccataccaccctgaacgcgcccgatctcgtc

SEQ ID NO: 6548 - DNA, 40 bp, Homo sapiens
gtctacggccataccaccctgaacgcgcccgatctcgtct

SEQ ID NO: 6549 - DNA, 41 bp, Homo sapiens
gtctacggccataccaccctgaacgcgcccgatctcgtctg

SEQ ID NO: 6550 - DNA, 42 bp, Homo sapiens
gtctacggccataccaccctgaacgcgcccgatctcgtctga

SEQ ID NO: 6551 - DNA, 43 bp, Homo sapiens
gtctacggccataccaccctgaacgcgcccgatctcgtctgat

SEQ ID NO: 6552 - DNA, 44 bp, Homo sapiens
gtctacggccataccaccctgaacgcgcccgatctcgtctgatc

SEQ ID NO: 6553 - DNA, 45 bp, Homo sapiens
gtctacggccataccaccctgaacgcgcccgatctcgtctgatct

SEQ ID NO: 6554 - DNA, 47 bp, Homo sapiens
gtctacggccataccaccctgaacgcgcccgatctcgtctgatctcg

SEQ ID NO: 6555 - DNA, 24 bp, Homo sapiens
tctacggccataccaccctgaacg

SEQ ID NO: 6556 - DNA, 28 bp, Homo sapiens
tctacggccataccaccctgaacgcgcc

SEQ ID NO: 6557 - DNA, 30 bp, Homo sapiens
tctacggccataccaccctgaacgcgcccg

SEQ ID NO: 6558 - DNA, 31 bp, Homo sapiens; identical to SEQ ID NO: 12

SEQ ID NO: 6559 - DNA, 32 bp, Homo sapiens; identical to SEQ ID NO: 13

SEQ ID NO: 6560 - DNA, 33 bp, Homo sapiens; identical to SEQ ID NO: 14

SEQ ID NO: 6561 - DNA, 38 bp, Homo sapiens
tctacggccataccaccctgaacgcgcccgatctcgtc

SEQ ID NO: 6562 - DNA, 23 bp, Homo sapiens
ctacggccataccaccctgaacg

SEQ ID NO: 6563 - DNA, 27 bp, Homo sapiens
ctacggccataccaccctgaacgcgcc

SEQ ID NO: 6564 - DNA, 28 bp, Homo sapiens
ctacggccataccaccctgaacgcgccc

SEQ ID NO: 6565 - DNA, 29 bp, Homo sapiens
ctacggccataccaccctgaacgcgcccg

SEQ ID NO: 6566 - DNA, 30 bp, Homo sapiens; identical to SEQ ID NO: 15

SEQ ID NO: 6567 - DNA, 31 bp, Homo sapiens; identical to SEQ ID NO: 16

SEQ ID NO: 6568 - DNA, 32 bp, Homo sapiens; identical to SEQ ID NO: 17

SEQ ID NO: 6569 - DNA, 33 bp, Homo sapiens
ctacggccataccaccctgaacgcgcccgatct

SEQ ID NO: 6570 - DNA, 36 bp, Homo sapiens
ctacggccataccaccctgaacgcgcccgatctcgt

SEQ ID NO: 6571 - DNA, 37 bp, Homo sapiens
ctacggccataccaccctgaacgcgcccgatctcgtc

SEQ ID NO: 6572 - DNA, 38 bp, Homo sapiens
ctacggccataccaccctgaacgcgcccgatctcgtct

SEQ ID NO: 6573 - DNA, 22 bp, Homo sapiens
tacggccataccaccctgaacg

SEQ ID NO: 6574 - DNA, 24 bp, Homo sapiens
tacggccataccaccctgaacgcg

SEQ ID NO: 6575 - DNA, 26 bp, Homo sapiens
tacggccataccaccctgaacgcgcc

SEQ ID NO: 6576 - DNA, 28 bp, Homo sapiens
tacggccataccaccctgaacgcgcccg

SEQ ID NO: 6577 - DNA, 29 bp, Homo sapiens
tacggccataccaccctgaacgcgcccga

SEQ ID NO: 6578 - DNA, 30 bp, Homo sapiens; identical to SEQ ID NO: 20

SEQ ID NO: 6579 - DNA, 31 bp, Homo sapiens; identical to SEQ ID NO: 21

SEQ ID NO: 6580 - DNA, 32 bp, Homo sapiens
tacggccataccaccctgaacgcgcccgatct

SEQ ID NO: 6581 - DNA, 36 bp, Homo sapiens
tacggccataccaccctgaacgcgcccgatctcgtc

SEQ ID NO: 6582 - DNA, 20 bp, Homo sapiens
acggccataccaccctgaac

SEQ ID NO: 6583 - DNA, 21 bp, Homo sapiens
acggccataccaccctgaacg

SEQ ID NO: 6584 - DNA, 23 bp, Homo sapiens
acggccataccaccctgaacgcg

SEQ ID NO: 6585 - DNA, 25 bp, Homo sapiens
acggccataccaccctgaacgcgcc

SEQ ID NO: 6586 - DNA, 26 bp, Homo sapiens
acggccataccaccctgaacgcgccc

SEQ ID NO: 6587 - DNA, 27 bp, Homo sapiens
acggccataccaccctgaacgcgcccg

SEQ ID NO: 6588 - DNA, 28 bp, Homo sapiens
acggccataccaccctgaacgcgcccga

SEQ ID NO: 6589 - DNA, 29 bp, Homo sapiens
acggccataccaccctgaacgcgcccgat

SEQ ID NO: 6590 - DNA, 30 bp, Homo sapiens; identical to SEQ ID NO: 26

SEQ ID NO: 6591 - DNA, 31 bp, Homo sapiens; identical to SEQ ID NO: 27

SEQ ID NO: 6592 - DNA, 32 bp, Homo sapiens
acggccataccaccctgaacgcgcccgatctc

SEQ ID NO: 6593 - DNA, 33 bp, Homo sapiens; identical to SEQ ID NO: 28

SEQ ID NO: 6594 - DNA, 34 bp, Homo sapiens
acggccataccaccctgaacgcgcccgatctcgt

SEQ ID NO: 6595 - DNA, 35 bp, Homo sapiens
acggccataccaccctgaacgcgcccgatctcgtc

SEQ ID NO: 6596 - DNA, 36 bp, Homo sapiens
acggccataccaccctgaacgcgcccgatctcgtct

SEQ ID NO: 6597 - DNA, 17 bp, Homo sapiens
cggccataccaccctga

SEQ ID NO: 6598 - DNA, 18 bp, Homo sapiens
cggccataccaccctgaa

SEQ ID NO: 6599 - DNA, 19 bp, Homo sapiens
cggccataccaccctgaac

SEQ ID NO: 6600 - DNA, 20 bp, Homo sapiens
cggccataccaccctgaacg

SEQ ID NO: 6601 - DNA, 21 bp, Homo sapiens
cggccataccaccctgaacgc

SEQ ID NO: 6602 - DNA, 22 bp, Homo sapiens
cggccataccaccctgaacgcg

SEQ ID NO: 6603 - DNA, 24 bp, Homo sapiens
cggccataccaccctgaacgcgcc

SEQ ID NO: 6604 - DNA, 25 bp, Homo sapiens
cggccataccaccctgaacgcgccc

SEQ ID NO: 6605 - DNA, 26 bp, Homo sapiens
cggccataccaccctgaacgcgcccg

SEQ ID NO: 6606 - DNA, 27 bp, Homo sapiens
cggccataccaccctgaacgcgcccga

SEQ ID NO: 6607 - DNA, 28 bp, Homo sapiens
cggccataccaccctgaacgcgcccgat

SEQ ID NO: 6608 - DNA, 29 bp, Homo sapiens
cggccataccaccctgaacgcgcccgatc

SEQ ID NO: 6609 - DNA, 30 bp, Homo sapiens
cggccataccaccctgaacgcgcccgatct

SEQ ID NO: 6610 - DNA, 32 bp, Homo sapiens
cggccataccaccctgaacgcgcccgatctcg

SEQ ID NO: 6611 - DNA, 33 bp, Homo sapiens
cggccataccaccctgaacgcgcccgatctcgt

SEQ ID NO: 6612 - DNA, 23 bp, Homo sapiens
ggccataccaccctgaacgcgcc

SEQ ID NO: 6613 - DNA, 24 bp, Homo sapiens
ggccataccaccctgaacgcgccc

SEQ ID NO: 6614 - DNA, 26 bp, Homo sapiens
ggccataccaccctgaacgcgcccga

SEQ ID NO: 6615 - DNA, 27 bp, Homo sapiens
ggccataccaccctgaacgcgcccgat

SEQ ID NO: 6616 - DNA, 28 bp, Homo sapiens
ggccataccaccctgaacgcgcccgatc

SEQ ID NO: 6617 - DNA, 29 bp, Homo sapiens
ggccataccaccctgaacgcgcccgatct

SEQ ID NO: 6618 - DNA, 33 bp, Homo sapiens
ggccataccaccctgaacgcgcccgatctcgtc

SEQ ID NO: 6619 - DNA, 22 bp, Homo sapiens
gccataccaccctgaacgcgcc

SEQ ID NO: 6620 - DNA, 23 bp, Homo sapiens
gccataccaccctgaacgcgccc

SEQ ID NO: 6621 - DNA, 24 bp, Homo sapiens
gccataccaccctgaacgcgcccg

SEQ ID NO: 6622 - DNA, 25 bp, Homo sapiens
gccataccaccctgaacgcgcccga

SEQ ID NO: 6623 - DNA, 26 bp, Homo sapiens
gccataccaccctgaacgcgcccgat

SEQ ID NO: 6624 - DNA, 27 bp, Homo sapiens
gccataccaccctgaacgcgcccgatc

SEQ ID NO: 6625 - DNA, 28 bp, Homo sapiens
gccataccaccctgaacgcgcccgatct

SEQ ID NO: 6626 - DNA, 29 bp, Homo sapiens
gccataccaccctgaacgcgcccgatctc

SEQ ID NO: 6627 - DNA, 30 bp, Homo sapiens
gccataccaccctgaacgcgcccgatctcg

SEQ ID NO: 6628 - DNA, 31 bp, Homo sapiens
gccataccaccctgaacgcgcccgatctcgt

SEQ ID NO: 6629 - DNA, 32 bp, Homo sapiens; identical to SEQ ID NO: 39

SEQ ID NO: 6630 - DNA, 33 bp, Homo sapiens; identical to SEQ ID NO: 40

SEQ ID NO: 6631 - DNA, 21 bp, Homo sapiens
ccataccaccctgaacgcgcc

SEQ ID NO: 6632 - DNA, 22 bp, Homo sapiens
ccataccaccctgaacgcgccc

SEQ ID NO: 6633 - DNA, 23 bp, Homo sapiens
ccataccaccctgaacgcgcccg

SEQ ID NO: 6634 - DNA, 24 bp, Homo sapiens
ccataccaccctgaacgcgcccga

SEQ ID NO: 6635 - DNA, 25 bp, Homo sapiens
ccataccaccctgaacgcgcccgat

SEQ ID NO: 6636 - DNA, 26 bp, Homo sapiens
ccataccaccctgaacgcgcccgatc

SEQ ID NO: 6637 - DNA, 27 bp, Homo sapiens
ccataccaccctgaacgcgcccgatct

SEQ ID NO: 6638 - DNA, 29 bp, Homo sapiens
ccataccaccctgaacgcgcccgatctcg

SEQ ID NO: 6639 - DNA, 30 bp, Homo sapiens
ccataccaccctgaacgcgcccgatctcgt

SEQ ID NO: 6640 - DNA, 31 bp, Homo sapiens; identical to SEQ ID NO: 46

SEQ ID NO: 6641 - DNA, 32 bp, Homo sapiens
ccataccaccctgaacgcgcccgatctcgtct

SEQ ID NO: 6642 - DNA, 20 bp, Homo sapiens
cataccaccctgaacgcgcc

SEQ ID NO: 6643 - DNA, 21 bp, Homo sapiens
cataccaccctgaacgcgccc

SEQ ID NO: 6644 - DNA, 22 bp, Homo sapiens
cataccaccctgaacgcgcccg

SEQ ID NO: 6645 - DNA, 23 bp, Homo sapiens
cataccaccctgaacgcgcccga

SEQ ID NO: 6646 - DNA, 24 bp, Homo sapiens
cataccaccctgaacgcgcccgat

SEQ ID NO: 6647 - DNA, 25 bp, Homo sapiens
cataccaccctgaacgcgcccgatc

SEQ ID NO: 6648 - DNA, 26 bp, Homo sapiens
cataccaccctgaacgcgcccgatct

SEQ ID NO: 6649 - DNA, 28 bp, Homo sapiens
cataccaccctgaacgcgcccgatctcg

SEQ ID NO: 6650 - DNA, 29 bp, Homo sapiens
cataccaccctgaacgcgcccgatctcgt

SEQ ID NO: 6651 - DNA, 30 bp, Homo sapiens; identical to SEQ ID NO: 51

SEQ ID NO: 6652 - DNA, 31 bp, Homo sapiens
cataccaccctgaacgcgcccgatctcgtct

SEQ ID NO: 6653 - DNA, 33 bp, Homo sapiens
cataccaccctgaacgcgcccgatctcgtctga

SEQ ID NO: 6654 - DNA, 19 bp, Homo sapiens
ataccaccctgaacgcgcc

SEQ ID NO: 6655 - DNA, 20 bp, Homo sapiens
ataccaccctgaacgcgccc

SEQ ID NO: 6656 - DNA, 21 bp, Homo sapiens
ataccaccctgaacgcgcccg

SEQ ID NO: 6657 - DNA, 22 bp, Homo sapiens
ataccaccctgaacgcgcccga

SEQ ID NO: 6658 - DNA, 23 bp, Homo sapiens
ataccaccctgaacgcgcccgat

SEQ ID NO: 6659 - DNA, 24 bp, Homo sapiens
ataccaccctgaacgcgcccgatc

SEQ ID NO: 6660 - DNA, 25 bp, Homo sapiens
ataccaccctgaacgcgcccgatct

SEQ ID NO: 6661 - DNA, 26 bp, Homo sapiens
ataccaccctgaacgcgcccgatctc

SEQ ID NO: 6662 - DNA, 27 bp, Homo sapiens
ataccaccctgaacgcgcccgatctcg

SEQ ID NO: 6663 - DNA, 28 bp, Homo sapiens
ataccaccctgaacgcgcccgatctcgt

SEQ ID NO: 6664 - DNA, 29 bp, Homo sapiens
ataccaccctgaacgcgcccgatctcgtc

SEQ ID NO: 6665 - DNA, 30 bp, Homo sapiens; identical to SEQ ID NO: 61

SEQ ID NO: 6666 - DNA, 32 bp, Homo sapiens
ataccaccctgaacgcgcccgatctcgtctga

SEQ ID NO: 6667 - DNA, 33 bp, Homo sapiens
ataccaccctgaacgcgcccgatctcgtctgat

SEQ ID NO: 6668 - DNA, 39 bp, Homo sapiens
ataccaccctgaacgcgcccgatctcgtctgatctcgga

SEQ ID NO: 6669 - DNA, 41 bp, Homo sapiens
ataccaccctgaacgcgcccgatctcgtctgatctcggaag

SEQ ID NO: 6670 - DNA, 18 bp, Homo sapiens
taccaccctgaacgcgcc

SEQ ID NO: 6671 - DNA, 19 bp, Homo sapiens
taccaccctgaacgcgccc

SEQ ID NO: 6672 - DNA, 20 bp, Homo sapiens
taccaccctgaacgcgcccg

SEQ ID NO: 6673 - DNA, 21 bp, Homo sapiens
taccaccctgaacgcgcccga

SEQ ID NO: 6674 - DNA, 22 bp, Homo sapiens
taccaccctgaacgcgcccgat

SEQ ID NO: 6675 - DNA, 23 bp, Homo sapiens
taccaccctgaacgcgcccgatc

SEQ ID NO: 6676 - DNA, 24 bp, Homo sapiens
taccaccctgaacgcgcccgatct

SEQ ID NO: 6677 - DNA, 25 bp, Homo sapiens
taccaccctgaacgcgcccgatctc

SEQ ID NO: 6678 - DNA, 26 bp, Homo sapiens
taccaccctgaacgcgcccgatctcg

SEQ ID NO: 6679 - DNA, 27 bp, Homo sapiens
taccaccctgaacgcgcccgatctcgt

SEQ ID NO: 6680 - DNA, 28 bp, Homo sapiens
taccaccctgaacgcgcccgatctcgtc

SEQ ID NO: 6681 - DNA, 29 bp, Homo sapiens
taccaccctgaacgcgcccgatctcgtct

SEQ ID NO: 6682 - DNA, 30 bp, Homo sapiens
taccaccctgaacgcgcccgatctcgtctg

SEQ ID NO: 6683 - DNA, 31 bp, Homo sapiens
taccaccctgaacgcgcccgatctcgtctga

SEQ ID NO: 6684 - DNA, 33 bp, Homo sapiens
taccaccctgaacgcgcccgatctcgtctgatc

SEQ ID NO: 6685 - DNA, 17 bp, Homo sapiens
accaccctgaacgcgcc

SEQ ID NO: 6686 - DNA, 18 bp, Homo sapiens
accaccctgaacgcgccc

SEQ ID NO: 6687 - DNA, 19 bp, Homo sapiens
accaccctgaacgcgcccg

SEQ ID NO: 6688 - DNA, 20 bp, Homo sapiens
accaccctgaacgcgcccga

SEQ ID NO: 6689 - DNA, 21 bp, Homo sapiens
accaccctgaacgcgcccgat

SEQ ID NO: 6690 - DNA, 22 bp, Homo sapiens
accaccctgaacgcgcccgatc

SEQ ID NO: 6691 - DNA, 23 bp, Homo sapiens
accaccctgaacgcgcccgatct

SEQ ID NO: 6692 - DNA, 24 bp, Homo sapiens
accaccctgaacgcgcccgatctc

SEQ ID NO: 6693 - DNA, 25 bp, Homo sapiens
accaccctgaacgcgcccgatctcg

SEQ ID NO: 6694 - DNA, 26 bp, Homo sapiens
accaccctgaacgcgcccgatctcgt

SEQ ID NO: 6695 - DNA, 27 bp, Homo sapiens
accaccctgaacgcgcccgatctcgtc

SEQ ID NO: 6696 - DNA, 28 bp, Homo sapiens
accaccctgaacgcgcccgatctcgtct

SEQ ID NO: 6697 - DNA, 30 bp, Homo sapiens
accaccctgaacgcgcccgatctcgtctga

SEQ ID NO: 6698 - DNA, 16 bp, Homo sapiens
ccaccctgaacgcgcc

SEQ ID NO: 6699 - DNA, 17 bp, Homo sapiens
ccaccctgaacgcgccc

SEQ ID NO: 6700 - DNA, 18 bp, Homo sapiens
ccaccctgaacgcgcccg

SEQ ID NO: 6701 - DNA, 19 bp, Homo sapiens
ccaccctgaacgcgcccga

SEQ ID NO: 6702 - DNA, 20 bp, Homo sapiens
ccaccctgaacgcgcccgat

SEQ ID NO: 6703 - DNA, 21 bp, Homo sapiens
ccaccctgaacgcgcccgatc

SEQ ID NO: 6704 - DNA, 22 bp, Homo sapiens
ccaccctgaacgcgcccgatct

SEQ ID NO: 6705 - DNA, 23 bp, Homo sapiens
ccaccctgaacgcgcccgatctc

SEQ ID NO: 6706 - DNA, 24 bp, Homo sapiens
ccaccctgaacgcgcccgatctcg

SEQ ID NO: 6707 - DNA, 25 bp, Homo sapiens
ccaccctgaacgcgcccgatctcgt

SEQ ID NO: 6708 - DNA, 26 bp, Homo sapiens
ccaccctgaacgcgcccgatctcgtc

SEQ ID NO: 6709 - DNA, 27 bp, Homo sapiens
ccaccctgaacgcgcccgatctcgtct

SEQ ID NO: 6710 - DNA, 28 bp, Homo sapiens
ccaccctgaacgcgcccgatctcgtctg

SEQ ID NO: 6711 - DNA, 29 bp, Homo sapiens
ccaccctgaacgcgcccgatctcgtctga

SEQ ID NO: 6712 - DNA, 32 bp, Homo sapiens
ccaccctgaacgcgcccgatctcgtctgatct

SEQ ID NO: 6713 - DNA, 33 bp, Homo sapiens
ccaccctgaacgcgcccgatctcgtctgatctc

SEQ ID NO: 6714 - DNA, 16 bp, Homo sapiens
caccctgaacgcgccc

SEQ ID NO: 6715 - DNA, 17 bp, Homo sapiens
caccctgaacgcgcccg

SEQ ID NO: 6716 - DNA, 18 bp, Homo sapiens
caccctgaacgcgcccga

SEQ ID NO: 6717 - DNA, 19 bp, Homo sapiens
caccctgaacgcgcccgat

SEQ ID NO: 6718 - DNA, 20 bp, Homo sapiens
caccctgaacgcgcccgatc

SEQ ID NO: 6719 - DNA, 21 bp, Homo sapiens
caccctgaacgcgcccgatct

SEQ ID NO: 6720 - DNA, 22 bp, Homo sapiens
caccctgaacgcgcccgatctc

SEQ ID NO: 6721 - DNA, 23 bp, Homo sapiens
caccctgaacgcgcccgatctcg

SEQ ID NO: 6722 - DNA, 24 bp, Homo sapiens
caccctgaacgcgcccgatctcgt

SEQ ID NO: 6723 - DNA, 25 bp, Homo sapiens
caccctgaacgcgcccgatctcgtc

SEQ ID NO: 6724 - DNA, 26 bp, Homo sapiens
caccctgaacgcgcccgatctcgtct

SEQ ID NO: 6725 - DNA, 28 bp, Homo sapiens
caccctgaacgcgcccgatctcgtctga

SEQ ID NO: 6726 - DNA, 16 bp, Homo sapiens
accctgaacgcgcccg

SEQ ID NO: 6727 - DNA, 17 bp, Homo sapiens
accctgaacgcgcccga

SEQ ID NO: 6728 - DNA, 18 bp, Homo sapiens
accctgaacgcgcccgat

SEQ ID NO: 6729 - DNA, 19 bp, Homo sapiens
accctgaacgcgcccgatc

SEQ ID NO: 6730 - DNA, 20 bp, Homo sapiens
accctgaacgcgcccgatct

SEQ ID NO: 6731 - DNA, 22 bp, Homo sapiens
accctgaacgcgcccgatctcg

SEQ ID NO: 6732 - DNA, 23 bp, Homo sapiens
accctgaacgcgcccgatctcgt

SEQ ID NO: 6733 - DNA, 24 bp, Homo sapiens
accctgaacgcgcccgatctcgtc

SEQ ID NO: 6734 - DNA, 16 bp, Homo sapiens
ccctgaacgcgcccga

SEQ ID NO: 6735 - DNA, 17 bp, Homo sapiens
ccctgaacgcgcccgat

SEQ ID NO: 6736 - DNA, 18 bp, Homo sapiens
ccctgaacgcgcccgatc

SEQ ID NO: 6737 - DNA, 19 bp, Homo sapiens
ccctgaacgcgcccgatct

SEQ ID NO: 6738 - DNA, 20 bp, Homo sapiens
ccctgaacgcgcccgatctc

SEQ ID NO: 6739 - DNA, 21 bp, Homo sapiens
ccctgaacgcgcccgatctcg

SEQ ID NO: 6740 - DNA, 22 bp, Homo sapiens
ccctgaacgcgcccgatctcgt

SEQ ID NO: 6741 - DNA, 23 bp, Homo sapiens
ccctgaacgcgcccgatctcgtc

SEQ ID NO: 6742 - DNA, 24 bp, Homo sapiens
ccctgaacgcgcccgatctcgtct

SEQ ID NO: 6743 - DNA, 25 bp, Homo sapiens
ccctgaacgcgcccgatctcgtctg

SEQ ID NO: 6744 - DNA, 26 bp, Homo sapiens
ccctgaacgcgcccgatctcgtctga

SEQ ID NO: 6745 - DNA, 28 bp, Homo sapiens
ccctgaacgcgcccgatctcgtctgatc

SEQ ID NO: 6746 - DNA, 29 bp, Homo sapiens
ccctgaacgcgcccgatctcgtctgatct

SEQ ID NO: 6747 - DNA, 31 bp, Homo sapiens
ccctgaacgcgcccgatctcgtctgatctcg

SEQ ID NO: 6748 - DNA, 32 bp, Homo sapiens
ccctgaacgcgcccgatctcgtctgatctcgg

SEQ ID NO: 6749 - DNA, 33 bp, Homo sapiens
ccctgaacgcgcccgatctcgtctgatctcgga

SEQ ID NO: 6750 - DNA, 35 bp, Homo sapiens
ccctgaacgcgcccgatctcgtctgatctcggaag

SEQ ID NO: 6751 - DNA, 37 bp, Homo sapiens
ccctgaacgcgcccgatctcgtctgatctcggaagct

SEQ ID NO: 6752 - DNA, 16 bp, Homo sapiens
cctgaacgcgcccgat

SEQ ID NO: 6753 - DNA, 17 bp, Homo sapiens
cctgaacgcgcccgatc

SEQ ID NO: 6754 - DNA, 18 bp, Homo sapiens
cctgaacgcgcccgatct

SEQ ID NO: 6755 - DNA, 19 bp, Homo sapiens
cctgaacgcgcccgatctc

SEQ ID NO: 6756 - DNA, 20 bp, Homo sapiens
cctgaacgcgcccgatctcg

SEQ ID NO: 6757 - DNA, 21 bp, Homo sapiens
cctgaacgcgcccgatctcgt

SEQ ID NO: 6758 - DNA, 22 bp, Homo sapiens
cctgaacgcgcccgatctcgtc

SEQ ID NO: 6759 - DNA, 23 bp, Homo sapiens
cctgaacgcgcccgatctcgtct

SEQ ID NO: 6760 - DNA, 25 bp, Homo sapiens
cctgaacgcgcccgatctcgtctga

SEQ ID NO: 6761 - DNA, 32 bp, Homo sapiens
cctgaacgcgcccgatctcgtctgatctcgga

SEQ ID NO: 6762 - DNA, 33 bp, Homo sapiens
cctgaacgcgcccgatctcgtctgatctcggaa

SEQ ID NO: 6763 - DNA, 34 bp, Homo sapiens
cctgaacgcgcccgatctcgtctgatctcggaag

SEQ ID NO: 6764 - DNA, 36 bp, Homo sapiens
cctgaacgcgcccgatctcgtctgatctcggaagct

SEQ ID NO: 6765 - DNA, 16 bp, Homo sapiens
ctgaacgcgcccgatc

SEQ ID NO: 6766 - DNA, 17 bp, Homo sapiens
ctgaacgcgcccgatct

SEQ ID NO: 6767 - DNA, 20 bp, Homo sapiens
ctgaacgcgcccgatctcgt

SEQ ID NO: 6768 - DNA, 21 bp, Homo sapiens
ctgaacgcgcccgatctcgtc

SEQ ID NO: 6769 - DNA, 24 bp, Homo sapiens
ctgaacgcgcccgatctcgtctga

SEQ ID NO: 6770 - DNA, 31 bp, Homo sapiens
ctgaacgcgcccgatctcgtctgatctcgga

SEQ ID NO: 6771 - DNA, 33 bp, Homo sapiens; identical to SEQ ID NO: 118

SEQ ID NO: 6772 - DNA, 35 bp, Homo sapiens
ctgaacgcgcccgatctcgtctgatctcggaagct

SEQ ID NO: 6773 - DNA, 16 bp, Homo sapiens
tgaacgcgcccgatct

SEQ ID NO: 6774 - DNA, 19 bp, Homo sapiens
tgaacgcgcccgatctcgt

SEQ ID NO: 6775 - DNA, 20 bp, Homo sapiens
tgaacgcgcccgatctcgtc

SEQ ID NO: 6776 - DNA, 23 bp, Homo sapiens
tgaacgcgcccgatctcgtctga

SEQ ID NO: 6777 - DNA, 30 bp, Homo sapiens
tgaacgcgcccgatctcgtctgatctcgga

SEQ ID NO: 6778 - DNA, 32 bp, Homo sapiens; identical to SEQ ID NO: 119

SEQ ID NO: 6779 - DNA, 27 bp, Homo sapiens
gaacgcgcccgatctcgtctgatctcg

SEQ ID NO: 6780 - DNA, 29 bp, Homo sapiens
gaacgcgcccgatctcgtctgatctcgga

SEQ ID NO: 6781 - DNA, 30 bp, Homo sapiens
gaacgcgcccgatctcgtctgatctcggaa

SEQ ID NO: 6782 - DNA, 31 bp, Homo sapiens; identical to SEQ ID NO: 120

SEQ ID NO: 6783 - DNA, 33 bp, Homo sapiens
gaacgcgcccgatctcgtctgatctcggaagct

SEQ ID NO: 6784 - DNA, 21 bp, Homo sapiens
aacgcgcccgatctcgtctga

SEQ ID NO: 6785 - DNA, 30 bp, Homo sapiens; identical to SEQ ID NO: 121

SEQ ID NO: 6786 - DNA, 19 bp, Homo sapiens
acgcgcccgatctcgtctg

SEQ ID NO: 6787 - DNA, 20 bp, Homo sapiens
acgcgcccgatctcgtctga

SEQ ID NO: 6788 - DNA, 21 bp, Homo sapiens
acgcgcccgatctcgtctgat

SEQ ID NO: 6789 - DNA, 24 bp, Homo sapiens
acgcgcccgatctcgtctgatctc

SEQ ID NO: 6790 - DNA, 25 bp, Homo sapiens
acgcgcccgatctcgtctgatctcg

SEQ ID NO: 6791 - DNA, 27 bp, Homo sapiens
acgcgcccgatctcgtctgatctcgga

SEQ ID NO: 6792 - DNA, 28 bp, Homo sapiens
acgcgcccgatctcgtctgatctcggaa

SEQ ID NO: 6793 - DNA, 29 bp, Homo sapiens
acgcgcccgatctcgtctgatctcggaag

SEQ ID NO: 6794 - DNA, 18 bp, Homo sapiens
cgcgcccgatctcgtctg

SEQ ID NO: 6795 - DNA, 19 bp, Homo sapiens
cgcgcccgatctcgtctga

SEQ ID NO: 6796 - DNA, 20 bp, Homo sapiens
cgcgcccgatctcgtctgat

SEQ ID NO: 6797 - DNA, 23 bp, Homo sapiens
cgcgcccgatctcgtctgatctc

SEQ ID NO: 6798 - DNA, 24 bp, Homo sapiens
cgcgcccgatctcgtctgatctcg

SEQ ID NO: 6799 - DNA, 26 bp, Homo sapiens
cgcgcccgatctcgtctgatctcgga

SEQ ID NO: 6800 - DNA, 27 bp, Homo sapiens
cgcgcccgatctcgtctgatctcggaa

SEQ ID NO: 6801 - DNA, 28 bp, Homo sapiens
cgcgcccgatctcgtctgatctcggaag

SEQ ID NO: 6802 - DNA, 18 bp, Homo sapiens
gcgcccgatctcgtctga

SEQ ID NO: 6803 - DNA, 23 bp, Homo sapiens
gcgcccgatctcgtctgatctcg

SEQ ID NO: 6804 - DNA, 27 bp, Homo sapiens
gcgcccgatctcgtctgatctcggaag

SEQ ID NO: 6805 - DNA, 16 bp, Homo sapiens
cgcccgatctcgtctg

SEQ ID NO: 6806 - DNA, 17 bp, Homo sapiens
cgcccgatctcgtctga

SEQ ID NO: 6807 - DNA, 18 bp, Homo sapiens
cgcccgatctcgtctgat

SEQ ID NO: 6808 - DNA, 19 bp, Homo sapiens
cgcccgatctcgtctgatc

SEQ ID NO: 6809 - DNA, 20 bp, Homo sapiens
cgcccgatctcgtctgatct

SEQ ID NO: 6810 - DNA, 22 bp, Homo sapiens
cgcccgatctcgtctgatctcg

SEQ ID NO: 6811 - DNA, 23 bp, Homo sapiens
cgcccgatctcgtctgatctcgg

SEQ ID NO: 6812 - DNA, 24 bp, Homo sapiens
cgcccgatctcgtctgatctcgga

SEQ ID NO: 6813 - DNA, 25 bp, Homo sapiens
cgcccgatctcgtctgatctcggaa

SEQ ID NO: 6814 - DNA, 26 bp, Homo sapiens
cgcccgatctcgtctgatctcggaag

SEQ ID NO: 6815 - DNA, 28 bp, Homo sapiens
cgcccgatctcgtctgatctcggaagct

SEQ ID NO: 6816 - DNA, 16 bp, Homo sapiens
gcccgatctcgtctga

SEQ ID NO: 6817 - DNA, 21 bp, Homo sapiens
gcccgatctcgtctgatctcg

SEQ ID NO: 6818 - DNA, 27 bp, Homo sapiens
gcccgatctcgtctgatctcggaagct

SEQ ID NO: 6819 - DNA, 16 bp, Homo sapiens
cccgatctcgtctgat

SEQ ID NO: 6820 - DNA, 26 bp, Homo sapiens
cccgatctcgtctgatctcggaagct

SEQ ID NO: 6821 - DNA, 20 bp, Homo sapiens
cgatctcgtctgatctcgga

SEQ ID NO: 6822 - DNA, 22 bp, Homo sapiens
cgatctcgtctgatctcggaag

SEQ ID NO: 6823 - DNA, 24 bp, Homo sapiens
cgatctcgtctgatctcggaagct

SEQ ID NO: 6824 - DNA, 19 bp, Homo sapiens
gatctcgtctgatctcgga

SEQ ID NO: 6825 - DNA, 21 bp, Homo sapiens
gatctcgtctgatctcggaag

SEQ ID NO: 6826 - DNA, 23 bp, Homo sapiens
gatctcgtctgatctcggaagct

SEQ ID NO: 6827 - DNA, 18 bp, Homo sapiens
atctcgtctgatctcgga

SEQ ID NO: 6828 - DNA, 17 bp, Homo sapiens
tctcgtctgatctcgga

SEQ ID NO: 6829 - DNA, 18 bp, Homo sapiens
tctcgtctgatctcggaa

SEQ ID NO: 6830 - DNA, 21 bp, Homo sapiens
tctcgtctgatctcggaagct

SEQ ID NO: 6831 - DNA, 22 bp, Homo sapiens
tctcgtctgatctcggaagcta

SEQ ID NO: 6832 - DNA, 26 bp, Homo sapiens
tctcgtctgatctcggaagctaagca

SEQ ID NO: 6833 - DNA, 16 bp, Homo sapiens
ctcgtctgatctcgga

SEQ ID NO: 6834 - DNA, 20 bp, Homo sapiens
ctcgtctgatctcggaagct

SEQ ID NO: 6835 - DNA, 17 bp, Homo sapiens
tcgtctgatctcggaag

SEQ ID NO: 6836 - DNA, 19 bp, Homo sapiens
tcgtctgatctcggaagct

SEQ ID NO: 6837 - DNA, 32 bp, Homo sapiens
tcgtctgatctcggaagctaagcagggtcggg

SEQ ID NO: 6838 - DNA, 35 bp, Homo sapiens
tcgtctgatctcggaagctaagcagggtcgggcct

SEQ ID NO: 6839 - DNA, 37 bp, Homo sapiens
tcgtctgatctcggaagctaagcagggtcgggcctgg

SEQ ID NO: 6840 - DNA, 39 bp, Homo sapiens
tcgtctgatctcggaagctaagcagggtcgggcctggtt

SEQ ID NO: 6841 - DNA, 16 bp, Homo sapiens
cgtctgatctcggaag

SEQ ID NO: 6842 - DNA, 18 bp, Homo sapiens
cgtctgatctcggaagct

SEQ ID NO: 6843 - DNA, 31 bp, Homo sapiens
cgtctgatctcggaagctaagcagggtcggg

SEQ ID NO: 6844 - DNA, 33 bp, Homo sapiens; identical to SEQ ID NO: 131

SEQ ID NO: 6845 - DNA, 17 bp, Homo sapiens
gtctgatctcggaagct

SEQ ID NO: 6846 - DNA, 31 bp, Homo sapiens
tctgatctcggaagctaagcagggtcgggcc

SEQ ID NO: 6847 - DNA, 32 bp, Homo sapiens
tctgatctcggaagctaagcagggtcgggcct

SEQ ID NO: 6848 - DNA, 34 bp, Homo sapiens
tctgatctcggaagctaagcagggtcgggcctgg

SEQ ID NO: 6849 - DNA, 33 bp, Homo sapiens; identical to SEQ ID NO: 132

SEQ ID NO: 6850 - DNA, 35 bp, Homo sapiens
ctgatctcggaagctaagcagggtcgggcctggtt

SEQ ID NO: 6851 - DNA, 34 bp, Homo sapiens
tgatctcggaagctaagcagggtcgggcctggtt

SEQ ID NO: 6852 - DNA, 30 bp, Homo sapiens
gatctcggaagctaagcagggtcgggcctg

SEQ ID NO: 6853 - DNA, 33 bp, Homo sapiens; identical to SEQ ID NO: 133

SEQ ID NO: 6854 - DNA, 29 bp, Homo sapiens
atctcggaagctaagcagggtcgggcctg

SEQ ID NO: 6855 - DNA, 30 bp, Homo sapiens
atctcggaagctaagcagggtcgggcctgg

SEQ ID NO: 6856 - DNA, 32 bp, Homo sapiens
atctcggaagctaagcagggtcgggcctggtt

SEQ ID NO: 6857 - DNA, 16 bp, Homo sapiens
tctcggaagctaagca

SEQ ID NO: 6858 - DNA, 26 bp, Homo sapiens
tctcggaagctaagcagggtcgggcc

SEQ ID NO: 6859 - DNA, 28 bp, Homo sapiens
tctcggaagctaagcagggtcgggcctg

SEQ ID NO: 6860 - DNA, 30 bp, Homo sapiens
tctcggaagctaagcagggtcgggcctggt

SEQ ID NO: 6861 - DNA, 31 bp, Homo sapiens
tctcggaagctaagcagggtcgggcctggtt

SEQ ID NO: 6862 - DNA, 32 bp, Homo sapiens
tctcggaagctaagcagggtcgggcctggtta

SEQ ID NO: 6863 - DNA, 25 bp, Homo sapiens
ctcggaagctaagcagggtcgggcc

SEQ ID NO: 6864 - DNA, 26 bp, Homo sapiens
ctcggaagctaagcagggtcgggcct

SEQ ID NO: 6865 - DNA, 28 bp, Homo sapiens
ctcggaagctaagcagggtcgggcctgg

SEQ ID NO: 6866 - DNA, 29 bp, Homo sapiens
ctcggaagctaagcagggtcgggcctggt

SEQ ID NO: 6867 - DNA, 30 bp, Homo sapiens; identical to SEQ ID NO: 135

SEQ ID NO: 6868 - DNA, 31 bp, Homo sapiens
ctcggaagctaagcagggtcgggcctggtta

SEQ ID NO: 6869 - DNA, 28 bp, Homo sapiens
tcggaagctaagcagggtcgggcctggt

SEQ ID NO: 6870 - DNA, 29 bp, Homo sapiens
tcggaagctaagcagggtcgggcctggtt

SEQ ID NO: 6871 - DNA, 27 bp, Homo sapiens
cggaagctaagcagggtcgggcctggt

SEQ ID NO: 6872 - DNA, 28 bp, Homo sapiens
cggaagctaagcagggtcgggcctggtt

SEQ ID NO: 6873 - DNA, 24 bp, Homo sapiens
ggaagctaagcagggtcgggcctg

SEQ ID NO: 6874 - DNA, 27 bp, Homo sapiens
ggaagctaagcagggtcgggcctggtt

SEQ ID NO: 6875 - DNA, 33 bp, Homo sapiens; identical to SEQ ID NO: 139

SEQ ID NO: 6876 - DNA, 21 bp, Homo sapiens
gaagctaagcagggtcgggcc

SEQ ID NO: 6877 - DNA, 23 bp, Homo sapiens
gaagctaagcagggtcgggcctg

SEQ ID NO: 6878 - DNA, 24 bp, Homo sapiens
gaagctaagcagggtcgggcctgg

SEQ ID NO: 6879 - DNA, 25 bp, Homo sapiens
gaagctaagcagggtcgggcctggt

SEQ ID NO: 6880 - DNA, 26 bp, Homo sapiens
gaagctaagcagggtcgggcctggtt

SEQ ID NO: 6881 - DNA, 27 bp, Homo sapiens
gaagctaagcagggtcgggcctggtta

SEQ ID NO: 6882 - DNA, 32 bp, Homo sapiens; identical to SEQ ID NO: 142

SEQ ID NO: 6883 - DNA, 25 bp, Homo sapiens
aagctaagcagggtcgggcctggtt

SEQ ID NO: 6884 - DNA, 26 bp, Homo sapiens
aagctaagcagggtcgggcctggtta

SEQ ID NO: 6885 - DNA, 19 bp, Homo sapiens
agctaagcagggtcgggcc

SEQ ID NO: 6886 - DNA, 21 bp, Homo sapiens
agctaagcagggtcgggcctg

SEQ ID NO: 6887 - DNA, 22 bp, Homo sapiens
agctaagcagggtcgggcctgg

SEQ ID NO: 6888 - DNA, 23 bp, Homo sapiens
agctaagcagggtcgggcctggt

SEQ ID NO: 6889 - DNA, 24 bp, Homo sapiens
agctaagcagggtcgggcctggtt

SEQ ID NO: 6890 - DNA, 25 bp, Homo sapiens
agctaagcagggtcgggcctggtta

SEQ ID NO: 6891 - DNA, 46 bp, Homo sapiens
agctaagcagggtcgggcctggttagtacttggatgggagaccgcc

SEQ ID NO: 6892 - DNA, 22 bp, Homo sapiens
gctaagcagggtcgggcctggt

SEQ ID NO: 6893 - DNA, 23 bp, Homo sapiens
gctaagcagggtcgggcctggtt

SEQ ID NO: 6894 - DNA, 24 bp, Homo sapiens
gctaagcagggtcgggcctggtta

SEQ ID NO: 6895 - DNA, 33 bp, Homo sapiens; identical to SEQ ID NO: 144

SEQ ID NO: 6896 - DNA, 22 bp, Homo sapiens
ctaagcagggtcgggcctggtt

SEQ ID NO: 6897 - DNA, 28 bp, Homo sapiens
ctaagcagggtcgggcctggttagtact

SEQ ID NO: 6898 - DNA, 31 bp, Homo sapiens
ctaagcagggtcgggcctggttagtacttgg

SEQ ID NO: 6899 - DNA, 32 bp, Homo sapiens; identical to SEQ ID NO: 145

SEQ ID NO: 6900 - DNA, 33 bp, Homo sapiens
ctaagcagggtcgggcctggttagtacttggat

SEQ ID NO: 6901 - DNA, 44 bp, Homo sapiens
ctaagcagggtcgggcctggttagtacttggatgggagaccgcc

SEQ ID NO: 6902 - DNA, 27 bp, Homo sapiens
taagcagggtcgggcctggttagtact

SEQ ID NO: 6903 - DNA, 31 bp, Homo sapiens
taagcagggtcgggcctggttagtacttgga

SEQ ID NO: 6904 - DNA, 43 bp, Homo sapiens
taagcagggtcgggcctggttagtacttggatgggagaccgcc

SEQ ID NO: 6905 - DNA, 16 bp, Homo sapiens
aagcagggtcgggcct

SEQ ID NO: 6906 - DNA, 17 bp, Homo sapiens
aagcagggtcgggcctg

SEQ ID NO: 6907 - DNA, 19 bp, Homo sapiens
aagcagggtcgggcctggt

SEQ ID NO: 6908 - DNA, 20 bp, Homo sapiens
aagcagggtcgggcctggtt

SEQ ID NO: 6909 - DNA, 26 bp, Homo sapiens
aagcagggtcgggcctggttagtact

SEQ ID NO: 6910 - DNA, 29 bp, Homo sapiens
aagcagggtcgggcctggttagtacttgg

SEQ ID NO: 6911 - DNA, 30 bp, Homo sapiens; identical to SEQ ID NO: 149

SEQ ID NO: 6912 - DNA, 31 bp, Homo sapiens
aagcagggtcgggcctggttagtacttggat

SEQ ID NO: 6913 - DNA, 42 bp, Homo sapiens
aagcagggtcgggcctggttagtacttggatgggagaccgcc

SEQ ID NO: 6914 - DNA, 16 bp, Homo sapiens
agcagggtcgggcctg

SEQ ID NO: 6915 - DNA, 18 bp, Homo sapiens
agcagggtcgggcctggt

SEQ ID NO: 6916 - DNA, 19 bp, Homo sapiens
agcagggtcgggcctggtt

SEQ ID NO: 6917 - DNA, 29 bp, Homo sapiens
agcagggtcgggcctggttagtacttgga

SEQ ID NO: 6918 - DNA, 41 bp, Homo sapiens
agcagggtcgggcctggttagtacttggatgggagaccgcc

SEQ ID NO: 6919 - DNA, 17 bp, Homo sapiens
gcagggtcgggcctggt

SEQ ID NO: 6920 - DNA, 18 bp, Homo sapiens
gcagggtcgggcctggtt

SEQ ID NO: 6921 - DNA, 22 bp, Homo sapiens
gcagggtcgggcctggttagta

SEQ ID NO: 6922 - DNA, 24 bp, Homo sapiens
gcagggtcgggcctggttagtact

SEQ ID NO: 6923 - DNA, 27 bp, Homo sapiens
gcagggtcgggcctggttagtacttgg

SEQ ID NO: 6924 - DNA, 28 bp, Homo sapiens
gcagggtcgggcctggttagtacttgga

SEQ ID NO: 6925 - DNA, 30 bp, Homo sapiens
gcagggtcgggcctggttagtacttggatg

SEQ ID NO: 6926 - DNA, 31 bp, Homo sapiens
gcagggtcgggcctggttagtacttggatgg

SEQ ID NO: 6927 - DNA, 32 bp, Homo sapiens
gcagggtcgggcctggttagtacttggatggg

SEQ ID NO: 6928 - DNA, 33 bp, Homo sapiens
gcagggtcgggcctggttagtacttggatggga

SEQ ID NO: 6929 - DNA, 40 bp, Homo sapiens
gcagggtcgggcctggttagtacttggatgggagaccgcc

SEQ ID NO: 6930 - DNA, 16 bp, Homo sapiens
cagggtcgggcctggt

SEQ ID NO: 6931 - DNA, 26 bp, Homo sapiens
cagggtcgggcctggttagtacttgg

SEQ ID NO: 6932 - DNA, 27 bp, Homo sapiens
cagggtcgggcctggttagtacttgga

SEQ ID NO: 6933 - DNA, 32 bp, Homo sapiens
cagggtcgggcctggttagtacttggatggga

SEQ ID NO: 6934 - DNA, 39 bp, Homo sapiens
cagggtcgggcctggttagtacttggatgggagaccgcc

SEQ ID NO: 6935 - DNA, 16 bp, Homo sapiens
agggtcgggcctggtt

SEQ ID NO: 6936 - DNA, 38 bp, Homo sapiens
agggtcgggcctggttagtacttggatgggagaccgcc

SEQ ID NO: 6937 - DNA, 16 bp, Homo sapiens
gggtcgggcctggtta

SEQ ID NO: 6938 - DNA, 19 bp, Homo sapiens
gggtcgggcctggttagta

SEQ ID NO: 6939 - DNA, 25 bp, Homo sapiens
gggtcgggcctggttagtacttgga

SEQ ID NO: 6940 - DNA, 30 bp, Homo sapiens
gggtcgggcctggttagtacttggatggga

SEQ ID NO: 6941 - DNA, 32 bp, Homo sapiens
gggtcgggcctggttagtacttggatgggaga

SEQ ID NO: 6942 - DNA, 37 bp, Homo sapiens
gggtcgggcctggttagtacttggatgggagaccgcc

SEQ ID NO: 6943 - DNA, 34 bp, Homo sapiens
tcgggcctggttagtacttggatgggagaccgcc

SEQ ID NO: 6944 - DNA, 21 bp, Homo sapiens
cgggcctggttagtacttgga

SEQ ID NO: 6945 - DNA, 26 bp, Homo sapiens
cgggcctggttagtacttggatggga

SEQ ID NO: 6946 - DNA, 33 bp, Homo sapiens; identical to SEQ ID NO: 151

SEQ ID NO: 6947 - DNA, 32 bp, Homo sapiens; identical to SEQ ID NO: 152

SEQ ID NO: 6948 - DNA, 29 bp, Homo sapiens
cctggttagtacttggatgggagaccgcc

SEQ ID NO: 6949 - DNA, 28 bp, Homo sapiens
ctggttagtacttggatgggagaccgcc

SEQ ID NO: 6950 - DNA, 27 bp, Homo sapiens
tggttagtacttggatgggagaccgcc

SEQ ID NO: 6951 - DNA, 25 bp, Homo sapiens
gttagtacttggatgggagaccgcc

SEQ ID NO: 6952 - DNA, 24 bp, Homo sapiens
ttagtacttggatgggagaccgcc

SEQ ID NO: 6953 - DNA, 23 bp, Homo sapiens
tagtacttggatgggagaccgcc

SEQ ID NO: 6954 - DNA, 22 bp, Homo sapiens
agtacttggatgggagaccgcc

SEQ ID NO: 6955 - DNA, 23 bp, Homo sapiens
agtacttggatgggagaccgcct

SEQ ID NO: 6956 - DNA, 47 bp, Homo sapiens
agtacttggatgggagaccgcctgggaataccgggtgctgtaggctt

SEQ ID NO: 6957 - DNA, 18 bp, Homo sapiens
gtacttggatgggagacc

SEQ ID NO: 6958 - DNA, 21 bp, Homo sapiens
gtacttggatgggagaccgcc

SEQ ID NO: 6959 - DNA, 22 bp, Homo sapiens
gtacttggatgggagaccgcct

SEQ ID NO: 6960 - DNA, 26 bp, Homo sapiens
gtacttggatgggagaccgcctggga

SEQ ID NO: 6961 - DNA, 27 bp, Homo sapiens
gtacttggatgggagaccgcctgggaa

SEQ ID NO: 6962 - DNA, 33 bp, Homo sapiens
gtacttggatgggagaccgcctgggaataccgg

SEQ ID NO: 6963 - DNA, 46 bp, Homo sapiens
gtacttggatgggagaccgcctgggaataccgggtgctgtaggctt

SEQ ID NO: 6964 - DNA, 47 bp, Homo sapiens
gtacttggatgggagaccgcctgggaataccgggtgctgtaggcttt

SEQ ID NO: 6965 - DNA, 20 bp, Homo sapiens
tacttggatgggagaccgcc

SEQ ID NO: 6966 - DNA, 45 bp, Homo sapiens
tacttggatgggagaccgcctgggaataccgggtgctgtaggctt

SEQ ID NO: 6967 - DNA, 46 bp, Homo sapiens
tacttggatgggagaccgcctgggaataccgggtgctgtaggcttt

SEQ ID NO: 6968 - DNA, 16 bp, Homo sapiens
acttggatgggagacc

SEQ ID NO: 6969 - DNA, 19 bp, Homo sapiens
acttggatgggagaccgcc

SEQ ID NO: 6970 - DNA, 20 bp, Homo sapiens
acttggatgggagaccgcct

SEQ ID NO: 6971 - DNA, 44 bp, Homo sapiens
acttggatgggagaccgcctgggaataccgggtgctgtaggctt

SEQ ID NO: 6972 - DNA, 45 bp, Homo sapiens
acttggatgggagaccgcctgggaataccgggtgctgtaggcttt

SEQ ID NO: 6973 - DNA, 18 bp, Homo sapiens
cttggatgggagaccgcc

SEQ ID NO: 6974 - DNA, 19 bp, Homo sapiens
cttggatgggagaccgcct

SEQ ID NO: 6975 - DNA, 23 bp, Homo sapiens
cttggatgggagaccgcctggga

SEQ ID NO: 6976 - DNA, 24 bp, Homo sapiens
cttggatgggagaccgcctgggaa

SEQ ID NO: 6977 - DNA, 25 bp, Homo sapiens
cttggatgggagaccgcctgggaat

SEQ ID NO: 6978 - DNA, 28 bp, Homo sapiens
cttggatgggagaccgcctgggaatacc

SEQ ID NO: 6979 - DNA, 29 bp, Homo sapiens
cttggatgggagaccgcctgggaataccg

SEQ ID NO: 6980 - DNA, 30 bp, Homo sapiens
cttggatgggagaccgcctgggaataccgg

SEQ ID NO: 6981 - DNA, 43 bp, Homo sapiens
cttggatgggagaccgcctgggaataccgggtgctgtaggctt

SEQ ID NO: 6982 - DNA, 44 bp, Homo sapiens
cttggatgggagaccgcctgggaataccgggtgctgtaggcttt

SEQ ID NO: 6983 - DNA, 17 bp, Homo sapiens
ttggatgggagaccgcc

SEQ ID NO: 6984 - DNA, 18 bp, Homo sapiens
ttggatgggagaccgcct

SEQ ID NO: 6985 - DNA, 22 bp, Homo sapiens
ttggatgggagaccgcctggga

SEQ ID NO: 6986 - DNA, 23 bp, Homo sapiens
ttggatgggagaccgcctgggaa

SEQ ID NO: 6987 - DNA, 24 bp, Homo sapiens
ttggatgggagaccgcctgggaat

SEQ ID NO: 6988 - DNA, 42 bp, Homo sapiens
ttggatgggagaccgcctgggaataccgggtgctgtaggctt

SEQ ID NO: 6989 - DNA, 16 bp, Homo sapiens
tggatgggagaccgcc

SEQ ID NO: 6990 - DNA, 40 bp, Homo sapiens
ggatgggagaccgcctgggaataccgggtgctgtaggctt

SEQ ID NO: 6991 - DNA, 38 bp, Homo sapiens
gatgggagaccgcctgggaataccgggtgctgtaggct

SEQ ID NO: 6992 - DNA, 39 bp, Homo sapiens
gatgggagaccgcctgggaataccgggtgctgtaggctt

SEQ ID NO: 6993 - DNA, 40 bp, Homo sapiens
gatgggagaccgcctgggaataccgggtgctgtaggcttt

SEQ ID NO: 6994 - DNA, 33 bp, Homo sapiens
atgggagaccgcctgggaataccgggtgctgta

SEQ ID NO: 6995 - DNA, 37 bp, Homo sapiens
atgggagaccgcctgggaataccgggtgctgtaggct

SEQ ID NO: 6996 - DNA, 38 bp, Homo sapiens
atgggagaccgcctgggaataccgggtgctgtaggctt

SEQ ID NO: 6997 - DNA, 39 bp, Homo sapiens
atgggagaccgcctgggaataccgggtgctgtaggcttt

SEQ ID NO: 6998 - DNA, 36 bp, Homo sapiens
tgggagaccgcctgggaataccgggtgctgtaggct

SEQ ID NO: 6999 - DNA, 37 bp, Homo sapiens
tgggagaccgcctgggaataccgggtgctgtaggctt

SEQ ID NO: 7000 - DNA, 38 bp, Homo sapiens
tgggagaccgcctgggaataccgggtgctgtaggcttt

SEQ ID NO: 7001 - DNA, 35 bp, Homo sapiens
gggagaccgcctgggaataccgggtgctgtaggct

SEQ ID NO: 7002 - DNA, 36 bp, Homo sapiens
gggagaccgcctgggaataccgggtgctgtaggctt

SEQ ID NO: 7003 - DNA, 37 bp, Homo sapiens
gggagaccgcctgggaataccgggtgctgtaggcttt

SEQ ID NO: 7004 - DNA, 34 bp, Homo sapiens
ggagaccgcctgggaataccgggtgctgtaggct

SEQ ID NO: 7005 - DNA, 35 bp, Homo sapiens
ggagaccgcctgggaataccgggtgctgtaggctt

SEQ ID NO: 7006 - DNA, 36 bp, Homo sapiens
ggagaccgcctgggaataccgggtgctgtaggcttt

SEQ ID NO: 7007 - DNA, 33 bp, Homo sapiens; identical to SEQ ID NO: 165

SEQ ID NO: 7008 - DNA, 34 bp, Homo sapiens
gagaccgcctgggaataccgggtgctgtaggctt

SEQ ID NO: 7009 - DNA, 32 bp, Homo sapiens
agaccgcctgggaataccgggtgctgtaggct

SEQ ID NO: 7010 - DNA, 33 bp, Homo sapiens; identical to SEQ ID NO: 166

SEQ ID NO: 7011 - DNA, 25 bp, Homo sapiens
gaccgcctgggaataccgggtgctg

SEQ ID NO: 7012 - DNA, 32 bp, Homo sapiens; identical to SEQ ID NO: 167

SEQ ID NO: 7013 - DNA, 33 bp, Homo sapiens; identical to SEQ ID NO: 168

SEQ ID NO: 7014 - DNA, 30 bp, Homo sapiens
accgcctgggaataccgggtgctgtaggct

SEQ ID NO: 7015 - DNA, 31 bp, Homo sapiens; identical to SEQ ID NO: 169

SEQ ID NO: 7016 - DNA, 32 bp, Homo sapiens
accgcctgggaataccgggtgctgtaggcttt

SEQ ID NO: 7017 - DNA, 29 bp, Homo sapiens
ccgcctgggaataccgggtgctgtaggct

SEQ ID NO: 7018 - DNA, 30 bp, Homo sapiens; identical to SEQ ID NO: 171

SEQ ID NO: 7019 - DNA, 31 bp, Homo sapiens; identical to SEQ ID NO: 172

SEQ ID NO: 7020 - DNA, 29 bp, Homo sapiens
cgcctgggaataccgggtgctgtaggctt

SEQ ID NO: 7021 - DNA, 30 bp, Homo sapiens; identical to SEQ ID NO: 174

SEQ ID NO: 7022 - DNA, 27 bp, Homo sapiens
gcctgggaataccgggtgctgtaggct

SEQ ID NO: 7023 - DNA, 28 bp, Homo sapiens
gcctgggaataccgggtgctgtaggctt

SEQ ID NO: 7024 - DNA, 29 bp, Homo sapiens
gcctgggaataccgggtgctgtaggcttt

SEQ ID NO: 7025 - DNA, 26 bp, Homo sapiens
cctgggaataccgggtgctgtaggct

SEQ ID NO: 7026 - DNA, 27 bp, Homo sapiens
cctgggaataccgggtgctgtaggctt

SEQ ID NO: 7027 - DNA, 28 bp, Homo sapiens
cctgggaataccgggtgctgtaggcttt

SEQ ID NO: 7028 - DNA, 25 bp, Homo sapiens
ctgggaataccgggtgctgtaggct

SEQ ID NO: 7029 - DNA, 26 bp, Homo sapiens
ctgggaataccgggtgctgtaggctt

SEQ ID NO: 7030 - DNA, 27 bp, Homo sapiens
ctgggaataccgggtgctgtaggcttt

SEQ ID NO: 7031 - DNA, 22 bp, Homo sapiens
tgggaataccgggtgctgtagg

SEQ ID NO: 7032 - DNA, 24 bp, Homo sapiens
tgggaataccgggtgctgtaggct

SEQ ID NO: 7033 - DNA, 25 bp, Homo sapiens
tgggaataccgggtgctgtaggctt

SEQ ID NO: 7034 - DNA, 26 bp, Homo sapiens
tgggaataccgggtgctgtaggcttt

SEQ ID NO: 7035 - DNA, 22 bp, Homo sapiens
gggaataccgggtgctgtaggc

SEQ ID NO: 7036 - DNA, 23 bp, Homo sapiens
gggaataccgggtgctgtaggct

SEQ ID NO: 7037 - DNA, 24 bp, Homo sapiens
gggaataccgggtgctgtaggctt

SEQ ID NO: 7038 - DNA, 25 bp, Homo sapiens
gggaataccgggtgctgtaggcttt

SEQ ID NO: 7039 - DNA, 26 bp, Homo sapiens
gggaataccgggtgctgtaggctttt

SEQ ID NO: 7040 - DNA, 18 bp, Homo sapiens
ggaataccgggtgctgta

SEQ ID NO: 7041 - DNA, 21 bp, Homo sapiens
ggaataccgggtgctgtaggc

SEQ ID NO: 7042 - DNA, 22 bp, Homo sapiens
ggaataccgggtgctgtaggct

SEQ ID NO: 7043 - DNA, 23 bp, Homo sapiens
ggaataccgggtgctgtaggctt

SEQ ID NO: 7044 - DNA, 24 bp, Homo sapiens
ggaataccgggtgctgtaggcttt

SEQ ID NO: 7045 - DNA, 17 bp, Homo sapiens
gaataccgggtgctgta

SEQ ID NO: 7046 - DNA, 20 bp, Homo sapiens
gaataccgggtgctgtaggc

SEQ ID NO: 7047 - DNA, 21 bp, Homo sapiens
gaataccgggtgctgtaggct

SEQ ID NO: 7048 - DNA, 22 bp, Homo sapiens
gaataccgggtgctgtaggctt

SEQ ID NO: 7049 - DNA, 23 bp, Homo sapiens
gaataccgggtgctgtaggcttt

SEQ ID NO: 7050 - DNA, 16 bp, Homo sapiens
aataccgggtgctgta

SEQ ID NO: 7051 - DNA, 19 bp, Homo sapiens
aataccgggtgctgtaggc

SEQ ID NO: 7052 - DNA, 20 bp, Homo sapiens
aataccgggtgctgtaggct

SEQ ID NO: 7053 - DNA, 21 bp, Homo sapiens
aataccgggtgctgtaggctt

SEQ ID NO: 7054 - DNA, 22 bp, Homo sapiens
aataccgggtgctgtaggcttt

SEQ ID NO: 7055 - DNA, 16 bp, Homo sapiens
ataccgggtgctgtag

SEQ ID NO: 7056 - DNA, 17 bp, Homo sapiens
ataccgggtgctgtagg

SEQ ID NO: 7057 - DNA, 18 bp, Homo sapiens
ataccgggtgctgtaggc

SEQ ID NO: 7058 - DNA, 19 bp, Homo sapiens
ataccgggtgctgtaggct

SEQ ID NO: 7059 - DNA, 20 bp, Homo sapiens
ataccgggtgctgtaggctt

SEQ ID NO: 7060 - DNA, 21 bp, Homo sapiens
ataccgggtgctgtaggcttt

SEQ ID NO: 7061 - DNA, 16 bp, Homo sapiens
taccgggtgctgtagg

SEQ ID NO: 7062 - DNA, 17 bp, Homo sapiens
taccgggtgctgtaggc

SEQ ID NO: 7063 - DNA, 18 bp, Homo sapiens
taccgggtgctgtaggct

SEQ ID NO: 7064 - DNA, 19 bp, Homo sapiens
taccgggtgctgtaggctt

SEQ ID NO: 7065 - DNA, 20 bp, Homo sapiens
taccgggtgctgtaggcttt

SEQ ID NO: 7066 - DNA, 16 bp, Homo sapiens
accgggtgctgtaggc

SEQ ID NO: 7067 - DNA, 17 bp, Homo sapiens
accgggtgctgtaggct

SEQ ID NO: 7068 - DNA, 18 bp, Homo sapiens
accgggtgctgtaggctt

SEQ ID NO: 7069 - DNA, 19 bp, Homo sapiens
accgggtgctgtaggcttt

SEQ ID NO: 7070 - DNA, 20 bp, Homo sapiens
accgggtgctgtaggctttt

SEQ ID NO: 7071 - DNA, 21 bp, Homo sapiens
accgggtgctgtaggcttttt

SEQ ID NO: 7072 - DNA, 16 bp, Homo sapiens
ccgggtgctgtaggct

SEQ ID NO: 7073 - DNA, 17 bp, Homo sapiens
ccgggtgctgtaggctt

SEQ ID NO: 7074 - DNA, 18 bp, Homo sapiens
ccgggtgctgtaggcttt

SEQ ID NO: 7075 - DNA, 16 bp, Homo sapiens
cgggtgctgtaggctt

SEQ ID NO: 7076 - DNA, 17 bp, Homo sapiens
cgggtgctgtaggcttt

SEQ ID NO: 7077 - DNA, 16 bp, Homo sapiens
gggtgctgtaggcttt

SEQ ID NO: 7078 - DNA, 17 bp, Homo sapiens
ataggtttggtcctagc

SEQ ID NO: 7079 - DNA, 23 bp, Homo sapiens
ataggtttggtcctagcctttct

SEQ ID NO: 7080 - DNA, 30 bp, Homo sapiens; identical to SEQ ID NO: 213

SEQ ID NO: 7081 - DNA, 31 bp, Homo sapiens; identical to SEQ ID NO: 214

SEQ ID NO: 7082 - DNA, 32 bp, Homo sapiens; identical to SEQ ID NO: 215

SEQ ID NO: 7083 - DNA, 33 bp, Homo sapiens; identical to SEQ ID NO: 216

SEQ ID NO: 7084 - DNA, 36 bp, Homo sapiens
ataggtttggtcctagcctttctattagctcttagt

SEQ ID NO: 7085 - DNA, 37 bp, Homo sapiens
ataggtttggtcctagcctttctattagctcttagta

SEQ ID NO: 7086 - DNA, 16 bp, Homo sapiens
ggtttggtcctagcct

SEQ ID NO: 7087 - DNA, 19 bp, Homo sapiens
tttctattagctcttagta

SEQ ID NO: 7088 - DNA, 32 bp, Homo sapiens
attagctcttagtaagattacacatgcaagca

SEQ ID NO: 7089 - DNA, 31 bp, Homo sapiens
cttagtaagattacacatgcaagcatccccg

SEQ ID NO: 7090 - DNA, 33 bp, Homo sapiens
tagtaagattacacatgcaagcatccccgttcc

SEQ ID NO: 7091 - DNA, 32 bp, Homo sapiens
catgcaagcatccccgttccagtgagttcacc

SEQ ID NO: 7092 - DNA, 33 bp, Homo sapiens
catgcaagcatccccgttccagtgagttcaccc

SEQ ID NO: 7093 - DNA, 18 bp, Homo sapiens
tgcaagcatccccgttcc

SEQ ID NO: 7094 - DNA, 30 bp, Homo sapiens
tgcaagcatccccgttccagtgagttcacc

SEQ ID NO: 7095 - DNA, 31 bp, Homo sapiens
tgcaagcatccccgttccagtgagttcaccc

SEQ ID NO: 7096 - DNA, 32 bp, Homo sapiens
tgcaagcatccccgttccagtgagttcaccct

SEQ ID NO: 7097 - DNA, 29 bp, Homo sapiens
gcaagcatccccgttccagtgagttcacc

SEQ ID NO: 7098 - DNA, 30 bp, Homo sapiens
gcaagcatccccgttccagtgagttcaccc

SEQ ID NO: 7099 - DNA, 31 bp, Homo sapiens
gcaagcatccccgttccagtgagttcaccct

SEQ ID NO: 7100 - DNA, 29 bp, Homo sapiens
caagcatccccgttccagtgagttcaccc

SEQ ID NO: 7101 - DNA, 27 bp, Homo sapiens
aagcatccccgttccagtgagttcacc

SEQ ID NO: 7102 - DNA, 28 bp, Homo sapiens
aagcatccccgttccagtgagttcaccc

SEQ ID NO: 7103 - DNA, 29 bp, Homo sapiens
aagcatccccgttccagtgagttcaccct

SEQ ID NO: 7104 - DNA, 26 bp, Homo sapiens
agcatccccgttccagtgagttcacc

SEQ ID NO: 7105 - DNA, 22 bp, Homo sapiens
tccccgttccagtgagttcacc

SEQ ID NO: 7106 - DNA, 23 bp, Homo sapiens
tccccgttccagtgagttcaccc

SEQ ID NO: 7107 - DNA, 24 bp, Homo sapiens
tccccgttccagtgagttcaccct

SEQ ID NO: 7108 - DNA, 19 bp, Homo sapiens
ccgttccagtgagttcacc

SEQ ID NO: 7109 - DNA, 20 bp, Homo sapiens
ccgttccagtgagttcaccc

SEQ ID NO: 7110 - DNA, 21 bp, Homo sapiens
ccgttccagtgagttcaccct

SEQ ID NO: 7111 - DNA, 18 bp, Homo sapiens
cgttccagtgagttcacc

SEQ ID NO: 7112 - DNA, 19 bp, Homo sapiens
cgttccagtgagttcaccc

SEQ ID NO: 7113 - DNA, 17 bp, Homo sapiens
cagtgagttcaccctct

SEQ ID NO: 7114 - DNA, 25 bp, Homo sapiens
cagtgagttcaccctctaaatcacc

SEQ ID NO: 7115 - DNA, 16 bp, Homo sapiens
agtgagttcaccctct

SEQ ID NO: 7116 - DNA, 24 bp, Homo sapiens
agtgagttcaccctctaaatcacc

SEQ ID NO: 7117 - DNA, 23 bp, Homo sapiens
gtgagttcaccctctaaatcacc

SEQ ID NO: 7118 - DNA, 20 bp, Homo sapiens
agttcaccctctaaatcacc

SEQ ID NO: 7119 - DNA, 22 bp, Homo sapiens
caccctctaaatcaccacgatc

SEQ ID NO: 7120 - DNA, 18 bp, Homo sapiens
ctctaaatcaccacgatc

SEQ ID NO: 7121 - DNA, 17 bp, Homo sapiens
tctaaatcaccacgatc

SEQ ID NO: 7122 - DNA, 26 bp, Homo sapiens
tctaaatcaccacgatcaaaaggaac

SEQ ID NO: 7123 - DNA, 33 bp, Homo sapiens
tctaaatcaccacgatcaaaaggaacaagcatc

SEQ ID NO: 7124 - DNA, 33 bp, Homo sapiens
ctaaatcaccacgatcaaaaggaacaagcatca

SEQ ID NO: 7125 - DNA, 32 bp, Homo sapiens
taaatcaccacgatcaaaaggaacaagcatca

SEQ ID NO: 7126 - DNA, 30 bp, Homo sapiens
aaatcaccacgatcaaaaggaacaagcatc

SEQ ID NO: 7127 - DNA, 31 bp, Homo sapiens
aaatcaccacgatcaaaaggaacaagcatca

SEQ ID NO: 7128 - DNA, 30 bp, Homo sapiens
aatcaccacgatcaaaaggaacaagcatca

SEQ ID NO: 7129 - DNA, 16 bp, Homo sapiens
caccacgatcaaaagg

SEQ ID NO: 7130 - DNA, 19 bp, Homo sapiens
caccacgatcaaaaggaac

SEQ ID NO: 7131 - DNA, 20 bp, Homo sapiens
caccacgatcaaaaggaaca

SEQ ID NO: 7132 - DNA, 26 bp, Homo sapiens
caccacgatcaaaaggaacaagcatc

SEQ ID NO: 7133 - DNA, 27 bp, Homo sapiens
caccacgatcaaaaggaacaagcatca

SEQ ID NO: 7134 - DNA, 30 bp, Homo sapiens
caccacgatcaaaaggaacaagcatcaagc

SEQ ID NO: 7135 - DNA, 31 bp, Homo sapiens
caccacgatcaaaaggaacaagcatcaagca

SEQ ID NO: 7136 - DNA, 25 bp, Homo sapiens
accacgatcaaaaggaacaagcatc

SEQ ID NO: 7137 - DNA, 26 bp, Homo sapiens
accacgatcaaaaggaacaagcatca

SEQ ID NO: 7138 - DNA, 30 bp, Homo sapiens
accacgatcaaaaggaacaagcatcaagca

SEQ ID NO: 7139 - DNA, 24 bp, Homo sapiens
ccacgatcaaaaggaacaagcatc

SEQ ID NO: 7140 - DNA, 25 bp, Homo sapiens
ccacgatcaaaaggaacaagcatca

SEQ ID NO: 7141 - DNA, 28 bp, Homo sapiens
cacgatcaaaaggaacaagcatcaagca

SEQ ID NO: 7142 - DNA, 22 bp, Homo sapiens
acgatcaaaaggaacaagcatc

SEQ ID NO: 7143 - DNA, 33 bp, Homo sapiens
aaaaggaacaagcatcaagcacgcagcaatgca

SEQ ID NO: 7144 - DNA, 31 bp, Homo sapiens
aaaggaacaagcatcaagcacgcagcaatgc

SEQ ID NO: 7145 - DNA, 32 bp, Homo sapiens
aaaggaacaagcatcaagcacgcagcaatgca

SEQ ID NO: 7146 - DNA, 21 bp, Homo sapiens
caagcacgcagcaatgcagct

SEQ ID NO: 7147 - DNA, 33 bp, Homo sapiens; identical to SEQ ID NO: 217

SEQ ID NO: 7148 - DNA, 34 bp, Homo sapiens
agcacgcagcaatgcagctcaaaacgcttagcct

SEQ ID NO: 7149 - DNA, 44 bp, Homo sapiens
agcacgcagcaatgcagctcaaaacgcttagcctagccacaccc

SEQ ID NO: 7150 - DNA, 32 bp, Homo sapiens
gcacgcagcaatgcagctcaaaacgcttagcc

SEQ ID NO: 7151 - DNA, 33 bp, Homo sapiens; identical to SEQ ID NO: 218

SEQ ID NO: 7152 - DNA, 31 bp, Homo sapiens
cacgcagcaatgcagctcaaaacgcttagcc

SEQ ID NO: 7153 - DNA, 32 bp, Homo sapiens
cacgcagcaatgcagctcaaaacgcttagcct

SEQ ID NO: 7154 - DNA, 26 bp, Homo sapiens
cagcaatgcagctcaaaacgcttagc

SEQ ID NO: 7155 - DNA, 28 bp, Homo sapiens
cagcaatgcagctcaaaacgcttagcct

SEQ ID NO: 7156 - DNA, 31 bp, Homo sapiens
cagcaatgcagctcaaaacgcttagcctagc

SEQ ID NO: 7157 - DNA, 30 bp, Homo sapiens
cagctcaaaacgcttagcctagccacaccc

SEQ ID NO: 7158 - DNA, 31 bp, Homo sapiens
cagctcaaaacgcttagcctagccacacccc

SEQ ID NO: 7159 - DNA, 32 bp, Homo sapiens
cagctcaaaacgcttagcctagccacaccccc

SEQ ID NO: 7160 - DNA, 29 bp, Homo sapiens
agctcaaaacgcttagcctagccacaccc

SEQ ID NO: 7161 - DNA, 30 bp, Homo sapiens
agctcaaaacgcttagcctagccacacccc

SEQ ID NO: 7162 - DNA, 17 bp, Homo sapiens
gctcaaaacgcttagcc

SEQ ID NO: 7163 - DNA, 22 bp, Homo sapiens
gctcaaaacgcttagcctagcc

SEQ ID NO: 7164 - DNA, 27 bp, Homo sapiens
gctcaaaacgcttagcctagccacacc

SEQ ID NO: 7165 - DNA, 28 bp, Homo sapiens
gctcaaaacgcttagcctagccacaccc

SEQ ID NO: 7166 - DNA, 29 bp, Homo sapiens
gctcaaaacgcttagcctagccacacccc

SEQ ID NO: 7167 - DNA, 30 bp, Homo sapiens; identical to SEQ ID NO: 222

SEQ ID NO: 7168 - DNA, 19 bp, Homo sapiens
caaaacgcttagcctagcc

SEQ ID NO: 7169 - DNA, 24 bp, Homo sapiens
caaaacgcttagcctagccacacc

SEQ ID NO: 7170 - DNA, 25 bp, Homo sapiens
caaaacgcttagcctagccacaccc

SEQ ID NO: 7171 - DNA, 26 bp, Homo sapiens
caaaacgcttagcctagccacacccc

SEQ ID NO: 7172 - DNA, 27 bp, Homo sapiens
caaaacgcttagcctagccacaccccc

SEQ ID NO: 7173 - DNA, 18 bp, Homo sapiens
aaaacgcttagcctagcc

SEQ ID NO: 7174 - DNA, 23 bp, Homo sapiens
aaaacgcttagcctagccacacc

SEQ ID NO: 7175 - DNA, 24 bp, Homo sapiens
aaaacgcttagcctagccacaccc

SEQ ID NO: 7176 - DNA, 25 bp, Homo sapiens
aaaacgcttagcctagccacacccc

SEQ ID NO: 7177 - DNA, 26 bp, Homo sapiens
aaaacgcttagcctagccacaccccc

SEQ ID NO: 7178 - DNA, 17 bp, Homo sapiens
aaacgcttagcctagcc

SEQ ID NO: 7179 - DNA, 22 bp, Homo sapiens
aaacgcttagcctagccacacc

SEQ ID NO: 7180 - DNA, 23 bp, Homo sapiens
aaacgcttagcctagccacaccc

SEQ ID NO: 7181 - DNA, 24 bp, Homo sapiens
aaacgcttagcctagccacacccc

SEQ ID NO: 7182 - DNA, 25 bp, Homo sapiens
aaacgcttagcctagccacaccccc

SEQ ID NO: 7183 - DNA, 16 bp, Homo sapiens
aacgcttagcctagcc

SEQ ID NO: 7184 - DNA, 21 bp, Homo sapiens
aacgcttagcctagccacacc

SEQ ID NO: 7185 - DNA, 22 bp, Homo sapiens
aacgcttagcctagccacaccc

SEQ ID NO: 7186 - DNA, 23 bp, Homo sapiens
aacgcttagcctagccacacccc

SEQ ID NO: 7187 - DNA, 24 bp, Homo sapiens
aacgcttagcctagccacaccccc

SEQ ID NO: 7188 - DNA, 20 bp, Homo sapiens
acgcttagcctagccacacc

SEQ ID NO: 7189 - DNA, 21 bp, Homo sapiens
acgcttagcctagccacaccc

SEQ ID NO: 7190 - DNA, 22 bp, Homo sapiens
acgcttagcctagccacacccc

SEQ ID NO: 7191 - DNA, 23 bp, Homo sapiens
acgcttagcctagccacaccccc

SEQ ID NO: 7192 - DNA, 20 bp, Homo sapiens
cgcttagcctagccacaccc

SEQ ID NO: 7193 - DNA, 21 bp, Homo sapiens
cgcttagcctagccacacccc

SEQ ID NO: 7194 - DNA, 18 bp, Homo sapiens
gcttagcctagccacacc

SEQ ID NO: 7195 - DNA, 19 bp, Homo sapiens
gcttagcctagccacaccc

SEQ ID NO: 7196 - DNA, 20 bp, Homo sapiens
gcttagcctagccacacccc

SEQ ID NO: 7197 - DNA, 21 bp, Homo sapiens
gcttagcctagccacaccccc

SEQ ID NO: 7198 - DNA, 17 bp, Homo sapiens
cttagcctagccacacc

SEQ ID NO: 7199 - DNA, 18 bp, Homo sapiens
cttagcctagccacaccc

SEQ ID NO: 7200 - DNA, 19 bp, Homo sapiens
cttagcctagccacacccc

SEQ ID NO: 7201 - DNA, 20 bp, Homo sapiens
cttagcctagccacaccccc

SEQ ID NO: 7202 - DNA, 17 bp, Homo sapiens
ttagcctagccacaccc

SEQ ID NO: 7203 - DNA, 18 bp, Homo sapiens
ttagcctagccacacccc

SEQ ID NO: 7204 - DNA, 19 bp, Homo sapiens
ttagcctagccacaccccc

SEQ ID NO: 7205 - DNA, 16 bp, Homo sapiens
tagcctagccacaccc

SEQ ID NO: 7206 - DNA, 17 bp, Homo sapiens
tagcctagccacacccc

SEQ ID NO: 7207 - DNA, 18 bp, Homo sapiens
tagcctagccacaccccc

SEQ ID NO: 7208 - DNA, 31 bp, Homo sapiens
acacccccacgggaaacagcagtgattaacc

SEQ ID NO: 7209 - DNA, 23 bp, Homo sapiens
cacgggaaacagcagtgattaac

SEQ ID NO: 7210 - DNA, 24 bp, Homo sapiens
cacgggaaacagcagtgattaacc

SEQ ID NO: 7211 - DNA, 25 bp, Homo sapiens
cacgggaaacagcagtgattaacct

SEQ ID NO: 7212 - DNA, 16 bp, Homo sapiens
acgggaaacagcagtg

SEQ ID NO: 7213 - DNA, 22 bp, Homo sapiens
acgggaaacagcagtgattaac

SEQ ID NO: 7214 - DNA, 23 bp, Homo sapiens
acgggaaacagcagtgattaacc

SEQ ID NO: 7215 - DNA, 24 bp, Homo sapiens
acgggaaacagcagtgattaacct

SEQ ID NO: 7216 - DNA, 32 bp, Homo sapiens
acgggaaacagcagtgattaacctttagcaat

SEQ ID NO: 7217 - DNA, 22 bp, Homo sapiens
cgggaaacagcagtgattaacc

SEQ ID NO: 7218 - DNA, 20 bp, Homo sapiens
ggaaacagcagtgattaacc

SEQ ID NO: 7219 - DNA, 26 bp, Homo sapiens
tttagcaataaacgaaagtttaacta

SEQ ID NO: 7220 - DNA, 31 bp, Homo sapiens
aaacgaaagtttaactaagctatactaaccc

SEQ ID NO: 7221 - DNA, 32 bp, Homo sapiens
aaacgaaagtttaactaagctatactaacccc

SEQ ID NO: 7222 - DNA, 30 bp, Homo sapiens
aacgaaagtttaactaagctatactaaccc

SEQ ID NO: 7223 - DNA, 16 bp, Homo sapiens
aagctatactaacccc

SEQ ID NO: 7224 - DNA, 33 bp, Homo sapiens; identical to SEQ ID NO: 243

SEQ ID NO: 7225 - DNA, 32 bp, Homo sapiens; identical to SEQ ID NO: 244

SEQ ID NO: 7226 - DNA, 17 bp, Homo sapiens
taaccccagggttggtc

SEQ ID NO: 7227 - DNA, 28 bp, Homo sapiens
taaccccagggttggtcaatttcgtgcc

SEQ ID NO: 7228 - DNA, 16 bp, Homo sapiens
aaccccagggttggtc

SEQ ID NO: 7229 - DNA, 17 bp, Homo sapiens
aaccccagggttggtca

SEQ ID NO: 7230 - DNA, 20 bp, Homo sapiens
aaccccagggttggtcaatt

SEQ ID NO: 7231 - DNA, 23 bp, Homo sapiens
aaccccagggttggtcaatttcg

SEQ ID NO: 7232 - DNA, 24 bp, Homo sapiens
aaccccagggttggtcaatttcgt

SEQ ID NO: 7233 - DNA, 26 bp, Homo sapiens
aaccccagggttggtcaatttcgtgc

SEQ ID NO: 7234 - DNA, 28 bp, Homo sapiens
aaccccagggttggtcaatttcgtgcca

SEQ ID NO: 7235 - DNA, 29 bp, Homo sapiens
aaccccagggttggtcaatttcgtgccag

SEQ ID NO: 7236 - DNA, 30 bp, Homo sapiens
aaccccagggttggtcaatttcgtgccagc

SEQ ID NO: 7237 - DNA, 23 bp, Homo sapiens
accccagggttggtcaatttcgt

SEQ ID NO: 7238 - DNA, 25 bp, Homo sapiens
accccagggttggtcaatttcgtgc

SEQ ID NO: 7239 - DNA, 26 bp, Homo sapiens
accccagggttggtcaatttcgtgcc

SEQ ID NO: 7240 - DNA, 25 bp, Homo sapiens
ccccagggttggtcaatttcgtgcc

SEQ ID NO: 7241 - DNA, 24 bp, Homo sapiens
cccagggttggtcaatttcgtgcc

SEQ ID NO: 7242 - DNA, 16 bp, Homo sapiens
ccagggttggtcaatt

SEQ ID NO: 7243 - DNA, 23 bp, Homo sapiens
ccagggttggtcaatttcgtgcc

SEQ ID NO: 7244 - DNA, 36 bp, Homo sapiens
ccagggttggtcaatttcgtgccagccaccgcggtc

SEQ ID NO: 7245 - DNA, 16 bp, Homo sapiens
cagggttggtcaattt

SEQ ID NO: 7246 - DNA, 17 bp, Homo sapiens
cagggttggtcaatttc

SEQ ID NO: 7247 - DNA, 18 bp, Homo sapiens
cagggttggtcaatttcg

SEQ ID NO: 7248 - DNA, 19 bp, Homo sapiens
cagggttggtcaatttcgt

SEQ ID NO: 7249 - DNA, 22 bp, Homo sapiens
cagggttggtcaatttcgtgcc

SEQ ID NO: 7250 - DNA, 23 bp, Homo sapiens
cagggttggtcaatttcgtgcca

SEQ ID NO: 7251 - DNA, 35 bp, Homo sapiens
cagggttggtcaatttcgtgccagccaccgcggtc

SEQ ID NO: 7252 - DNA, 36 bp, Homo sapiens
cagggttggtcaatttcgtgccagccaccgcggtca

SEQ ID NO: 7253 - DNA, 16 bp, Homo sapiens
agggttggtcaatttc

SEQ ID NO: 7254 - DNA, 17 bp, Homo sapiens
agggttggtcaatttcg

SEQ ID NO: 7255 - DNA, 21 bp, Homo sapiens
agggttggtcaatttcgtgcc

SEQ ID NO: 7256 - DNA, 34 bp, Homo sapiens
agggttggtcaatttcgtgccagccaccgcggtc

SEQ ID NO: 7257 - DNA, 35 bp, Homo sapiens
agggttggtcaatttcgtgccagccaccgcggtca

SEQ ID NO: 7258 - DNA, 20 bp, Homo sapiens
gggttggtcaatttcgtgcc

SEQ ID NO: 7259 - DNA, 22 bp, Homo sapiens
ggtcaatttcgtgccagccacc

SEQ ID NO: 7260 - DNA, 16 bp, Homo sapiens
caatttcgtgccagcc

SEQ ID NO: 7261 - DNA, 19 bp, Homo sapiens
caatttcgtgccagccacc

SEQ ID NO: 7262 - DNA, 18 bp, Homo sapiens
aatttcgtgccagccacc

SEQ ID NO: 7263 - DNA, 17 bp, Homo sapiens
atttcgtgccagccacc

SEQ ID NO: 7264 - DNA, 23 bp, Homo sapiens
atttcgtgccagccaccgcggtc

SEQ ID NO: 7265 - DNA, 24 bp, Homo sapiens
atttcgtgccagccaccgcggtca

SEQ ID NO: 7266 - DNA, 26 bp, Homo sapiens
atttcgtgccagccaccgcggtcaca

SEQ ID NO: 7267 - DNA, 20 bp, Homo sapiens
tcgtgccagccaccgcggtc

SEQ ID NO: 7268 - DNA, 19 bp, Homo sapiens
cgtgccagccaccgcggtc

SEQ ID NO: 7269 - DNA, 20 bp, Homo sapiens
cgtgccagccaccgcggtca

SEQ ID NO: 7270 - DNA, 18 bp, Homo sapiens
agccaccgcggtcacacg

SEQ ID NO: 7271 - DNA, 25 bp, Homo sapiens
agccaccgcggtcacacgattaacc

SEQ ID NO: 7272 - DNA, 26 bp, Homo sapiens
agccaccgcggtcacacgattaaccc

SEQ ID NO: 7273 - DNA, 27 bp, Homo sapiens
agccaccgcggtcacacgattaaccca

SEQ ID NO: 7274 - DNA, 30 bp, Homo sapiens
agccaccgcggtcacacgattaacccaagt

SEQ ID NO: 7275 - DNA, 31 bp, Homo sapiens; identical to SEQ ID NO: 257

SEQ ID NO: 7276 - DNA, 32 bp, Homo sapiens
agccaccgcggtcacacgattaacccaagtca

SEQ ID NO: 7277 - DNA, 41 bp, Homo sapiens
agccaccgcggtcacacgattaacccaagtcaatagaagcc

SEQ ID NO: 7278 - DNA, 25 bp, Homo sapiens
gccaccgcggtcacacgattaaccc

SEQ ID NO: 7279 - DNA, 30 bp, Homo sapiens
gccaccgcggtcacacgattaacccaagtc

SEQ ID NO: 7280 - DNA, 16 bp, Homo sapiens
ccaccgcggtcacacg

SEQ ID NO: 7281 - DNA, 24 bp, Homo sapiens
ccaccgcggtcacacgattaaccc

SEQ ID NO: 7282 - DNA, 23 bp, Homo sapiens
caccgcggtcacacgattaaccc

SEQ ID NO: 7283 - DNA, 38 bp, Homo sapiens
caccgcggtcacacgattaacccaagtcaatagaagcc

SEQ ID NO: 7284 - DNA, 22 bp, Homo sapiens
accgcggtcacacgattaaccc

SEQ ID NO: 7285 - DNA, 19 bp, Homo sapiens
gcggtcacacgattaaccc

SEQ ID NO: 7286 - DNA, 34 bp, Homo sapiens
gcggtcacacgattaacccaagtcaatagaagcc

SEQ ID NO: 7287 - DNA, 35 bp, Homo sapiens
gcggtcacacgattaacccaagtcaatagaagccg

SEQ ID NO: 7288 - DNA, 18 bp, Homo sapiens
cggtcacacgattaaccc

SEQ ID NO: 7289 - DNA, 32 bp, Homo sapiens
cggtcacacgattaacccaagtcaatagaagc

SEQ ID NO: 7290 - DNA, 33 bp, Homo sapiens; identical to SEQ ID NO: 258

SEQ ID NO: 7291 - DNA, 31 bp, Homo sapiens
gtcacacgattaacccaagtcaatagaagcc

SEQ ID NO: 7292 - DNA, 32 bp, Homo sapiens
gtcacacgattaacccaagtcaatagaagccg

SEQ ID NO: 7293 - DNA, 32 bp, Homo sapiens
cacacgattaacccaagtcaatagaagccggc

SEQ ID NO: 7294 - DNA, 33 bp, Homo sapiens
cacacgattaacccaagtcaatagaagccggcg

SEQ ID NO: 7295 - DNA, 28 bp, Homo sapiens
acacgattaacccaagtcaatagaagcc

SEQ ID NO: 7296 - DNA, 29 bp, Homo sapiens
acacgattaacccaagtcaatagaagccg

SEQ ID NO: 7297 - DNA, 30 bp, Homo sapiens
acacgattaacccaagtcaatagaagccgg

SEQ ID NO: 7298 - DNA, 31 bp, Homo sapiens; identical to SEQ ID NO: 260

SEQ ID NO: 7299 - DNA, 32 bp, Homo sapiens; identical to SEQ ID NO: 261

SEQ ID NO: 7300 - DNA, 27 bp, Homo sapiens
cacgattaacccaagtcaatagaagcc

SEQ ID NO: 7301 - DNA, 28 bp, Homo sapiens
cacgattaacccaagtcaatagaagccg

SEQ ID NO: 7302 - DNA, 30 bp, Homo sapiens; identical to SEQ ID NO: 263

SEQ ID NO: 7303 - DNA, 31 bp, Homo sapiens
cacgattaacccaagtcaatagaagccggcg

SEQ ID NO: 7304 - DNA, 33 bp, Homo sapiens
cacgattaacccaagtcaatagaagccggcgta

SEQ ID NO: 7305 - DNA, 29 bp, Homo sapiens
acgattaacccaagtcaatagaagccggc

SEQ ID NO: 7306 - DNA, 25 bp, Homo sapiens
cgattaacccaagtcaatagaagcc

SEQ ID NO: 7307 - DNA, 28 bp, Homo sapiens
cgattaacccaagtcaatagaagccggc

SEQ ID NO: 7308 - DNA, 29 bp, Homo sapiens
cgattaacccaagtcaatagaagccggcg

SEQ ID NO: 7309 - DNA, 30 bp, Homo sapiens
cgattaacccaagtcaatagaagccggcgt

SEQ ID NO: 7310 - DNA, 32 bp, Homo sapiens
cgattaacccaagtcaatagaagccggcgtaa

SEQ ID NO: 7311 - DNA, 27 bp, Homo sapiens
gattaacccaagtcaatagaagccggc

SEQ ID NO: 7312 - DNA, 28 bp, Homo sapiens
gattaacccaagtcaatagaagccggcg

SEQ ID NO: 7313 - DNA, 23 bp, Homo sapiens
attaacccaagtcaatagaagcc

SEQ ID NO: 7314 - DNA, 24 bp, Homo sapiens
attaacccaagtcaatagaagccg

SEQ ID NO: 7315 - DNA, 26 bp, Homo sapiens
attaacccaagtcaatagaagccggc

SEQ ID NO: 7316 - DNA, 19 bp, Homo sapiens
aacccaagtcaatagaagc

SEQ ID NO: 7317 - DNA, 16 bp, Homo sapiens
caagtcaatagaagcc

SEQ ID NO: 7318 - DNA, 17 bp, Homo sapiens
caagtcaatagaagccg

SEQ ID NO: 7319 - DNA, 19 bp, Homo sapiens
caagtcaatagaagccggc

SEQ ID NO: 7320 - DNA, 20 bp, Homo sapiens
caagtcaatagaagccggcg

SEQ ID NO: 7321 - DNA, 22 bp, Homo sapiens
caagtcaatagaagccggcgta

SEQ ID NO: 7322 - DNA, 41 bp, Homo sapiens
caagtcaatagaagccggcgtaaagagtgttttagatcacc

SEQ ID NO: 7323 - DNA, 42 bp, Homo sapiens
caagtcaatagaagccggcgtaaagagtgttttagatcaccc

SEQ ID NO: 7324 - DNA, 43 bp, Homo sapiens
caagtcaatagaagccggcgtaaagagtgttttagatcacccc

SEQ ID NO: 7325 - DNA, 44 bp, Homo sapiens
caagtcaatagaagccggcgtaaagagtgttttagatcaccccc

SEQ ID NO: 7326 - DNA, 18 bp, Homo sapiens
aagtcaatagaagccggc

SEQ ID NO: 7327 - DNA, 19 bp, Homo sapiens
aagtcaatagaagccggcg

SEQ ID NO: 7328 - DNA, 21 bp, Homo sapiens
aagtcaatagaagccggcgta

SEQ ID NO: 7329 - DNA, 40 bp, Homo sapiens
aagtcaatagaagccggcgtaaagagtgttttagatcacc

SEQ ID NO: 7330 - DNA, 41 bp, Homo sapiens
aagtcaatagaagccggcgtaaagagtgttttagatcaccc

SEQ ID NO: 7331 - DNA, 17 bp, Homo sapiens
agtcaatagaagccggc

SEQ ID NO: 7332 - DNA, 20 bp, Homo sapiens
agtcaatagaagccggcgta

SEQ ID NO: 7333 - DNA, 39 bp, Homo sapiens
agtcaatagaagccggcgtaaagagtgttttagatcacc

SEQ ID NO: 7334 - DNA, 40 bp, Homo sapiens
agtcaatagaagccggcgtaaagagtgttttagatcaccc

SEQ ID NO: 7335 - DNA, 16 bp, Homo sapiens
gtcaatagaagccggc

SEQ ID NO: 7336 - DNA, 37 bp, Homo sapiens
tcaatagaagccggcgtaaagagtgttttagatcacc

SEQ ID NO: 7337 - DNA, 38 bp, Homo sapiens
tcaatagaagccggcgtaaagagtgttttagatcaccc

SEQ ID NO: 7338 - DNA, 39 bp, Homo sapiens
tcaatagaagccggcgtaaagagtgttttagatcacccc

SEQ ID NO: 7339 - DNA, 36 bp, Homo sapiens
caatagaagccggcgtaaagagtgttttagatcacc

SEQ ID NO: 7340 - DNA, 37 bp, Homo sapiens
caatagaagccggcgtaaagagtgttttagatcaccc

SEQ ID NO: 7341 - DNA, 38 bp, Homo sapiens
caatagaagccggcgtaaagagtgttttagatcacccc

SEQ ID NO: 7342 - DNA, 16 bp, Homo sapiens
aatagaagccggcgta

SEQ ID NO: 7343 - DNA, 17 bp, Homo sapiens
aatagaagccggcgtaa

SEQ ID NO: 7344 - DNA, 18 bp, Homo sapiens
aatagaagccggcgtaaa

SEQ ID NO: 7345 - DNA, 19 bp, Homo sapiens
aatagaagccggcgtaaag

SEQ ID NO: 7346 - DNA, 20 bp, Homo sapiens
aatagaagccggcgtaaaga

SEQ ID NO: 7347 - DNA, 21 bp, Homo sapiens
aatagaagccggcgtaaagag

SEQ ID NO: 7348 - DNA, 22 bp, Homo sapiens
aatagaagccggcgtaaagagt

SEQ ID NO: 7349 - DNA, 23 bp, Homo sapiens
aatagaagccggcgtaaagagtg

SEQ ID NO: 7350 - DNA, 25 bp, Homo sapiens
aatagaagccggcgtaaagagtgtt

SEQ ID NO: 7351 - DNA, 28 bp, Homo sapiens
aatagaagccggcgtaaagagtgtttta

SEQ ID NO: 7352 - DNA, 29 bp, Homo sapiens
aatagaagccggcgtaaagagtgttttag

SEQ ID NO: 7353 - DNA, 30 bp, Homo sapiens
aatagaagccggcgtaaagagtgttttaga

SEQ ID NO: 7354 - DNA, 31 bp, Homo sapiens
aatagaagccggcgtaaagagtgttttagat

SEQ ID NO: 7355 - DNA, 32 bp, Homo sapiens; identical to SEQ ID NO: 272

SEQ ID NO: 7356 - DNA, 33 bp, Homo sapiens; identical to SEQ ID NO: 273

SEQ ID NO: 7357 - DNA, 34 bp, Homo sapiens
aatagaagccggcgtaaagagtgttttagatcac

SEQ ID NO: 7358 - DNA, 35 bp, Homo sapiens
aatagaagccggcgtaaagagtgttttagatcacc

SEQ ID NO: 7359 - DNA, 36 bp, Homo sapiens
aatagaagccggcgtaaagagtgttttagatcaccc

SEQ ID NO: 7360 - DNA, 37 bp, Homo sapiens
aatagaagccggcgtaaagagtgttttagatcacccc

SEQ ID NO: 7361 - DNA, 38 bp, Homo sapiens
aatagaagccggcgtaaagagtgttttagatcaccccc

SEQ ID NO: 7362 - DNA, 39 bp, Homo sapiens
aatagaagccggcgtaaagagtgttttagatcaccccct

SEQ ID NO: 7363 - DNA, 40 bp, Homo sapiens
aatagaagccggcgtaaagagtgttttagatcaccccctc

SEQ ID NO: 7364 - DNA, 41 bp, Homo sapiens
aatagaagccggcgtaaagagtgttttagatcaccccctcc

SEQ ID NO: 7365 - DNA, 42 bp, Homo sapiens
aatagaagccggcgtaaagagtgttttagatcaccccctccc

SEQ ID NO: 7366 - DNA, 43 bp, Homo sapiens
aatagaagccggcgtaaagagtgttttagatcaccccctcccc

SEQ ID NO: 7367 - DNA, 44 bp, Homo sapiens
aatagaagccggcgtaaagagtgttttagatcaccccctcccca

SEQ ID NO: 7368 - DNA, 16 bp, Homo sapiens
atagaagccggcgtaa

SEQ ID NO: 7369 - DNA, 17 bp, Homo sapiens
atagaagccggcgtaaa

SEQ ID NO: 7370 - DNA, 18 bp, Homo sapiens
atagaagccggcgtaaag

SEQ ID NO: 7371 - DNA, 28 bp, Homo sapiens
atagaagccggcgtaaagagtgttttag

SEQ ID NO: 7372 - DNA, 29 bp, Homo sapiens
atagaagccggcgtaaagagtgttttaga

SEQ ID NO: 7373 - DNA, 30 bp, Homo sapiens
atagaagccggcgtaaagagtgttttagat

SEQ ID NO: 7374 - DNA, 31 bp, Homo sapiens; identical to SEQ ID NO: 274

SEQ ID NO: 7375 - DNA, 32 bp, Homo sapiens
atagaagccggcgtaaagagtgttttagatca

SEQ ID NO: 7376 - DNA, 33 bp, Homo sapiens
atagaagccggcgtaaagagtgttttagatcac

SEQ ID NO: 7377 - DNA, 34 bp, Homo sapiens
atagaagccggcgtaaagagtgttttagatcacc

SEQ ID NO: 7378 - DNA, 35 bp, Homo sapiens
atagaagccggcgtaaagagtgttttagatcaccc

SEQ ID NO: 7379 - DNA, 36 bp, Homo sapiens
atagaagccggcgtaaagagtgttttagatcacccc

SEQ ID NO: 7380 - DNA, 37 bp, Homo sapiens
atagaagccggcgtaaagagtgttttagatcaccccc

SEQ ID NO: 7381 - DNA, 38 bp, Homo sapiens
atagaagccggcgtaaagagtgttttagatcaccccct

SEQ ID NO: 7382 - DNA, 39 bp, Homo sapiens
atagaagccggcgtaaagagtgttttagatcaccccctc

SEQ ID NO: 7383 - DNA, 30 bp, Homo sapiens
tagaagccggcgtaaagagtgttttagatc

SEQ ID NO: 7384 - DNA, 32 bp, Homo sapiens
tagaagccggcgtaaagagtgttttagatcac

SEQ ID NO: 7385 - DNA, 33 bp, Homo sapiens; identical to SEQ ID NO: 275

SEQ ID NO: 7386 - DNA, 34 bp, Homo sapiens
tagaagccggcgtaaagagtgttttagatcaccc

SEQ ID NO: 7387 - DNA, 35 bp, Homo sapiens
tagaagccggcgtaaagagtgttttagatcacccc

SEQ ID NO: 7388 - DNA, 36 bp, Homo sapiens
tagaagccggcgtaaagagtgttttagatcaccccc

SEQ ID NO: 7389 - DNA, 31 bp, Homo sapiens
agaagccggcgtaaagagtgttttagatcac

SEQ ID NO: 7390 - DNA, 32 bp, Homo sapiens; identical to SEQ ID NO: 276

SEQ ID NO: 7391 - DNA, 33 bp, Homo sapiens; identical to SEQ ID NO: 277

SEQ ID NO: 7392 - DNA, 34 bp, Homo sapiens
agaagccggcgtaaagagtgttttagatcacccc

SEQ ID NO: 7393 - DNA, 35 bp, Homo sapiens
agaagccggcgtaaagagtgttttagatcaccccc

SEQ ID NO: 7394 - DNA, 30 bp, Homo sapiens
gaagccggcgtaaagagtgttttagatcac

SEQ ID NO: 7395 - DNA, 31 bp, Homo sapiens; identical to SEQ ID NO: 278

SEQ ID NO: 7396 - DNA, 32 bp, Homo sapiens; identical to SEQ ID NO: 279

SEQ ID NO: 7397 - DNA, 33 bp, Homo sapiens; identical to SEQ ID NO: 280

SEQ ID NO: 7398 - DNA, 34 bp, Homo sapiens
gaagccggcgtaaagagtgttttagatcaccccc

SEQ ID NO: 7399 - DNA, 27 bp, Homo sapiens
aagccggcgtaaagagtgttttagatc

SEQ ID NO: 7400 - DNA, 30 bp, Homo sapiens; identical to SEQ ID NO: 281

SEQ ID NO: 7401 - DNA, 31 bp, Homo sapiens; identical to SEQ ID NO: 282

SEQ ID NO: 7402 - DNA, 32 bp, Homo sapiens; identical to SEQ ID NO: 283

SEQ ID NO: 7403 - DNA, 33 bp, Homo sapiens; identical to SEQ ID NO: 284

SEQ ID NO: 7404 - DNA, 29 bp, Homo sapiens
agccggcgtaaagagtgttttagatcacc

SEQ ID NO: 7405 - DNA, 30 bp, Homo sapiens
agccggcgtaaagagtgttttagatcaccc

SEQ ID NO: 7406 - DNA, 31 bp, Homo sapiens
agccggcgtaaagagtgttttagatcacccc

SEQ ID NO: 7407 - DNA, 32 bp, Homo sapiens
agccggcgtaaagagtgttttagatcaccccc

SEQ ID NO: 7408 - DNA, 25 bp, Homo sapiens
gccggcgtaaagagtgttttagatc

SEQ ID NO: 7409 - DNA, 28 bp, Homo sapiens
gccggcgtaaagagtgttttagatcacc

SEQ ID NO: 7410 - DNA, 29 bp, Homo sapiens
gccggcgtaaagagtgttttagatcaccc

SEQ ID NO: 7411 - DNA, 30 bp, Homo sapiens
gccggcgtaaagagtgttttagatcacccc

SEQ ID NO: 7412 - DNA, 31 bp, Homo sapiens
gccggcgtaaagagtgttttagatcaccccc

SEQ ID NO: 7413 - DNA, 24 bp, Homo sapiens
ccggcgtaaagagtgttttagatc

SEQ ID NO: 7414 - DNA, 27 bp, Homo sapiens
ccggcgtaaagagtgttttagatcacc

SEQ ID NO: 7415 - DNA, 28 bp, Homo sapiens
ccggcgtaaagagtgttttagatcaccc

SEQ ID NO: 7416 - DNA, 29 bp, Homo sapiens
ccggcgtaaagagtgttttagatcacccc

SEQ ID NO: 7417 - DNA, 30 bp, Homo sapiens
ccggcgtaaagagtgttttagatcaccccc

SEQ ID NO: 7418 - DNA, 26 bp, Homo sapiens
cggcgtaaagagtgttttagatcacc

SEQ ID NO: 7419 - DNA, 25 bp, Homo sapiens
ggcgtaaagagtgttttagatcacc

SEQ ID NO: 7420 - DNA, 26 bp, Homo sapiens
ggcgtaaagagtgttttagatcaccc

SEQ ID NO: 7421 - DNA, 27 bp, Homo sapiens
ggcgtaaagagtgttttagatcacccc

SEQ ID NO: 7422 - DNA, 28 bp, Homo sapiens
ggcgtaaagagtgttttagatcaccccc

SEQ ID NO: 7423 - DNA, 21 bp, Homo sapiens
gcgtaaagagtgttttagatc

SEQ ID NO: 7424 - DNA, 24 bp, Homo sapiens
gcgtaaagagtgttttagatcacc

SEQ ID NO: 7425 - DNA, 32 bp, Homo sapiens
gcgtaaagagtgttttagatcaccccctcccc

SEQ ID NO: 7426 - DNA, 20 bp, Homo sapiens
cgtaaagagtgttttagatc

SEQ ID NO: 7427 - DNA, 23 bp, Homo sapiens
cgtaaagagtgttttagatcacc

SEQ ID NO: 7428 - DNA, 16 bp, Homo sapiens
aagagtgttttagatc

SEQ ID NO: 7429 - DNA, 23 bp, Homo sapiens
atcaccccctccccaataaagct

SEQ ID NO: 7430 - DNA, 16 bp, Homo sapiens
cctccccaataaagct

SEQ ID NO: 7431 - DNA, 27 bp, Homo sapiens
cctccccaataaagctaaaactcacct

SEQ ID NO: 7432 - DNA, 21 bp, Homo sapiens
ctccccaataaagctaaaact

SEQ ID NO: 7433 - DNA, 25 bp, Homo sapiens
ctccccaataaagctaaaactcacc

SEQ ID NO: 7434 - DNA, 26 bp, Homo sapiens
ctccccaataaagctaaaactcacct

SEQ ID NO: 7435 - DNA, 27 bp, Homo sapiens
ctccccaataaagctaaaactcacctg

SEQ ID NO: 7436 - DNA, 31 bp, Homo sapiens
ctccccaataaagctaaaactcacctgagtt

SEQ ID NO: 7437 - DNA, 24 bp, Homo sapiens
tccccaataaagctaaaactcacc

SEQ ID NO: 7438 - DNA, 25 bp, Homo sapiens
tccccaataaagctaaaactcacct

SEQ ID NO: 7439 - DNA, 24 bp, Homo sapiens
ccccaataaagctaaaactcacct

SEQ ID NO: 7440 - DNA, 23 bp, Homo sapiens
cccaataaagctaaaactcacct

SEQ ID NO: 7441 - DNA, 21 bp, Homo sapiens
ccaataaagctaaaactcacc

SEQ ID NO: 7442 - DNA, 22 bp, Homo sapiens
ccaataaagctaaaactcacct

SEQ ID NO: 7443 - DNA, 20 bp, Homo sapiens
caataaagctaaaactcacc

SEQ ID NO: 7444 - DNA, 21 bp, Homo sapiens
caataaagctaaaactcacct

SEQ ID NO: 7445 - DNA, 22 bp, Homo sapiens
caataaagctaaaactcacctg

SEQ ID NO: 7446 - DNA, 37 bp, Homo sapiens
caataaagctaaaactcacctgagttgtaaaaaactc

SEQ ID NO: 7447 - DNA, 19 bp, Homo sapiens
aataaagctaaaactcacc

SEQ ID NO: 7448 - DNA, 20 bp, Homo sapiens
aataaagctaaaactcacct

SEQ ID NO: 7449 - DNA, 21 bp, Homo sapiens
aataaagctaaaactcacctg

SEQ ID NO: 7450 - DNA, 36 bp, Homo sapiens
aataaagctaaaactcacctgagttgtaaaaaactc

SEQ ID NO: 7451 - DNA, 18 bp, Homo sapiens
ataaagctaaaactcacc

SEQ ID NO: 7452 - DNA, 19 bp, Homo sapiens
ataaagctaaaactcacct

SEQ ID NO: 7453 - DNA, 20 bp, Homo sapiens
ataaagctaaaactcacctg

SEQ ID NO: 7454 - DNA, 35 bp, Homo sapiens
ataaagctaaaactcacctgagttgtaaaaaactc

SEQ ID NO: 7455 - DNA, 18 bp, Homo sapiens
taaagctaaaactcacct

SEQ ID NO: 7456 - DNA, 17 bp, Homo sapiens
aaagctaaaactcacct

SEQ ID NO: 7457 - DNA, 33 bp, Homo sapiens; identical to SEQ ID NO: 300

SEQ ID NO: 7458 - DNA, 16 bp, Homo sapiens
aagctaaaactcacct

SEQ ID NO: 7459 - DNA, 32 bp, Homo sapiens; identical to SEQ ID NO: 302

SEQ ID NO: 7460 - DNA, 29 bp, Homo sapiens
ctaaaactcacctgagttgtaaaaaactc

SEQ ID NO: 7461 - DNA, 27 bp, Homo sapiens
aaaactcacctgagttgtaaaaaactc

SEQ ID NO: 7462 - DNA, 19 bp, Homo sapiens
cacctgagttgtaaaaaac

SEQ ID NO: 7463 - DNA, 20 bp, Homo sapiens
cacctgagttgtaaaaaact

SEQ ID NO: 7464 - DNA, 21 bp, Homo sapiens
cacctgagttgtaaaaaactc

SEQ ID NO: 7465 - DNA, 20 bp, Homo sapiens
acctgagttgtaaaaaactc

SEQ ID NO: 7466 - DNA, 17 bp, Homo sapiens
tgagttgtaaaaaactc

SEQ ID NO: 7467 - DNA, 24 bp, Homo sapiens
ttgtaaaaaactccagttgacaca

SEQ ID NO: 7468 - DNA, 33 bp, Homo sapiens
ttgtaaaaaactccagttgacacaaaatagact

SEQ ID NO: 7469 - DNA, 21 bp, Homo sapiens
tgtaaaaaactccagttgaca

SEQ ID NO: 7470 - DNA, 22 bp, Homo sapiens
tgtaaaaaactccagttgacac

SEQ ID NO: 7471 - DNA, 23 bp, Homo sapiens
tgtaaaaaactccagttgacaca

SEQ ID NO: 7472 - DNA, 32 bp, Homo sapiens
tgtaaaaaactccagttgacacaaaatagact

SEQ ID NO: 7473 - DNA, 22 bp, Homo sapiens
gtaaaaaactccagttgacaca

SEQ ID NO: 7474 - DNA, 31 bp, Homo sapiens
gtaaaaaactccagttgacacaaaatagact

SEQ ID NO: 7475 - DNA, 21 bp, Homo sapiens
taaaaaactccagttgacaca

SEQ ID NO: 7476 - DNA, 30 bp, Homo sapiens
taaaaaactccagttgacacaaaatagact

SEQ ID NO: 7477 - DNA, 26 bp, Homo sapiens
aaactccagttgacacaaaatagact

SEQ ID NO: 7478 - DNA, 25 bp, Homo sapiens
aactccagttgacacaaaatagact

SEQ ID NO: 7479 - DNA, 24 bp, Homo sapiens
actccagttgacacaaaatagact

SEQ ID NO: 7480 - DNA, 25 bp, Homo sapiens
actccagttgacacaaaatagacta

SEQ ID NO: 7481 - DNA, 27 bp, Homo sapiens
actccagttgacacaaaatagactacg

SEQ ID NO: 7482 - DNA, 23 bp, Homo sapiens
ctccagttgacacaaaatagact

SEQ ID NO: 7483 - DNA, 19 bp, Homo sapiens
cagttgacacaaaatagac

SEQ ID NO: 7484 - DNA, 18 bp, Homo sapiens
agttgacacaaaatagac

SEQ ID NO: 7485 - DNA, 17 bp, Homo sapiens
gttgacacaaaatagac

SEQ ID NO: 7486 - DNA, 37 bp, Homo sapiens
aaatagactacgaaagtggctttaacatatctgaaca

SEQ ID NO: 7487 - DNA, 39 bp, Homo sapiens
aaatagactacgaaagtggctttaacatatctgaacaca

SEQ ID NO: 7488 - DNA, 41 bp, Homo sapiens
aaatagactacgaaagtggctttaacatatctgaacacaca

SEQ ID NO: 7489 - DNA, 47 bp, Homo sapiens
aaatagactacgaaagtggctttaacatatctgaacacacaatagct

SEQ ID NO: 7490 - DNA, 38 bp, Homo sapiens
aatagactacgaaagtggctttaacatatctgaacaca

SEQ ID NO: 7491 - DNA, 46 bp, Homo sapiens
aatagactacgaaagtggctttaacatatctgaacacacaatagct

SEQ ID NO: 7492 - DNA, 32 bp, Homo sapiens
gactacgaaagtggctttaacatatctgaaca

SEQ ID NO: 7493 - DNA, 33 bp, Homo sapiens
actacgaaagtggctttaacatatctgaacaca

SEQ ID NO: 7494 - DNA, 19 bp, Homo sapiens
tacgaaagtggctttaaca

SEQ ID NO: 7495 - DNA, 21 bp, Homo sapiens
tacgaaagtggctttaacata

SEQ ID NO: 7496 - DNA, 23 bp, Homo sapiens
tacgaaagtggctttaacatatc

SEQ ID NO: 7497 - DNA, 24 bp, Homo sapiens
tacgaaagtggctttaacatatct

SEQ ID NO: 7498 - DNA, 28 bp, Homo sapiens
tacgaaagtggctttaacatatctgaac

SEQ ID NO: 7499 - DNA, 29 bp, Homo sapiens
tacgaaagtggctttaacatatctgaaca

SEQ ID NO: 7500 - DNA, 30 bp, Homo sapiens; identical to SEQ ID NO: 311

SEQ ID NO: 7501 - DNA, 31 bp, Homo sapiens; identical to SEQ ID NO: 312

SEQ ID NO: 7502 - DNA, 32 bp, Homo sapiens
tacgaaagtggctttaacatatctgaacacac

SEQ ID NO: 7503 - DNA, 33 bp, Homo sapiens; identical to SEQ ID NO: 313

SEQ ID NO: 7504 - DNA, 39 bp, Homo sapiens
tacgaaagtggctttaacatatctgaacacacaatagct

SEQ ID NO: 7505 - DNA, 45 bp, Homo sapiens
tacgaaagtggctttaacatatctgaacacacaatagctaagacc

SEQ ID NO: 7506 - DNA, 46 bp, Homo sapiens
tacgaaagtggctttaacatatctgaacacacaatagctaagaccc

SEQ ID NO: 7507 - DNA, 18 bp, Homo sapiens
acgaaagtggctttaaca

SEQ ID NO: 7508 - DNA, 22 bp, Homo sapiens
acgaaagtggctttaacatatc

SEQ ID NO: 7509 - DNA, 23 bp, Homo sapiens
acgaaagtggctttaacatatct

SEQ ID NO: 7510 - DNA, 24 bp, Homo sapiens
acgaaagtggctttaacatatctg

SEQ ID NO: 7511 - DNA, 27 bp, Homo sapiens
acgaaagtggctttaacatatctgaac

SEQ ID NO: 7512 - DNA, 28 bp, Homo sapiens
acgaaagtggctttaacatatctgaaca

SEQ ID NO: 7513 - DNA, 29 bp, Homo sapiens
acgaaagtggctttaacatatctgaacac

SEQ ID NO: 7514 - DNA, 30 bp, Homo sapiens; identical to SEQ ID NO: 316

SEQ ID NO: 7515 - DNA, 31 bp, Homo sapiens; identical to SEQ ID NO: 317

SEQ ID NO: 7516 - DNA, 32 bp, Homo sapiens; identical to SEQ ID NO: 318

SEQ ID NO: 7517 - DNA, 38 bp, Homo sapiens
acgaaagtggctttaacatatctgaacacacaatagct

SEQ ID NO: 7518 - DNA, 45 bp, Homo sapiens
acgaaagtggctttaacatatctgaacacacaatagctaagaccc

SEQ ID NO: 7519 - DNA, 46 bp, Homo sapiens
acgaaagtggctttaacatatctgaacacacaatagctaagaccca

SEQ ID NO: 7520 - DNA, 21 bp, Homo sapiens
cgaaagtggctttaacatatc

SEQ ID NO: 7521 - DNA, 29 bp, Homo sapiens
cgaaagtggctttaacatatctgaacaca

SEQ ID NO: 7522 - DNA, 31 bp, Homo sapiens
cgaaagtggctttaacatatctgaacacaca

SEQ ID NO: 7523 - DNA, 37 bp, Homo sapiens
cgaaagtggctttaacatatctgaacacacaatagct

SEQ ID NO: 7524 - DNA, 43 bp, Homo sapiens
cgaaagtggctttaacatatctgaacacacaatagctaagacc

SEQ ID NO: 7525 - DNA, 44 bp, Homo sapiens
cgaaagtggctttaacatatctgaacacacaatagctaagaccc

SEQ ID NO: 7526 - DNA, 16 bp, Homo sapiens
gaaagtggctttaaca

SEQ ID NO: 7527 - DNA, 26 bp, Homo sapiens
gaaagtggctttaacatatctgaaca

SEQ ID NO: 7528 - DNA, 27 bp, Homo sapiens
gaaagtggctttaacatatctgaacac

SEQ ID NO: 7529 - DNA, 28 bp, Homo sapiens
gaaagtggctttaacatatctgaacaca

SEQ ID NO: 7530 - DNA, 36 bp, Homo sapiens
gaaagtggctttaacatatctgaacacacaatagct

SEQ ID NO: 7531 - DNA, 42 bp, Homo sapiens
gaaagtggctttaacatatctgaacacacaatagctaagacc

SEQ ID NO: 7532 - DNA, 43 bp, Homo sapiens
gaaagtggctttaacatatctgaacacacaatagctaagaccc

SEQ ID NO: 7533 - DNA, 23 bp, Homo sapiens
aaagtggctttaacatatctgaa

SEQ ID NO: 7534 - DNA, 24 bp, Homo sapiens
aaagtggctttaacatatctgaac

SEQ ID NO: 7535 - DNA, 25 bp, Homo sapiens
aaagtggctttaacatatctgaaca

SEQ ID NO: 7536 - DNA, 26 bp, Homo sapiens
aaagtggctttaacatatctgaacac

SEQ ID NO: 7537 - DNA, 27 bp, Homo sapiens
aaagtggctttaacatatctgaacaca

SEQ ID NO: 7538 - DNA, 28 bp, Homo sapiens
aaagtggctttaacatatctgaacacac

SEQ ID NO: 7539 - DNA, 29 bp, Homo sapiens
aaagtggctttaacatatctgaacacaca

SEQ ID NO: 7540 - DNA, 32 bp, Homo sapiens; identical to SEQ ID NO: 326

SEQ ID NO: 7541 - DNA, 35 bp, Homo sapiens
aaagtggctttaacatatctgaacacacaatagct

SEQ ID NO: 7542 - DNA, 38 bp, Homo sapiens
aaagtggctttaacatatctgaacacacaatagctaag

SEQ ID NO: 7543 - DNA, 41 bp, Homo sapiens
aaagtggctttaacatatctgaacacacaatagctaagacc

SEQ ID NO: 7544 - DNA, 42 bp, Homo sapiens
aaagtggctttaacatatctgaacacacaatagctaagaccc

SEQ ID NO: 7545 - DNA, 43 bp, Homo sapiens
aaagtggctttaacatatctgaacacacaatagctaagaccca

SEQ ID NO: 7546 - DNA, 47 bp, Homo sapiens
aaagtggctttaacatatctgaacacacaatagctaagacccaaact

SEQ ID NO: 7547 - DNA, 24 bp, Homo sapiens
aagtggctttaacatatctgaaca

SEQ ID NO: 7548 - DNA, 26 bp, Homo sapiens
aagtggctttaacatatctgaacaca

SEQ ID NO: 7549 - DNA, 40 bp, Homo sapiens
aagtggctttaacatatctgaacacacaatagctaagacc

SEQ ID NO: 7550 - DNA, 41 bp, Homo sapiens
aagtggctttaacatatctgaacacacaatagctaagaccc

SEQ ID NO: 7551 - DNA, 23 bp, Homo sapiens
agtggctttaacatatctgaaca

SEQ ID NO: 7552 - DNA, 25 bp, Homo sapiens
agtggctttaacatatctgaacaca

SEQ ID NO: 7553 - DNA, 27 bp, Homo sapiens
agtggctttaacatatctgaacacaca

SEQ ID NO: 7554 - DNA, 33 bp, Homo sapiens; identical to SEQ ID NO: 327

SEQ ID NO: 7555 - DNA, 39 bp, Homo sapiens
agtggctttaacatatctgaacacacaatagctaagacc

SEQ ID NO: 7556 - DNA, 40 bp, Homo sapiens
agtggctttaacatatctgaacacacaatagctaagaccc

SEQ ID NO: 7557 - DNA, 22 bp, Homo sapiens
gtggctttaacatatctgaaca

SEQ ID NO: 7558 - DNA, 32 bp, Homo sapiens; identical to SEQ ID NO: 328

SEQ ID NO: 7559 - DNA, 38 bp, Homo sapiens
gtggctttaacatatctgaacacacaatagctaagacc

SEQ ID NO: 7560 - DNA, 39 bp, Homo sapiens
gtggctttaacatatctgaacacacaatagctaagaccc

SEQ ID NO: 7561 - DNA, 37 bp, Homo sapiens
tggctttaacatatctgaacacacaatagctaagacc

SEQ ID NO: 7562 - DNA, 38 bp, Homo sapiens
tggctttaacatatctgaacacacaatagctaagaccc

SEQ ID NO: 7563 - DNA, 35 bp, Homo sapiens
gctttaacatatctgaacacacaatagctaagacc

SEQ ID NO: 7564 - DNA, 36 bp, Homo sapiens
gctttaacatatctgaacacacaatagctaagaccc

SEQ ID NO: 7565 - DNA, 28 bp, Homo sapiens
ctttaacatatctgaacacacaatagct

SEQ ID NO: 7566 - DNA, 35 bp, Homo sapiens
ctttaacatatctgaacacacaatagctaagaccc

SEQ ID NO: 7567 - DNA, 27 bp, Homo sapiens
tttaacatatctgaacacacaatagct

SEQ ID NO: 7568 - DNA, 33 bp, Homo sapiens; identical to SEQ ID NO: 329

SEQ ID NO: 7569 - DNA, 34 bp, Homo sapiens
tttaacatatctgaacacacaatagctaagaccc

SEQ ID NO: 7570 - DNA, 26 bp, Homo sapiens
ttaacatatctgaacacacaatagct

SEQ ID NO: 7571 - DNA, 27 bp, Homo sapiens
ttaacatatctgaacacacaatagcta

SEQ ID NO: 7572 - DNA, 29 bp, Homo sapiens
ttaacatatctgaacacacaatagctaag

SEQ ID NO: 7573 - DNA, 32 bp, Homo sapiens; identical to SEQ ID NO: 331

SEQ ID NO: 7574 - DNA, 33 bp, Homo sapiens; identical to SEQ ID NO: 332

SEQ ID NO: 7575 - DNA, 34 bp, Homo sapiens
ttaacatatctgaacacacaatagctaagaccca

SEQ ID NO: 7576 - DNA, 38 bp, Homo sapiens
ttaacatatctgaacacacaatagctaagacccaaact

SEQ ID NO: 7577 - DNA, 25 bp, Homo sapiens
taacatatctgaacacacaatagct

SEQ ID NO: 7578 - DNA, 26 bp, Homo sapiens
taacatatctgaacacacaatagcta

SEQ ID NO: 7579 - DNA, 28 bp, Homo sapiens
taacatatctgaacacacaatagctaag

SEQ ID NO: 7580 - DNA, 31 bp, Homo sapiens; identical to SEQ ID NO: 334

SEQ ID NO: 7581 - DNA, 32 bp, Homo sapiens; identical to SEQ ID NO: 335

SEQ ID NO: 7582 - DNA, 33 bp, Homo sapiens; identical to SEQ ID NO: 336

SEQ ID NO: 7583 - DNA, 16 bp, Homo sapiens
aacatatctgaacaca

SEQ ID NO: 7584 - DNA, 18 bp, Homo sapiens
aacatatctgaacacaca

SEQ ID NO: 7585 - DNA, 21 bp, Homo sapiens
aacatatctgaacacacaata

SEQ ID NO: 7586 - DNA, 24 bp, Homo sapiens
aacatatctgaacacacaatagct

SEQ ID NO: 7587 - DNA, 25 bp, Homo sapiens
aacatatctgaacacacaatagcta

SEQ ID NO: 7588 - DNA, 27 bp, Homo sapiens
aacatatctgaacacacaatagctaag

SEQ ID NO: 7589 - DNA, 28 bp, Homo sapiens
aacatatctgaacacacaatagctaaga

SEQ ID NO: 7590 - DNA, 29 bp, Homo sapiens
aacatatctgaacacacaatagctaagac

SEQ ID NO: 7591 - DNA, 30 bp, Homo sapiens; identical to SEQ ID NO: 340

SEQ ID NO: 7592 - DNA, 31 bp, Homo sapiens; identical to SEQ ID NO: 341

SEQ ID NO: 7593 - DNA, 32 bp, Homo sapiens; identical to SEQ ID NO: 342

SEQ ID NO: 7594 - DNA, 36 bp, Homo sapiens
aacatatctgaacacacaatagctaagacccaaact

SEQ ID NO: 7595 - DNA, 20 bp, Homo sapiens
acatatctgaacacacaata

SEQ ID NO: 7596 - DNA, 23 bp, Homo sapiens
acatatctgaacacacaatagct

SEQ ID NO: 7597 - DNA, 24 bp, Homo sapiens
acatatctgaacacacaatagcta

SEQ ID NO: 7598 - DNA, 26 bp, Homo sapiens
acatatctgaacacacaatagctaag

SEQ ID NO: 7599 - DNA, 27 bp, Homo sapiens
acatatctgaacacacaatagctaaga

SEQ ID NO: 7600 - DNA, 29 bp, Homo sapiens
acatatctgaacacacaatagctaagacc

SEQ ID NO: 7601 - DNA, 30 bp, Homo sapiens; identical to SEQ ID NO: 347

SEQ ID NO: 7602 - DNA, 31 bp, Homo sapiens; identical to SEQ ID NO: 348

SEQ ID NO: 7603 - DNA, 32 bp, Homo sapiens
acatatctgaacacacaatagctaagacccaa

SEQ ID NO: 7604 - DNA, 35 bp, Homo sapiens
acatatctgaacacacaatagctaagacccaaact

SEQ ID NO: 7605 - DNA, 22 bp, Homo sapiens
catatctgaacacacaatagct

SEQ ID NO: 7606 - DNA, 25 bp, Homo sapiens
catatctgaacacacaatagctaag

SEQ ID NO: 7607 - DNA, 26 bp, Homo sapiens
catatctgaacacacaatagctaaga

SEQ ID NO: 7608 - DNA, 28 bp, Homo sapiens
catatctgaacacacaatagctaagacc

SEQ ID NO: 7609 - DNA, 29 bp, Homo sapiens
catatctgaacacacaatagctaagaccc

SEQ ID NO: 7610 - DNA, 30 bp, Homo sapiens; identical to SEQ ID NO: 352

SEQ ID NO: 7611 - DNA, 33 bp, Homo sapiens; identical to SEQ ID NO: 353

SEQ ID NO: 7612 - DNA, 34 bp, Homo sapiens
catatctgaacacacaatagctaagacccaaact

SEQ ID NO: 7613 - DNA, 21 bp, Homo sapiens
atatctgaacacacaatagct

SEQ ID NO: 7614 - DNA, 24 bp, Homo sapiens
atatctgaacacacaatagctaag

SEQ ID NO: 7615 - DNA, 25 bp, Homo sapiens
atatctgaacacacaatagctaaga

SEQ ID NO: 7616 - DNA, 27 bp, Homo sapiens
atatctgaacacacaatagctaagacc

SEQ ID NO: 7617 - DNA, 28 bp, Homo sapiens
atatctgaacacacaatagctaagaccc

SEQ ID NO: 7618 - DNA, 29 bp, Homo sapiens
atatctgaacacacaatagctaagaccca

SEQ ID NO: 7619 - DNA, 33 bp, Homo sapiens; identical to SEQ ID NO: 359

SEQ ID NO: 7620 - DNA, 20 bp, Homo sapiens
tatctgaacacacaatagct

SEQ ID NO: 7621 - DNA, 23 bp, Homo sapiens
tatctgaacacacaatagctaag

SEQ ID NO: 7622 - DNA, 24 bp, Homo sapiens
tatctgaacacacaatagctaaga

SEQ ID NO: 7623 - DNA, 26 bp, Homo sapiens
tatctgaacacacaatagctaagacc

SEQ ID NO: 7624 - DNA, 27 bp, Homo sapiens
tatctgaacacacaatagctaagaccc

SEQ ID NO: 7625 - DNA, 28 bp, Homo sapiens
tatctgaacacacaatagctaagaccca

SEQ ID NO: 7626 - DNA, 30 bp, Homo sapiens
tatctgaacacacaatagctaagacccaaa

SEQ ID NO: 7627 - DNA, 32 bp, Homo sapiens; identical to SEQ ID NO: 366

SEQ ID NO: 7628 - DNA, 38 bp, Homo sapiens
tatctgaacacacaatagctaagacccaaactgggatt

SEQ ID NO: 7629 - DNA, 42 bp, Homo sapiens
tatctgaacacacaatagctaagacccaaactgggattagat

SEQ ID NO: 7630 - DNA, 44 bp, Homo sapiens
tatctgaacacacaatagctaagacccaaactgggattagatac

SEQ ID NO: 7631 - DNA, 45 bp, Homo sapiens
tatctgaacacacaatagctaagacccaaactgggattagatacc

SEQ ID NO: 7632 - DNA, 19 bp, Homo sapiens
atctgaacacacaatagct

SEQ ID NO: 7633 - DNA, 22 bp, Homo sapiens
atctgaacacacaatagctaag

SEQ ID NO: 7634 - DNA, 23 bp, Homo sapiens
atctgaacacacaatagctaaga

SEQ ID NO: 7635 - DNA, 25 bp, Homo sapiens
atctgaacacacaatagctaagacc

SEQ ID NO: 7636 - DNA, 26 bp, Homo sapiens
atctgaacacacaatagctaagaccc

SEQ ID NO: 7637 - DNA, 27 bp, Homo sapiens
atctgaacacacaatagctaagaccca

SEQ ID NO: 7638 - DNA, 31 bp, Homo sapiens; identical to SEQ ID NO: 372

SEQ ID NO: 7639 - DNA, 44 bp, Homo sapiens
atctgaacacacaatagctaagacccaaactgggattagatacc

SEQ ID NO: 7640 - DNA, 18 bp, Homo sapiens
tctgaacacacaatagct

SEQ ID NO: 7641 - DNA, 21 bp, Homo sapiens
tctgaacacacaatagctaag

SEQ ID NO: 7642 - DNA, 24 bp, Homo sapiens
tctgaacacacaatagctaagacc

SEQ ID NO: 7643 - DNA, 25 bp, Homo sapiens
tctgaacacacaatagctaagaccc

SEQ ID NO: 7644 - DNA, 26 bp, Homo sapiens
tctgaacacacaatagctaagaccca

SEQ ID NO: 7645 - DNA, 30 bp, Homo sapiens; identical to SEQ ID NO: 376

SEQ ID NO: 7646 - DNA, 17 bp, Homo sapiens
ctgaacacacaatagct

SEQ ID NO: 7647 - DNA, 23 bp, Homo sapiens
ctgaacacacaatagctaagacc

SEQ ID NO: 7648 - DNA, 24 bp, Homo sapiens
ctgaacacacaatagctaagaccc

SEQ ID NO: 7649 - DNA, 25 bp, Homo sapiens
ctgaacacacaatagctaagaccca

SEQ ID NO: 7650 - DNA, 29 bp, Homo sapiens
ctgaacacacaatagctaagacccaaact

SEQ ID NO: 7651 - DNA, 22 bp, Homo sapiens
tgaacacacaatagctaagacc

SEQ ID NO: 7652 - DNA, 23 bp, Homo sapiens
tgaacacacaatagctaagaccc

SEQ ID NO: 7653 - DNA, 24 bp, Homo sapiens
tgaacacacaatagctaagaccca

SEQ ID NO: 7654 - DNA, 25 bp, Homo sapiens
tgaacacacaatagctaagacccaa

SEQ ID NO: 7655 - DNA, 28 bp, Homo sapiens
tgaacacacaatagctaagacccaaact

SEQ ID NO: 7656 - DNA, 21 bp, Homo sapiens
gaacacacaatagctaagacc

SEQ ID NO: 7657 - DNA, 22 bp, Homo sapiens
gaacacacaatagctaagaccc

SEQ ID NO: 7658 - DNA, 23 bp, Homo sapiens
gaacacacaatagctaagaccca

SEQ ID NO: 7659 - DNA, 27 bp, Homo sapiens
gaacacacaatagctaagacccaaact

SEQ ID NO: 7660 - DNA, 28 bp, Homo sapiens
gaacacacaatagctaagacccaaactg

SEQ ID NO: 7661 - DNA, 20 bp, Homo sapiens
aacacacaatagctaagacc

SEQ ID NO: 7662 - DNA, 21 bp, Homo sapiens
aacacacaatagctaagaccc

SEQ ID NO: 7663 - DNA, 18 bp, Homo sapiens
cacacaatagctaagacc

SEQ ID NO: 7664 - DNA, 19 bp, Homo sapiens
cacacaatagctaagaccc

SEQ ID NO: 7665 - DNA, 17 bp, Homo sapiens
acacaatagctaagacc

SEQ ID NO: 7666 - DNA, 18 bp, Homo sapiens
acacaatagctaagaccc

SEQ ID NO: 7667 - DNA, 16 bp, Homo sapiens
cacaatagctaagacc

SEQ ID NO: 7668 - DNA, 17 bp, Homo sapiens
cacaatagctaagaccc

SEQ ID NO: 7669 - DNA, 18 bp, Homo sapiens
cacaatagctaagaccca

SEQ ID NO: 7670 - DNA, 22 bp, Homo sapiens
cacaatagctaagacccaaact

SEQ ID NO: 7671 - DNA, 16 bp, Homo sapiens
acaatagctaagaccc

SEQ ID NO: 7672 - DNA, 16 bp, Homo sapiens
caatagctaagaccca

SEQ ID NO: 7673 - DNA, 20 bp, Homo sapiens
caatagctaagacccaaact

SEQ ID NO: 7674 - DNA, 22 bp, Homo sapiens
caatagctaagacccaaactgg

SEQ ID NO: 7675 - DNA, 19 bp, Homo sapiens
aatagctaagacccaaact

SEQ ID NO: 7676 - DNA, 18 bp, Homo sapiens
atagctaagacccaaact

SEQ ID NO: 7677 - DNA, 18 bp, Homo sapiens
caaactgggattagatac

SEQ ID NO: 7678 - DNA, 19 bp, Homo sapiens
caaactgggattagatacc

SEQ ID NO: 7679 - DNA, 17 bp, Homo sapiens
aaactgggattagatac

SEQ ID NO: 7680 - DNA, 18 bp, Homo sapiens
aaactgggattagatacc

SEQ ID NO: 7681 - DNA, 19 bp, Homo sapiens
aaactgggattagataccc

SEQ ID NO: 7682 - DNA, 33 bp, Homo sapiens
aaactgggattagataccccactatgcttagcc

SEQ ID NO: 7683 - DNA, 16 bp, Homo sapiens
aactgggattagatac

SEQ ID NO: 7684 - DNA, 17 bp, Homo sapiens
aactgggattagatacc

SEQ ID NO: 7685 - DNA, 18 bp, Homo sapiens
aactgggattagataccc

SEQ ID NO: 7686 - DNA, 32 bp, Homo sapiens
aactgggattagataccccactatgcttagcc

SEQ ID NO: 7687 - DNA, 33 bp, Homo sapiens
aactgggattagataccccactatgcttagccc

SEQ ID NO: 7688 - DNA, 16 bp, Homo sapiens
actgggattagatacc

SEQ ID NO: 7689 - DNA, 30 bp, Homo sapiens
gggattagataccccactatgcttagccct

SEQ ID NO: 7690 - DNA, 26 bp, Homo sapiens
gattagataccccactatgcttagcc

SEQ ID NO: 7691 - DNA, 27 bp, Homo sapiens
gattagataccccactatgcttagccc

SEQ ID NO: 7692 - DNA, 28 bp, Homo sapiens
gattagataccccactatgcttagccct

SEQ ID NO: 7693 - DNA, 33 bp, Homo sapiens
gattagataccccactatgcttagccctaaacc

SEQ ID NO: 7694 - DNA, 16 bp, Homo sapiens
ccactatgcttagccc

SEQ ID NO: 7695 - DNA, 17 bp, Homo sapiens
ccactatgcttagccct

SEQ ID NO: 7696 - DNA, 22 bp, Homo sapiens
ccactatgcttagccctaaacc

SEQ ID NO: 7697 - DNA, 23 bp, Homo sapiens
ccactatgcttagccctaaacct

SEQ ID NO: 7698 - DNA, 31 bp, Homo sapiens
ccactatgcttagccctaaacctcaacagtt

SEQ ID NO: 7699 - DNA, 16 bp, Homo sapiens
cactatgcttagccct

SEQ ID NO: 7700 - DNA, 21 bp, Homo sapiens
cactatgcttagccctaaacc

SEQ ID NO: 7701 - DNA, 22 bp, Homo sapiens
cactatgcttagccctaaacct

SEQ ID NO: 7702 - DNA, 30 bp, Homo sapiens
cactatgcttagccctaaacctcaacagtt

SEQ ID NO: 7703 - DNA, 20 bp, Homo sapiens
actatgcttagccctaaacc

SEQ ID NO: 7704 - DNA, 21 bp, Homo sapiens
actatgcttagccctaaacct

SEQ ID NO: 7705 - DNA, 29 bp, Homo sapiens
actatgcttagccctaaacctcaacagtt

SEQ ID NO: 7706 - DNA, 19 bp, Homo sapiens
ctatgcttagccctaaacc

SEQ ID NO: 7707 - DNA, 20 bp, Homo sapiens
ctatgcttagccctaaacct

SEQ ID NO: 7708 - DNA, 28 bp, Homo sapiens
ctatgcttagccctaaacctcaacagtt

SEQ ID NO: 7709 - DNA, 19 bp, Homo sapiens
tatgcttagccctaaacct

SEQ ID NO: 7710 - DNA, 17 bp, Homo sapiens
atgcttagccctaaacc

SEQ ID NO: 7711 - DNA, 18 bp, Homo sapiens
atgcttagccctaaacct

SEQ ID NO: 7712 - DNA, 26 bp, Homo sapiens
atgcttagccctaaacctcaacagtt

SEQ ID NO: 7713 - DNA, 30 bp, Homo sapiens
tagccctaaacctcaacagttaaatcaaca

SEQ ID NO: 7714 - DNA, 25 bp, Homo sapiens
agttaaatcaacaaaactgctcgcc

SEQ ID NO: 7715 - DNA, 33 bp, Homo sapiens
agttaaatcaacaaaactgctcgccagaacact

SEQ ID NO: 7716 - DNA, 20 bp, Homo sapiens
gttaaatcaacaaaactgct

SEQ ID NO: 7717 - DNA, 24 bp, Homo sapiens
gttaaatcaacaaaactgctcgcc

SEQ ID NO: 7718 - DNA, 32 bp, Homo sapiens; identical to SEQ ID NO: 400

SEQ ID NO: 7719 - DNA, 23 bp, Homo sapiens
ttaaatcaacaaaactgctcgcc

SEQ ID NO: 7720 - DNA, 31 bp, Homo sapiens
ttaaatcaacaaaactgctcgccagaacact

SEQ ID NO: 7721 - DNA, 30 bp, Homo sapiens
taaatcaacaaaactgctcgccagaacact

SEQ ID NO: 7722 - DNA, 21 bp, Homo sapiens
aaatcaacaaaactgctcgcc

SEQ ID NO: 7723 - DNA, 29 bp, Homo sapiens
aaatcaacaaaactgctcgccagaacact

SEQ ID NO: 7724 - DNA, 20 bp, Homo sapiens
aatcaacaaaactgctcgcc

SEQ ID NO: 7725 - DNA, 21 bp, Homo sapiens
aatcaacaaaactgctcgcca

SEQ ID NO: 7726 - DNA, 28 bp, Homo sapiens
aatcaacaaaactgctcgccagaacact

SEQ ID NO: 7727 - DNA, 19 bp, Homo sapiens
atcaacaaaactgctcgcc

SEQ ID NO: 7728 - DNA, 27 bp, Homo sapiens
atcaacaaaactgctcgccagaacact

SEQ ID NO: 7729 - DNA, 26 bp, Homo sapiens
tcaacaaaactgctcgccagaacact

SEQ ID NO: 7730 - DNA, 17 bp, Homo sapiens
caacaaaactgctcgcc

SEQ ID NO: 7731 - DNA, 25 bp, Homo sapiens
caacaaaactgctcgccagaacact

SEQ ID NO: 7732 - DNA, 16 bp, Homo sapiens
aacaaaactgctcgcc

SEQ ID NO: 7733 - DNA, 17 bp, Homo sapiens
aacaaaactgctcgcca

SEQ ID NO: 7734 - DNA, 24 bp, Homo sapiens
aacaaaactgctcgccagaacact

SEQ ID NO: 7735 - DNA, 16 bp, Homo sapiens
acaaaactgctcgcca

SEQ ID NO: 7736 - DNA, 23 bp, Homo sapiens
acaaaactgctcgccagaacact

SEQ ID NO: 7737 - DNA, 22 bp, Homo sapiens
caaaactgctcgccagaacact

SEQ ID NO: 7738 - DNA, 21 bp, Homo sapiens
aaaactgctcgccagaacact

SEQ ID NO: 7739 - DNA, 17 bp, Homo sapiens
aaactgctcgccagaac

SEQ ID NO: 7740 - DNA, 18 bp, Homo sapiens
aaactgctcgccagaaca

SEQ ID NO: 7741 - DNA, 20 bp, Homo sapiens
aaactgctcgccagaacact

SEQ ID NO: 7742 - DNA, 33 bp, Homo sapiens; identical to SEQ ID NO: 411

SEQ ID NO: 7743 - DNA, 41 bp, Homo sapiens
aaactgctcgccagaacactacgagccacagcttaaaactc

SEQ ID NO: 7744 - DNA, 16 bp, Homo sapiens
aactgctcgccagaac

SEQ ID NO: 7745 - DNA, 19 bp, Homo sapiens
aactgctcgccagaacact

SEQ ID NO: 7746 - DNA, 32 bp, Homo sapiens
aactgctcgccagaacactacgagccacagct

SEQ ID NO: 7747 - DNA, 18 bp, Homo sapiens
actgctcgccagaacact

SEQ ID NO: 7748 - DNA, 17 bp, Homo sapiens
ctgctcgccagaacact

SEQ ID NO: 7749 - DNA, 30 bp, Homo sapiens
ctgctcgccagaacactacgagccacagct

SEQ ID NO: 7750 - DNA, 16 bp, Homo sapiens
tgctcgccagaacact

SEQ ID NO: 7751 - DNA, 21 bp, Homo sapiens
ctcgccagaacactacgagcc

SEQ ID NO: 7752 - DNA, 19 bp, Homo sapiens
cgccagaacactacgagcc

SEQ ID NO: 7753 - DNA, 22 bp, Homo sapiens
cgccagaacactacgagccaca

SEQ ID NO: 7754 - DNA, 23 bp, Homo sapiens
cgccagaacactacgagccacag

SEQ ID NO: 7755 - DNA, 24 bp, Homo sapiens
cgccagaacactacgagccacagc

SEQ ID NO: 7756 - DNA, 25 bp, Homo sapiens
cgccagaacactacgagccacagct

SEQ ID NO: 7757 - DNA, 27 bp, Homo sapiens
cgccagaacactacgagccacagctta

SEQ ID NO: 7758 - DNA, 29 bp, Homo sapiens
cgccagaacactacgagccacagcttaaa

SEQ ID NO: 7759 - DNA, 32 bp, Homo sapiens
cgccagaacactacgagccacagcttaaaact

SEQ ID NO: 7760 - DNA, 33 bp, Homo sapiens
cgccagaacactacgagccacagcttaaaactc

SEQ ID NO: 7761 - DNA, 17 bp, Homo sapiens
ccagaacactacgagcc

SEQ ID NO: 7762 - DNA, 20 bp, Homo sapiens
ccagaacactacgagccaca

SEQ ID NO: 7763 - DNA, 22 bp, Homo sapiens
ccagaacactacgagccacagc

SEQ ID NO: 7764 - DNA, 23 bp, Homo sapiens
ccagaacactacgagccacagct

SEQ ID NO: 7765 - DNA, 25 bp, Homo sapiens
ccagaacactacgagccacagctta

SEQ ID NO: 7766 - DNA, 30 bp, Homo sapiens; identical to SEQ ID NO: 417

SEQ ID NO: 7767 - DNA, 31 bp, Homo sapiens
ccagaacactacgagccacagcttaaaactc

SEQ ID NO: 7768 - DNA, 16 bp, Homo sapiens
cagaacactacgagcc

SEQ ID NO: 7769 - DNA, 19 bp, Homo sapiens
cagaacactacgagccaca

SEQ ID NO: 7770 - DNA, 22 bp, Homo sapiens
cagaacactacgagccacagct

SEQ ID NO: 7771 - DNA, 24 bp, Homo sapiens
cagaacactacgagccacagctta

SEQ ID NO: 7772 - DNA, 27 bp, Homo sapiens
cagaacactacgagccacagcttaaaa

SEQ ID NO: 7773 - DNA, 29 bp, Homo sapiens
cagaacactacgagccacagcttaaaact

SEQ ID NO: 7774 - DNA, 30 bp, Homo sapiens
cagaacactacgagccacagcttaaaactc

SEQ ID NO: 7775 - DNA, 18 bp, Homo sapiens
agaacactacgagccaca

SEQ ID NO: 7776 - DNA, 21 bp, Homo sapiens
agaacactacgagccacagct

SEQ ID NO: 7777 - DNA, 23 bp, Homo sapiens
agaacactacgagccacagctta

SEQ ID NO: 7778 - DNA, 28 bp, Homo sapiens
agaacactacgagccacagcttaaaact

SEQ ID NO: 7779 - DNA, 29 bp, Homo sapiens
agaacactacgagccacagcttaaaactc

SEQ ID NO: 7780 - DNA, 17 bp, Homo sapiens
gaacactacgagccaca

SEQ ID NO: 7781 - DNA, 20 bp, Homo sapiens
gaacactacgagccacagct

SEQ ID NO: 7782 - DNA, 28 bp, Homo sapiens
gaacactacgagccacagcttaaaactc

SEQ ID NO: 7783 - DNA, 27 bp, Homo sapiens
aacactacgagccacagcttaaaactc

SEQ ID NO: 7784 - DNA, 25 bp, Homo sapiens
cactacgagccacagcttaaaactc

SEQ ID NO: 7785 - DNA, 33 bp, Homo sapiens
cactacgagccacagcttaaaactcaaaggacc

SEQ ID NO: 7786 - DNA, 24 bp, Homo sapiens
actacgagccacagcttaaaactc

SEQ ID NO: 7787 - DNA, 33 bp, Homo sapiens
actacgagccacagcttaaaactcaaaggacct

SEQ ID NO: 7788 - DNA, 22 bp, Homo sapiens
ctacgagccacagcttaaaact

SEQ ID NO: 7789 - DNA, 23 bp, Homo sapiens
ctacgagccacagcttaaaactc

SEQ ID NO: 7790 - DNA, 31 bp, Homo sapiens; identical to SEQ ID NO: 428

SEQ ID NO: 7791 - DNA, 32 bp, Homo sapiens; identical to SEQ ID NO: 429

SEQ ID NO: 7792 - DNA, 22 bp, Homo sapiens
tacgagccacagcttaaaactc

SEQ ID NO: 7793 - DNA, 30 bp, Homo sapiens; identical to SEQ ID NO: 431

SEQ ID NO: 7794 - DNA, 31 bp, Homo sapiens; identical to SEQ ID NO: 432

SEQ ID NO: 7795 - DNA, 21 bp, Homo sapiens
acgagccacagcttaaaactc

SEQ ID NO: 7796 - DNA, 29 bp, Homo sapiens
acgagccacagcttaaaactcaaaggacc

SEQ ID NO: 7797 - DNA, 30 bp, Homo sapiens; identical to SEQ ID NO: 435

SEQ ID NO: 7798 - DNA, 33 bp, Homo sapiens
acgagccacagcttaaaactcaaaggacctggc

SEQ ID NO: 7799 - DNA, 20 bp, Homo sapiens
cgagccacagcttaaaactc

SEQ ID NO: 7800 - DNA, 28 bp, Homo sapiens
cgagccacagcttaaaactcaaaggacc

SEQ ID NO: 7801 - DNA, 29 bp, Homo sapiens
cgagccacagcttaaaactcaaaggacct

SEQ ID NO: 7802 - DNA, 19 bp, Homo sapiens
gagccacagcttaaaactc

SEQ ID NO: 7803 - DNA, 18 bp, Homo sapiens
agccacagcttaaaactc

SEQ ID NO: 7804 - DNA, 23 bp, Homo sapiens
agccacagcttaaaactcaaagg

SEQ ID NO: 7805 - DNA, 26 bp, Homo sapiens
agccacagcttaaaactcaaaggacc

SEQ ID NO: 7806 - DNA, 27 bp, Homo sapiens
agccacagcttaaaactcaaaggacct

SEQ ID NO: 7807 - DNA, 17 bp, Homo sapiens
gccacagcttaaaactc

SEQ ID NO: 7808 - DNA, 16 bp, Homo sapiens
ccacagcttaaaactc

SEQ ID NO: 7809 - DNA, 33 bp, Homo sapiens
cacagcttaaaactcaaaggacctggcggtgct

SEQ ID NO: 7810 - DNA, 22 bp, Homo sapiens
acagcttaaaactcaaaggacc

SEQ ID NO: 7811 - DNA, 23 bp, Homo sapiens
acagcttaaaactcaaaggacct

SEQ ID NO: 7812 - DNA, 26 bp, Homo sapiens
acagcttaaaactcaaaggacctggc

SEQ ID NO: 7813 - DNA, 31 bp, Homo sapiens
acagcttaaaactcaaaggacctggcggtgc

SEQ ID NO: 7814 - DNA, 32 bp, Homo sapiens
acagcttaaaactcaaaggacctggcggtgct

SEQ ID NO: 7815 - DNA, 21 bp, Homo sapiens
cagcttaaaactcaaaggacc

SEQ ID NO: 7816 - DNA, 22 bp, Homo sapiens
cagcttaaaactcaaaggacct

SEQ ID NO: 7817 - DNA, 19 bp, Homo sapiens
gcttaaaactcaaaggacc

SEQ ID NO: 7818 - DNA, 20 bp, Homo sapiens
gcttaaaactcaaaggacct

SEQ ID NO: 7819 - DNA, 29 bp, Homo sapiens
gcttaaaactcaaaggacctggcggtgct

SEQ ID NO: 7820 - DNA, 30 bp, Homo sapiens
gcttaaaactcaaaggacctggcggtgctt

SEQ ID NO: 7821 - DNA, 18 bp, Homo sapiens
cttaaaactcaaaggacc

SEQ ID NO: 7822 - DNA, 19 bp, Homo sapiens
cttaaaactcaaaggacct

SEQ ID NO: 7823 - DNA, 29 bp, Homo sapiens
cttaaaactcaaaggacctggcggtgctt

SEQ ID NO: 7824 - DNA, 18 bp, Homo sapiens
ttaaaactcaaaggacct

SEQ ID NO: 7825 - DNA, 28 bp, Homo sapiens
ttaaaactcaaaggacctggcggtgctt

SEQ ID NO: 7826 - DNA, 16 bp, Homo sapiens
taaaactcaaaggacc

SEQ ID NO: 7827 - DNA, 17 bp, Homo sapiens
taaaactcaaaggacct

SEQ ID NO: 7828 - DNA, 19 bp, Homo sapiens
taaaactcaaaggacctgg

SEQ ID NO: 7829 - DNA, 20 bp, Homo sapiens
taaaactcaaaggacctggc

SEQ ID NO: 7830 - DNA, 21 bp, Homo sapiens
taaaactcaaaggacctggcg

SEQ ID NO: 7831 - DNA, 25 bp, Homo sapiens
taaaactcaaaggacctggcggtgc

SEQ ID NO: 7832 - DNA, 26 bp, Homo sapiens
taaaactcaaaggacctggcggtgct

SEQ ID NO: 7833 - DNA, 27 bp, Homo sapiens
taaaactcaaaggacctggcggtgctt

SEQ ID NO: 7834 - DNA, 29 bp, Homo sapiens
taaaactcaaaggacctggcggtgcttca

SEQ ID NO: 7835 - DNA, 33 bp, Homo sapiens
taaaactcaaaggacctggcggtgcttcatatc

SEQ ID NO: 7836 - DNA, 34 bp, Homo sapiens
taaaactcaaaggacctggcggtgcttcatatcc

SEQ ID NO: 7837 - DNA, 35 bp, Homo sapiens
taaaactcaaaggacctggcggtgcttcatatccc

SEQ ID NO: 7838 - DNA, 36 bp, Homo sapiens
taaaactcaaaggacctggcggtgcttcatatccct

SEQ ID NO: 7839 - DNA, 38 bp, Homo sapiens
taaaactcaaaggacctggcggtgcttcatatccctct

SEQ ID NO: 7840 - DNA, 39 bp, Homo sapiens
taaaactcaaaggacctggcggtgcttcatatccctcta

SEQ ID NO: 7841 - DNA, 40 bp, Homo sapiens
taaaactcaaaggacctggcggtgcttcatatccctctag

SEQ ID NO: 7842 - DNA, 47 bp, Homo sapiens
taaaactcaaaggacctggcggtgcttcatatccctctagaggagcc

SEQ ID NO: 7843 - DNA, 16 bp, Homo sapiens
aaaactcaaaggacct

SEQ ID NO: 7844 - DNA, 25 bp, Homo sapiens
aaaactcaaaggacctggcggtgct

SEQ ID NO: 7845 - DNA, 26 bp, Homo sapiens
aaaactcaaaggacctggcggtgctt

SEQ ID NO: 7846 - DNA, 33 bp, Homo sapiens
aaaactcaaaggacctggcggtgcttcatatcc

SEQ ID NO: 7847 - DNA, 24 bp, Homo sapiens
aaactcaaaggacctggcggtgct

SEQ ID NO: 7848 - DNA, 25 bp, Homo sapiens
aaactcaaaggacctggcggtgctt

SEQ ID NO: 7849 - DNA, 32 bp, Homo sapiens
aaactcaaaggacctggcggtgcttcatatcc

SEQ ID NO: 7850 - DNA, 33 bp, Homo sapiens
aaactcaaaggacctggcggtgcttcatatccc

SEQ ID NO: 7851 - DNA, 23 bp, Homo sapiens
aactcaaaggacctggcggtgct

SEQ ID NO: 7852 - DNA, 24 bp, Homo sapiens
aactcaaaggacctggcggtgctt

SEQ ID NO: 7853 - DNA, 31 bp, Homo sapiens
aactcaaaggacctggcggtgcttcatatcc

SEQ ID NO: 7854 - DNA, 32 bp, Homo sapiens
aactcaaaggacctggcggtgcttcatatccc

SEQ ID NO: 7855 - DNA, 33 bp, Homo sapiens
aactcaaaggacctggcggtgcttcatatccct

SEQ ID NO: 7856 - DNA, 16 bp, Homo sapiens
actcaaaggacctggc

SEQ ID NO: 7857 - DNA, 18 bp, Homo sapiens
actcaaaggacctggcgg

SEQ ID NO: 7858 - DNA, 21 bp, Homo sapiens
actcaaaggacctggcggtgc

SEQ ID NO: 7859 - DNA, 22 bp, Homo sapiens
actcaaaggacctggcggtgct

SEQ ID NO: 7860 - DNA, 23 bp, Homo sapiens
actcaaaggacctggcggtgctt

SEQ ID NO: 7861 - DNA, 30 bp, Homo sapiens
actcaaaggacctggcggtgcttcatatcc

SEQ ID NO: 7862 - DNA, 31 bp, Homo sapiens
actcaaaggacctggcggtgcttcatatccc

SEQ ID NO: 7863 - DNA, 32 bp, Homo sapiens; identical to SEQ ID NO: 453

SEQ ID NO: 7864 - DNA, 16 bp, Homo sapiens
ctcaaaggacctggcg

SEQ ID NO: 7865 - DNA, 17 bp, Homo sapiens
ctcaaaggacctggcgg

SEQ ID NO: 7866 - DNA, 20 bp, Homo sapiens
ctcaaaggacctggcggtgc

SEQ ID NO: 7867 - DNA, 21 bp, Homo sapiens
ctcaaaggacctggcggtgct

SEQ ID NO: 7868 - DNA, 22 bp, Homo sapiens
ctcaaaggacctggcggtgctt

SEQ ID NO: 7869 - DNA, 30 bp, Homo sapiens
ctcaaaggacctggcggtgcttcatatccc

SEQ ID NO: 7870 - DNA, 31 bp, Homo sapiens
ctcaaaggacctggcggtgcttcatatccct

SEQ ID NO: 7871 - DNA, 33 bp, Homo sapiens
ctcaaaggacctggcggtgcttcatatccctct

SEQ ID NO: 7872 - DNA, 20 bp, Homo sapiens
tcaaaggacctggcggtgct

SEQ ID NO: 7873 - DNA, 21 bp, Homo sapiens
tcaaaggacctggcggtgctt

SEQ ID NO: 7874 - DNA, 29 bp, Homo sapiens
tcaaaggacctggcggtgcttcatatccc

SEQ ID NO: 7875 - DNA, 30 bp, Homo sapiens
tcaaaggacctggcggtgcttcatatccct

SEQ ID NO: 7876 - DNA, 33 bp, Homo sapiens
tcaaaggacctggcggtgcttcatatccctcta

SEQ ID NO: 7877 - DNA, 18 bp, Homo sapiens
caaaggacctggcggtgc

SEQ ID NO: 7878 - DNA, 19 bp, Homo sapiens
caaaggacctggcggtgct

SEQ ID NO: 7879 - DNA, 20 bp, Homo sapiens
caaaggacctggcggtgctt

SEQ ID NO: 7880 - DNA, 27 bp, Homo sapiens
caaaggacctggcggtgcttcatatcc

SEQ ID NO: 7881 - DNA, 28 bp, Homo sapiens
caaaggacctggcggtgcttcatatccc

SEQ ID NO: 7882 - DNA, 29 bp, Homo sapiens
caaaggacctggcggtgcttcatatccct

SEQ ID NO: 7883 - DNA, 31 bp, Homo sapiens
caaaggacctggcggtgcttcatatccctct

SEQ ID NO: 7884 - DNA, 32 bp, Homo sapiens; identical to SEQ ID NO: 460

SEQ ID NO: 7885 - DNA, 33 bp, Homo sapiens; identical to SEQ ID NO: 461

SEQ ID NO: 7886 - DNA, 40 bp, Homo sapiens
caaaggacctggcggtgcttcatatccctctagaggagcc

SEQ ID NO: 7887 - DNA, 41 bp, Homo sapiens
caaaggacctggcggtgcttcatatccctctagaggagcct

SEQ ID NO: 7888 - DNA, 17 bp, Homo sapiens
aaaggacctggcggtgc

SEQ ID NO: 7889 - DNA, 18 bp, Homo sapiens
aaaggacctggcggtgct

SEQ ID NO: 7890 - DNA, 19 bp, Homo sapiens
aaaggacctggcggtgctt

SEQ ID NO: 7891 - DNA, 26 bp, Homo sapiens
aaaggacctggcggtgcttcatatcc

SEQ ID NO: 7892 - DNA, 27 bp, Homo sapiens
aaaggacctggcggtgcttcatatccc

SEQ ID NO: 7893 - DNA, 28 bp, Homo sapiens
aaaggacctggcggtgcttcatatccct

SEQ ID NO: 7894 - DNA, 30 bp, Homo sapiens
aaaggacctggcggtgcttcatatccctct

SEQ ID NO: 7895 - DNA, 31 bp, Homo sapiens
aaaggacctggcggtgcttcatatccctcta

SEQ ID NO: 7896 - DNA, 32 bp, Homo sapiens; identical to SEQ ID NO: 465

SEQ ID NO: 7897 - DNA, 39 bp, Homo sapiens
aaaggacctggcggtgcttcatatccctctagaggagcc

SEQ ID NO: 7898 - DNA, 40 bp, Homo sapiens
aaaggacctggcggtgcttcatatccctctagaggagcct

SEQ ID NO: 7899 - DNA, 16 bp, Homo sapiens
aaggacctggcggtgc

SEQ ID NO: 7900 - DNA, 17 bp, Homo sapiens
aaggacctggcggtgct

SEQ ID NO: 7901 - DNA, 18 bp, Homo sapiens
aaggacctggcggtgctt

SEQ ID NO: 7902 - DNA, 19 bp, Homo sapiens
aaggacctggcggtgcttc

SEQ ID NO: 7903 - DNA, 24 bp, Homo sapiens
aaggacctggcggtgcttcatatc

SEQ ID NO: 7904 - DNA, 25 bp, Homo sapiens
aaggacctggcggtgcttcatatcc

SEQ ID NO: 7905 - DNA, 26 bp, Homo sapiens
aaggacctggcggtgcttcatatccc

SEQ ID NO: 7906 - DNA, 27 bp, Homo sapiens
aaggacctggcggtgcttcatatccct

SEQ ID NO: 7907 - DNA, 29 bp, Homo sapiens
aaggacctggcggtgcttcatatccctct

SEQ ID NO: 7908 - DNA, 30 bp, Homo sapiens
aaggacctggcggtgcttcatatccctcta

SEQ ID NO: 7909 - DNA, 31 bp, Homo sapiens; identical to SEQ ID NO: 471

SEQ ID NO: 7910 - DNA, 38 bp, Homo sapiens
aaggacctggcggtgcttcatatccctctagaggagcc

SEQ ID NO: 7911 - DNA, 39 bp, Homo sapiens
aaggacctggcggtgcttcatatccctctagaggagcct

SEQ ID NO: 7912 - DNA, 25 bp, Homo sapiens
aggacctggcggtgcttcatatccc

SEQ ID NO: 7913 - DNA, 26 bp, Homo sapiens
aggacctggcggtgcttcatatccct

SEQ ID NO: 7914 - DNA, 29 bp, Homo sapiens
aggacctggcggtgcttcatatccctcta

SEQ ID NO: 7915 - DNA, 32 bp, Homo sapiens
ctggcggtgcttcatatccctctagaggagcc

SEQ ID NO: 7916 - DNA, 33 bp, Homo sapiens
ctggcggtgcttcatatccctctagaggagcct

SEQ ID NO: 7917 - DNA, 30 bp, Homo sapiens
tcatatccctctagaggagcctgttctgta

SEQ ID NO: 7918 - DNA, 33 bp, Homo sapiens
tcatatccctctagaggagcctgttctgtaatc

SEQ ID NO: 7919 - DNA, 32 bp, Homo sapiens
catatccctctagaggagcctgttctgtaatc

SEQ ID NO: 7920 - DNA, 28 bp, Homo sapiens
atatccctctagaggagcctgttctgta

SEQ ID NO: 7921 - DNA, 31 bp, Homo sapiens
atatccctctagaggagcctgttctgtaatc

SEQ ID NO: 7922 - DNA, 40 bp, Homo sapiens
atatccctctagaggagcctgttctgtaatcgataaaccc

SEQ ID NO: 7923 - DNA, 27 bp, Homo sapiens
tatccctctagaggagcctgttctgta

SEQ ID NO: 7924 - DNA, 30 bp, Homo sapiens; identical to SEQ ID NO: 472

SEQ ID NO: 7925 - DNA, 31 bp, Homo sapiens
tatccctctagaggagcctgttctgtaatcg

SEQ ID NO: 7926 - DNA, 38 bp, Homo sapiens
tatccctctagaggagcctgttctgtaatcgataaacc

SEQ ID NO: 7927 - DNA, 39 bp, Homo sapiens
tatccctctagaggagcctgttctgtaatcgataaaccc

SEQ ID NO: 7928 - DNA, 40 bp, Homo sapiens
tatccctctagaggagcctgttctgtaatcgataaacccc

SEQ ID NO: 7929 - DNA, 29 bp, Homo sapiens
atccctctagaggagcctgttctgtaatc

SEQ ID NO: 7930 - DNA, 24 bp, Homo sapiens
ccctctagaggagcctgttctgta

SEQ ID NO: 7931 - DNA, 26 bp, Homo sapiens
ccctctagaggagcctgttctgtaat

SEQ ID NO: 7932 - DNA, 27 bp, Homo sapiens
ccctctagaggagcctgttctgtaatc

SEQ ID NO: 7933 - DNA, 28 bp, Homo sapiens
ccctctagaggagcctgttctgtaatcg

SEQ ID NO: 7934 - DNA, 29 bp, Homo sapiens
ccctctagaggagcctgttctgtaatcga

SEQ ID NO: 7935 - DNA, 30 bp, Homo sapiens
ccctctagaggagcctgttctgtaatcgat

SEQ ID NO: 7936 - DNA, 31 bp, Homo sapiens
ccctctagaggagcctgttctgtaatcgata

SEQ ID NO: 7937 - DNA, 35 bp, Homo sapiens
ccctctagaggagcctgttctgtaatcgataaacc

SEQ ID NO: 7938 - DNA, 36 bp, Homo sapiens
ccctctagaggagcctgttctgtaatcgataaaccc

SEQ ID NO: 7939 - DNA, 37 bp, Homo sapiens
ccctctagaggagcctgttctgtaatcgataaacccc

SEQ ID NO: 7940 - DNA, 19 bp, Homo sapiens
cctctagaggagcctgttc

SEQ ID NO: 7941 - DNA, 21 bp, Homo sapiens
cctctagaggagcctgttctg

SEQ ID NO: 7942 - DNA, 22 bp, Homo sapiens
cctctagaggagcctgttctgt

SEQ ID NO: 7943 - DNA, 23 bp, Homo sapiens
cctctagaggagcctgttctgta

SEQ ID NO: 7944 - DNA, 24 bp, Homo sapiens
cctctagaggagcctgttctgtaa

SEQ ID NO: 7945 - DNA, 25 bp, Homo sapiens
cctctagaggagcctgttctgtaat

SEQ ID NO: 7946 - DNA, 26 bp, Homo sapiens
cctctagaggagcctgttctgtaatc

SEQ ID NO: 7947 - DNA, 27 bp, Homo sapiens
cctctagaggagcctgttctgtaatcg

SEQ ID NO: 7948 - DNA, 28 bp, Homo sapiens
cctctagaggagcctgttctgtaatcga

SEQ ID NO: 7949 - DNA, 29 bp, Homo sapiens
cctctagaggagcctgttctgtaatcgat

SEQ ID NO: 7950 - DNA, 30 bp, Homo sapiens; identical to SEQ ID NO: 477

SEQ ID NO: 7951 - DNA, 31 bp, Homo sapiens
cctctagaggagcctgttctgtaatcgataa

SEQ ID NO: 7952 - DNA, 34 bp, Homo sapiens
cctctagaggagcctgttctgtaatcgataaacc

SEQ ID NO: 7953 - DNA, 35 bp, Homo sapiens
cctctagaggagcctgttctgtaatcgataaaccc

SEQ ID NO: 7954 - DNA, 36 bp, Homo sapiens
cctctagaggagcctgttctgtaatcgataaacccc

SEQ ID NO: 7955 - DNA, 37 bp, Homo sapiens
cctctagaggagcctgttctgtaatcgataaaccccg

SEQ ID NO: 7956 - DNA, 40 bp, Homo sapiens
cctctagaggagcctgttctgtaatcgataaaccccgatc

SEQ ID NO: 7957 - DNA, 18 bp, Homo sapiens
ctctagaggagcctgttc

SEQ ID NO: 7958 - DNA, 19 bp, Homo sapiens
ctctagaggagcctgttct

SEQ ID NO: 7959 - DNA, 21 bp, Homo sapiens
ctctagaggagcctgttctgt

SEQ ID NO: 7960 - DNA, 22 bp, Homo sapiens
ctctagaggagcctgttctgta

SEQ ID NO: 7961 - DNA, 23 bp, Homo sapiens
ctctagaggagcctgttctgtaa

SEQ ID NO: 7962 - DNA, 24 bp, Homo sapiens
ctctagaggagcctgttctgtaat

SEQ ID NO: 7963 - DNA, 25 bp, Homo sapiens
ctctagaggagcctgttctgtaatc

SEQ ID NO: 7964 - DNA, 26 bp, Homo sapiens
ctctagaggagcctgttctgtaatcg

SEQ ID NO: 7965 - DNA, 27 bp, Homo sapiens
ctctagaggagcctgttctgtaatcga

SEQ ID NO: 7966 - DNA, 28 bp, Homo sapiens
ctctagaggagcctgttctgtaatcgat

SEQ ID NO: 7967 - DNA, 29 bp, Homo sapiens
ctctagaggagcctgttctgtaatcgata

SEQ ID NO: 7968 - DNA, 30 bp, Homo sapiens; identical to SEQ ID NO: 484

SEQ ID NO: 7969 - DNA, 32 bp, Homo sapiens
ctctagaggagcctgttctgtaatcgataaac

SEQ ID NO: 7970 - DNA, 33 bp, Homo sapiens; identical to SEQ ID NO: 485

SEQ ID NO: 7971 - DNA, 34 bp, Homo sapiens
ctctagaggagcctgttctgtaatcgataaaccc

SEQ ID NO: 7972 - DNA, 35 bp, Homo sapiens
ctctagaggagcctgttctgtaatcgataaacccc

SEQ ID NO: 7973 - DNA, 36 bp, Homo sapiens
ctctagaggagcctgttctgtaatcgataaaccccg

SEQ ID NO: 7974 - DNA, 39 bp, Homo sapiens
ctctagaggagcctgttctgtaatcgataaaccccgatc

SEQ ID NO: 7975 - DNA, 40 bp, Homo sapiens
ctctagaggagcctgttctgtaatcgataaaccccgatca

SEQ ID NO: 7976 - DNA, 43 bp, Homo sapiens
ctctagaggagcctgttctgtaatcgataaaccccgatcaacc

SEQ ID NO: 7977 - DNA, 16 bp, Homo sapiens
tctagaggagcctgtt

SEQ ID NO: 7978 - DNA, 17 bp, Homo sapiens
tctagaggagcctgttc

SEQ ID NO: 7979 - DNA, 18 bp, Homo sapiens
tctagaggagcctgttct

SEQ ID NO: 7980 - DNA, 19 bp, Homo sapiens
tctagaggagcctgttctg

SEQ ID NO: 7981 - DNA, 20 bp, Homo sapiens
tctagaggagcctgttctgt

SEQ ID NO: 7982 - DNA, 21 bp, Homo sapiens
tctagaggagcctgttctgta

SEQ ID NO: 7983 - DNA, 22 bp, Homo sapiens
tctagaggagcctgttctgtaa

SEQ ID NO: 7984 - DNA, 23 bp, Homo sapiens
tctagaggagcctgttctgtaat

SEQ ID NO: 7985 - DNA, 24 bp, Homo sapiens
tctagaggagcctgttctgtaatc

SEQ ID NO: 7986 - DNA, 25 bp, Homo sapiens
tctagaggagcctgttctgtaatcg

SEQ ID NO: 7987 - DNA, 26 bp, Homo sapiens
tctagaggagcctgttctgtaatcga

SEQ ID NO: 7988 - DNA, 27 bp, Homo sapiens
tctagaggagcctgttctgtaatcgat

SEQ ID NO: 7989 - DNA, 28 bp, Homo sapiens
tctagaggagcctgttctgtaatcgata

SEQ ID NO: 7990 - DNA, 29 bp, Homo sapiens
tctagaggagcctgttctgtaatcgataa

SEQ ID NO: 7991 - DNA, 30 bp, Homo sapiens
tctagaggagcctgttctgtaatcgataaa

SEQ ID NO: 7992 - DNA, 31 bp, Homo sapiens
tctagaggagcctgttctgtaatcgataaac

SEQ ID NO: 7993 - DNA, 32 bp, Homo sapiens; identical to SEQ ID NO: 495

SEQ ID NO: 7994 - DNA, 33 bp, Homo sapiens; identical to SEQ ID NO: 496

SEQ ID NO: 7995 - DNA, 34 bp, Homo sapiens
tctagaggagcctgttctgtaatcgataaacccc

SEQ ID NO: 7996 - DNA, 35 bp, Homo sapiens
tctagaggagcctgttctgtaatcgataaaccccg

SEQ ID NO: 7997 - DNA, 38 bp, Homo sapiens
tctagaggagcctgttctgtaatcgataaaccccgatc

SEQ ID NO: 7998 - DNA, 39 bp, Homo sapiens
tctagaggagcctgttctgtaatcgataaaccccgatca

SEQ ID NO: 7999 - DNA, 42 bp, Homo sapiens
tctagaggagcctgttctgtaatcgataaaccccgatcaacc

SEQ ID NO: 8000 - DNA, 16 bp, Homo sapiens
ctagaggagcctgttc

SEQ ID NO: 8001 - DNA, 17 bp, Homo sapiens
ctagaggagcctgttct

SEQ ID NO: 8002 - DNA, 20 bp, Homo sapiens
ctagaggagcctgttctgta

SEQ ID NO: 8003 - DNA, 21 bp, Homo sapiens
ctagaggagcctgttctgtaa

SEQ ID NO: 8004 - DNA, 22 bp, Homo sapiens
ctagaggagcctgttctgtaat

SEQ ID NO: 8005 - DNA, 23 bp, Homo sapiens
ctagaggagcctgttctgtaatc

SEQ ID NO: 8006 - DNA, 24 bp, Homo sapiens
ctagaggagcctgttctgtaatcg

SEQ ID NO: 8007 - DNA, 25 bp, Homo sapiens
ctagaggagcctgttctgtaatcga

SEQ ID NO: 8008 - DNA, 26 bp, Homo sapiens
ctagaggagcctgttctgtaatcgat

SEQ ID NO: 8009 - DNA, 27 bp, Homo sapiens
ctagaggagcctgttctgtaatcgata

SEQ ID NO: 8010 - DNA, 28 bp, Homo sapiens
ctagaggagcctgttctgtaatcgataa

SEQ ID NO: 8011 - DNA, 31 bp, Homo sapiens; identical to SEQ ID NO: 504

SEQ ID NO: 8012 - DNA, 32 bp, Homo sapiens; identical to SEQ ID NO: 505

SEQ ID NO: 8013 - DNA, 33 bp, Homo sapiens; identical to SEQ ID NO: 506

SEQ ID NO: 8014 - DNA, 37 bp, Homo sapiens
ctagaggagcctgttctgtaatcgataaaccccgatc

SEQ ID NO: 8015 - DNA, 38 bp, Homo sapiens
ctagaggagcctgttctgtaatcgataaaccccgatca

SEQ ID NO: 8016 - DNA, 41 bp, Homo sapiens
ctagaggagcctgttctgtaatcgataaaccccgatcaacc

SEQ ID NO: 8017 - DNA, 16 bp, Homo sapiens
tagaggagcctgttct

SEQ ID NO: 8018 - DNA, 19 bp, Homo sapiens
tagaggagcctgttctgta

SEQ ID NO: 8019 - DNA, 20 bp, Homo sapiens
tagaggagcctgttctgtaa

SEQ ID NO: 8020 - DNA, 21 bp, Homo sapiens
tagaggagcctgttctgtaat

SEQ ID NO: 8021 - DNA, 22 bp, Homo sapiens
tagaggagcctgttctgtaatc

SEQ ID NO: 8022 - DNA, 23 bp, Homo sapiens
tagaggagcctgttctgtaatcg

SEQ ID NO: 8023 - DNA, 24 bp, Homo sapiens
tagaggagcctgttctgtaatcga

SEQ ID NO: 8024 - DNA, 25 bp, Homo sapiens
tagaggagcctgttctgtaatcgat

SEQ ID NO: 8025 - DNA, 26 bp, Homo sapiens
tagaggagcctgttctgtaatcgata

SEQ ID NO: 8026 - DNA, 27 bp, Homo sapiens
tagaggagcctgttctgtaatcgataa

SEQ ID NO: 8027 - DNA, 30 bp, Homo sapiens; identical to SEQ ID NO: 513

SEQ ID NO: 8028 - DNA, 31 bp, Homo sapiens; identical to SEQ ID NO: 514

SEQ ID NO: 8029 - DNA, 32 bp, Homo sapiens; identical to SEQ ID NO: 515

SEQ ID NO: 8030 - DNA, 36 bp, Homo sapiens
tagaggagcctgttctgtaatcgataaaccccgatc

SEQ ID NO: 8031 - DNA, 37 bp, Homo sapiens
tagaggagcctgttctgtaatcgataaaccccgatca

SEQ ID NO: 8032 - DNA, 40 bp, Homo sapiens
tagaggagcctgttctgtaatcgataaaccccgatcaacc

SEQ ID NO: 8033 - DNA, 16 bp, Homo sapiens
agaggagcctgttctg

SEQ ID NO: 8034 - DNA, 17 bp, Homo sapiens
agaggagcctgttctgt

SEQ ID NO: 8035 - DNA, 18 bp, Homo sapiens
agaggagcctgttctgta

SEQ ID NO: 8036 - DNA, 19 bp, Homo sapiens
agaggagcctgttctgtaa

SEQ ID NO: 8037 - DNA, 20 bp, Homo sapiens
agaggagcctgttctgtaat

SEQ ID NO: 8038 - DNA, 21 bp, Homo sapiens
agaggagcctgttctgtaatc

SEQ ID NO: 8039 - DNA, 22 bp, Homo sapiens
agaggagcctgttctgtaatcg

SEQ ID NO: 8040 - DNA, 23 bp, Homo sapiens
agaggagcctgttctgtaatcga

SEQ ID NO: 8041 - DNA, 24 bp, Homo sapiens
agaggagcctgttctgtaatcgat

SEQ ID NO: 8042 - DNA, 25 bp, Homo sapiens
agaggagcctgttctgtaatcgata

SEQ ID NO: 8043 - DNA, 26 bp, Homo sapiens
agaggagcctgttctgtaatcgataa

SEQ ID NO: 8044 - DNA, 27 bp, Homo sapiens
agaggagcctgttctgtaatcgataaa

SEQ ID NO: 8045 - DNA, 28 bp, Homo sapiens
agaggagcctgttctgtaatcgataaac

SEQ ID NO: 8046 - DNA, 29 bp, Homo sapiens
agaggagcctgttctgtaatcgataaacc

SEQ ID NO: 8047 - DNA, 30 bp, Homo sapiens; identical to SEQ ID NO: 524

SEQ ID NO: 8048 - DNA, 31 bp, Homo sapiens; identical to SEQ ID NO: 525

SEQ ID NO: 8049 - DNA, 32 bp, Homo sapiens
agaggagcctgttctgtaatcgataaaccccg

SEQ ID NO: 8050 - DNA, 35 bp, Homo sapiens
agaggagcctgttctgtaatcgataaaccccgatc

SEQ ID NO: 8051 - DNA, 36 bp, Homo sapiens
agaggagcctgttctgtaatcgataaaccccgatca

SEQ ID NO: 8052 - DNA, 39 bp, Homo sapiens
agaggagcctgttctgtaatcgataaaccccgatcaacc

SEQ ID NO: 8053 - DNA, 16 bp, Homo sapiens
gaggagcctgttctgt

SEQ ID NO: 8054 - DNA, 17 bp, Homo sapiens
gaggagcctgttctgta

SEQ ID NO: 8055 - DNA, 18 bp, Homo sapiens
gaggagcctgttctgtaa

SEQ ID NO: 8056 - DNA, 19 bp, Homo sapiens
gaggagcctgttctgtaat

SEQ ID NO: 8057 - DNA, 20 bp, Homo sapiens
gaggagcctgttctgtaatc

SEQ ID NO: 8058 - DNA, 21 bp, Homo sapiens
gaggagcctgttctgtaatcg

SEQ ID NO: 8059 - DNA, 22 bp, Homo sapiens
gaggagcctgttctgtaatcga

SEQ ID NO: 8060 - DNA, 23 bp, Homo sapiens
gaggagcctgttctgtaatcgat

SEQ ID NO: 8061 - DNA, 24 bp, Homo sapiens
gaggagcctgttctgtaatcgata

SEQ ID NO: 8062 - DNA, 25 bp, Homo sapiens
gaggagcctgttctgtaatcgataa

SEQ ID NO: 8063 - DNA, 26 bp, Homo sapiens
gaggagcctgttctgtaatcgataaa

SEQ ID NO: 8064 - DNA, 27 bp, Homo sapiens
gaggagcctgttctgtaatcgataaac

SEQ ID NO: 8065 - DNA, 28 bp, Homo sapiens
gaggagcctgttctgtaatcgataaacc

SEQ ID NO: 8066 - DNA, 29 bp, Homo sapiens
gaggagcctgttctgtaatcgataaaccc

SEQ ID NO: 8067 - DNA, 30 bp, Homo sapiens; identical to SEQ ID NO: 534

SEQ ID NO: 8068 - DNA, 31 bp, Homo sapiens
gaggagcctgttctgtaatcgataaaccccg

SEQ ID NO: 8069 - DNA, 34 bp, Homo sapiens
gaggagcctgttctgtaatcgataaaccccgatc

SEQ ID NO: 8070 - DNA, 38 bp, Homo sapiens
gaggagcctgttctgtaatcgataaaccccgatcaacc

SEQ ID NO: 8071 - DNA, 16 bp, Homo sapiens
aggagcctgttctgta

SEQ ID NO: 8072 - DNA, 18 bp, Homo sapiens
aggagcctgttctgtaat

SEQ ID NO: 8073 - DNA, 19 bp, Homo sapiens
aggagcctgttctgtaatc

SEQ ID NO: 8074 - DNA, 20 bp, Homo sapiens
aggagcctgttctgtaatcg

SEQ ID NO: 8075 - DNA, 22 bp, Homo sapiens
aggagcctgttctgtaatcgat

SEQ ID NO: 8076 - DNA, 23 bp, Homo sapiens
aggagcctgttctgtaatcgata

SEQ ID NO: 8077 - DNA, 24 bp, Homo sapiens
aggagcctgttctgtaatcgataa

SEQ ID NO: 8078 - DNA, 27 bp, Homo sapiens
aggagcctgttctgtaatcgataaacc

SEQ ID NO: 8079 - DNA, 28 bp, Homo sapiens
aggagcctgttctgtaatcgataaaccc

SEQ ID NO: 8080 - DNA, 29 bp, Homo sapiens
aggagcctgttctgtaatcgataaacccc

SEQ ID NO: 8081 - DNA, 30 bp, Homo sapiens
aggagcctgttctgtaatcgataaaccccg

SEQ ID NO: 8082 - DNA, 33 bp, Homo sapiens
aggagcctgttctgtaatcgataaaccccgatc

SEQ ID NO: 8083 - DNA, 26 bp, Homo sapiens
ggagcctgttctgtaatcgataaacc

SEQ ID NO: 8084 - DNA, 27 bp, Homo sapiens
ggagcctgttctgtaatcgataaaccc

SEQ ID NO: 8085 - DNA, 16 bp, Homo sapiens
gagcctgttctgtaat

SEQ ID NO: 8086 - DNA, 17 bp, Homo sapiens
gagcctgttctgtaatc

SEQ ID NO: 8087 - DNA, 21 bp, Homo sapiens
gagcctgttctgtaatcgata

SEQ ID NO: 8088 - DNA, 25 bp, Homo sapiens
gagcctgttctgtaatcgataaacc

SEQ ID NO: 8089 - DNA, 26 bp, Homo sapiens
gagcctgttctgtaatcgataaaccc

SEQ ID NO: 8090 - DNA, 27 bp, Homo sapiens
gagcctgttctgtaatcgataaacccc

SEQ ID NO: 8091 - DNA, 28 bp, Homo sapiens
gagcctgttctgtaatcgataaaccccg

SEQ ID NO: 8092 - DNA, 31 bp, Homo sapiens
gagcctgttctgtaatcgataaaccccgatc

SEQ ID NO: 8093 - DNA, 16 bp, Homo sapiens
agcctgttctgtaatc

SEQ ID NO: 8094 - DNA, 20 bp, Homo sapiens
agcctgttctgtaatcgata

SEQ ID NO: 8095 - DNA, 24 bp, Homo sapiens
agcctgttctgtaatcgataaacc

SEQ ID NO: 8096 - DNA, 25 bp, Homo sapiens
agcctgttctgtaatcgataaaccc

SEQ ID NO: 8097 - DNA, 26 bp, Homo sapiens
agcctgttctgtaatcgataaacccc

SEQ ID NO: 8098 - DNA, 27 bp, Homo sapiens
agcctgttctgtaatcgataaaccccg

SEQ ID NO: 8099 - DNA, 30 bp, Homo sapiens
agcctgttctgtaatcgataaaccccgatc

SEQ ID NO: 8100 - DNA, 31 bp, Homo sapiens
agcctgttctgtaatcgataaaccccgatca

SEQ ID NO: 8101 - DNA, 23 bp, Homo sapiens
gcctgttctgtaatcgataaacc

SEQ ID NO: 8102 - DNA, 24 bp, Homo sapiens
gcctgttctgtaatcgataaaccc

SEQ ID NO: 8103 - DNA, 25 bp, Homo sapiens
gcctgttctgtaatcgataaacccc

SEQ ID NO: 8104 - DNA, 26 bp, Homo sapiens
gcctgttctgtaatcgataaaccccg

SEQ ID NO: 8105 - DNA, 27 bp, Homo sapiens
gcctgttctgtaatcgataaaccccga

SEQ ID NO: 8106 - DNA, 29 bp, Homo sapiens
gcctgttctgtaatcgataaaccccgatc

SEQ ID NO: 8107 - DNA, 30 bp, Homo sapiens
gcctgttctgtaatcgataaaccccgatca

SEQ ID NO: 8108 - DNA, 33 bp, Homo sapiens
gcctgttctgtaatcgataaaccccgatcaacc

SEQ ID NO: 8109 - DNA, 22 bp, Homo sapiens
cctgttctgtaatcgataaacc

SEQ ID NO: 8110 - DNA, 23 bp, Homo sapiens
cctgttctgtaatcgataaaccc

SEQ ID NO: 8111 - DNA, 24 bp, Homo sapiens
cctgttctgtaatcgataaacccc

SEQ ID NO: 8112 - DNA, 25 bp, Homo sapiens
cctgttctgtaatcgataaaccccg

SEQ ID NO: 8113 - DNA, 28 bp, Homo sapiens
cctgttctgtaatcgataaaccccgatc

SEQ ID NO: 8114 - DNA, 29 bp, Homo sapiens
cctgttctgtaatcgataaaccccgatca

SEQ ID NO: 8115 - DNA, 32 bp, Homo sapiens
cctgttctgtaatcgataaaccccgatcaacc

SEQ ID NO: 8116 - DNA, 33 bp, Homo sapiens
cctgttctgtaatcgataaaccccgatcaacct

SEQ ID NO: 8117 - DNA, 21 bp, Homo sapiens
ctgttctgtaatcgataaacc

SEQ ID NO: 8118 - DNA, 22 bp, Homo sapiens
ctgttctgtaatcgataaaccc

SEQ ID NO: 8119 - DNA, 23 bp, Homo sapiens
ctgttctgtaatcgataaacccc

SEQ ID NO: 8120 - DNA, 27 bp, Homo sapiens
ctgttctgtaatcgataaaccccgatc

SEQ ID NO: 8121 - DNA, 28 bp, Homo sapiens
ctgttctgtaatcgataaaccccgatca

SEQ ID NO: 8122 - DNA, 31 bp, Homo sapiens
ctgttctgtaatcgataaaccccgatcaacc

SEQ ID NO: 8123 - DNA, 32 bp, Homo sapiens
ctgttctgtaatcgataaaccccgatcaacct

SEQ ID NO: 8124 - DNA, 20 bp, Homo sapiens
tgttctgtaatcgataaacc

SEQ ID NO: 8125 - DNA, 21 bp, Homo sapiens
tgttctgtaatcgataaaccc

SEQ ID NO: 8126 - DNA, 22 bp, Homo sapiens
tgttctgtaatcgataaacccc

SEQ ID NO: 8127 - DNA, 23 bp, Homo sapiens
tgttctgtaatcgataaaccccg

SEQ ID NO: 8128 - DNA, 25 bp, Homo sapiens
tgttctgtaatcgataaaccccgat

SEQ ID NO: 8129 - DNA, 26 bp, Homo sapiens
tgttctgtaatcgataaaccccgatc

SEQ ID NO: 8130 - DNA, 27 bp, Homo sapiens
tgttctgtaatcgataaaccccgatca

SEQ ID NO: 8131 - DNA, 29 bp, Homo sapiens
tgttctgtaatcgataaaccccgatcaac

SEQ ID NO: 8132 - DNA, 30 bp, Homo sapiens; identical to SEQ ID NO: 562

SEQ ID NO: 8133 - DNA, 31 bp, Homo sapiens; identical to SEQ ID NO: 563

SEQ ID NO: 8134 - DNA, 19 bp, Homo sapiens
gttctgtaatcgataaacc

SEQ ID NO: 8135 - DNA, 20 bp, Homo sapiens
gttctgtaatcgataaaccc

SEQ ID NO: 8136 - DNA, 21 bp, Homo sapiens
gttctgtaatcgataaacccc

SEQ ID NO: 8137 - DNA, 24 bp, Homo sapiens
gttctgtaatcgataaaccccgat

SEQ ID NO: 8138 - DNA, 25 bp, Homo sapiens
gttctgtaatcgataaaccccgatc

SEQ ID NO: 8139 - DNA, 26 bp, Homo sapiens
gttctgtaatcgataaaccccgatca

SEQ ID NO: 8140 - DNA, 29 bp, Homo sapiens
gttctgtaatcgataaaccccgatcaacc

SEQ ID NO: 8141 - DNA, 18 bp, Homo sapiens
tctgtaatcgataaaccc

SEQ ID NO: 8142 - DNA, 46 bp, Homo sapiens
gataaaccccgatcaacctcaccacctcttgctcagcctatatacc

SEQ ID NO: 8143 - DNA, 32 bp, Homo sapiens
ataaaccccgatcaacctcaccacctcttgct

SEQ ID NO: 8144 - DNA, 45 bp, Homo sapiens
ataaaccccgatcaacctcaccacctcttgctcagcctatatacc

SEQ ID NO: 8145 - DNA, 29 bp, Homo sapiens
aaccccgatcaacctcaccacctcttgct

SEQ ID NO: 8146 - DNA, 33 bp, Homo sapiens
ccccgatcaacctcaccacctcttgctcagcct

SEQ ID NO: 8147 - DNA, 19 bp, Homo sapiens
ccgatcaacctcaccacct

SEQ ID NO: 8148 - DNA, 25 bp, Homo sapiens
ccgatcaacctcaccacctcttgct

SEQ ID NO: 8149 - DNA, 26 bp, Homo sapiens
ccgatcaacctcaccacctcttgctc

SEQ ID NO: 8150 - DNA, 27 bp, Homo sapiens
ccgatcaacctcaccacctcttgctca

SEQ ID NO: 8151 - DNA, 30 bp, Homo sapiens; identical to SEQ ID NO: 567

SEQ ID NO: 8152 - DNA, 31 bp, Homo sapiens; identical to SEQ ID NO: 568

SEQ ID NO: 8153 - DNA, 38 bp, Homo sapiens
ccgatcaacctcaccacctcttgctcagcctatatacc

SEQ ID NO: 8154 - DNA, 39 bp, Homo sapiens
ccgatcaacctcaccacctcttgctcagcctatataccg

SEQ ID NO: 8155 - DNA, 17 bp, Homo sapiens
cgatcaacctcaccacc

SEQ ID NO: 8156 - DNA, 18 bp, Homo sapiens
cgatcaacctcaccacct

SEQ ID NO: 8157 - DNA, 23 bp, Homo sapiens
cgatcaacctcaccacctcttgc

SEQ ID NO: 8158 - DNA, 24 bp, Homo sapiens
cgatcaacctcaccacctcttgct

SEQ ID NO: 8159 - DNA, 25 bp, Homo sapiens
cgatcaacctcaccacctcttgctc

SEQ ID NO: 8160 - DNA, 26 bp, Homo sapiens
cgatcaacctcaccacctcttgctca

SEQ ID NO: 8161 - DNA, 28 bp, Homo sapiens
cgatcaacctcaccacctcttgctcagc

SEQ ID NO: 8162 - DNA, 29 bp, Homo sapiens
cgatcaacctcaccacctcttgctcagcc

SEQ ID NO: 8163 - DNA, 30 bp, Homo sapiens; identical to SEQ ID NO: 573

SEQ ID NO: 8164 - DNA, 31 bp, Homo sapiens
cgatcaacctcaccacctcttgctcagccta

SEQ ID NO: 8165 - DNA, 32 bp, Homo sapiens
cgatcaacctcaccacctcttgctcagcctat

SEQ ID NO: 8166 - DNA, 33 bp, Homo sapiens; identical to SEQ ID NO: 574

SEQ ID NO: 8167 - DNA, 34 bp, Homo sapiens
cgatcaacctcaccacctcttgctcagcctatat

SEQ ID NO: 8168 - DNA, 35 bp, Homo sapiens
cgatcaacctcaccacctcttgctcagcctatata

SEQ ID NO: 8169 - DNA, 36 bp, Homo sapiens
cgatcaacctcaccacctcttgctcagcctatatac

SEQ ID NO: 8170 - DNA, 37 bp, Homo sapiens
cgatcaacctcaccacctcttgctcagcctatatacc

SEQ ID NO: 8171 - DNA, 38 bp, Homo sapiens
cgatcaacctcaccacctcttgctcagcctatataccg

SEQ ID NO: 8172 - DNA, 40 bp, Homo sapiens
cgatcaacctcaccacctcttgctcagcctatataccgcc

SEQ ID NO: 8173 - DNA, 22 bp, Homo sapiens
gatcaacctcaccacctcttgc

SEQ ID NO: 8174 - DNA, 23 bp, Homo sapiens
gatcaacctcaccacctcttgct

SEQ ID NO: 8175 - DNA, 24 bp, Homo sapiens
gatcaacctcaccacctcttgctc

SEQ ID NO: 8176 - DNA, 25 bp, Homo sapiens
gatcaacctcaccacctcttgctca

SEQ ID NO: 8177 - DNA, 28 bp, Homo sapiens
gatcaacctcaccacctcttgctcagcc

SEQ ID NO: 8178 - DNA, 29 bp, Homo sapiens
gatcaacctcaccacctcttgctcagcct

SEQ ID NO: 8179 - DNA, 32 bp, Homo sapiens
gatcaacctcaccacctcttgctcagcctata

SEQ ID NO: 8180 - DNA, 33 bp, Homo sapiens
gatcaacctcaccacctcttgctcagcctatat

SEQ ID NO: 8181 - DNA, 36 bp, Homo sapiens
gatcaacctcaccacctcttgctcagcctatatacc

SEQ ID NO: 8182 - DNA, 37 bp, Homo sapiens
gatcaacctcaccacctcttgctcagcctatataccg

SEQ ID NO: 8183 - DNA, 21 bp, Homo sapiens
atcaacctcaccacctcttgc

SEQ ID NO: 8184 - DNA, 22 bp, Homo sapiens
atcaacctcaccacctcttgct

SEQ ID NO: 8185 - DNA, 23 bp, Homo sapiens
atcaacctcaccacctcttgctc

SEQ ID NO: 8186 - DNA, 24 bp, Homo sapiens
atcaacctcaccacctcttgctca

SEQ ID NO: 8187 - DNA, 27 bp, Homo sapiens
atcaacctcaccacctcttgctcagcc

SEQ ID NO: 8188 - DNA, 28 bp, Homo sapiens
atcaacctcaccacctcttgctcagcct

SEQ ID NO: 8189 - DNA, 31 bp, Homo sapiens; identical to SEQ ID NO: 579

SEQ ID NO: 8190 - DNA, 32 bp, Homo sapiens
atcaacctcaccacctcttgctcagcctatat

SEQ ID NO: 8191 - DNA, 33 bp, Homo sapiens
atcaacctcaccacctcttgctcagcctatata

SEQ ID NO: 8192 - DNA, 35 bp, Homo sapiens
atcaacctcaccacctcttgctcagcctatatacc

SEQ ID NO: 8193 - DNA, 36 bp, Homo sapiens
atcaacctcaccacctcttgctcagcctatataccg

SEQ ID NO: 8194 - DNA, 20 bp, Homo sapiens
caacctcaccacctcttgct

SEQ ID NO: 8195 - DNA, 25 bp, Homo sapiens
caacctcaccacctcttgctcagcc

SEQ ID NO: 8196 - DNA, 26 bp, Homo sapiens
caacctcaccacctcttgctcagcct

SEQ ID NO: 8197 - DNA, 29 bp, Homo sapiens
caacctcaccacctcttgctcagcctata

SEQ ID NO: 8198 - DNA, 33 bp, Homo sapiens; identical to SEQ ID NO: 582

SEQ ID NO: 8199 - DNA, 34 bp, Homo sapiens
caacctcaccacctcttgctcagcctatataccg

SEQ ID NO: 8200 - DNA, 19 bp, Homo sapiens
aacctcaccacctcttgct

SEQ ID NO: 8201 - DNA, 20 bp, Homo sapiens
aacctcaccacctcttgctc

SEQ ID NO: 8202 - DNA, 21 bp, Homo sapiens
aacctcaccacctcttgctca

SEQ ID NO: 8203 - DNA, 24 bp, Homo sapiens
aacctcaccacctcttgctcagcc

SEQ ID NO: 8204 - DNA, 25 bp, Homo sapiens
aacctcaccacctcttgctcagcct

SEQ ID NO: 8205 - DNA, 28 bp, Homo sapiens
aacctcaccacctcttgctcagcctata

SEQ ID NO: 8206 - DNA, 29 bp, Homo sapiens
aacctcaccacctcttgctcagcctatat

SEQ ID NO: 8207 - DNA, 30 bp, Homo sapiens
aacctcaccacctcttgctcagcctatata

SEQ ID NO: 8208 - DNA, 31 bp, Homo sapiens
aacctcaccacctcttgctcagcctatatac

SEQ ID NO: 8209 - DNA, 32 bp, Homo sapiens; identical to SEQ ID NO: 587

SEQ ID NO: 8210 - DNA, 33 bp, Homo sapiens; identical to SEQ ID NO: 588

SEQ ID NO: 8211 - DNA, 18 bp, Homo sapiens
acctcaccacctcttgct

SEQ ID NO: 8212 - DNA, 23 bp, Homo sapiens
acctcaccacctcttgctcagcc

SEQ ID NO: 8213 - DNA, 24 bp, Homo sapiens
acctcaccacctcttgctcagcct

SEQ ID NO: 8214 - DNA, 27 bp, Homo sapiens
acctcaccacctcttgctcagcctata

SEQ ID NO: 8215 - DNA, 31 bp, Homo sapiens; identical to SEQ ID NO: 590

SEQ ID NO: 8216 - DNA, 32 bp, Homo sapiens; identical to SEQ ID NO: 591

SEQ ID NO: 8217 - DNA, 22 bp, Homo sapiens
cctcaccacctcttgctcagcc

SEQ ID NO: 8218 - DNA, 23 bp, Homo sapiens
cctcaccacctcttgctcagcct

SEQ ID NO: 8219 - DNA, 30 bp, Homo sapiens; identical to SEQ ID NO: 592

SEQ ID NO: 8220 - DNA, 31 bp, Homo sapiens
cctcaccacctcttgctcagcctatataccg

SEQ ID NO: 8221 - DNA, 16 bp, Homo sapiens
ctcaccacctcttgct

SEQ ID NO: 8222 - DNA, 21 bp, Homo sapiens
ctcaccacctcttgctcagcc

SEQ ID NO: 8223 - DNA, 22 bp, Homo sapiens
ctcaccacctcttgctcagcct

SEQ ID NO: 8224 - DNA, 29 bp, Homo sapiens
ctcaccacctcttgctcagcctatatacc

SEQ ID NO: 8225 - DNA, 30 bp, Homo sapiens
ctcaccacctcttgctcagcctatataccg

SEQ ID NO: 8226 - DNA, 16 bp, Homo sapiens
tcaccacctcttgctc

SEQ ID NO: 8227 - DNA, 17 bp, Homo sapiens
tcaccacctcttgctca

SEQ ID NO: 8228 - DNA, 19 bp, Homo sapiens
tcaccacctcttgctcagc

SEQ ID NO: 8229 - DNA, 20 bp, Homo sapiens
tcaccacctcttgctcagcc

SEQ ID NO: 8230 - DNA, 21 bp, Homo sapiens
tcaccacctcttgctcagcct

SEQ ID NO: 8231 - DNA, 22 bp, Homo sapiens
tcaccacctcttgctcagccta

SEQ ID NO: 8232 - DNA, 23 bp, Homo sapiens
tcaccacctcttgctcagcctat

SEQ ID NO: 8233 - DNA, 24 bp, Homo sapiens
tcaccacctcttgctcagcctata

SEQ ID NO: 8234 - DNA, 25 bp, Homo sapiens
tcaccacctcttgctcagcctatat

SEQ ID NO: 8235 - DNA, 26 bp, Homo sapiens
tcaccacctcttgctcagcctatata

SEQ ID NO: 8236 - DNA, 27 bp, Homo sapiens
tcaccacctcttgctcagcctatatac

SEQ ID NO: 8237 - DNA, 28 bp, Homo sapiens
tcaccacctcttgctcagcctatatacc

SEQ ID NO: 8238 - DNA, 29 bp, Homo sapiens
tcaccacctcttgctcagcctatataccg

SEQ ID NO: 8239 - DNA, 31 bp, Homo sapiens; identical to SEQ ID NO: 602

SEQ ID NO: 8240 - DNA, 19 bp, Homo sapiens
caccacctcttgctcagcc

SEQ ID NO: 8241 - DNA, 20 bp, Homo sapiens
caccacctcttgctcagcct

SEQ ID NO: 8242 - DNA, 23 bp, Homo sapiens
caccacctcttgctcagcctata

SEQ ID NO: 8243 - DNA, 27 bp, Homo sapiens
caccacctcttgctcagcctatatacc

SEQ ID NO: 8244 - DNA, 28 bp, Homo sapiens
caccacctcttgctcagcctatataccg

SEQ ID NO: 8245 - DNA, 26 bp, Homo sapiens
accacctcttgctcagcctatatacc

SEQ ID NO: 8246 - DNA, 25 bp, Homo sapiens
ccacctcttgctcagcctatatacc

SEQ ID NO: 8247 - DNA, 24 bp, Homo sapiens
cacctcttgctcagcctatatacc

SEQ ID NO: 8248 - DNA, 23 bp, Homo sapiens
acctcttgctcagcctatatacc

SEQ ID NO: 8249 - DNA, 21 bp, Homo sapiens
ctcttgctcagcctatatacc

SEQ ID NO: 8250 - DNA, 20 bp, Homo sapiens
tcttgctcagcctatatacc

SEQ ID NO: 8251 - DNA, 19 bp, Homo sapiens
cttgctcagcctatatacc

SEQ ID NO: 8252 - DNA, 20 bp, Homo sapiens
cttgctcagcctatataccg

SEQ ID NO: 8253 - DNA, 18 bp, Homo sapiens
ttgctcagcctatatacc

SEQ ID NO: 8254 - DNA, 17 bp, Homo sapiens
tgctcagcctatatacc

SEQ ID NO: 8255 - DNA, 16 bp, Homo sapiens
gctcagcctatatacc

SEQ ID NO: 8256 - DNA, 27 bp, Homo sapiens
ctcagcctatataccgccatcttcagc

SEQ ID NO: 8257 - DNA, 25 bp, Homo sapiens
cagcctatataccgccatcttcagc

SEQ ID NO: 8258 - DNA, 29 bp, Homo sapiens
cagcctatataccgccatcttcagcaaac

SEQ ID NO: 8259 - DNA, 30 bp, Homo sapiens
cagcctatataccgccatcttcagcaaacc

SEQ ID NO: 8260 - DNA, 20 bp, Homo sapiens
tatataccgccatcttcagc

SEQ ID NO: 8261 - DNA, 21 bp, Homo sapiens
tatataccgccatcttcagca

SEQ ID NO: 8262 - DNA, 25 bp, Homo sapiens
tatataccgccatcttcagcaaacc

SEQ ID NO: 8263 - DNA, 26 bp, Homo sapiens
tatataccgccatcttcagcaaaccc

SEQ ID NO: 8264 - DNA, 31 bp, Homo sapiens
tatataccgccatcttcagcaaaccctgatg

SEQ ID NO: 8265 - DNA, 19 bp, Homo sapiens
atataccgccatcttcagc

SEQ ID NO: 8266 - DNA, 28 bp, Homo sapiens
ataccgccatcttcagcaaaccctgatg

SEQ ID NO: 8267 - DNA, 16 bp, Homo sapiens
taccgccatcttcagc

SEQ ID NO: 8268 - DNA, 25 bp, Homo sapiens
gccatcttcagcaaaccctgatgaa

SEQ ID NO: 8269 - DNA, 17 bp, Homo sapiens
ccatcttcagcaaaccc

SEQ ID NO: 8270 - DNA, 28 bp, Homo sapiens
ccatcttcagcaaaccctgatgaaggct

SEQ ID NO: 8271 - DNA, 32 bp, Homo sapiens
ctgatgaaggctacaaagtaagcgcaagtacc

SEQ ID NO: 8272 - DNA, 33 bp, Homo sapiens; identical to SEQ ID NO: 607

SEQ ID NO: 8273 - DNA, 19 bp, Homo sapiens
tgatgaaggctacaaagta

SEQ ID NO: 8274 - DNA, 32 bp, Homo sapiens
tgatgaaggctacaaagtaagcgcaagtaccc

SEQ ID NO: 8275 - DNA, 18 bp, Homo sapiens
gatgaaggctacaaagta

SEQ ID NO: 8276 - DNA, 31 bp, Homo sapiens
acaaagtaagcgcaagtacccacgtaaagac

SEQ ID NO: 8277 - DNA, 21 bp, Homo sapiens
caaagtaagcgcaagtaccca

SEQ ID NO: 8278 - DNA, 18 bp, Homo sapiens
aaagtaagcgcaagtacc

SEQ ID NO: 8279 - DNA, 19 bp, Homo sapiens
aaagtaagcgcaagtaccc

SEQ ID NO: 8280 - DNA, 16 bp, Homo sapiens
aagtaagcgcaagtac

SEQ ID NO: 8281 - DNA, 17 bp, Homo sapiens
aagtaagcgcaagtacc

SEQ ID NO: 8282 - DNA, 18 bp, Homo sapiens
aagtaagcgcaagtaccc

SEQ ID NO: 8283 - DNA, 21 bp, Homo sapiens
aagtaagcgcaagtacccacg

SEQ ID NO: 8284 - DNA, 28 bp, Homo sapiens
aagtaagcgcaagtacccacgtaaagac

SEQ ID NO: 8285 - DNA, 29 bp, Homo sapiens
aagtaagcgcaagtacccacgtaaagacg

SEQ ID NO: 8286 - DNA, 27 bp, Homo sapiens
agtaagcgcaagtacccacgtaaagac

SEQ ID NO: 8287 - DNA, 25 bp, Homo sapiens
taagcgcaagtacccacgtaaagac

SEQ ID NO: 8288 - DNA, 23 bp, Homo sapiens
agcgcaagtacccacgtaaagac

SEQ ID NO: 8289 - DNA, 28 bp, Homo sapiens
agcgcaagtacccacgtaaagacgttag

SEQ ID NO: 8290 - DNA, 31 bp, Homo sapiens
agcgcaagtacccacgtaaagacgttaggtc

SEQ ID NO: 8291 - DNA, 19 bp, Homo sapiens
caagtacccacgtaaagac

SEQ ID NO: 8292 - DNA, 20 bp, Homo sapiens
caagtacccacgtaaagacg

SEQ ID NO: 8293 - DNA, 38 bp, Homo sapiens
caagtacccacgtaaagacgttaggtcaaggtgtagcc

SEQ ID NO: 8294 - DNA, 39 bp, Homo sapiens
caagtacccacgtaaagacgttaggtcaaggtgtagccc

SEQ ID NO: 8295 - DNA, 17 bp, Homo sapiens
agtacccacgtaaagac

SEQ ID NO: 8296 - DNA, 33 bp, Homo sapiens
cccacgtaaagacgttaggtcaaggtgtagccc

SEQ ID NO: 8297 - DNA, 31 bp, Homo sapiens
ccacgtaaagacgttaggtcaaggtgtagcc

SEQ ID NO: 8298 - DNA, 32 bp, Homo sapiens
ccacgtaaagacgttaggtcaaggtgtagccc

SEQ ID NO: 8299 - DNA, 19 bp, Homo sapiens
cacgtaaagacgttaggtc

SEQ ID NO: 8300 - DNA, 22 bp, Homo sapiens
cacgtaaagacgttaggtcaag

SEQ ID NO: 8301 - DNA, 23 bp, Homo sapiens
cacgtaaagacgttaggtcaagg

SEQ ID NO: 8302 - DNA, 25 bp, Homo sapiens
cacgtaaagacgttaggtcaaggtg

SEQ ID NO: 8303 - DNA, 27 bp, Homo sapiens
cacgtaaagacgttaggtcaaggtgta

SEQ ID NO: 8304 - DNA, 29 bp, Homo sapiens
cacgtaaagacgttaggtcaaggtgtagc

SEQ ID NO: 8305 - DNA, 30 bp, Homo sapiens; identical to SEQ ID NO: 616

SEQ ID NO: 8306 - DNA, 31 bp, Homo sapiens; identical to SEQ ID NO: 617

SEQ ID NO: 8307 - DNA, 32 bp, Homo sapiens
cacgtaaagacgttaggtcaaggtgtagccca

SEQ ID NO: 8308 - DNA, 18 bp, Homo sapiens
acgtaaagacgttaggtc

SEQ ID NO: 8309 - DNA, 21 bp, Homo sapiens
acgtaaagacgttaggtcaag

SEQ ID NO: 8310 - DNA, 23 bp, Homo sapiens
acgtaaagacgttaggtcaaggt

SEQ ID NO: 8311 - DNA, 25 bp, Homo sapiens
acgtaaagacgttaggtcaaggtgt

SEQ ID NO: 8312 - DNA, 26 bp, Homo sapiens
acgtaaagacgttaggtcaaggtgta

SEQ ID NO: 8313 - DNA, 27 bp, Homo sapiens
acgtaaagacgttaggtcaaggtgtag

SEQ ID NO: 8314 - DNA, 28 bp, Homo sapiens
acgtaaagacgttaggtcaaggtgtagc

SEQ ID NO: 8315 - DNA, 29 bp, Homo sapiens
acgtaaagacgttaggtcaaggtgtagcc

SEQ ID NO: 8316 - DNA, 30 bp, Homo sapiens; identical to SEQ ID NO: 621

SEQ ID NO: 8317 - DNA, 17 bp, Homo sapiens
cgtaaagacgttaggtc

SEQ ID NO: 8318 - DNA, 25 bp, Homo sapiens
cgtaaagacgttaggtcaaggtgta

SEQ ID NO: 8319 - DNA, 26 bp, Homo sapiens
cgtaaagacgttaggtcaaggtgtag

SEQ ID NO: 8320 - DNA, 27 bp, Homo sapiens
cgtaaagacgttaggtcaaggtgtagc

SEQ ID NO: 8321 - DNA, 28 bp, Homo sapiens
cgtaaagacgttaggtcaaggtgtagcc

SEQ ID NO: 8322 - DNA, 29 bp, Homo sapiens
cgtaaagacgttaggtcaaggtgtagccc

SEQ ID NO: 8323 - DNA, 16 bp, Homo sapiens
gtaaagacgttaggtc

SEQ ID NO: 8324 - DNA, 24 bp, Homo sapiens
gtaaagacgttaggtcaaggtgta

SEQ ID NO: 8325 - DNA, 25 bp, Homo sapiens
gtaaagacgttaggtcaaggtgtag

SEQ ID NO: 8326 - DNA, 26 bp, Homo sapiens
gtaaagacgttaggtcaaggtgtagc

SEQ ID NO: 8327 - DNA, 27 bp, Homo sapiens
gtaaagacgttaggtcaaggtgtagcc

SEQ ID NO: 8328 - DNA, 28 bp, Homo sapiens
gtaaagacgttaggtcaaggtgtagccc

SEQ ID NO: 8329 - DNA, 29 bp, Homo sapiens
gtaaagacgttaggtcaaggtgtagccca

SEQ ID NO: 8330 - DNA, 22 bp, Homo sapiens
taaagacgttaggtcaaggtgt

SEQ ID NO: 8331 - DNA, 23 bp, Homo sapiens
taaagacgttaggtcaaggtgta

SEQ ID NO: 8332 - DNA, 24 bp, Homo sapiens
taaagacgttaggtcaaggtgtag

SEQ ID NO: 8333 - DNA, 25 bp, Homo sapiens
taaagacgttaggtcaaggtgtagc

SEQ ID NO: 8334 - DNA, 26 bp, Homo sapiens
taaagacgttaggtcaaggtgtagcc

SEQ ID NO: 8335 - DNA, 27 bp, Homo sapiens
taaagacgttaggtcaaggtgtagccc

SEQ ID NO: 8336 - DNA, 28 bp, Homo sapiens
taaagacgttaggtcaaggtgtagccca

SEQ ID NO: 8337 - DNA, 33 bp, Homo sapiens; identical to SEQ ID NO: 632

SEQ ID NO: 8338 - DNA, 23 bp, Homo sapiens
aaagacgttaggtcaaggtgtag

SEQ ID NO: 8339 - DNA, 25 bp, Homo sapiens
aaagacgttaggtcaaggtgtagcc

SEQ ID NO: 8340 - DNA, 26 bp, Homo sapiens
aaagacgttaggtcaaggtgtagccc

SEQ ID NO: 8341 - DNA, 21 bp, Homo sapiens
aagacgttaggtcaaggtgta

SEQ ID NO: 8342 - DNA, 22 bp, Homo sapiens
aagacgttaggtcaaggtgtag

SEQ ID NO: 8343 - DNA, 23 bp, Homo sapiens
aagacgttaggtcaaggtgtagc

SEQ ID NO: 8344 - DNA, 24 bp, Homo sapiens
aagacgttaggtcaaggtgtagcc

SEQ ID NO: 8345 - DNA, 25 bp, Homo sapiens
aagacgttaggtcaaggtgtagccc

SEQ ID NO: 8346 - DNA, 21 bp, Homo sapiens
agacgttaggtcaaggtgtag

SEQ ID NO: 8347 - DNA, 23 bp, Homo sapiens
agacgttaggtcaaggtgtagcc

SEQ ID NO: 8348 - DNA, 24 bp, Homo sapiens
agacgttaggtcaaggtgtagccc

SEQ ID NO: 8349 - DNA, 22 bp, Homo sapiens
gacgttaggtcaaggtgtagcc

SEQ ID NO: 8350 - DNA, 23 bp, Homo sapiens
gacgttaggtcaaggtgtagccc

SEQ ID NO: 8351 - DNA, 32 bp, Homo sapiens
gacgttaggtcaaggtgtagcccatgaggtgg

SEQ ID NO: 8352 - DNA, 33 bp, Homo sapiens
gacgttaggtcaaggtgtagcccatgaggtggc

SEQ ID NO: 8353 - DNA, 18 bp, Homo sapiens
acgttaggtcaaggtgta

SEQ ID NO: 8354 - DNA, 19 bp, Homo sapiens
acgttaggtcaaggtgtag

SEQ ID NO: 8355 - DNA, 20 bp, Homo sapiens
acgttaggtcaaggtgtagc

SEQ ID NO: 8356 - DNA, 21 bp, Homo sapiens
acgttaggtcaaggtgtagcc

SEQ ID NO: 8357 - DNA, 22 bp, Homo sapiens
acgttaggtcaaggtgtagccc

SEQ ID NO: 8358 - DNA, 31 bp, Homo sapiens
acgttaggtcaaggtgtagcccatgaggtgg

SEQ ID NO: 8359 - DNA, 33 bp, Homo sapiens
acgttaggtcaaggtgtagcccatgaggtggca

SEQ ID NO: 8360 - DNA, 16 bp, Homo sapiens
cgttaggtcaaggtgt

SEQ ID NO: 8361 - DNA, 18 bp, Homo sapiens
cgttaggtcaaggtgtag

SEQ ID NO: 8362 - DNA, 20 bp, Homo sapiens
cgttaggtcaaggtgtagcc

SEQ ID NO: 8363 - DNA, 21 bp, Homo sapiens
cgttaggtcaaggtgtagccc

SEQ ID NO: 8364 - DNA, 30 bp, Homo sapiens
cgttaggtcaaggtgtagcccatgaggtgg

SEQ ID NO: 8365 - DNA, 32 bp, Homo sapiens
cgttaggtcaaggtgtagcccatgaggtggca

SEQ ID NO: 8366 - DNA, 16 bp, Homo sapiens
gttaggtcaaggtgta

SEQ ID NO: 8367 - DNA, 17 bp, Homo sapiens
gttaggtcaaggtgtag

SEQ ID NO: 8368 - DNA, 19 bp, Homo sapiens
gttaggtcaaggtgtagcc

SEQ ID NO: 8369 - DNA, 20 bp, Homo sapiens
gttaggtcaaggtgtagccc

SEQ ID NO: 8370 - DNA, 30 bp, Homo sapiens
gttaggtcaaggtgtagcccatgaggtggc

SEQ ID NO: 8371 - DNA, 31 bp, Homo sapiens
gttaggtcaaggtgtagcccatgaggtggca

SEQ ID NO: 8372 - DNA, 18 bp, Homo sapiens
ttaggtcaaggtgtagcc

SEQ ID NO: 8373 - DNA, 19 bp, Homo sapiens
ttaggtcaaggtgtagccc

SEQ ID NO: 8374 - DNA, 30 bp, Homo sapiens
ttaggtcaaggtgtagcccatgaggtggca

SEQ ID NO: 8375 - DNA, 33 bp, Homo sapiens
ttaggtcaaggtgtagcccatgaggtggcaaga

SEQ ID NO: 8376 - DNA, 17 bp, Homo sapiens
taggtcaaggtgtagcc

SEQ ID NO: 8377 - DNA, 16 bp, Homo sapiens
aggtcaaggtgtagcc

SEQ ID NO: 8378 - DNA, 26 bp, Homo sapiens
gtcaaggtgtagcccatgaggtggca

SEQ ID NO: 8379 - DNA, 23 bp, Homo sapiens
aaggtgtagcccatgaggtggca

SEQ ID NO: 8380 - DNA, 25 bp, Homo sapiens
cccatgaggtggcaagaaatgggct

SEQ ID NO: 8381 - DNA, 23 bp, Homo sapiens
catgaggtggcaagaaatgggct

SEQ ID NO: 8382 - DNA, 22 bp, Homo sapiens
atgaggtggcaagaaatgggct

SEQ ID NO: 8383 - DNA, 16 bp, Homo sapiens
agaaatgggctacatt

SEQ ID NO: 8384 - DNA, 21 bp, Homo sapiens
aaatgggctacattttctacc

SEQ ID NO: 8385 - DNA, 20 bp, Homo sapiens
aatgggctacattttctacc

SEQ ID NO: 8386 - DNA, 19 bp, Homo sapiens
atgggctacattttctacc

SEQ ID NO: 8387 - DNA, 18 bp, Homo sapiens
tgggctacattttctacc

SEQ ID NO: 8388 - DNA, 30 bp, Homo sapiens
ccagaaaactacgatagcccttatgaaact

SEQ ID NO: 8389 - DNA, 19 bp, Homo sapiens
cagaaaactacgatagccc

SEQ ID NO: 8390 - DNA, 20 bp, Homo sapiens
cagaaaactacgatagccct

SEQ ID NO: 8391 - DNA, 24 bp, Homo sapiens
cagaaaactacgatagcccttatg

SEQ ID NO: 8392 - DNA, 29 bp, Homo sapiens
cagaaaactacgatagcccttatgaaact

SEQ ID NO: 8393 - DNA, 33 bp, Homo sapiens
cagaaaactacgatagcccttatgaaacttaag

SEQ ID NO: 8394 - DNA, 23 bp, Homo sapiens
agaaaactacgatagcccttatg

SEQ ID NO: 8395 - DNA, 28 bp, Homo sapiens
agaaaactacgatagcccttatgaaact

SEQ ID NO: 8396 - DNA, 27 bp, Homo sapiens
gaaaactacgatagcccttatgaaact

SEQ ID NO: 8397 - DNA, 26 bp, Homo sapiens
aaaactacgatagcccttatgaaact

SEQ ID NO: 8398 - DNA, 25 bp, Homo sapiens
aaactacgatagcccttatgaaact

SEQ ID NO: 8399 - DNA, 24 bp, Homo sapiens
aactacgatagcccttatgaaact

SEQ ID NO: 8400 - DNA, 23 bp, Homo sapiens
actacgatagcccttatgaaact

SEQ ID NO: 8401 - DNA, 22 bp, Homo sapiens
ctacgatagcccttatgaaact

SEQ ID NO: 8402 - DNA, 21 bp, Homo sapiens
tacgatagcccttatgaaact

SEQ ID NO: 8403 - DNA, 20 bp, Homo sapiens
acgatagcccttatgaaact

SEQ ID NO: 8404 - DNA, 33 bp, Homo sapiens
acgatagcccttatgaaacttaagggtcgaagg

SEQ ID NO: 8405 - DNA, 19 bp, Homo sapiens
cgatagcccttatgaaact

SEQ ID NO: 8406 - DNA, 32 bp, Homo sapiens
cgatagcccttatgaaacttaagggtcgaagg

SEQ ID NO: 8407 - DNA, 18 bp, Homo sapiens
gatagcccttatgaaact

SEQ ID NO: 8408 - DNA, 17 bp, Homo sapiens
atagcccttatgaaact

SEQ ID NO: 8409 - DNA, 32 bp, Homo sapiens
atagcccttatgaaacttaagggtcgaaggtg

SEQ ID NO: 8410 - DNA, 19 bp, Homo sapiens
aaacttaagggtcgaaggt

SEQ ID NO: 8411 - DNA, 27 bp, Homo sapiens
taagggtcgaaggtggatttagcagta

SEQ ID NO: 8412 - DNA, 31 bp, Homo sapiens
taagggtcgaaggtggatttagcagtaaact

SEQ ID NO: 8413 - DNA, 33 bp, Homo sapiens
aactaagagtagagtgcttagttgaacagggcc

SEQ ID NO: 8414 - DNA, 32 bp, Homo sapiens
ctaagagtagagtgcttagttgaacagggccc

SEQ ID NO: 8415 - DNA, 31 bp, Homo sapiens
taagagtagagtgcttagttgaacagggccc

SEQ ID NO: 8416 - DNA, 32 bp, Homo sapiens
taagagtagagtgcttagttgaacagggccct

SEQ ID NO: 8417 - DNA, 24 bp, Homo sapiens
aagagtagagtgcttagttgaaca

SEQ ID NO: 8418 - DNA, 29 bp, Homo sapiens
aagagtagagtgcttagttgaacagggcc

SEQ ID NO: 8419 - DNA, 30 bp, Homo sapiens
aagagtagagtgcttagttgaacagggccc

SEQ ID NO: 8420 - DNA, 31 bp, Homo sapiens
aagagtagagtgcttagttgaacagggccct

SEQ ID NO: 8421 - DNA, 23 bp, Homo sapiens
agagtagagtgcttagttgaaca

SEQ ID NO: 8422 - DNA, 28 bp, Homo sapiens
agagtagagtgcttagttgaacagggcc

SEQ ID NO: 8423 - DNA, 29 bp, Homo sapiens
agagtagagtgcttagttgaacagggccc

SEQ ID NO: 8424 - DNA, 30 bp, Homo sapiens; identical to SEQ ID NO: 655

SEQ ID NO: 8425 - DNA, 21 bp, Homo sapiens
gagtagagtgcttagttgaac

SEQ ID NO: 8426 - DNA, 22 bp, Homo sapiens
gagtagagtgcttagttgaaca

SEQ ID NO: 8427 - DNA, 27 bp, Homo sapiens
gagtagagtgcttagttgaacagggcc

SEQ ID NO: 8428 - DNA, 28 bp, Homo sapiens
gagtagagtgcttagttgaacagggccc

SEQ ID NO: 8429 - DNA, 29 bp, Homo sapiens
gagtagagtgcttagttgaacagggccct

SEQ ID NO: 8430 - DNA, 31 bp, Homo sapiens
gagtagagtgcttagttgaacagggccctga

SEQ ID NO: 8431 - DNA, 32 bp, Homo sapiens
gagtagagtgcttagttgaacagggccctgaa

SEQ ID NO: 8432 - DNA, 33 bp, Homo sapiens; identical to SEQ ID NO: 659

SEQ ID NO: 8433 - DNA, 20 bp, Homo sapiens
agtagagtgcttagttgaac

SEQ ID NO: 8434 - DNA, 21 bp, Homo sapiens
agtagagtgcttagttgaaca

SEQ ID NO: 8435 - DNA, 23 bp, Homo sapiens
agtagagtgcttagttgaacagg

SEQ ID NO: 8436 - DNA, 26 bp, Homo sapiens
agtagagtgcttagttgaacagggcc

SEQ ID NO: 8437 - DNA, 27 bp, Homo sapiens
agtagagtgcttagttgaacagggccc

SEQ ID NO: 8438 - DNA, 28 bp, Homo sapiens
agtagagtgcttagttgaacagggccct

SEQ ID NO: 8439 - DNA, 32 bp, Homo sapiens
agtagagtgcttagttgaacagggccctgaag

SEQ ID NO: 8440 - DNA, 33 bp, Homo sapiens
agtagagtgcttagttgaacagggccctgaagc

SEQ ID NO: 8441 - DNA, 19 bp, Homo sapiens
gtagagtgcttagttgaac

SEQ ID NO: 8442 - DNA, 20 bp, Homo sapiens
gtagagtgcttagttgaaca

SEQ ID NO: 8443 - DNA, 25 bp, Homo sapiens
gtagagtgcttagttgaacagggcc

SEQ ID NO: 8444 - DNA, 26 bp, Homo sapiens
gtagagtgcttagttgaacagggccc

SEQ ID NO: 8445 - DNA, 27 bp, Homo sapiens
gtagagtgcttagttgaacagggccct

SEQ ID NO: 8446 - DNA, 31 bp, Homo sapiens
gtagagtgcttagttgaacagggccctgaag

SEQ ID NO: 8447 - DNA, 24 bp, Homo sapiens
tagagtgcttagttgaacagggcc

SEQ ID NO: 8448 - DNA, 25 bp, Homo sapiens
tagagtgcttagttgaacagggccc

SEQ ID NO: 8449 - DNA, 26 bp, Homo sapiens
tagagtgcttagttgaacagggccct

SEQ ID NO: 8450 - DNA, 30 bp, Homo sapiens
tagagtgcttagttgaacagggccctgaag

SEQ ID NO: 8451 - DNA, 31 bp, Homo sapiens
tagagtgcttagttgaacagggccctgaagc

SEQ ID NO: 8452 - DNA, 24 bp, Homo sapiens
agagtgcttagttgaacagggccc

SEQ ID NO: 8453 - DNA, 25 bp, Homo sapiens
agagtgcttagttgaacagggccct

SEQ ID NO: 8454 - DNA, 17 bp, Homo sapiens
gagtgcttagttgaaca

SEQ ID NO: 8455 - DNA, 22 bp, Homo sapiens
gagtgcttagttgaacagggcc

SEQ ID NO: 8456 - DNA, 23 bp, Homo sapiens
gagtgcttagttgaacagggccc

SEQ ID NO: 8457 - DNA, 24 bp, Homo sapiens
gagtgcttagttgaacagggccct

SEQ ID NO: 8458 - DNA, 28 bp, Homo sapiens
gagtgcttagttgaacagggccctgaag

SEQ ID NO: 8459 - DNA, 29 bp, Homo sapiens
gagtgcttagttgaacagggccctgaagc

SEQ ID NO: 8460 - DNA, 22 bp, Homo sapiens
agtgcttagttgaacagggccc

SEQ ID NO: 8461 - DNA, 23 bp, Homo sapiens
agtgcttagttgaacagggccct

SEQ ID NO: 8462 - DNA, 20 bp, Homo sapiens
gtgcttagttgaacagggcc

SEQ ID NO: 8463 - DNA, 21 bp, Homo sapiens
gtgcttagttgaacagggccc

SEQ ID NO: 8464 - DNA, 22 bp, Homo sapiens
gtgcttagttgaacagggccct

SEQ ID NO: 8465 - DNA, 26 bp, Homo sapiens
gtgcttagttgaacagggccctgaag

SEQ ID NO: 8466 - DNA, 27 bp, Homo sapiens
gtgcttagttgaacagggccctgaagc

SEQ ID NO: 8467 - DNA, 20 bp, Homo sapiens
tgcttagttgaacagggccc

SEQ ID NO: 8468 - DNA, 21 bp, Homo sapiens
tgcttagttgaacagggccct

SEQ ID NO: 8469 - DNA, 24 bp, Homo sapiens
tgcttagttgaacagggccctgaa

SEQ ID NO: 8470 - DNA, 25 bp, Homo sapiens
tgcttagttgaacagggccctgaag

SEQ ID NO: 8471 - DNA, 26 bp, Homo sapiens
tgcttagttgaacagggccctgaagc

SEQ ID NO: 8472 - DNA, 20 bp, Homo sapiens
gcttagttgaacagggccct

SEQ ID NO: 8473 - DNA, 25 bp, Homo sapiens
gcttagttgaacagggccctgaagc

SEQ ID NO: 8474 - DNA, 17 bp, Homo sapiens
cttagttgaacagggcc

SEQ ID NO: 8475 - DNA, 18 bp, Homo sapiens
cttagttgaacagggccc

SEQ ID NO: 8476 - DNA, 19 bp, Homo sapiens
cttagttgaacagggccct

SEQ ID NO: 8477 - DNA, 21 bp, Homo sapiens
cttagttgaacagggccctga

SEQ ID NO: 8478 - DNA, 22 bp, Homo sapiens
cttagttgaacagggccctgaa

SEQ ID NO: 8479 - DNA, 23 bp, Homo sapiens
cttagttgaacagggccctgaag

SEQ ID NO: 8480 - DNA, 16 bp, Homo sapiens
ttagttgaacagggcc

SEQ ID NO: 8481 - DNA, 17 bp, Homo sapiens
ttagttgaacagggccc

SEQ ID NO: 8482 - DNA, 18 bp, Homo sapiens
ttagttgaacagggccct

SEQ ID NO: 8483 - DNA, 21 bp, Homo sapiens
ttagttgaacagggccctgaa

SEQ ID NO: 8484 - DNA, 22 bp, Homo sapiens
ttagttgaacagggccctgaag

SEQ ID NO: 8485 - DNA, 16 bp, Homo sapiens
tagttgaacagggccc

SEQ ID NO: 8486 - DNA, 17 bp, Homo sapiens
tagttgaacagggccct

SEQ ID NO: 8487 - DNA, 18 bp, Homo sapiens
tagttgaacagggccctg

SEQ ID NO: 8488 - DNA, 19 bp, Homo sapiens
tagttgaacagggccctga

SEQ ID NO: 8489 - DNA, 20 bp, Homo sapiens
tagttgaacagggccctgaa

SEQ ID NO: 8490 - DNA, 21 bp, Homo sapiens
tagttgaacagggccctgaag

SEQ ID NO: 8491 - DNA, 22 bp, Homo sapiens
tagttgaacagggccctgaagc

SEQ ID NO: 8492 - DNA, 24 bp, Homo sapiens
tagttgaacagggccctgaagcgc

SEQ ID NO: 8493 - DNA, 25 bp, Homo sapiens
tagttgaacagggccctgaagcgcg

SEQ ID NO: 8494 - DNA, 29 bp, Homo sapiens
tagttgaacagggccctgaagcgcgtaca

SEQ ID NO: 8495 - DNA, 33 bp, Homo sapiens
tagttgaacagggccctgaagcgcgtacacacc

SEQ ID NO: 8496 - DNA, 36 bp, Homo sapiens
tagttgaacagggccctgaagcgcgtacacaccgcc

SEQ ID NO: 8497 - DNA, 37 bp, Homo sapiens
tagttgaacagggccctgaagcgcgtacacaccgccc

SEQ ID NO: 8498 - DNA, 44 bp, Homo sapiens
tagttgaacagggccctgaagcgcgtacacaccgcccgtcaccc

SEQ ID NO: 8499 - DNA, 16 bp, Homo sapiens
agttgaacagggccct

SEQ ID NO: 8500 - DNA, 17 bp, Homo sapiens
agttgaacagggccctg

SEQ ID NO: 8501 - DNA, 20 bp, Homo sapiens
agttgaacagggccctgaag

SEQ ID NO: 8502 - DNA, 21 bp, Homo sapiens
agttgaacagggccctgaagc

SEQ ID NO: 8503 - DNA, 19 bp, Homo sapiens
gttgaacagggccctgaag

SEQ ID NO: 8504 - DNA, 20 bp, Homo sapiens
gttgaacagggccctgaagc

SEQ ID NO: 8505 - DNA, 30 bp, Homo sapiens
ttgaacagggccctgaagcgcgtacacacc

SEQ ID NO: 8506 - DNA, 17 bp, Homo sapiens
tgaacagggccctgaag

SEQ ID NO: 8507 - DNA, 22 bp, Homo sapiens
tgaacagggccctgaagcgcgt

SEQ ID NO: 8508 - DNA, 25 bp, Homo sapiens
tgaacagggccctgaagcgcgtaca

SEQ ID NO: 8509 - DNA, 29 bp, Homo sapiens
tgaacagggccctgaagcgcgtacacacc

SEQ ID NO: 8510 - DNA, 32 bp, Homo sapiens
tgaacagggccctgaagcgcgtacacaccgcc

SEQ ID NO: 8511 - DNA, 21 bp, Homo sapiens
gaacagggccctgaagcgcgt

SEQ ID NO: 8512 - DNA, 28 bp, Homo sapiens
gaacagggccctgaagcgcgtacacacc

SEQ ID NO: 8513 - DNA, 31 bp, Homo sapiens
gaacagggccctgaagcgcgtacacaccgcc

SEQ ID NO: 8514 - DNA, 27 bp, Homo sapiens
aacagggccctgaagcgcgtacacacc

SEQ ID NO: 8515 - DNA, 30 bp, Homo sapiens
aacagggccctgaagcgcgtacacaccgcc

SEQ ID NO: 8516 - DNA, 25 bp, Homo sapiens
cagggccctgaagcgcgtacacacc

SEQ ID NO: 8517 - DNA, 28 bp, Homo sapiens
ctgaagcgcgtacacaccgcccgtcacc

SEQ ID NO: 8518 - DNA, 29 bp, Homo sapiens
ctgaagcgcgtacacaccgcccgtcaccc

SEQ ID NO: 8519 - DNA, 24 bp, Homo sapiens
agcgcgtacacaccgcccgtcacc

SEQ ID NO: 8520 - DNA, 27 bp, Homo sapiens
caccgcccgtcaccctcctcaagtata

SEQ ID NO: 8521 - DNA, 29 bp, Homo sapiens
caccgcccgtcaccctcctcaagtatact

SEQ ID NO: 8522 - DNA, 31 bp, Homo sapiens
caccgcccgtcaccctcctcaagtatacttc

SEQ ID NO: 8523 - DNA, 32 bp, Homo sapiens
caccgcccgtcaccctcctcaagtatacttca

SEQ ID NO: 8524 - DNA, 24 bp, Homo sapiens
ccgcccgtcaccctcctcaagtat

SEQ ID NO: 8525 - DNA, 33 bp, Homo sapiens
ccgcccgtcaccctcctcaagtatacttcaaag

SEQ ID NO: 8526 - DNA, 33 bp, Homo sapiens
cccgtcaccctcctcaagtatacttcaaaggac

SEQ ID NO: 8527 - DNA, 32 bp, Homo sapiens
ccgtcaccctcctcaagtatacttcaaaggac

SEQ ID NO: 8528 - DNA, 27 bp, Homo sapiens
cgtcaccctcctcaagtatacttcaaa

SEQ ID NO: 8529 - DNA, 28 bp, Homo sapiens
cgtcaccctcctcaagtatacttcaaag

SEQ ID NO: 8530 - DNA, 31 bp, Homo sapiens; identical to SEQ ID NO: 686

SEQ ID NO: 8531 - DNA, 32 bp, Homo sapiens
cgtcaccctcctcaagtatacttcaaaggaca

SEQ ID NO: 8532 - DNA, 26 bp, Homo sapiens
gtcaccctcctcaagtatacttcaaa

SEQ ID NO: 8533 - DNA, 27 bp, Homo sapiens
gtcaccctcctcaagtatacttcaaag

SEQ ID NO: 8534 - DNA, 30 bp, Homo sapiens; identical to SEQ ID NO: 687

SEQ ID NO: 8535 - DNA, 31 bp, Homo sapiens
gtcaccctcctcaagtatacttcaaaggaca

SEQ ID NO: 8536 - DNA, 25 bp, Homo sapiens
tcaccctcctcaagtatacttcaaa

SEQ ID NO: 8537 - DNA, 29 bp, Homo sapiens
tcaccctcctcaagtatacttcaaaggac

SEQ ID NO: 8538 - DNA, 30 bp, Homo sapiens
tcaccctcctcaagtatacttcaaaggaca

SEQ ID NO: 8539 - DNA, 32 bp, Homo sapiens
tcaccctcctcaagtatacttcaaaggacatt

SEQ ID NO: 8540 - DNA, 27 bp, Homo sapiens
accctcctcaagtatacttcaaaggac

SEQ ID NO: 8541 - DNA, 26 bp, Homo sapiens
ccctcctcaagtatacttcaaaggac

SEQ ID NO: 8542 - DNA, 27 bp, Homo sapiens
ccctcctcaagtatacttcaaaggaca

SEQ ID NO: 8543 - DNA, 32 bp, Homo sapiens
ccctcctcaagtatacttcaaaggacatttaa

SEQ ID NO: 8544 - DNA, 26 bp, Homo sapiens
cctcctcaagtatacttcaaaggaca

SEQ ID NO: 8545 - DNA, 24 bp, Homo sapiens
ctcctcaagtatacttcaaaggac

SEQ ID NO: 8546 - DNA, 25 bp, Homo sapiens
ctcctcaagtatacttcaaaggaca

SEQ ID NO: 8547 - DNA, 32 bp, Homo sapiens; identical to SEQ ID NO: 689

SEQ ID NO: 8548 - DNA, 39 bp, Homo sapiens
ctcctcaagtatacttcaaaggacatttaactaaaaccc

SEQ ID NO: 8549 - DNA, 24 bp, Homo sapiens
tcctcaagtatacttcaaaggaca

SEQ ID NO: 8550 - DNA, 30 bp, Homo sapiens
cctcaagtatacttcaaaggacatttaact

SEQ ID NO: 8551 - DNA, 29 bp, Homo sapiens
ctcaagtatacttcaaaggacatttaact

SEQ ID NO: 8552 - DNA, 20 bp, Homo sapiens
tcaagtatacttcaaaggac

SEQ ID NO: 8553 - DNA, 21 bp, Homo sapiens
tcaagtatacttcaaaggaca

SEQ ID NO: 8554 - DNA, 23 bp, Homo sapiens
tcaagtatacttcaaaggacatt

SEQ ID NO: 8555 - DNA, 28 bp, Homo sapiens
tcaagtatacttcaaaggacatttaact

SEQ ID NO: 8556 - DNA, 34 bp, Homo sapiens
tcaagtatacttcaaaggacatttaactaaaacc

SEQ ID NO: 8557 - DNA, 35 bp, Homo sapiens
tcaagtatacttcaaaggacatttaactaaaaccc

SEQ ID NO: 8558 - DNA, 19 bp, Homo sapiens
caagtatacttcaaaggac

SEQ ID NO: 8559 - DNA, 20 bp, Homo sapiens
caagtatacttcaaaggaca

SEQ ID NO: 8560 - DNA, 22 bp, Homo sapiens
caagtatacttcaaaggacatt

SEQ ID NO: 8561 - DNA, 27 bp, Homo sapiens
caagtatacttcaaaggacatttaact

SEQ ID NO: 8562 - DNA, 33 bp, Homo sapiens; identical to SEQ ID NO: 695

SEQ ID NO: 8563 - DNA, 34 bp, Homo sapiens
caagtatacttcaaaggacatttaactaaaaccc

SEQ ID NO: 8564 - DNA, 18 bp, Homo sapiens
aagtatacttcaaaggac

SEQ ID NO: 8565 - DNA, 19 bp, Homo sapiens
aagtatacttcaaaggaca

SEQ ID NO: 8566 - DNA, 21 bp, Homo sapiens
aagtatacttcaaaggacatt

SEQ ID NO: 8567 - DNA, 26 bp, Homo sapiens
aagtatacttcaaaggacatttaact

SEQ ID NO: 8568 - DNA, 27 bp, Homo sapiens
aagtatacttcaaaggacatttaacta

SEQ ID NO: 8569 - DNA, 32 bp, Homo sapiens; identical to SEQ ID NO: 698

SEQ ID NO: 8570 - DNA, 33 bp, Homo sapiens; identical to SEQ ID NO: 699

SEQ ID NO: 8571 - DNA, 17 bp, Homo sapiens
agtatacttcaaaggac

SEQ ID NO: 8572 - DNA, 18 bp, Homo sapiens
agtatacttcaaaggaca

SEQ ID NO: 8573 - DNA, 20 bp, Homo sapiens
agtatacttcaaaggacatt

SEQ ID NO: 8574 - DNA, 21 bp, Homo sapiens
agtatacttcaaaggacattt

SEQ ID NO: 8575 - DNA, 25 bp, Homo sapiens
agtatacttcaaaggacatttaact

SEQ ID NO: 8576 - DNA, 26 bp, Homo sapiens
agtatacttcaaaggacatttaacta

SEQ ID NO: 8577 - DNA, 27 bp, Homo sapiens
agtatacttcaaaggacatttaactaa

SEQ ID NO: 8578 - DNA, 31 bp, Homo sapiens; identical to SEQ ID NO: 705

SEQ ID NO: 8579 - DNA, 32 bp, Homo sapiens; identical to SEQ ID NO: 706

SEQ ID NO: 8580 - DNA, 33 bp, Homo sapiens; identical to SEQ ID NO: 707

SEQ ID NO: 8581 - DNA, 34 bp, Homo sapiens
agtatacttcaaaggacatttaactaaaacccct

SEQ ID NO: 8582 - DNA, 17 bp, Homo sapiens
gtatacttcaaaggaca

SEQ ID NO: 8583 - DNA, 24 bp, Homo sapiens
gtatacttcaaaggacatttaact

SEQ ID NO: 8584 - DNA, 30 bp, Homo sapiens; identical to SEQ ID NO: 709

SEQ ID NO: 8585 - DNA, 31 bp, Homo sapiens
gtatacttcaaaggacatttaactaaaaccc

SEQ ID NO: 8586 - DNA, 33 bp, Homo sapiens
gtatacttcaaaggacatttaactaaaacccct

SEQ ID NO: 8587 - DNA, 23 bp, Homo sapiens
tatacttcaaaggacatttaact

SEQ ID NO: 8588 - DNA, 29 bp, Homo sapiens
tatacttcaaaggacatttaactaaaacc

SEQ ID NO: 8589 - DNA, 30 bp, Homo sapiens; identical to SEQ ID NO: 712

SEQ ID NO: 8590 - DNA, 31 bp, Homo sapiens
tatacttcaaaggacatttaactaaaacccc

SEQ ID NO: 8591 - DNA, 32 bp, Homo sapiens
tatacttcaaaggacatttaactaaaacccct

SEQ ID NO: 8592 - DNA, 22 bp, Homo sapiens
atacttcaaaggacatttaact

SEQ ID NO: 8593 - DNA, 23 bp, Homo sapiens
atacttcaaaggacatttaacta

SEQ ID NO: 8594 - DNA, 24 bp, Homo sapiens
atacttcaaaggacatttaactaa

SEQ ID NO: 8595 - DNA, 28 bp, Homo sapiens
atacttcaaaggacatttaactaaaacc

SEQ ID NO: 8596 - DNA, 29 bp, Homo sapiens
atacttcaaaggacatttaactaaaaccc

SEQ ID NO: 8597 - DNA, 21 bp, Homo sapiens
tacttcaaaggacatttaact

SEQ ID NO: 8598 - DNA, 27 bp, Homo sapiens
tacttcaaaggacatttaactaaaacc

SEQ ID NO: 8599 - DNA, 28 bp, Homo sapiens
tacttcaaaggacatttaactaaaaccc

SEQ ID NO: 8600 - DNA, 29 bp, Homo sapiens
tacttcaaaggacatttaactaaaacccc

SEQ ID NO: 8601 - DNA, 30 bp, Homo sapiens; identical to SEQ ID NO: 719

SEQ ID NO: 8602 - DNA, 20 bp, Homo sapiens
acttcaaaggacatttaact

SEQ ID NO: 8603 - DNA, 26 bp, Homo sapiens
acttcaaaggacatttaactaaaacc

SEQ ID NO: 8604 - DNA, 27 bp, Homo sapiens
acttcaaaggacatttaactaaaaccc

SEQ ID NO: 8605 - DNA, 28 bp, Homo sapiens
acttcaaaggacatttaactaaaacccc

SEQ ID NO: 8606 - DNA, 29 bp, Homo sapiens
acttcaaaggacatttaactaaaacccct

SEQ ID NO: 8607 - DNA, 19 bp, Homo sapiens
cttcaaaggacatttaact

SEQ ID NO: 8608 - DNA, 25 bp, Homo sapiens
cttcaaaggacatttaactaaaacc

SEQ ID NO: 8609 - DNA, 26 bp, Homo sapiens
cttcaaaggacatttaactaaaaccc

SEQ ID NO: 8610 - DNA, 28 bp, Homo sapiens
cttcaaaggacatttaactaaaacccct

SEQ ID NO: 8611 - DNA, 18 bp, Homo sapiens
ttcaaaggacatttaact

SEQ ID NO: 8612 - DNA, 24 bp, Homo sapiens
ttcaaaggacatttaactaaaacc

SEQ ID NO: 8613 - DNA, 25 bp, Homo sapiens
ttcaaaggacatttaactaaaaccc

SEQ ID NO: 8614 - DNA, 26 bp, Homo sapiens
ttcaaaggacatttaactaaaacccc

SEQ ID NO: 8615 - DNA, 27 bp, Homo sapiens
ttcaaaggacatttaactaaaacccct

SEQ ID NO: 8616 - DNA, 17 bp, Homo sapiens
tcaaaggacatttaact

SEQ ID NO: 8617 - DNA, 23 bp, Homo sapiens
tcaaaggacatttaactaaaacc

SEQ ID NO: 8618 - DNA, 24 bp, Homo sapiens
tcaaaggacatttaactaaaaccc

SEQ ID NO: 8619 - DNA, 25 bp, Homo sapiens
tcaaaggacatttaactaaaacccc

SEQ ID NO: 8620 - DNA, 26 bp, Homo sapiens
tcaaaggacatttaactaaaacccct

SEQ ID NO: 8621 - DNA, 16 bp, Homo sapiens
caaaggacatttaact

SEQ ID NO: 8622 - DNA, 22 bp, Homo sapiens
caaaggacatttaactaaaacc

SEQ ID NO: 8623 - DNA, 23 bp, Homo sapiens
caaaggacatttaactaaaaccc

SEQ ID NO: 8624 - DNA, 24 bp, Homo sapiens
caaaggacatttaactaaaacccc

SEQ ID NO: 8625 - DNA, 25 bp, Homo sapiens
caaaggacatttaactaaaacccct

SEQ ID NO: 8626 - DNA, 30 bp, Homo sapiens
caaaggacatttaactaaaacccctacgca

SEQ ID NO: 8627 - DNA, 16 bp, Homo sapiens
aaaggacatttaacta

SEQ ID NO: 8628 - DNA, 17 bp, Homo sapiens
aaaggacatttaactaa

SEQ ID NO: 8629 - DNA, 21 bp, Homo sapiens
aaaggacatttaactaaaacc

SEQ ID NO: 8630 - DNA, 22 bp, Homo sapiens
aaaggacatttaactaaaaccc

SEQ ID NO: 8631 - DNA, 23 bp, Homo sapiens
aaaggacatttaactaaaacccc

SEQ ID NO: 8632 - DNA, 24 bp, Homo sapiens
aaaggacatttaactaaaacccct

SEQ ID NO: 8633 - DNA, 29 bp, Homo sapiens
aaaggacatttaactaaaacccctacgca

SEQ ID NO: 8634 - DNA, 16 bp, Homo sapiens
aaggacatttaactaa

SEQ ID NO: 8635 - DNA, 17 bp, Homo sapiens
aaggacatttaactaaa

SEQ ID NO: 8636 - DNA, 18 bp, Homo sapiens
aaggacatttaactaaaa

SEQ ID NO: 8637 - DNA, 20 bp, Homo sapiens
aaggacatttaactaaaacc

SEQ ID NO: 8638 - DNA, 21 bp, Homo sapiens
aaggacatttaactaaaaccc

SEQ ID NO: 8639 - DNA, 22 bp, Homo sapiens
aaggacatttaactaaaacccc

SEQ ID NO: 8640 - DNA, 23 bp, Homo sapiens
aaggacatttaactaaaacccct

SEQ ID NO: 8641 - DNA, 28 bp, Homo sapiens
aaggacatttaactaaaacccctacgca

SEQ ID NO: 8642 - DNA, 19 bp, Homo sapiens
aggacatttaactaaaacc

SEQ ID NO: 8643 - DNA, 20 bp, Homo sapiens
aggacatttaactaaaaccc

SEQ ID NO: 8644 - DNA, 21 bp, Homo sapiens
aggacatttaactaaaacccc

SEQ ID NO: 8645 - DNA, 22 bp, Homo sapiens
aggacatttaactaaaacccct

SEQ ID NO: 8646 - DNA, 18 bp, Homo sapiens
ggacatttaactaaaacc

SEQ ID NO: 8647 - DNA, 19 bp, Homo sapiens
ggacatttaactaaaaccc

SEQ ID NO: 8648 - DNA, 20 bp, Homo sapiens
ggacatttaactaaaacccc

SEQ ID NO: 8649 - DNA, 38 bp, Homo sapiens
aaaacccctacgcatttatatagaggagacaagtcgta

SEQ ID NO: 8650 - DNA, 40 bp, Homo sapiens
aaaacccctacgcatttatatagaggagacaagtcgtaac

SEQ ID NO: 8651 - DNA, 41 bp, Homo sapiens
aaaacccctacgcatttatatagaggagacaagtcgtaaca

SEQ ID NO: 8652 - DNA, 43 bp, Homo sapiens
aaaacccctacgcatttatatagaggagacaagtcgtaacatg

SEQ ID NO: 8653 - DNA, 39 bp, Homo sapiens
aaacccctacgcatttatatagaggagacaagtcgtaac

SEQ ID NO: 8654 - DNA, 40 bp, Homo sapiens
aaacccctacgcatttatatagaggagacaagtcgtaaca

SEQ ID NO: 8655 - DNA, 24 bp, Homo sapiens
cctacgcatttatatagaggagac

SEQ ID NO: 8656 - DNA, 25 bp, Homo sapiens
cctacgcatttatatagaggagaca

SEQ ID NO: 8657 - DNA, 29 bp, Homo sapiens
cctacgcatttatatagaggagacaagtc

SEQ ID NO: 8658 - DNA, 30 bp, Homo sapiens
cctacgcatttatatagaggagacaagtcg

SEQ ID NO: 8659 - DNA, 31 bp, Homo sapiens
cctacgcatttatatagaggagacaagtcgt

SEQ ID NO: 8660 - DNA, 32 bp, Homo sapiens; identical to SEQ ID NO: 752

SEQ ID NO: 8661 - DNA, 33 bp, Homo sapiens
cctacgcatttatatagaggagacaagtcgtaa

SEQ ID NO: 8662 - DNA, 34 bp, Homo sapiens
cctacgcatttatatagaggagacaagtcgtaac

SEQ ID NO: 8663 - DNA, 35 bp, Homo sapiens
cctacgcatttatatagaggagacaagtcgtaaca

SEQ ID NO: 8664 - DNA, 37 bp, Homo sapiens
cctacgcatttatatagaggagacaagtcgtaacatg

SEQ ID NO: 8665 - DNA, 23 bp, Homo sapiens
ctacgcatttatatagaggagac

SEQ ID NO: 8666 - DNA, 24 bp, Homo sapiens
ctacgcatttatatagaggagaca

SEQ ID NO: 8667 - DNA, 25 bp, Homo sapiens
ctacgcatttatatagaggagacaa

SEQ ID NO: 8668 - DNA, 26 bp, Homo sapiens
ctacgcatttatatagaggagacaag

SEQ ID NO: 8669 - DNA, 28 bp, Homo sapiens
ctacgcatttatatagaggagacaagtc

SEQ ID NO: 8670 - DNA, 29 bp, Homo sapiens
ctacgcatttatatagaggagacaagtcg

SEQ ID NO: 8671 - DNA, 30 bp, Homo sapiens
ctacgcatttatatagaggagacaagtcgt

SEQ ID NO: 8672 - DNA, 31 bp, Homo sapiens; identical to SEQ ID NO: 756

SEQ ID NO: 8673 - DNA, 33 bp, Homo sapiens; identical to SEQ ID NO: 757

SEQ ID NO: 8674 - DNA, 34 bp, Homo sapiens
ctacgcatttatatagaggagacaagtcgtaaca

SEQ ID NO: 8675 - DNA, 22 bp, Homo sapiens
tacgcatttatatagaggagac

SEQ ID NO: 8676 - DNA, 23 bp, Homo sapiens
tacgcatttatatagaggagaca

SEQ ID NO: 8677 - DNA, 24 bp, Homo sapiens
tacgcatttatatagaggagacaa

SEQ ID NO: 8678 - DNA, 25 bp, Homo sapiens
tacgcatttatatagaggagacaag

SEQ ID NO: 8679 - DNA, 27 bp, Homo sapiens
tacgcatttatatagaggagacaagtc

SEQ ID NO: 8680 - DNA, 28 bp, Homo sapiens
tacgcatttatatagaggagacaagtcg

SEQ ID NO: 8681 - DNA, 29 bp, Homo sapiens
tacgcatttatatagaggagacaagtcgt

SEQ ID NO: 8682 - DNA, 30 bp, Homo sapiens
tacgcatttatatagaggagacaagtcgta

SEQ ID NO: 8683 - DNA, 32 bp, Homo sapiens; identical to SEQ ID NO: 761

SEQ ID NO: 8684 - DNA, 33 bp, Homo sapiens; identical to SEQ ID NO: 762

SEQ ID NO: 8685 - DNA, 21 bp, Homo sapiens
acgcatttatatagaggagac

SEQ ID NO: 8686 - DNA, 22 bp, Homo sapiens
acgcatttatatagaggagaca

SEQ ID NO: 8687 - DNA, 23 bp, Homo sapiens
acgcatttatatagaggagacaa

SEQ ID NO: 8688 - DNA, 26 bp, Homo sapiens
acgcatttatatagaggagacaagtc

SEQ ID NO: 8689 - DNA, 29 bp, Homo sapiens
acgcatttatatagaggagacaagtcgta

SEQ ID NO: 8690 - DNA, 31 bp, Homo sapiens
acgcatttatatagaggagacaagtcgtaac

SEQ ID NO: 8691 - DNA, 32 bp, Homo sapiens
acgcatttatatagaggagacaagtcgtaaca

SEQ ID NO: 8692 - DNA, 34 bp, Homo sapiens
acgcatttatatagaggagacaagtcgtaacatg

SEQ ID NO: 8693 - DNA, 20 bp, Homo sapiens
cgcatttatatagaggagac

SEQ ID NO: 8694 - DNA, 21 bp, Homo sapiens
cgcatttatatagaggagaca

SEQ ID NO: 8695 - DNA, 25 bp, Homo sapiens
cgcatttatatagaggagacaagtc

SEQ ID NO: 8696 - DNA, 28 bp, Homo sapiens
cgcatttatatagaggagacaagtcgta

SEQ ID NO: 8697 - DNA, 30 bp, Homo sapiens; identical to SEQ ID NO: 766

SEQ ID NO: 8698 - DNA, 31 bp, Homo sapiens; identical to SEQ ID NO: 767

SEQ ID NO: 8699 - DNA, 32 bp, Homo sapiens
cgcatttatatagaggagacaagtcgtaacat

SEQ ID NO: 8700 - DNA, 33 bp, Homo sapiens; identical to SEQ ID NO: 768

SEQ ID NO: 8701 - DNA, 19 bp, Homo sapiens
gcatttatatagaggagac

SEQ ID NO: 8702 - DNA, 20 bp, Homo sapiens
gcatttatatagaggagaca

SEQ ID NO: 8703 - DNA, 24 bp, Homo sapiens
gcatttatatagaggagacaagtc

SEQ ID NO: 8704 - DNA, 29 bp, Homo sapiens
gcatttatatagaggagacaagtcgtaac

SEQ ID NO: 8705 - DNA, 30 bp, Homo sapiens; identical to SEQ ID NO: 770

SEQ ID NO: 8706 - DNA, 32 bp, Homo sapiens; identical to SEQ ID NO: 771

SEQ ID NO: 8707 - DNA, 18 bp, Homo sapiens
catttatatagaggagac

SEQ ID NO: 8708 - DNA, 19 bp, Homo sapiens
catttatatagaggagaca

SEQ ID NO: 8709 - DNA, 23 bp, Homo sapiens
catttatatagaggagacaagtc

SEQ ID NO: 8710 - DNA, 26 bp, Homo sapiens
catttatatagaggagacaagtcgta

SEQ ID NO: 8711 - DNA, 28 bp, Homo sapiens
catttatatagaggagacaagtcgtaac

SEQ ID NO: 8712 - DNA, 29 bp, Homo sapiens
catttatatagaggagacaagtcgtaaca

SEQ ID NO: 8713 - DNA, 30 bp, Homo sapiens
catttatatagaggagacaagtcgtaacat

SEQ ID NO: 8714 - DNA, 31 bp, Homo sapiens; identical to SEQ ID NO: 775

SEQ ID NO: 8715 - DNA, 22 bp, Homo sapiens
atttatatagaggagacaagtc

SEQ ID NO: 8716 - DNA, 27 bp, Homo sapiens
atttatatagaggagacaagtcgtaac

SEQ ID NO: 8717 - DNA, 28 bp, Homo sapiens
atttatatagaggagacaagtcgtaaca

SEQ ID NO: 8718 - DNA, 30 bp, Homo sapiens
atttatatagaggagacaagtcgtaacatg

SEQ ID NO: 8719 - DNA, 31 bp, Homo sapiens
atttatatagaggagacaagtcgtaacatgg

SEQ ID NO: 8720 - DNA, 16 bp, Homo sapiens
tttatatagaggagac

SEQ ID NO: 8721 - DNA, 17 bp, Homo sapiens
tttatatagaggagaca

SEQ ID NO: 8722 - DNA, 21 bp, Homo sapiens
tttatatagaggagacaagtc

SEQ ID NO: 8723 - DNA, 24 bp, Homo sapiens
tttatatagaggagacaagtcgta

SEQ ID NO: 8724 - DNA, 25 bp, Homo sapiens
tttatatagaggagacaagtcgtaa

SEQ ID NO: 8725 - DNA, 26 bp, Homo sapiens
tttatatagaggagacaagtcgtaac

SEQ ID NO: 8726 - DNA, 27 bp, Homo sapiens
tttatatagaggagacaagtcgtaaca

SEQ ID NO: 8727 - DNA, 28 bp, Homo sapiens
tttatatagaggagacaagtcgtaacat

SEQ ID NO: 8728 - DNA, 29 bp, Homo sapiens
tttatatagaggagacaagtcgtaacatg

SEQ ID NO: 8729 - DNA, 31 bp, Homo sapiens
tttatatagaggagacaagtcgtaacatggt

SEQ ID NO: 8730 - DNA, 32 bp, Homo sapiens
tttatatagaggagacaagtcgtaacatggta

SEQ ID NO: 8731 - DNA, 16 bp, Homo sapiens
ttatatagaggagaca

SEQ ID NO: 8732 - DNA, 20 bp, Homo sapiens
ttatatagaggagacaagtc

SEQ ID NO: 8733 - DNA, 25 bp, Homo sapiens
ttatatagaggagacaagtcgtaac

SEQ ID NO: 8734 - DNA, 26 bp, Homo sapiens
ttatatagaggagacaagtcgtaaca

SEQ ID NO: 8735 - DNA, 28 bp, Homo sapiens
ttatatagaggagacaagtcgtaacatg

SEQ ID NO: 8736 - DNA, 19 bp, Homo sapiens
tatatagaggagacaagtc

SEQ ID NO: 8737 - DNA, 22 bp, Homo sapiens
tatatagaggagacaagtcgta

SEQ ID NO: 8738 - DNA, 24 bp, Homo sapiens
tatatagaggagacaagtcgtaac

SEQ ID NO: 8739 - DNA, 25 bp, Homo sapiens
tatatagaggagacaagtcgtaaca

SEQ ID NO: 8740 - DNA, 27 bp, Homo sapiens
tatatagaggagacaagtcgtaacatg

SEQ ID NO: 8741 - DNA, 18 bp, Homo sapiens
atatagaggagacaagtc

SEQ ID NO: 8742 - DNA, 21 bp, Homo sapiens
atatagaggagacaagtcgta

SEQ ID NO: 8743 - DNA, 22 bp, Homo sapiens
atatagaggagacaagtcgtaa

SEQ ID NO: 8744 - DNA, 23 bp, Homo sapiens
atatagaggagacaagtcgtaac

SEQ ID NO: 8745 - DNA, 24 bp, Homo sapiens
atatagaggagacaagtcgtaaca

SEQ ID NO: 8746 - DNA, 25 bp, Homo sapiens
atatagaggagacaagtcgtaacat

SEQ ID NO: 8747 - DNA, 26 bp, Homo sapiens
atatagaggagacaagtcgtaacatg

SEQ ID NO: 8748 - DNA, 29 bp, Homo sapiens
atatagaggagacaagtcgtaacatggta

SEQ ID NO: 8749 - DNA, 33 bp, Homo sapiens
atatagaggagacaagtcgtaacatggtaagtg

SEQ ID NO: 8750 - DNA, 17 bp, Homo sapiens
tatagaggagacaagtc

SEQ ID NO: 8751 - DNA, 20 bp, Homo sapiens
tatagaggagacaagtcgta

SEQ ID NO: 8752 - DNA, 22 bp, Homo sapiens
tatagaggagacaagtcgtaac

SEQ ID NO: 8753 - DNA, 23 bp, Homo sapiens
tatagaggagacaagtcgtaaca

SEQ ID NO: 8754 - DNA, 24 bp, Homo sapiens
tatagaggagacaagtcgtaacat

SEQ ID NO: 8755 - DNA, 25 bp, Homo sapiens
tatagaggagacaagtcgtaacatg

SEQ ID NO: 8756 - DNA, 16 bp, Homo sapiens
atagaggagacaagtc

SEQ ID NO: 8757 - DNA, 19 bp, Homo sapiens
atagaggagacaagtcgta

SEQ ID NO: 8758 - DNA, 21 bp, Homo sapiens
atagaggagacaagtcgtaac

SEQ ID NO: 8759 - DNA, 22 bp, Homo sapiens
atagaggagacaagtcgtaaca

SEQ ID NO: 8760 - DNA, 23 bp, Homo sapiens
atagaggagacaagtcgtaacat

SEQ ID NO: 8761 - DNA, 24 bp, Homo sapiens
atagaggagacaagtcgtaacatg

SEQ ID NO: 8762 - DNA, 18 bp, Homo sapiens
tagaggagacaagtcgta

SEQ ID NO: 8763 - DNA, 20 bp, Homo sapiens
tagaggagacaagtcgtaac

SEQ ID NO: 8764 - DNA, 21 bp, Homo sapiens
tagaggagacaagtcgtaaca

SEQ ID NO: 8765 - DNA, 23 bp, Homo sapiens
tagaggagacaagtcgtaacatg

SEQ ID NO: 8766 - DNA, 33 bp, Homo sapiens; identical to SEQ ID NO: 807

SEQ ID NO: 8767 - DNA, 19 bp, Homo sapiens
agaggagacaagtcgtaac

SEQ ID NO: 8768 - DNA, 20 bp, Homo sapiens
agaggagacaagtcgtaaca

SEQ ID NO: 8769 - DNA, 22 bp, Homo sapiens
agaggagacaagtcgtaacatg

SEQ ID NO: 8770 - DNA, 31 bp, Homo sapiens
agaggagacaagtcgtaacatggtaagtgta

SEQ ID NO: 8771 - DNA, 32 bp, Homo sapiens
agaggagacaagtcgtaacatggtaagtgtac

SEQ ID NO: 8772 - DNA, 18 bp, Homo sapiens
gaggagacaagtcgtaac

SEQ ID NO: 8773 - DNA, 19 bp, Homo sapiens
gaggagacaagtcgtaaca

SEQ ID NO: 8774 - DNA, 21 bp, Homo sapiens
gaggagacaagtcgtaacatg

SEQ ID NO: 8775 - DNA, 31 bp, Homo sapiens
gaggagacaagtcgtaacatggtaagtgtac

SEQ ID NO: 8776 - DNA, 18 bp, Homo sapiens
aggagacaagtcgtaaca

SEQ ID NO: 8777 - DNA, 33 bp, Homo sapiens
tcgtaacatggtaagtgtactggaaagtgcact

SEQ ID NO: 8778 - DNA, 32 bp, Homo sapiens; identical to SEQ ID NO: 813

SEQ ID NO: 8779 - DNA, 36 bp, Homo sapiens
gtaacatggtaagtgtactggaaagtgcacttggac

SEQ ID NO: 8780 - DNA, 37 bp, Homo sapiens
gtaacatggtaagtgtactggaaagtgcacttggacg

SEQ ID NO: 8781 - DNA, 36 bp, Homo sapiens
taacatggtaagtgtactggaaagtgcacttggacg

SEQ ID NO: 8782 - DNA, 35 bp, Homo sapiens
aacatggtaagtgtactggaaagtgcacttggacg

SEQ ID NO: 8783 - DNA, 33 bp, Homo sapiens; identical to SEQ ID NO: 814

SEQ ID NO: 8784 - DNA, 34 bp, Homo sapiens
acatggtaagtgtactggaaagtgcacttggacg

SEQ ID NO: 8785 - DNA, 32 bp, Homo sapiens
catggtaagtgtactggaaagtgcacttggac

SEQ ID NO: 8786 - DNA, 33 bp, Homo sapiens; identical to SEQ ID NO: 815

SEQ ID NO: 8787 - DNA, 31 bp, Homo sapiens
atggtaagtgtactggaaagtgcacttggac

SEQ ID NO: 8788 - DNA, 32 bp, Homo sapiens
atggtaagtgtactggaaagtgcacttggacg

SEQ ID NO: 8789 - DNA, 30 bp, Homo sapiens
tggtaagtgtactggaaagtgcacttggac

SEQ ID NO: 8790 - DNA, 31 bp, Homo sapiens
tggtaagtgtactggaaagtgcacttggacg

SEQ ID NO: 8791 - DNA, 29 bp, Homo sapiens
ggtaagtgtactggaaagtgcacttggac

SEQ ID NO: 8792 - DNA, 30 bp, Homo sapiens
ggtaagtgtactggaaagtgcacttggacg

SEQ ID NO: 8793 - DNA, 29 bp, Homo sapiens
gtaagtgtactggaaagtgcacttggacg

SEQ ID NO: 8794 - DNA, 23 bp, Homo sapiens
tgtactggaaagtgcacttggac

SEQ ID NO: 8795 - DNA, 21 bp, Homo sapiens
tactggaaagtgcacttggac

SEQ ID NO: 8796 - DNA, 22 bp, Homo sapiens
tactggaaagtgcacttggacg

SEQ ID NO: 8797 - DNA, 24 bp, Homo sapiens
tactggaaagtgcacttggacgaa

SEQ ID NO: 8798 - DNA, 25 bp, Homo sapiens
tactggaaagtgcacttggacgaac

SEQ ID NO: 8799 - DNA, 20 bp, Homo sapiens
actggaaagtgcacttggac

SEQ ID NO: 8800 - DNA, 21 bp, Homo sapiens
actggaaagtgcacttggacg

SEQ ID NO: 8801 - DNA, 24 bp, Homo sapiens
actggaaagtgcacttggacgaac

SEQ ID NO: 8802 - DNA, 25 bp, Homo sapiens
actggaaagtgcacttggacgaacc

SEQ ID NO: 8803 - DNA, 19 bp, Homo sapiens
ctggaaagtgcacttggac

SEQ ID NO: 8804 - DNA, 20 bp, Homo sapiens
ctggaaagtgcacttggacg

SEQ ID NO: 8805 - DNA, 22 bp, Homo sapiens
ctggaaagtgcacttggacgaa

SEQ ID NO: 8806 - DNA, 23 bp, Homo sapiens
ctggaaagtgcacttggacgaac

SEQ ID NO: 8807 - DNA, 18 bp, Homo sapiens
tggaaagtgcacttggac

SEQ ID NO: 8808 - DNA, 19 bp, Homo sapiens
tggaaagtgcacttggacg

SEQ ID NO: 8809 - DNA, 17 bp, Homo sapiens
ggaaagtgcacttggac

SEQ ID NO: 8810 - DNA, 18 bp, Homo sapiens
ggaaagtgcacttggacg

SEQ ID NO: 8811 - DNA, 16 bp, Homo sapiens
gaaagtgcacttggac

SEQ ID NO: 8812 - DNA, 16 bp, Homo sapiens
gctaaacctagcccca

SEQ ID NO: 8813 - DNA, 20 bp, Homo sapiens
gctaaacctagccccaaacc

SEQ ID NO: 8814 - DNA, 21 bp, Homo sapiens
gctaaacctagccccaaaccc

SEQ ID NO: 8815 - DNA, 22 bp, Homo sapiens
gctaaacctagccccaaaccca

SEQ ID NO: 8816 - DNA, 23 bp, Homo sapiens
gctaaacctagccccaaacccac

SEQ ID NO: 8817 - DNA, 24 bp, Homo sapiens
gctaaacctagccccaaacccact

SEQ ID NO: 8818 - DNA, 25 bp, Homo sapiens
gctaaacctagccccaaacccactc

SEQ ID NO: 8819 - DNA, 26 bp, Homo sapiens
gctaaacctagccccaaacccactcc

SEQ ID NO: 8820 - DNA, 27 bp, Homo sapiens
gctaaacctagccccaaacccactcca

SEQ ID NO: 8821 - DNA, 28 bp, Homo sapiens
gctaaacctagccccaaacccactccac

SEQ ID NO: 8822 - DNA, 29 bp, Homo sapiens
gctaaacctagccccaaacccactccacc

SEQ ID NO: 8823 - DNA, 30 bp, Homo sapiens; identical to SEQ ID NO: 832

SEQ ID NO: 8824 - DNA, 31 bp, Homo sapiens; identical to SEQ ID NO: 833

SEQ ID NO: 8825 - DNA, 32 bp, Homo sapiens; identical to SEQ ID NO: 834

SEQ ID NO: 8826 - DNA, 33 bp, Homo sapiens; identical to SEQ ID NO: 835

SEQ ID NO: 8827 - DNA, 34 bp, Homo sapiens
gctaaacctagccccaaacccactccaccttact

SEQ ID NO: 8828 - DNA, 35 bp, Homo sapiens
gctaaacctagccccaaacccactccaccttacta

SEQ ID NO: 8829 - DNA, 36 bp, Homo sapiens
gctaaacctagccccaaacccactccaccttactac

SEQ ID NO: 8830 - DNA, 37 bp, Homo sapiens
gctaaacctagccccaaacccactccaccttactacc

SEQ ID NO: 8831 - DNA, 38 bp, Homo sapiens
gctaaacctagccccaaacccactccaccttactacca

SEQ ID NO: 8832 - DNA, 39 bp, Homo sapiens
gctaaacctagccccaaacccactccaccttactaccag

SEQ ID NO: 8833 - DNA, 40 bp, Homo sapiens
gctaaacctagccccaaacccactccaccttactaccaga

SEQ ID NO: 8834 - DNA, 41 bp, Homo sapiens
gctaaacctagccccaaacccactccaccttactaccagac

SEQ ID NO: 8835 - DNA, 42 bp, Homo sapiens
gctaaacctagccccaaacccactccaccttactaccagaca

SEQ ID NO: 8836 - DNA, 43 bp, Homo sapiens
gctaaacctagccccaaacccactccaccttactaccagacaa

SEQ ID NO: 8837 - DNA, 44 bp, Homo sapiens
gctaaacctagccccaaacccactccaccttactaccagacaac

SEQ ID NO: 8838 - DNA, 45 bp, Homo sapiens
gctaaacctagccccaaacccactccaccttactaccagacaacc

SEQ ID NO: 8839 - DNA, 46 bp, Homo sapiens
gctaaacctagccccaaacccactccaccttactaccagacaacct

SEQ ID NO: 8840 - DNA, 47 bp, Homo sapiens
gctaaacctagccccaaacccactccaccttactaccagacaacctt

SEQ ID NO: 8841 - DNA, 28 bp, Homo sapiens
ctaaacctagccccaaacccactccacc

SEQ ID NO: 8842 - DNA, 26 bp, Homo sapiens
aaacctagccccaaacccactccacc

SEQ ID NO: 8843 - DNA, 31 bp, Homo sapiens
aaacctagccccaaacccactccaccttact

SEQ ID NO: 8844 - DNA, 34 bp, Homo sapiens
aaacctagccccaaacccactccaccttactacc

SEQ ID NO: 8845 - DNA, 33 bp, Homo sapiens
aacctagccccaaacccactccaccttactacc

SEQ ID NO: 8846 - DNA, 33 bp, Homo sapiens
acctagccccaaacccactccaccttactacca

SEQ ID NO: 8847 - DNA, 31 bp, Homo sapiens
cctagccccaaacccactccaccttactacc

SEQ ID NO: 8848 - DNA, 31 bp, Homo sapiens
ctagccccaaacccactccaccttactacca

SEQ ID NO: 8849 - DNA, 21 bp, Homo sapiens
tagccccaaacccactccacc

SEQ ID NO: 8850 - DNA, 22 bp, Homo sapiens
tagccccaaacccactccacct

SEQ ID NO: 8851 - DNA, 26 bp, Homo sapiens
tagccccaaacccactccaccttact

SEQ ID NO: 8852 - DNA, 29 bp, Homo sapiens
tagccccaaacccactccaccttactacc

SEQ ID NO: 8853 - DNA, 30 bp, Homo sapiens
tagccccaaacccactccaccttactacca

SEQ ID NO: 8854 - DNA, 32 bp, Homo sapiens
tagccccaaacccactccaccttactaccaga

SEQ ID NO: 8855 - DNA, 33 bp, Homo sapiens; identical to SEQ ID NO: 838

SEQ ID NO: 8856 - DNA, 37 bp, Homo sapiens
tagccccaaacccactccaccttactaccagacaacc

SEQ ID NO: 8857 - DNA, 43 bp, Homo sapiens
tagccccaaacccactccaccttactaccagacaaccttagcc

SEQ ID NO: 8858 - DNA, 20 bp, Homo sapiens
agccccaaacccactccacc

SEQ ID NO: 8859 - DNA, 21 bp, Homo sapiens
agccccaaacccactccacct

SEQ ID NO: 8860 - DNA, 25 bp, Homo sapiens
agccccaaacccactccaccttact

SEQ ID NO: 8861 - DNA, 28 bp, Homo sapiens
agccccaaacccactccaccttactacc

SEQ ID NO: 8862 - DNA, 29 bp, Homo sapiens
agccccaaacccactccaccttactacca

SEQ ID NO: 8863 - DNA, 32 bp, Homo sapiens
agccccaaacccactccaccttactaccagac

SEQ ID NO: 8864 - DNA, 33 bp, Homo sapiens
agccccaaacccactccaccttactaccagaca

SEQ ID NO: 8865 - DNA, 36 bp, Homo sapiens
agccccaaacccactccaccttactaccagacaacc

SEQ ID NO: 8866 - DNA, 42 bp, Homo sapiens
agccccaaacccactccaccttactaccagacaaccttagcc

SEQ ID NO: 8867 - DNA, 16 bp, Homo sapiens
ccaaacccactccacc

SEQ ID NO: 8868 - DNA, 24 bp, Homo sapiens
ccaaacccactccaccttactacc

SEQ ID NO: 8869 - DNA, 32 bp, Homo sapiens
ccaaacccactccaccttactaccagacaacc

SEQ ID NO: 8870 - DNA, 16 bp, Homo sapiens
caaacccactccacct

SEQ ID NO: 8871 - DNA, 23 bp, Homo sapiens
caaacccactccaccttactacc

SEQ ID NO: 8872 - DNA, 24 bp, Homo sapiens
caaacccactccaccttactacca

SEQ ID NO: 8873 - DNA, 27 bp, Homo sapiens
caaacccactccaccttactaccagac

SEQ ID NO: 8874 - DNA, 31 bp, Homo sapiens
caaacccactccaccttactaccagacaacc

SEQ ID NO: 8875 - DNA, 32 bp, Homo sapiens
caaacccactccaccttactaccagacaacct

SEQ ID NO: 8876 - DNA, 37 bp, Homo sapiens
caaacccactccaccttactaccagacaaccttagcc

SEQ ID NO: 8877 - DNA, 42 bp, Homo sapiens
caaacccactccaccttactaccagacaaccttagccaaacc

SEQ ID NO: 8878 - DNA, 19 bp, Homo sapiens
aaacccactccaccttact

SEQ ID NO: 8879 - DNA, 22 bp, Homo sapiens
aaacccactccaccttactacc

SEQ ID NO: 8880 - DNA, 23 bp, Homo sapiens
aaacccactccaccttactacca

SEQ ID NO: 8881 - DNA, 25 bp, Homo sapiens
aaacccactccaccttactaccaga

SEQ ID NO: 8882 - DNA, 26 bp, Homo sapiens
aaacccactccaccttactaccagac

SEQ ID NO: 8883 - DNA, 27 bp, Homo sapiens
aaacccactccaccttactaccagaca

SEQ ID NO: 8884 - DNA, 29 bp, Homo sapiens
aaacccactccaccttactaccagacaac

SEQ ID NO: 8885 - DNA, 30 bp, Homo sapiens; identical to SEQ ID NO: 845

SEQ ID NO: 8886 - DNA, 31 bp, Homo sapiens; identical to SEQ ID NO: 846

SEQ ID NO: 8887 - DNA, 36 bp, Homo sapiens
aaacccactccaccttactaccagacaaccttagcc

SEQ ID NO: 8888 - DNA, 37 bp, Homo sapiens
aaacccactccaccttactaccagacaaccttagcca

SEQ ID NO: 8889 - DNA, 41 bp, Homo sapiens
aaacccactccaccttactaccagacaaccttagccaaacc

SEQ ID NO: 8890 - DNA, 42 bp, Homo sapiens
aaacccactccaccttactaccagacaaccttagccaaacca

SEQ ID NO: 8891 - DNA, 18 bp, Homo sapiens
aacccactccaccttact

SEQ ID NO: 8892 - DNA, 21 bp, Homo sapiens
aacccactccaccttactacc

SEQ ID NO: 8893 - DNA, 22 bp, Homo sapiens
aacccactccaccttactacca

SEQ ID NO: 8894 - DNA, 24 bp, Homo sapiens
aacccactccaccttactaccaga

SEQ ID NO: 8895 - DNA, 25 bp, Homo sapiens
aacccactccaccttactaccagac

SEQ ID NO: 8896 - DNA, 26 bp, Homo sapiens
aacccactccaccttactaccagaca

SEQ ID NO: 8897 - DNA, 29 bp, Homo sapiens
aacccactccaccttactaccagacaacc

SEQ ID NO: 8898 - DNA, 30 bp, Homo sapiens; identical to SEQ ID NO: 851

SEQ ID NO: 8899 - DNA, 35 bp, Homo sapiens
aacccactccaccttactaccagacaaccttagcc

SEQ ID NO: 8900 - DNA, 36 bp, Homo sapiens
aacccactccaccttactaccagacaaccttagcca

SEQ ID NO: 8901 - DNA, 40 bp, Homo sapiens
aacccactccaccttactaccagacaaccttagccaaacc

SEQ ID NO: 8902 - DNA, 47 bp, Homo sapiens
aacccactccaccttactaccagacaaccttagccaaaccatttacc

SEQ ID NO: 8903 - DNA, 26 bp, Homo sapiens
acccactccaccttactaccagacaa

SEQ ID NO: 8904 - DNA, 23 bp, Homo sapiens
ccactccaccttactaccagaca

SEQ ID NO: 8905 - DNA, 17 bp, Homo sapiens
cactccaccttactacc

SEQ ID NO: 8906 - DNA, 18 bp, Homo sapiens
cactccaccttactacca

SEQ ID NO: 8907 - DNA, 21 bp, Homo sapiens
cactccaccttactaccagac

SEQ ID NO: 8908 - DNA, 25 bp, Homo sapiens
cactccaccttactaccagacaacc

SEQ ID NO: 8909 - DNA, 26 bp, Homo sapiens
cactccaccttactaccagacaacct

SEQ ID NO: 8910 - DNA, 31 bp, Homo sapiens; identical to SEQ ID NO: 854

SEQ ID NO: 8911 - DNA, 32 bp, Homo sapiens
cactccaccttactaccagacaaccttagcca

SEQ ID NO: 8912 - DNA, 36 bp, Homo sapiens
cactccaccttactaccagacaaccttagccaaacc

SEQ ID NO: 8913 - DNA, 44 bp, Homo sapiens
cactccaccttactaccagacaaccttagccaaaccatttaccc

SEQ ID NO: 8914 - DNA, 45 bp, Homo sapiens
cactccaccttactaccagacaaccttagccaaaccatttaccca

SEQ ID NO: 8915 - DNA, 16 bp, Homo sapiens
actccaccttactacc

SEQ ID NO: 8916 - DNA, 17 bp, Homo sapiens
actccaccttactacca

SEQ ID NO: 8917 - DNA, 19 bp, Homo sapiens
actccaccttactaccaga

SEQ ID NO: 8918 - DNA, 24 bp, Homo sapiens
actccaccttactaccagacaacc

SEQ ID NO: 8919 - DNA, 25 bp, Homo sapiens
actccaccttactaccagacaacct

SEQ ID NO: 8920 - DNA, 30 bp, Homo sapiens; identical to SEQ ID NO: 856

SEQ ID NO: 8921 - DNA, 31 bp, Homo sapiens
actccaccttactaccagacaaccttagcca

SEQ ID NO: 8922 - DNA, 35 bp, Homo sapiens
actccaccttactaccagacaaccttagccaaacc

SEQ ID NO: 8923 - DNA, 29 bp, Homo sapiens
ctccaccttactaccagacaaccttagcc

SEQ ID NO: 8924 - DNA, 33 bp, Homo sapiens
tccaccttactaccagacaaccttagccaaacc

SEQ ID NO: 8925 - DNA, 27 bp, Homo sapiens
ccaccttactaccagacaaccttagcc

SEQ ID NO: 8926 - DNA, 32 bp, Homo sapiens
ccaccttactaccagacaaccttagccaaacc

SEQ ID NO: 8927 - DNA, 20 bp, Homo sapiens
caccttactaccagacaacc

SEQ ID NO: 8928 - DNA, 26 bp, Homo sapiens
caccttactaccagacaaccttagcc

SEQ ID NO: 8929 - DNA, 31 bp, Homo sapiens; identical to SEQ ID NO: 858

SEQ ID NO: 8930 - DNA, 32 bp, Homo sapiens
caccttactaccagacaaccttagccaaacca

SEQ ID NO: 8931 - DNA, 33 bp, Homo sapiens
caccttactaccagacaaccttagccaaaccat

SEQ ID NO: 8932 - DNA, 38 bp, Homo sapiens
caccttactaccagacaaccttagccaaaccatttacc

SEQ ID NO: 8933 - DNA, 39 bp, Homo sapiens
caccttactaccagacaaccttagccaaaccatttaccc

SEQ ID NO: 8934 - DNA, 40 bp, Homo sapiens
caccttactaccagacaaccttagccaaaccatttaccca

SEQ ID NO: 8935 - DNA, 19 bp, Homo sapiens
accttactaccagacaacc

SEQ ID NO: 8936 - DNA, 25 bp, Homo sapiens
accttactaccagacaaccttagcc

SEQ ID NO: 8937 - DNA, 30 bp, Homo sapiens; identical to SEQ ID NO: 860

SEQ ID NO: 8938 - DNA, 31 bp, Homo sapiens
accttactaccagacaaccttagccaaacca

SEQ ID NO: 8939 - DNA, 32 bp, Homo sapiens
accttactaccagacaaccttagccaaaccat

SEQ ID NO: 8940 - DNA, 37 bp, Homo sapiens
accttactaccagacaaccttagccaaaccatttacc

SEQ ID NO: 8941 - DNA, 38 bp, Homo sapiens
accttactaccagacaaccttagccaaaccatttaccc

SEQ ID NO: 8942 - DNA, 39 bp, Homo sapiens
accttactaccagacaaccttagccaaaccatttaccca

SEQ ID NO: 8943 - DNA, 18 bp, Homo sapiens
ccttactaccagacaacc

SEQ ID NO: 8944 - DNA, 24 bp, Homo sapiens
ccttactaccagacaaccttagcc

SEQ ID NO: 8945 - DNA, 29 bp, Homo sapiens
ccttactaccagacaaccttagccaaacc

SEQ ID NO: 8946 - DNA, 37 bp, Homo sapiens
ccttactaccagacaaccttagccaaaccatttaccc

SEQ ID NO: 8947 - DNA, 38 bp, Homo sapiens
ccttactaccagacaaccttagccaaaccatttaccca

SEQ ID NO: 8948 - DNA, 23 bp, Homo sapiens
cttactaccagacaaccttagcc

SEQ ID NO: 8949 - DNA, 28 bp, Homo sapiens
cttactaccagacaaccttagccaaacc

SEQ ID NO: 8950 - DNA, 36 bp, Homo sapiens
cttactaccagacaaccttagccaaaccatttaccc

SEQ ID NO: 8951 - DNA, 37 bp, Homo sapiens
cttactaccagacaaccttagccaaaccatttaccca

SEQ ID NO: 8952 - DNA, 16 bp, Homo sapiens
ttactaccagacaacc

SEQ ID NO: 8953 - DNA, 17 bp, Homo sapiens
ttactaccagacaacct

SEQ ID NO: 8954 - DNA, 22 bp, Homo sapiens
ttactaccagacaaccttagcc

SEQ ID NO: 8955 - DNA, 23 bp, Homo sapiens
ttactaccagacaaccttagcca

SEQ ID NO: 8956 - DNA, 27 bp, Homo sapiens
ttactaccagacaaccttagccaaacc

SEQ ID NO: 8957 - DNA, 28 bp, Homo sapiens
ttactaccagacaaccttagccaaacca

SEQ ID NO: 8958 - DNA, 29 bp, Homo sapiens
ttactaccagacaaccttagccaaaccat

SEQ ID NO: 8959 - DNA, 34 bp, Homo sapiens
ttactaccagacaaccttagccaaaccatttacc

SEQ ID NO: 8960 - DNA, 35 bp, Homo sapiens
ttactaccagacaaccttagccaaaccatttaccc

SEQ ID NO: 8961 - DNA, 36 bp, Homo sapiens
ttactaccagacaaccttagccaaaccatttaccca

SEQ ID NO: 8962 - DNA, 16 bp, Homo sapiens
tactaccagacaacct

SEQ ID NO: 8963 - DNA, 21 bp, Homo sapiens
tactaccagacaaccttagcc

SEQ ID NO: 8964 - DNA, 26 bp, Homo sapiens
tactaccagacaaccttagccaaacc

SEQ ID NO: 8965 - DNA, 33 bp, Homo sapiens; identical to SEQ ID NO: 868

SEQ ID NO: 8966 - DNA, 34 bp, Homo sapiens
tactaccagacaaccttagccaaaccatttaccc

SEQ ID NO: 8967 - DNA, 35 bp, Homo sapiens
tactaccagacaaccttagccaaaccatttaccca

SEQ ID NO: 8968 - DNA, 20 bp, Homo sapiens
actaccagacaaccttagcc

SEQ ID NO: 8969 - DNA, 25 bp, Homo sapiens
actaccagacaaccttagccaaacc

SEQ ID NO: 8970 - DNA, 32 bp, Homo sapiens
actaccagacaaccttagccaaaccatttacc

SEQ ID NO: 8971 - DNA, 33 bp, Homo sapiens
actaccagacaaccttagccaaaccatttaccc

SEQ ID NO: 8972 - DNA, 19 bp, Homo sapiens
ctaccagacaaccttagcc

SEQ ID NO: 8973 - DNA, 24 bp, Homo sapiens
ctaccagacaaccttagccaaacc

SEQ ID NO: 8974 - DNA, 31 bp, Homo sapiens
ctaccagacaaccttagccaaaccatttacc

SEQ ID NO: 8975 - DNA, 32 bp, Homo sapiens
ctaccagacaaccttagccaaaccatttaccc

SEQ ID NO: 8976 - DNA, 33 bp, Homo sapiens
ctaccagacaaccttagccaaaccatttaccca

SEQ ID NO: 8977 - DNA, 32 bp, Homo sapiens
taccagacaaccttagccaaaccatttaccca

SEQ ID NO: 8978 - DNA, 22 bp, Homo sapiens
accagacaaccttagccaaacc

SEQ ID NO: 8979 - DNA, 30 bp, Homo sapiens
accagacaaccttagccaaaccatttaccc

SEQ ID NO: 8980 - DNA, 31 bp, Homo sapiens
accagacaaccttagccaaaccatttaccca

SEQ ID NO: 8981 - DNA, 20 bp, Homo sapiens
cagacaaccttagccaaacc

SEQ ID NO: 8982 - DNA, 27 bp, Homo sapiens
cagacaaccttagccaaaccatttacc

SEQ ID NO: 8983 - DNA, 28 bp, Homo sapiens
cagacaaccttagccaaaccatttaccc

SEQ ID NO: 8984 - DNA, 29 bp, Homo sapiens
cagacaaccttagccaaaccatttaccca

SEQ ID NO: 8985 - DNA, 32 bp, Homo sapiens
cagacaaccttagccaaaccatttacccaaat

SEQ ID NO: 8986 - DNA, 19 bp, Homo sapiens
agacaaccttagccaaacc

SEQ ID NO: 8987 - DNA, 26 bp, Homo sapiens
agacaaccttagccaaaccatttacc

SEQ ID NO: 8988 - DNA, 27 bp, Homo sapiens
agacaaccttagccaaaccatttaccc

SEQ ID NO: 8989 - DNA, 28 bp, Homo sapiens
agacaaccttagccaaaccatttaccca

SEQ ID NO: 8990 - DNA, 18 bp, Homo sapiens
gacaaccttagccaaacc

SEQ ID NO: 8991 - DNA, 25 bp, Homo sapiens
gacaaccttagccaaaccatttacc

SEQ ID NO: 8992 - DNA, 26 bp, Homo sapiens
gacaaccttagccaaaccatttaccc

SEQ ID NO: 8993 - DNA, 27 bp, Homo sapiens
gacaaccttagccaaaccatttaccca

SEQ ID NO: 8994 - DNA, 22 bp, Homo sapiens
aaccttagccaaaccatttacc

SEQ ID NO: 8995 - DNA, 23 bp, Homo sapiens
aaccttagccaaaccatttaccc

SEQ ID NO: 8996 - DNA, 24 bp, Homo sapiens
aaccttagccaaaccatttaccca

SEQ ID NO: 8997 - DNA, 22 bp, Homo sapiens
accttagccaaaccatttaccc

SEQ ID NO: 8998 - DNA, 23 bp, Homo sapiens
accttagccaaaccatttaccca

SEQ ID NO: 8999 - DNA, 18 bp, Homo sapiens
ttagccaaaccatttacc

SEQ ID NO: 9000 - DNA, 19 bp, Homo sapiens
ttagccaaaccatttaccc

SEQ ID NO: 9001 - DNA, 20 bp, Homo sapiens
ttagccaaaccatttaccca

SEQ ID NO: 9002 - DNA, 19 bp, Homo sapiens
tagccaaaccatttaccca

SEQ ID NO: 9003 - DNA, 44 bp, Homo sapiens
aaaccatttacccaaataaagtataggcgatagaaattgaaacc

SEQ ID NO: 9004 - DNA, 45 bp, Homo sapiens
aaaccatttacccaaataaagtataggcgatagaaattgaaacct

SEQ ID NO: 9005 - DNA, 43 bp, Homo sapiens
aaccatttacccaaataaagtataggcgatagaaattgaaacc

SEQ ID NO: 9006 - DNA, 44 bp, Homo sapiens
aaccatttacccaaataaagtataggcgatagaaattgaaacct

SEQ ID NO: 9007 - DNA, 40 bp, Homo sapiens
catttacccaaataaagtataggcgatagaaattgaaacc

SEQ ID NO: 9008 - DNA, 31 bp, Homo sapiens
atttacccaaataaagtataggcgatagaaa

SEQ ID NO: 9009 - DNA, 33 bp, Homo sapiens
atttacccaaataaagtataggcgatagaaatt

SEQ ID NO: 9010 - DNA, 39 bp, Homo sapiens
atttacccaaataaagtataggcgatagaaattgaaacc

SEQ ID NO: 9011 - DNA, 40 bp, Homo sapiens
atttacccaaataaagtataggcgatagaaattgaaacct

SEQ ID NO: 9012 - DNA, 43 bp, Homo sapiens
atttacccaaataaagtataggcgatagaaattgaaacctggc

SEQ ID NO: 9013 - DNA, 45 bp, Homo sapiens
atttacccaaataaagtataggcgatagaaattgaaacctggcgc

SEQ ID NO: 9014 - DNA, 46 bp, Homo sapiens
atttacccaaataaagtataggcgatagaaattgaaacctggcgca

SEQ ID NO: 9015 - DNA, 32 bp, Homo sapiens
tttacccaaataaagtataggcgatagaaatt

SEQ ID NO: 9016 - DNA, 39 bp, Homo sapiens
tttacccaaataaagtataggcgatagaaattgaaacct

SEQ ID NO: 9017 - DNA, 31 bp, Homo sapiens
ttacccaaataaagtataggcgatagaaatt

SEQ ID NO: 9018 - DNA, 37 bp, Homo sapiens
ttacccaaataaagtataggcgatagaaattgaaacc

SEQ ID NO: 9019 - DNA, 38 bp, Homo sapiens
ttacccaaataaagtataggcgatagaaattgaaacct

SEQ ID NO: 9020 - DNA, 43 bp, Homo sapiens
ttacccaaataaagtataggcgatagaaattgaaacctggcgc

SEQ ID NO: 9021 - DNA, 44 bp, Homo sapiens
ttacccaaataaagtataggcgatagaaattgaaacctggcgca

SEQ ID NO: 9022 - DNA, 47 bp, Homo sapiens
ttacccaaataaagtataggcgatagaaattgaaacctggcgcaata

SEQ ID NO: 9023 - DNA, 36 bp, Homo sapiens
tacccaaataaagtataggcgatagaaattgaaacc

SEQ ID NO: 9024 - DNA, 37 bp, Homo sapiens
tacccaaataaagtataggcgatagaaattgaaacct

SEQ ID NO: 9025 - DNA, 41 bp, Homo sapiens
tacccaaataaagtataggcgatagaaattgaaacctggcg

SEQ ID NO: 9026 - DNA, 42 bp, Homo sapiens
tacccaaataaagtataggcgatagaaattgaaacctggcgc

SEQ ID NO: 9027 - DNA, 43 bp, Homo sapiens
tacccaaataaagtataggcgatagaaattgaaacctggcgca

SEQ ID NO: 9028 - DNA, 35 bp, Homo sapiens
acccaaataaagtataggcgatagaaattgaaacc

SEQ ID NO: 9029 - DNA, 36 bp, Homo sapiens
acccaaataaagtataggcgatagaaattgaaacct

SEQ ID NO: 9030 - DNA, 40 bp, Homo sapiens
acccaaataaagtataggcgatagaaattgaaacctggcg

SEQ ID NO: 9031 - DNA, 41 bp, Homo sapiens
acccaaataaagtataggcgatagaaattgaaacctggcgc

SEQ ID NO: 9032 - DNA, 42 bp, Homo sapiens
acccaaataaagtataggcgatagaaattgaaacctggcgca

SEQ ID NO: 9033 - DNA, 44 bp, Homo sapiens
acccaaataaagtataggcgatagaaattgaaacctggcgcaat

SEQ ID NO: 9034 - DNA, 45 bp, Homo sapiens
acccaaataaagtataggcgatagaaattgaaacctggcgcaata

SEQ ID NO: 9035 - DNA, 32 bp, Homo sapiens
cccaaataaagtataggcgatagaaattgaaa

SEQ ID NO: 9036 - DNA, 33 bp, Homo sapiens; identical to SEQ ID NO: 877

SEQ ID NO: 9037 - DNA, 34 bp, Homo sapiens
cccaaataaagtataggcgatagaaattgaaacc

SEQ ID NO: 9038 - DNA, 35 bp, Homo sapiens
cccaaataaagtataggcgatagaaattgaaacct

SEQ ID NO: 9039 - DNA, 38 bp, Homo sapiens
cccaaataaagtataggcgatagaaattgaaacctggc

SEQ ID NO: 9040 - DNA, 40 bp, Homo sapiens
cccaaataaagtataggcgatagaaattgaaacctggcgc

SEQ ID NO: 9041 - DNA, 41 bp, Homo sapiens
cccaaataaagtataggcgatagaaattgaaacctggcgca

SEQ ID NO: 9042 - DNA, 43 bp, Homo sapiens
cccaaataaagtataggcgatagaaattgaaacctggcgcaat

SEQ ID NO: 9043 - DNA, 30 bp, Homo sapiens
ccaaataaagtataggcgatagaaattgaa

SEQ ID NO: 9044 - DNA, 31 bp, Homo sapiens
ccaaataaagtataggcgatagaaattgaaa

SEQ ID NO: 9045 - DNA, 32 bp, Homo sapiens; identical to SEQ ID NO: 878

SEQ ID NO: 9046 - DNA, 33 bp, Homo sapiens; identical to SEQ ID NO: 879

SEQ ID NO: 9047 - DNA, 34 bp, Homo sapiens
ccaaataaagtataggcgatagaaattgaaacct

SEQ ID NO: 9048 - DNA, 40 bp, Homo sapiens
ccaaataaagtataggcgatagaaattgaaacctggcgca

SEQ ID NO: 9049 - DNA, 42 bp, Homo sapiens
ccaaataaagtataggcgatagaaattgaaacctggcgcaat

SEQ ID NO: 9050 - DNA, 17 bp, Homo sapiens
caaataaagtataggcg

SEQ ID NO: 9051 - DNA, 26 bp, Homo sapiens
caaataaagtataggcgatagaaatt

SEQ ID NO: 9052 - DNA, 30 bp, Homo sapiens
caaataaagtataggcgatagaaattgaaa

SEQ ID NO: 9053 - DNA, 31 bp, Homo sapiens
caaataaagtataggcgatagaaattgaaac

SEQ ID NO: 9054 - DNA, 32 bp, Homo sapiens; identical to SEQ ID NO: 881

SEQ ID NO: 9055 - DNA, 33 bp, Homo sapiens; identical to SEQ ID NO: 882

SEQ ID NO: 9056 - DNA, 38 bp, Homo sapiens
caaataaagtataggcgatagaaattgaaacctggcgc

SEQ ID NO: 9057 - DNA, 39 bp, Homo sapiens
caaataaagtataggcgatagaaattgaaacctggcgca

SEQ ID NO: 9058 - DNA, 16 bp, Homo sapiens
aaataaagtataggcg

SEQ ID NO: 9059 - DNA, 19 bp, Homo sapiens
aaataaagtataggcgata

SEQ ID NO: 9060 - DNA, 20 bp, Homo sapiens
aaataaagtataggcgatag

SEQ ID NO: 9061 - DNA, 22 bp, Homo sapiens
aaataaagtataggcgatagaa

SEQ ID NO: 9062 - DNA, 24 bp, Homo sapiens
aaataaagtataggcgatagaaat

SEQ ID NO: 9063 - DNA, 25 bp, Homo sapiens
aaataaagtataggcgatagaaatt

SEQ ID NO: 9064 - DNA, 26 bp, Homo sapiens
aaataaagtataggcgatagaaattg

SEQ ID NO: 9065 - DNA, 28 bp, Homo sapiens
aaataaagtataggcgatagaaattgaa

SEQ ID NO: 9066 - DNA, 29 bp, Homo sapiens
aaataaagtataggcgatagaaattgaaa

SEQ ID NO: 9067 - DNA, 30 bp, Homo sapiens; identical to SEQ ID NO: 884

SEQ ID NO: 9068 - DNA, 31 bp, Homo sapiens; identical to SEQ ID NO: 885

SEQ ID NO: 9069 - DNA, 32 bp, Homo sapiens; identical to SEQ ID NO: 886

SEQ ID NO: 9070 - DNA, 35 bp, Homo sapiens
aaataaagtataggcgatagaaattgaaacctggc

SEQ ID NO: 9071 - DNA, 37 bp, Homo sapiens
aaataaagtataggcgatagaaattgaaacctggcgc

SEQ ID NO: 9072 - DNA, 38 bp, Homo sapiens
aaataaagtataggcgatagaaattgaaacctggcgca

SEQ ID NO: 9073 - DNA, 40 bp, Homo sapiens
aaataaagtataggcgatagaaattgaaacctggcgcaat

SEQ ID NO: 9074 - DNA, 41 bp, Homo sapiens
aaataaagtataggcgatagaaattgaaacctggcgcaata

SEQ ID NO: 9075 - DNA, 43 bp, Homo sapiens
aaataaagtataggcgatagaaattgaaacctggcgcaataga

SEQ ID NO: 9076 - DNA, 17 bp, Homo sapiens
aataaagtataggcgat

SEQ ID NO: 9077 - DNA, 18 bp, Homo sapiens
aataaagtataggcgata

SEQ ID NO: 9078 - DNA, 19 bp, Homo sapiens
aataaagtataggcgatag

SEQ ID NO: 9079 - DNA, 21 bp, Homo sapiens
aataaagtataggcgatagaa

SEQ ID NO: 9080 - DNA, 23 bp, Homo sapiens
aataaagtataggcgatagaaat

SEQ ID NO: 9081 - DNA, 24 bp, Homo sapiens
aataaagtataggcgatagaaatt

SEQ ID NO: 9082 - DNA, 25 bp, Homo sapiens
aataaagtataggcgatagaaattg

SEQ ID NO: 9083 - DNA, 29 bp, Homo sapiens
aataaagtataggcgatagaaattgaaac

SEQ ID NO: 9084 - DNA, 30 bp, Homo sapiens; identical to SEQ ID NO: 890

SEQ ID NO: 9085 - DNA, 31 bp, Homo sapiens; identical to SEQ ID NO: 891

SEQ ID NO: 9086 - DNA, 34 bp, Homo sapiens
aataaagtataggcgatagaaattgaaacctggc

SEQ ID NO: 9087 - DNA, 36 bp, Homo sapiens
aataaagtataggcgatagaaattgaaacctggcgc

SEQ ID NO: 9088 - DNA, 37 bp, Homo sapiens
aataaagtataggcgatagaaattgaaacctggcgca

SEQ ID NO: 9089 - DNA, 38 bp, Homo sapiens
aataaagtataggcgatagaaattgaaacctggcgcaa

SEQ ID NO: 9090 - DNA, 39 bp, Homo sapiens
aataaagtataggcgatagaaattgaaacctggcgcaat

SEQ ID NO: 9091 - DNA, 40 bp, Homo sapiens
aataaagtataggcgatagaaattgaaacctggcgcaata

SEQ ID NO: 9092 - DNA, 23 bp, Homo sapiens
ataaagtataggcgatagaaatt

SEQ ID NO: 9093 - DNA, 27 bp, Homo sapiens
ataaagtataggcgatagaaattgaaa

SEQ ID NO: 9094 - DNA, 29 bp, Homo sapiens
ataaagtataggcgatagaaattgaaacc

SEQ ID NO: 9095 - DNA, 30 bp, Homo sapiens
ataaagtataggcgatagaaattgaaacct

SEQ ID NO: 9096 - DNA, 35 bp, Homo sapiens
ataaagtataggcgatagaaattgaaacctggcgc

SEQ ID NO: 9097 - DNA, 36 bp, Homo sapiens
ataaagtataggcgatagaaattgaaacctggcgca

SEQ ID NO: 9098 - DNA, 22 bp, Homo sapiens
taaagtataggcgatagaaatt

SEQ ID NO: 9099 - DNA, 28 bp, Homo sapiens
taaagtataggcgatagaaattgaaacc

SEQ ID NO: 9100 - DNA, 29 bp, Homo sapiens
taaagtataggcgatagaaattgaaacct

SEQ ID NO: 9101 - DNA, 34 bp, Homo sapiens
taaagtataggcgatagaaattgaaacctggcgc

SEQ ID NO: 9102 - DNA, 35 bp, Homo sapiens
taaagtataggcgatagaaattgaaacctggcgca

SEQ ID NO: 9103 - DNA, 21 bp, Homo sapiens
aaagtataggcgatagaaatt

SEQ ID NO: 9104 - DNA, 22 bp, Homo sapiens
aaagtataggcgatagaaattg

SEQ ID NO: 9105 - DNA, 25 bp, Homo sapiens
aaagtataggcgatagaaattgaaa

SEQ ID NO: 9106 - DNA, 26 bp, Homo sapiens
aaagtataggcgatagaaattgaaac

SEQ ID NO: 9107 - DNA, 27 bp, Homo sapiens
aaagtataggcgatagaaattgaaacc

SEQ ID NO: 9108 - DNA, 28 bp, Homo sapiens
aaagtataggcgatagaaattgaaacct

SEQ ID NO: 9109 - DNA, 31 bp, Homo sapiens
aaagtataggcgatagaaattgaaacctggc

SEQ ID NO: 9110 - DNA, 33 bp, Homo sapiens; identical to SEQ ID NO: 899

SEQ ID NO: 9111 - DNA, 34 bp, Homo sapiens
aaagtataggcgatagaaattgaaacctggcgca

SEQ ID NO: 9112 - DNA, 20 bp, Homo sapiens
aagtataggcgatagaaatt

SEQ ID NO: 9113 - DNA, 21 bp, Homo sapiens
aagtataggcgatagaaattg

SEQ ID NO: 9114 - DNA, 23 bp, Homo sapiens
aagtataggcgatagaaattgaa

SEQ ID NO: 9115 - DNA, 24 bp, Homo sapiens
aagtataggcgatagaaattgaaa

SEQ ID NO: 9116 - DNA, 25 bp, Homo sapiens
aagtataggcgatagaaattgaaac

SEQ ID NO: 9117 - DNA, 26 bp, Homo sapiens
aagtataggcgatagaaattgaaacc

SEQ ID NO: 9118 - DNA, 27 bp, Homo sapiens
aagtataggcgatagaaattgaaacct

SEQ ID NO: 9119 - DNA, 30 bp, Homo sapiens
aagtataggcgatagaaattgaaacctggc

SEQ ID NO: 9120 - DNA, 32 bp, Homo sapiens; identical to SEQ ID NO: 904

SEQ ID NO: 9121 - DNA, 33 bp, Homo sapiens; identical to SEQ ID NO: 905

SEQ ID NO: 9122 - DNA, 47 bp, Homo sapiens
aagtataggcgatagaaattgaaacctggcgcaatagatatagtacc

SEQ ID NO: 9123 - DNA, 23 bp, Homo sapiens
agtataggcgatagaaattgaaa

SEQ ID NO: 9124 - DNA, 24 bp, Homo sapiens
agtataggcgatagaaattgaaac

SEQ ID NO: 9125 - DNA, 25 bp, Homo sapiens
agtataggcgatagaaattgaaacc

SEQ ID NO: 9126 - DNA, 26 bp, Homo sapiens
agtataggcgatagaaattgaaacct

SEQ ID NO: 9127 - DNA, 29 bp, Homo sapiens
agtataggcgatagaaattgaaacctggc

SEQ ID NO: 9128 - DNA, 31 bp, Homo sapiens; identical to SEQ ID NO: 908

SEQ ID NO: 9129 - DNA, 32 bp, Homo sapiens; identical to SEQ ID NO: 909

SEQ ID NO: 9130 - DNA, 46 bp, Homo sapiens
agtataggcgatagaaattgaaacctggcgcaatagatatagtacc

SEQ ID NO: 9131 - DNA, 23 bp, Homo sapiens
gtataggcgatagaaattgaaac

SEQ ID NO: 9132 - DNA, 24 bp, Homo sapiens
gtataggcgatagaaattgaaacc

SEQ ID NO: 9133 - DNA, 25 bp, Homo sapiens
gtataggcgatagaaattgaaacct

SEQ ID NO: 9134 - DNA, 30 bp, Homo sapiens
gtataggcgatagaaattgaaacctggcgc

SEQ ID NO: 9135 - DNA, 31 bp, Homo sapiens
gtataggcgatagaaattgaaacctggcgca

SEQ ID NO: 9136 - DNA, 45 bp, Homo sapiens
gtataggcgatagaaattgaaacctggcgcaatagatatagtacc

SEQ ID NO: 9137 - DNA, 22 bp, Homo sapiens
tataggcgatagaaattgaaac

SEQ ID NO: 9138 - DNA, 23 bp, Homo sapiens
tataggcgatagaaattgaaacc

SEQ ID NO: 9139 - DNA, 24 bp, Homo sapiens
tataggcgatagaaattgaaacct

SEQ ID NO: 9140 - DNA, 28 bp, Homo sapiens
tataggcgatagaaattgaaacctggcg

SEQ ID NO: 9141 - DNA, 29 bp, Homo sapiens
tataggcgatagaaattgaaacctggcgc

SEQ ID NO: 9142 - DNA, 30 bp, Homo sapiens; identical to SEQ ID NO: 913

SEQ ID NO: 9143 - DNA, 31 bp, Homo sapiens
tataggcgatagaaattgaaacctggcgcaa

SEQ ID NO: 9144 - DNA, 33 bp, Homo sapiens
tataggcgatagaaattgaaacctggcgcaata

SEQ ID NO: 9145 - DNA, 44 bp, Homo sapiens
tataggcgatagaaattgaaacctggcgcaatagatatagtacc

SEQ ID NO: 9146 - DNA, 19 bp, Homo sapiens
ataggcgatagaaattgaa

SEQ ID NO: 9147 - DNA, 20 bp, Homo sapiens
ataggcgatagaaattgaaa

SEQ ID NO: 9148 - DNA, 21 bp, Homo sapiens
ataggcgatagaaattgaaac

SEQ ID NO: 9149 - DNA, 22 bp, Homo sapiens
ataggcgatagaaattgaaacc

SEQ ID NO: 9150 - DNA, 23 bp, Homo sapiens
ataggcgatagaaattgaaacct

SEQ ID NO: 9151 - DNA, 27 bp, Homo sapiens
ataggcgatagaaattgaaacctggcg

SEQ ID NO: 9152 - DNA, 28 bp, Homo sapiens
ataggcgatagaaattgaaacctggcgc

SEQ ID NO: 9153 - DNA, 29 bp, Homo sapiens
ataggcgatagaaattgaaacctggcgca

SEQ ID NO: 9154 - DNA, 30 bp, Homo sapiens
ataggcgatagaaattgaaacctggcgcaa

SEQ ID NO: 9155 - DNA, 31 bp, Homo sapiens
ataggcgatagaaattgaaacctggcgcaat

SEQ ID NO: 9156 - DNA, 32 bp, Homo sapiens
ataggcgatagaaattgaaacctggcgcaata

SEQ ID NO: 9157 - DNA, 33 bp, Homo sapiens
ataggcgatagaaattgaaacctggcgcaatag

SEQ ID NO: 9158 - DNA, 16 bp, Homo sapiens
taggcgatagaaattg

SEQ ID NO: 9159 - DNA, 18 bp, Homo sapiens
taggcgatagaaattgaa

SEQ ID NO: 9160 - DNA, 19 bp, Homo sapiens
taggcgatagaaattgaaa

SEQ ID NO: 9161 - DNA, 20 bp, Homo sapiens
taggcgatagaaattgaaac

SEQ ID NO: 9162 - DNA, 21 bp, Homo sapiens
taggcgatagaaattgaaacc

SEQ ID NO: 9163 - DNA, 22 bp, Homo sapiens
taggcgatagaaattgaaacct

SEQ ID NO: 9164 - DNA, 25 bp, Homo sapiens
taggcgatagaaattgaaacctggc

SEQ ID NO: 9165 - DNA, 26 bp, Homo sapiens
taggcgatagaaattgaaacctggcg

SEQ ID NO: 9166 - DNA, 27 bp, Homo sapiens
taggcgatagaaattgaaacctggcgc

SEQ ID NO: 9167 - DNA, 28 bp, Homo sapiens
taggcgatagaaattgaaacctggcgca

SEQ ID NO: 9168 - DNA, 29 bp, Homo sapiens
taggcgatagaaattgaaacctggcgcaa

SEQ ID NO: 9169 - DNA, 30 bp, Homo sapiens
taggcgatagaaattgaaacctggcgcaat

SEQ ID NO: 9170 - DNA, 31 bp, Homo sapiens
taggcgatagaaattgaaacctggcgcaata

SEQ ID NO: 9171 - DNA, 32 bp, Homo sapiens
taggcgatagaaattgaaacctggcgcaatag

SEQ ID NO: 9172 - DNA, 33 bp, Homo sapiens; identical to SEQ ID NO: 925

SEQ ID NO: 9173 - DNA, 34 bp, Homo sapiens
taggcgatagaaattgaaacctggcgcaatagat

SEQ ID NO: 9174 - DNA, 42 bp, Homo sapiens
taggcgatagaaattgaaacctggcgcaatagatatagtacc

SEQ ID NO: 9175 - DNA, 19 bp, Homo sapiens
aggcgatagaaattgaaac

SEQ ID NO: 9176 - DNA, 20 bp, Homo sapiens
aggcgatagaaattgaaacc

SEQ ID NO: 9177 - DNA, 21 bp, Homo sapiens
aggcgatagaaattgaaacct

SEQ ID NO: 9178 - DNA, 25 bp, Homo sapiens
aggcgatagaaattgaaacctggcg

SEQ ID NO: 9179 - DNA, 26 bp, Homo sapiens
aggcgatagaaattgaaacctggcgc

SEQ ID NO: 9180 - DNA, 27 bp, Homo sapiens
aggcgatagaaattgaaacctggcgca

SEQ ID NO: 9181 - DNA, 28 bp, Homo sapiens
aggcgatagaaattgaaacctggcgcaa

SEQ ID NO: 9182 - DNA, 29 bp, Homo sapiens
aggcgatagaaattgaaacctggcgcaat

SEQ ID NO: 9183 - DNA, 30 bp, Homo sapiens
aggcgatagaaattgaaacctggcgcaata

SEQ ID NO: 9184 - DNA, 31 bp, Homo sapiens
aggcgatagaaattgaaacctggcgcaatag

SEQ ID NO: 9185 - DNA, 32 bp, Homo sapiens; identical to SEQ ID NO: 929

SEQ ID NO: 9186 - DNA, 33 bp, Homo sapiens
aggcgatagaaattgaaacctggcgcaatagat

SEQ ID NO: 9187 - DNA, 40 bp, Homo sapiens
aggcgatagaaattgaaacctggcgcaatagatatagtac

SEQ ID NO: 9188 - DNA, 19 bp, Homo sapiens
ggcgatagaaattgaaacc

SEQ ID NO: 9189 - DNA, 20 bp, Homo sapiens
ggcgatagaaattgaaacct

SEQ ID NO: 9190 - DNA, 25 bp, Homo sapiens
ggcgatagaaattgaaacctggcgc

SEQ ID NO: 9191 - DNA, 26 bp, Homo sapiens
ggcgatagaaattgaaacctggcgca

SEQ ID NO: 9192 - DNA, 18 bp, Homo sapiens
gcgatagaaattgaaacc

SEQ ID NO: 9193 - DNA, 19 bp, Homo sapiens
gcgatagaaattgaaacct

SEQ ID NO: 9194 - DNA, 22 bp, Homo sapiens
gcgatagaaattgaaacctggc

SEQ ID NO: 9195 - DNA, 23 bp, Homo sapiens
gcgatagaaattgaaacctggcg

SEQ ID NO: 9196 - DNA, 24 bp, Homo sapiens
gcgatagaaattgaaacctggcgc

SEQ ID NO: 9197 - DNA, 25 bp, Homo sapiens
gcgatagaaattgaaacctggcgca

SEQ ID NO: 9198 - DNA, 17 bp, Homo sapiens
cgatagaaattgaaacc

SEQ ID NO: 9199 - DNA, 18 bp, Homo sapiens
cgatagaaattgaaacct

SEQ ID NO: 9200 - DNA, 22 bp, Homo sapiens
cgatagaaattgaaacctggcg

SEQ ID NO: 9201 - DNA, 23 bp, Homo sapiens
cgatagaaattgaaacctggcgc

SEQ ID NO: 9202 - DNA, 24 bp, Homo sapiens
cgatagaaattgaaacctggcgca

SEQ ID NO: 9203 - DNA, 25 bp, Homo sapiens
cgatagaaattgaaacctggcgcaa

SEQ ID NO: 9204 - DNA, 26 bp, Homo sapiens
cgatagaaattgaaacctggcgcaat

SEQ ID NO: 9205 - DNA, 27 bp, Homo sapiens
cgatagaaattgaaacctggcgcaata

SEQ ID NO: 9206 - DNA, 28 bp, Homo sapiens
cgatagaaattgaaacctggcgcaatag

SEQ ID NO: 9207 - DNA, 29 bp, Homo sapiens
cgatagaaattgaaacctggcgcaataga

SEQ ID NO: 9208 - DNA, 30 bp, Homo sapiens; identical to SEQ ID NO: 938

SEQ ID NO: 9209 - DNA, 31 bp, Homo sapiens
cgatagaaattgaaacctggcgcaatagata

SEQ ID NO: 9210 - DNA, 32 bp, Homo sapiens
cgatagaaattgaaacctggcgcaatagatat

SEQ ID NO: 9211 - DNA, 37 bp, Homo sapiens
cgatagaaattgaaacctggcgcaatagatatagtac

SEQ ID NO: 9212 - DNA, 38 bp, Homo sapiens
cgatagaaattgaaacctggcgcaatagatatagtacc

SEQ ID NO: 9213 - DNA, 17 bp, Homo sapiens
gatagaaattgaaacct

SEQ ID NO: 9214 - DNA, 21 bp, Homo sapiens
gatagaaattgaaacctggcg

SEQ ID NO: 9215 - DNA, 22 bp, Homo sapiens
gatagaaattgaaacctggcgc

SEQ ID NO: 9216 - DNA, 23 bp, Homo sapiens
gatagaaattgaaacctggcgca

SEQ ID NO: 9217 - DNA, 24 bp, Homo sapiens
gatagaaattgaaacctggcgcaa

SEQ ID NO: 9218 - DNA, 25 bp, Homo sapiens
gatagaaattgaaacctggcgcaat

SEQ ID NO: 9219 - DNA, 26 bp, Homo sapiens
gatagaaattgaaacctggcgcaata

SEQ ID NO: 9220 - DNA, 27 bp, Homo sapiens
gatagaaattgaaacctggcgcaatag

SEQ ID NO: 9221 - DNA, 28 bp, Homo sapiens
gatagaaattgaaacctggcgcaataga

SEQ ID NO: 9222 - DNA, 29 bp, Homo sapiens
gatagaaattgaaacctggcgcaatagat

SEQ ID NO: 9223 - DNA, 30 bp, Homo sapiens
gatagaaattgaaacctggcgcaatagata

SEQ ID NO: 9224 - DNA, 16 bp, Homo sapiens
atagaaattgaaacct

SEQ ID NO: 9225 - DNA, 19 bp, Homo sapiens
atagaaattgaaacctggc

SEQ ID NO: 9226 - DNA, 20 bp, Homo sapiens
atagaaattgaaacctggcg

SEQ ID NO: 9227 - DNA, 21 bp, Homo sapiens
atagaaattgaaacctggcgc

SEQ ID NO: 9228 - DNA, 22 bp, Homo sapiens
atagaaattgaaacctggcgca

SEQ ID NO: 9229 - DNA, 23 bp, Homo sapiens
atagaaattgaaacctggcgcaa

SEQ ID NO: 9230 - DNA, 24 bp, Homo sapiens
atagaaattgaaacctggcgcaat

SEQ ID NO: 9231 - DNA, 25 bp, Homo sapiens
atagaaattgaaacctggcgcaata

SEQ ID NO: 9232 - DNA, 26 bp, Homo sapiens
atagaaattgaaacctggcgcaatag

SEQ ID NO: 9233 - DNA, 27 bp, Homo sapiens
atagaaattgaaacctggcgcaataga

SEQ ID NO: 9234 - DNA, 28 bp, Homo sapiens
atagaaattgaaacctggcgcaatagat

SEQ ID NO: 9235 - DNA, 29 bp, Homo sapiens
atagaaattgaaacctggcgcaatagata

SEQ ID NO: 9236 - DNA, 34 bp, Homo sapiens
atagaaattgaaacctggcgcaatagatatagta

SEQ ID NO: 9237 - DNA, 35 bp, Homo sapiens
atagaaattgaaacctggcgcaatagatatagtac

SEQ ID NO: 9238 - DNA, 36 bp, Homo sapiens
atagaaattgaaacctggcgcaatagatatagtacc

SEQ ID NO: 9239 - DNA, 21 bp, Homo sapiens
tagaaattgaaacctggcgca

SEQ ID NO: 9240 - DNA, 29 bp, Homo sapiens
tagaaattgaaacctggcgcaatagatat

SEQ ID NO: 9241 - DNA, 33 bp, Homo sapiens
tagaaattgaaacctggcgcaatagatatagta

SEQ ID NO: 9242 - DNA, 20 bp, Homo sapiens
agaaattgaaacctggcgca

SEQ ID NO: 9243 - DNA, 19 bp, Homo sapiens
gaaattgaaacctggcgca

SEQ ID NO: 9244 - DNA, 32 bp, Homo sapiens
gaaattgaaacctggcgcaatagatatagtac

SEQ ID NO: 9245 - DNA, 18 bp, Homo sapiens
aaattgaaacctggcgca

SEQ ID NO: 9246 - DNA, 20 bp, Homo sapiens
aaattgaaacctggcgcaat

SEQ ID NO: 9247 - DNA, 31 bp, Homo sapiens
aaattgaaacctggcgcaatagatatagtac

SEQ ID NO: 9248 - DNA, 17 bp, Homo sapiens
aattgaaacctggcgca

SEQ ID NO: 9249 - DNA, 30 bp, Homo sapiens
aattgaaacctggcgcaatagatatagtac

SEQ ID NO: 9250 - DNA, 16 bp, Homo sapiens
attgaaacctggcgca

SEQ ID NO: 9251 - DNA, 29 bp, Homo sapiens
attgaaacctggcgcaatagatatagtac

SEQ ID NO: 9252 - DNA, 30 bp, Homo sapiens
attgaaacctggcgcaatagatatagtacc

SEQ ID NO: 9253 - DNA, 28 bp, Homo sapiens
ttgaaacctggcgcaatagatatagtac

SEQ ID NO: 9254 - DNA, 27 bp, Homo sapiens
tgaaacctggcgcaatagatatagtac

SEQ ID NO: 9255 - DNA, 25 bp, Homo sapiens
aaacctggcgcaatagatatagtac

SEQ ID NO: 9256 - DNA, 24 bp, Homo sapiens
aacctggcgcaatagatatagtac

SEQ ID NO: 9257 - DNA, 23 bp, Homo sapiens
acctggcgcaatagatatagtac

SEQ ID NO: 9258 - DNA, 22 bp, Homo sapiens
cctggcgcaatagatatagtac

SEQ ID NO: 9259 - DNA, 21 bp, Homo sapiens
ctggcgcaatagatatagtac

SEQ ID NO: 9260 - DNA, 22 bp, Homo sapiens
ctggcgcaatagatatagtacc

SEQ ID NO: 9261 - DNA, 20 bp, Homo sapiens
tggcgcaatagatatagtac

SEQ ID NO: 9262 - DNA, 21 bp, Homo sapiens
tggcgcaatagatatagtacc

SEQ ID NO: 9263 - DNA, 17 bp, Homo sapiens
cgcaatagatatagtac

SEQ ID NO: 9264 - DNA, 26 bp, Homo sapiens
caagggaaagatgaaaaattataacc

SEQ ID NO: 9265 - DNA, 24 bp, Homo sapiens
agggaaagatgaaaaattataacc

SEQ ID NO: 9266 - DNA, 33 bp, Homo sapiens
aaaattataaccaagcataatatagcaaggact

SEQ ID NO: 9267 - DNA, 32 bp, Homo sapiens; identical to SEQ ID NO: 950

SEQ ID NO: 9268 - DNA, 31 bp, Homo sapiens; identical to SEQ ID NO: 951

SEQ ID NO: 9269 - DNA, 30 bp, Homo sapiens; identical to SEQ ID NO: 952

SEQ ID NO: 9270 - DNA, 29 bp, Homo sapiens
ttataaccaagcataatatagcaaggact

SEQ ID NO: 9271 - DNA, 28 bp, Homo sapiens
tataaccaagcataatatagcaaggact

SEQ ID NO: 9272 - DNA, 27 bp, Homo sapiens
ataaccaagcataatatagcaaggact

SEQ ID NO: 9273 - DNA, 26 bp, Homo sapiens
taaccaagcataatatagcaaggact

SEQ ID NO: 9274 - DNA, 25 bp, Homo sapiens
aaccaagcataatatagcaaggact

SEQ ID NO: 9275 - DNA, 24 bp, Homo sapiens
accaagcataatatagcaaggact

SEQ ID NO: 9276 - DNA, 23 bp, Homo sapiens
ccaagcataatatagcaaggact

SEQ ID NO: 9277 - DNA, 22 bp, Homo sapiens
caagcataatatagcaaggact

SEQ ID NO: 9278 - DNA, 26 bp, Homo sapiens
caagcataatatagcaaggactaacc

SEQ ID NO: 9279 - DNA, 27 bp, Homo sapiens
caagcataatatagcaaggactaaccc

SEQ ID NO: 9280 - DNA, 28 bp, Homo sapiens
caagcataatatagcaaggactaacccc

SEQ ID NO: 9281 - DNA, 29 bp, Homo sapiens
caagcataatatagcaaggactaacccct

SEQ ID NO: 9282 - DNA, 20 bp, Homo sapiens
aagcataatatagcaaggac

SEQ ID NO: 9283 - DNA, 21 bp, Homo sapiens
aagcataatatagcaaggact

SEQ ID NO: 9284 - DNA, 22 bp, Homo sapiens
aagcataatatagcaaggacta

SEQ ID NO: 9285 - DNA, 25 bp, Homo sapiens
aagcataatatagcaaggactaacc

SEQ ID NO: 9286 - DNA, 26 bp, Homo sapiens
aagcataatatagcaaggactaaccc

SEQ ID NO: 9287 - DNA, 27 bp, Homo sapiens
aagcataatatagcaaggactaacccc

SEQ ID NO: 9288 - DNA, 28 bp, Homo sapiens
aagcataatatagcaaggactaacccct

SEQ ID NO: 9289 - DNA, 33 bp, Homo sapiens; identical to SEQ ID NO: 968

SEQ ID NO: 9290 - DNA, 20 bp, Homo sapiens
agcataatatagcaaggact

SEQ ID NO: 9291 - DNA, 21 bp, Homo sapiens
agcataatatagcaaggacta

SEQ ID NO: 9292 - DNA, 24 bp, Homo sapiens
agcataatatagcaaggactaacc

SEQ ID NO: 9293 - DNA, 25 bp, Homo sapiens
agcataatatagcaaggactaaccc

SEQ ID NO: 9294 - DNA, 26 bp, Homo sapiens
agcataatatagcaaggactaacccc

SEQ ID NO: 9295 - DNA, 32 bp, Homo sapiens
agcataatatagcaaggactaacccctatacc

SEQ ID NO: 9296 - DNA, 19 bp, Homo sapiens
gcataatatagcaaggact

SEQ ID NO: 9297 - DNA, 23 bp, Homo sapiens
gcataatatagcaaggactaacc

SEQ ID NO: 9298 - DNA, 24 bp, Homo sapiens
gcataatatagcaaggactaaccc

SEQ ID NO: 9299 - DNA, 18 bp, Homo sapiens
cataatatagcaaggact

SEQ ID NO: 9300 - DNA, 22 bp, Homo sapiens
cataatatagcaaggactaacc

SEQ ID NO: 9301 - DNA, 23 bp, Homo sapiens
cataatatagcaaggactaaccc

SEQ ID NO: 9302 - DNA, 24 bp, Homo sapiens
cataatatagcaaggactaacccc

SEQ ID NO: 9303 - DNA, 25 bp, Homo sapiens
cataatatagcaaggactaacccct

SEQ ID NO: 9304 - DNA, 17 bp, Homo sapiens
ataatatagcaaggact

SEQ ID NO: 9305 - DNA, 21 bp, Homo sapiens
ataatatagcaaggactaacc

SEQ ID NO: 9306 - DNA, 22 bp, Homo sapiens
ataatatagcaaggactaaccc

SEQ ID NO: 9307 - DNA, 23 bp, Homo sapiens
ataatatagcaaggactaacccc

SEQ ID NO: 9308 - DNA, 16 bp, Homo sapiens
taatatagcaaggact

SEQ ID NO: 9309 - DNA, 17 bp, Homo sapiens
taatatagcaaggacta

SEQ ID NO: 9310 - DNA, 20 bp, Homo sapiens
taatatagcaaggactaacc

SEQ ID NO: 9311 - DNA, 21 bp, Homo sapiens
taatatagcaaggactaaccc

SEQ ID NO: 9312 - DNA, 22 bp, Homo sapiens
taatatagcaaggactaacccc

SEQ ID NO: 9313 - DNA, 23 bp, Homo sapiens
taatatagcaaggactaacccct

SEQ ID NO: 9314 - DNA, 32 bp, Homo sapiens
taatatagcaaggactaacccctataccttct

SEQ ID NO: 9315 - DNA, 16 bp, Homo sapiens
aatatagcaaggacta

SEQ ID NO: 9316 - DNA, 19 bp, Homo sapiens
aatatagcaaggactaacc

SEQ ID NO: 9317 - DNA, 20 bp, Homo sapiens
aatatagcaaggactaaccc

SEQ ID NO: 9318 - DNA, 21 bp, Homo sapiens
aatatagcaaggactaacccc

SEQ ID NO: 9319 - DNA, 22 bp, Homo sapiens
aatatagcaaggactaacccct

SEQ ID NO: 9320 - DNA, 18 bp, Homo sapiens
atatagcaaggactaacc

SEQ ID NO: 9321 - DNA, 19 bp, Homo sapiens
atatagcaaggactaaccc

SEQ ID NO: 9322 - DNA, 20 bp, Homo sapiens
atatagcaaggactaacccc

SEQ ID NO: 9323 - DNA, 17 bp, Homo sapiens
tatagcaaggactaacc

SEQ ID NO: 9324 - DNA, 18 bp, Homo sapiens
tatagcaaggactaaccc

SEQ ID NO: 9325 - DNA, 19 bp, Homo sapiens
tatagcaaggactaacccc

SEQ ID NO: 9326 - DNA, 32 bp, Homo sapiens
tatagcaaggactaacccctataccttctgca

SEQ ID NO: 9327 - DNA, 16 bp, Homo sapiens
atagcaaggactaacc

SEQ ID NO: 9328 - DNA, 17 bp, Homo sapiens
atagcaaggactaaccc

SEQ ID NO: 9329 - DNA, 18 bp, Homo sapiens
atagcaaggactaacccc

SEQ ID NO: 9330 - DNA, 16 bp, Homo sapiens
tagcaaggactaaccc

SEQ ID NO: 9331 - DNA, 17 bp, Homo sapiens
tagcaaggactaacccc

SEQ ID NO: 9332 - DNA, 18 bp, Homo sapiens
tagcaaggactaacccct

SEQ ID NO: 9333 - DNA, 23 bp, Homo sapiens
tagcaaggactaacccctatacc

SEQ ID NO: 9334 - DNA, 24 bp, Homo sapiens
tagcaaggactaacccctatacct

SEQ ID NO: 9335 - DNA, 27 bp, Homo sapiens
tagcaaggactaacccctataccttct

SEQ ID NO: 9336 - DNA, 16 bp, Homo sapiens
agcaaggactaacccc

SEQ ID NO: 9337 - DNA, 22 bp, Homo sapiens
agcaaggactaacccctatacc

SEQ ID NO: 9338 - DNA, 16 bp, Homo sapiens
gcaaggactaacccct

SEQ ID NO: 9339 - DNA, 21 bp, Homo sapiens
gcaaggactaacccctatacc

SEQ ID NO: 9340 - DNA, 22 bp, Homo sapiens
gcaaggactaacccctatacct

SEQ ID NO: 9341 - DNA, 20 bp, Homo sapiens
caaggactaacccctatacc

SEQ ID NO: 9342 - DNA, 21 bp, Homo sapiens
caaggactaacccctatacct

SEQ ID NO: 9343 - DNA, 24 bp, Homo sapiens
caaggactaacccctataccttct

SEQ ID NO: 9344 - DNA, 27 bp, Homo sapiens
caaggactaacccctataccttctgca

SEQ ID NO: 9345 - DNA, 19 bp, Homo sapiens
aaggactaacccctatacc

SEQ ID NO: 9346 - DNA, 20 bp, Homo sapiens
aaggactaacccctatacct

SEQ ID NO: 9347 - DNA, 18 bp, Homo sapiens
aggactaacccctatacc

SEQ ID NO: 9348 - DNA, 19 bp, Homo sapiens
aggactaacccctatacct

SEQ ID NO: 9349 - DNA, 25 bp, Homo sapiens
aggactaacccctataccttctgca

SEQ ID NO: 9350 - DNA, 32 bp, Homo sapiens
aggactaacccctataccttctgcataatgaa

SEQ ID NO: 9351 - DNA, 17 bp, Homo sapiens
ggactaacccctatacc

SEQ ID NO: 9352 - DNA, 16 bp, Homo sapiens
gactaacccctatacc

SEQ ID NO: 9353 - DNA, 19 bp, Homo sapiens
aacccctataccttctgca

SEQ ID NO: 9354 - DNA, 27 bp, Homo sapiens
ctataccttctgcataatgaattaact

SEQ ID NO: 9355 - DNA, 32 bp, Homo sapiens; identical to SEQ ID NO: 1000

SEQ ID NO: 9356 - DNA, 33 bp, Homo sapiens
aattaactagaaataactttgcaaggagagcca

SEQ ID NO: 9357 - DNA, 31 bp, Homo sapiens
attaactagaaataactttgcaaggagagcc

SEQ ID NO: 9358 - DNA, 30 bp, Homo sapiens; identical to SEQ ID NO: 1001

SEQ ID NO: 9359 - DNA, 29 bp, Homo sapiens
taactagaaataactttgcaaggagagcc

SEQ ID NO: 9360 - DNA, 30 bp, Homo sapiens
taactagaaataactttgcaaggagagcca

SEQ ID NO: 9361 - DNA, 24 bp, Homo sapiens
aactagaaataactttgcaaggag

SEQ ID NO: 9362 - DNA, 28 bp, Homo sapiens
aactagaaataactttgcaaggagagcc

SEQ ID NO: 9363 - DNA, 29 bp, Homo sapiens
aactagaaataactttgcaaggagagcca

SEQ ID NO: 9364 - DNA, 27 bp, Homo sapiens
actagaaataactttgcaaggagagcc

SEQ ID NO: 9365 - DNA, 33 bp, Homo sapiens
actagaaataactttgcaaggagagccaaagct

SEQ ID NO: 9366 - DNA, 26 bp, Homo sapiens
ctagaaataactttgcaaggagagcc

SEQ ID NO: 9367 - DNA, 25 bp, Homo sapiens
tagaaataactttgcaaggagagcc

SEQ ID NO: 9368 - DNA, 24 bp, Homo sapiens
agaaataactttgcaaggagagcc

SEQ ID NO: 9369 - DNA, 23 bp, Homo sapiens
gaaataactttgcaaggagagcc

SEQ ID NO: 9370 - DNA, 20 bp, Homo sapiens
ataactttgcaaggagagcc

SEQ ID NO: 9371 - DNA, 31 bp, Homo sapiens
ataactttgcaaggagagccaaagctaagac

SEQ ID NO: 9372 - DNA, 32 bp, Homo sapiens
ataactttgcaaggagagccaaagctaagacc

SEQ ID NO: 9373 - DNA, 33 bp, Homo sapiens
ataactttgcaaggagagccaaagctaagaccc

SEQ ID NO: 9374 - DNA, 30 bp, Homo sapiens
taactttgcaaggagagccaaagctaagac

SEQ ID NO: 9375 - DNA, 31 bp, Homo sapiens
taactttgcaaggagagccaaagctaagacc

SEQ ID NO: 9376 - DNA, 29 bp, Homo sapiens
aactttgcaaggagagccaaagctaagac

SEQ ID NO: 9377 - DNA, 30 bp, Homo sapiens; identical to SEQ ID NO: 1006

SEQ ID NO: 9378 - DNA, 31 bp, Homo sapiens
aactttgcaaggagagccaaagctaagaccc

SEQ ID NO: 9379 - DNA, 32 bp, Homo sapiens
aactttgcaaggagagccaaagctaagacccc

SEQ ID NO: 9380 - DNA, 37 bp, Homo sapiens
aactttgcaaggagagccaaagctaagacccccgaaa

SEQ ID NO: 9381 - DNA, 46 bp, Homo sapiens
aactttgcaaggagagccaaagctaagacccccgaaaccagacgag

SEQ ID NO: 9382 - DNA, 28 bp, Homo sapiens
actttgcaaggagagccaaagctaagac

SEQ ID NO: 9383 - DNA, 29 bp, Homo sapiens
actttgcaaggagagccaaagctaagacc

SEQ ID NO: 9384 - DNA, 30 bp, Homo sapiens
actttgcaaggagagccaaagctaagaccc

SEQ ID NO: 9385 - DNA, 31 bp, Homo sapiens
actttgcaaggagagccaaagctaagacccc

SEQ ID NO: 9386 - DNA, 33 bp, Homo sapiens
actttgcaaggagagccaaagctaagacccccg

SEQ ID NO: 9387 - DNA, 34 bp, Homo sapiens
actttgcaaggagagccaaagctaagacccccga

SEQ ID NO: 9388 - DNA, 35 bp, Homo sapiens
actttgcaaggagagccaaagctaagacccccgaa

SEQ ID NO: 9389 - DNA, 36 bp, Homo sapiens
actttgcaaggagagccaaagctaagacccccgaaa

SEQ ID NO: 9390 - DNA, 43 bp, Homo sapiens
actttgcaaggagagccaaagctaagacccccgaaaccagacg

SEQ ID NO: 9391 - DNA, 45 bp, Homo sapiens
actttgcaaggagagccaaagctaagacccccgaaaccagacgag

SEQ ID NO: 9392 - DNA, 47 bp, Homo sapiens
actttgcaaggagagccaaagctaagacccccgaaaccagacgagct

SEQ ID NO: 9393 - DNA, 27 bp, Homo sapiens
ctttgcaaggagagccaaagctaagac

SEQ ID NO: 9394 - DNA, 28 bp, Homo sapiens
ctttgcaaggagagccaaagctaagacc

SEQ ID NO: 9395 - DNA, 26 bp, Homo sapiens
tttgcaaggagagccaaagctaagac

SEQ ID NO: 9396 - DNA, 28 bp, Homo sapiens
tttgcaaggagagccaaagctaagaccc

SEQ ID NO: 9397 - DNA, 29 bp, Homo sapiens
tttgcaaggagagccaaagctaagacccc

SEQ ID NO: 9398 - DNA, 26 bp, Homo sapiens
ttgcaaggagagccaaagctaagacc

SEQ ID NO: 9399 - DNA, 27 bp, Homo sapiens
ttgcaaggagagccaaagctaagaccc

SEQ ID NO: 9400 - DNA, 28 bp, Homo sapiens
ttgcaaggagagccaaagctaagacccc

SEQ ID NO: 9401 - DNA, 33 bp, Homo sapiens
ttgcaaggagagccaaagctaagacccccgaaa

SEQ ID NO: 9402 - DNA, 16 bp, Homo sapiens
aaagctaagacccccg

SEQ ID NO: 9403 - DNA, 28 bp, Homo sapiens
aagacccccgaaaccagacgagctacct

SEQ ID NO: 9404 - DNA, 33 bp, Homo sapiens
aagacccccgaaaccagacgagctacctaagaa

SEQ ID NO: 9405 - DNA, 31 bp, Homo sapiens
cccccgaaaccagacgagctacctaagaaca

SEQ ID NO: 9406 - DNA, 30 bp, Homo sapiens
ccccgaaaccagacgagctacctaagaaca

SEQ ID NO: 9407 - DNA, 21 bp, Homo sapiens
cccgaaaccagacgagctacc

SEQ ID NO: 9408 - DNA, 22 bp, Homo sapiens
cccgaaaccagacgagctacct

SEQ ID NO: 9409 - DNA, 27 bp, Homo sapiens
cccgaaaccagacgagctacctaagaa

SEQ ID NO: 9410 - DNA, 28 bp, Homo sapiens
cccgaaaccagacgagctacctaagaac

SEQ ID NO: 9411 - DNA, 29 bp, Homo sapiens
cccgaaaccagacgagctacctaagaaca

SEQ ID NO: 9412 - DNA, 20 bp, Homo sapiens
ccgaaaccagacgagctacc

SEQ ID NO: 9413 - DNA, 21 bp, Homo sapiens
ccgaaaccagacgagctacct

SEQ ID NO: 9414 - DNA, 25 bp, Homo sapiens
ccgaaaccagacgagctacctaaga

SEQ ID NO: 9415 - DNA, 26 bp, Homo sapiens
ccgaaaccagacgagctacctaagaa

SEQ ID NO: 9416 - DNA, 27 bp, Homo sapiens
ccgaaaccagacgagctacctaagaac

SEQ ID NO: 9417 - DNA, 28 bp, Homo sapiens
ccgaaaccagacgagctacctaagaaca

SEQ ID NO: 9418 - DNA, 30 bp, Homo sapiens
ccgaaaccagacgagctacctaagaacagc

SEQ ID NO: 9419 - DNA, 44 bp, Homo sapiens
ccgaaaccagacgagctacctaagaacagctaaaagagcacacc

SEQ ID NO: 9420 - DNA, 45 bp, Homo sapiens
ccgaaaccagacgagctacctaagaacagctaaaagagcacaccc

SEQ ID NO: 9421 - DNA, 46 bp, Homo sapiens
ccgaaaccagacgagctacctaagaacagctaaaagagcacacccg

SEQ ID NO: 9422 - DNA, 16 bp, Homo sapiens
cgaaaccagacgagct

SEQ ID NO: 9423 - DNA, 19 bp, Homo sapiens
cgaaaccagacgagctacc

SEQ ID NO: 9424 - DNA, 20 bp, Homo sapiens
cgaaaccagacgagctacct

SEQ ID NO: 9425 - DNA, 23 bp, Homo sapiens
cgaaaccagacgagctacctaag

SEQ ID NO: 9426 - DNA, 24 bp, Homo sapiens
cgaaaccagacgagctacctaaga

SEQ ID NO: 9427 - DNA, 25 bp, Homo sapiens
cgaaaccagacgagctacctaagaa

SEQ ID NO: 9428 - DNA, 26 bp, Homo sapiens
cgaaaccagacgagctacctaagaac

SEQ ID NO: 9429 - DNA, 27 bp, Homo sapiens
cgaaaccagacgagctacctaagaaca

SEQ ID NO: 9430 - DNA, 28 bp, Homo sapiens
cgaaaccagacgagctacctaagaacag

SEQ ID NO: 9431 - DNA, 29 bp, Homo sapiens
cgaaaccagacgagctacctaagaacagc

SEQ ID NO: 9432 - DNA, 31 bp, Homo sapiens
cgaaaccagacgagctacctaagaacagcta

SEQ ID NO: 9433 - DNA, 32 bp, Homo sapiens; identical to SEQ ID NO: 1021

SEQ ID NO: 9434 - DNA, 33 bp, Homo sapiens; identical to SEQ ID NO: 1022

SEQ ID NO: 9435 - DNA, 43 bp, Homo sapiens
cgaaaccagacgagctacctaagaacagctaaaagagcacacc

SEQ ID NO: 9436 - DNA, 44 bp, Homo sapiens
cgaaaccagacgagctacctaagaacagctaaaagagcacaccc

SEQ ID NO: 9437 - DNA, 45 bp, Homo sapiens
cgaaaccagacgagctacctaagaacagctaaaagagcacacccg

SEQ ID NO: 9438 - DNA, 18 bp, Homo sapiens
gaaaccagacgagctacc

SEQ ID NO: 9439 - DNA, 19 bp, Homo sapiens
gaaaccagacgagctacct

SEQ ID NO: 9440 - DNA, 24 bp, Homo sapiens
gaaaccagacgagctacctaagaa

SEQ ID NO: 9441 - DNA, 25 bp, Homo sapiens
gaaaccagacgagctacctaagaac

SEQ ID NO: 9442 - DNA, 26 bp, Homo sapiens
gaaaccagacgagctacctaagaaca

SEQ ID NO: 9443 - DNA, 27 bp, Homo sapiens
gaaaccagacgagctacctaagaacag

SEQ ID NO: 9444 - DNA, 28 bp, Homo sapiens
gaaaccagacgagctacctaagaacagc

SEQ ID NO: 9445 - DNA, 29 bp, Homo sapiens
gaaaccagacgagctacctaagaacagct

SEQ ID NO: 9446 - DNA, 30 bp, Homo sapiens
gaaaccagacgagctacctaagaacagcta

SEQ ID NO: 9447 - DNA, 31 bp, Homo sapiens
gaaaccagacgagctacctaagaacagctaa

SEQ ID NO: 9448 - DNA, 32 bp, Homo sapiens
gaaaccagacgagctacctaagaacagctaaa

SEQ ID NO: 9449 - DNA, 42 bp, Homo sapiens
gaaaccagacgagctacctaagaacagctaaaagagcacacc

SEQ ID NO: 9450 - DNA, 44 bp, Homo sapiens
gaaaccagacgagctacctaagaacagctaaaagagcacacccg

SEQ ID NO: 9451 - DNA, 24 bp, Homo sapiens
aaaccagacgagctacctaagaac

SEQ ID NO: 9452 - DNA, 25 bp, Homo sapiens
aaaccagacgagctacctaagaaca

SEQ ID NO: 9453 - DNA, 30 bp, Homo sapiens
aaaccagacgagctacctaagaacagctaa

SEQ ID NO: 9454 - DNA, 23 bp, Homo sapiens
aaccagacgagctacctaagaac

SEQ ID NO: 9455 - DNA, 29 bp, Homo sapiens
aaccagacgagctacctaagaacagctaa

SEQ ID NO: 9456 - DNA, 23 bp, Homo sapiens
accagacgagctacctaagaaca

SEQ ID NO: 9457 - DNA, 22 bp, Homo sapiens
ccagacgagctacctaagaaca

SEQ ID NO: 9458 - DNA, 20 bp, Homo sapiens
cagacgagctacctaagaac

SEQ ID NO: 9459 - DNA, 21 bp, Homo sapiens
cagacgagctacctaagaaca

SEQ ID NO: 9460 - DNA, 19 bp, Homo sapiens
agacgagctacctaagaac

SEQ ID NO: 9461 - DNA, 20 bp, Homo sapiens
agacgagctacctaagaaca

SEQ ID NO: 9462 - DNA, 22 bp, Homo sapiens
agacgagctacctaagaacagc

SEQ ID NO: 9463 - DNA, 25 bp, Homo sapiens
agacgagctacctaagaacagctaa

SEQ ID NO: 9464 - DNA, 26 bp, Homo sapiens
agacgagctacctaagaacagctaaa

SEQ ID NO: 9465 - DNA, 36 bp, Homo sapiens
agacgagctacctaagaacagctaaaagagcacacc

SEQ ID NO: 9466 - DNA, 37 bp, Homo sapiens
agacgagctacctaagaacagctaaaagagcacaccc

SEQ ID NO: 9467 - DNA, 38 bp, Homo sapiens
agacgagctacctaagaacagctaaaagagcacacccg

SEQ ID NO: 9468 - DNA, 18 bp, Homo sapiens
gacgagctacctaagaac

SEQ ID NO: 9469 - DNA, 19 bp, Homo sapiens
gacgagctacctaagaaca

SEQ ID NO: 9470 - DNA, 21 bp, Homo sapiens
gacgagctacctaagaacagc

SEQ ID NO: 9471 - DNA, 24 bp, Homo sapiens
gacgagctacctaagaacagctaa

SEQ ID NO: 9472 - DNA, 25 bp, Homo sapiens
gacgagctacctaagaacagctaaa

SEQ ID NO: 9473 - DNA, 35 bp, Homo sapiens
gacgagctacctaagaacagctaaaagagcacacc

SEQ ID NO: 9474 - DNA, 36 bp, Homo sapiens
gacgagctacctaagaacagctaaaagagcacaccc

SEQ ID NO: 9475 - DNA, 37 bp, Homo sapiens
gacgagctacctaagaacagctaaaagagcacacccg

SEQ ID NO: 9476 - DNA, 17 bp, Homo sapiens
acgagctacctaagaac

SEQ ID NO: 9477 - DNA, 18 bp, Homo sapiens
acgagctacctaagaaca

SEQ ID NO: 9478 - DNA, 34 bp, Homo sapiens
acgagctacctaagaacagctaaaagagcacacc

SEQ ID NO: 9479 - DNA, 35 bp, Homo sapiens
acgagctacctaagaacagctaaaagagcacaccc

SEQ ID NO: 9480 - DNA, 27 bp, Homo sapiens
acctaagaacagctaaaagagcacacc

SEQ ID NO: 9481 - DNA, 26 bp, Homo sapiens
ctaagaacagctaaaagagcacaccc

SEQ ID NO: 9482 - DNA, 27 bp, Homo sapiens
ctaagaacagctaaaagagcacacccg

SEQ ID NO: 9483 - DNA, 24 bp, Homo sapiens
taagaacagctaaaagagcacacc

SEQ ID NO: 9484 - DNA, 25 bp, Homo sapiens
taagaacagctaaaagagcacaccc

SEQ ID NO: 9485 - DNA, 26 bp, Homo sapiens
taagaacagctaaaagagcacacccg

SEQ ID NO: 9486 - DNA, 28 bp, Homo sapiens
taagaacagctaaaagagcacacccgtc

SEQ ID NO: 9487 - DNA, 29 bp, Homo sapiens
taagaacagctaaaagagcacacccgtct

SEQ ID NO: 9488 - DNA, 33 bp, Homo sapiens
taagaacagctaaaagagcacacccgtctatgt

SEQ ID NO: 9489 - DNA, 23 bp, Homo sapiens
aagaacagctaaaagagcacacc

SEQ ID NO: 9490 - DNA, 24 bp, Homo sapiens
aagaacagctaaaagagcacaccc

SEQ ID NO: 9491 - DNA, 25 bp, Homo sapiens
aagaacagctaaaagagcacacccg

SEQ ID NO: 9492 - DNA, 31 bp, Homo sapiens; identical to SEQ ID NO: 1033

SEQ ID NO: 9493 - DNA, 27 bp, Homo sapiens
ctaaaagagcacacccgtctatgtagc

SEQ ID NO: 9494 - DNA, 26 bp, Homo sapiens
taaaagagcacacccgtctatgtagc

SEQ ID NO: 9495 - DNA, 27 bp, Homo sapiens
taaaagagcacacccgtctatgtagca

SEQ ID NO: 9496 - DNA, 33 bp, Homo sapiens; identical to SEQ ID NO: 1034

SEQ ID NO: 9497 - DNA, 25 bp, Homo sapiens
aaaagagcacacccgtctatgtagc

SEQ ID NO: 9498 - DNA, 26 bp, Homo sapiens
aaaagagcacacccgtctatgtagca

SEQ ID NO: 9499 - DNA, 35 bp, Homo sapiens
aaaagagcacacccgtctatgtagcaaaatagtgg

SEQ ID NO: 9500 - DNA, 23 bp, Homo sapiens
aagagcacacccgtctatgtagc

SEQ ID NO: 9501 - DNA, 24 bp, Homo sapiens
aagagcacacccgtctatgtagca

SEQ ID NO: 9502 - DNA, 33 bp, Homo sapiens
aagagcacacccgtctatgtagcaaaatagtgg

SEQ ID NO: 9503 - DNA, 22 bp, Homo sapiens
agagcacacccgtctatgtagc

SEQ ID NO: 9504 - DNA, 23 bp, Homo sapiens
agagcacacccgtctatgtagca

SEQ ID NO: 9505 - DNA, 32 bp, Homo sapiens
agagcacacccgtctatgtagcaaaatagtgg

SEQ ID NO: 9506 - DNA, 21 bp, Homo sapiens
gagcacacccgtctatgtagc

SEQ ID NO: 9507 - DNA, 22 bp, Homo sapiens
gagcacacccgtctatgtagca

SEQ ID NO: 9508 - DNA, 31 bp, Homo sapiens; identical to SEQ ID NO: 1038

SEQ ID NO: 9509 - DNA, 18 bp, Homo sapiens
agcacacccgtctatgta

SEQ ID NO: 9510 - DNA, 20 bp, Homo sapiens
agcacacccgtctatgtagc

SEQ ID NO: 9511 - DNA, 21 bp, Homo sapiens
agcacacccgtctatgtagca

SEQ ID NO: 9512 - DNA, 27 bp, Homo sapiens
agcacacccgtctatgtagcaaaatag

SEQ ID NO: 9513 - DNA, 30 bp, Homo sapiens; identical to SEQ ID NO: 1041

SEQ ID NO: 9514 - DNA, 19 bp, Homo sapiens
gcacacccgtctatgtagc

SEQ ID NO: 9515 - DNA, 20 bp, Homo sapiens
gcacacccgtctatgtagca

SEQ ID NO: 9516 - DNA, 29 bp, Homo sapiens
gcacacccgtctatgtagcaaaatagtgg

SEQ ID NO: 9517 - DNA, 18 bp, Homo sapiens
cacacccgtctatgtagc

SEQ ID NO: 9518 - DNA, 19 bp, Homo sapiens
cacacccgtctatgtagca

SEQ ID NO: 9519 - DNA, 20 bp, Homo sapiens
cacacccgtctatgtagcaa

SEQ ID NO: 9520 - DNA, 21 bp, Homo sapiens
cacacccgtctatgtagcaaa

SEQ ID NO: 9521 - DNA, 22 bp, Homo sapiens
cacacccgtctatgtagcaaaa

SEQ ID NO: 9522 - DNA, 23 bp, Homo sapiens
cacacccgtctatgtagcaaaat

SEQ ID NO: 9523 - DNA, 24 bp, Homo sapiens
cacacccgtctatgtagcaaaata

SEQ ID NO: 9524 - DNA, 25 bp, Homo sapiens
cacacccgtctatgtagcaaaatag

SEQ ID NO: 9525 - DNA, 26 bp, Homo sapiens
cacacccgtctatgtagcaaaatagt

SEQ ID NO: 9526 - DNA, 27 bp, Homo sapiens
cacacccgtctatgtagcaaaatagtg

SEQ ID NO: 9527 - DNA, 28 bp, Homo sapiens
cacacccgtctatgtagcaaaatagtgg

SEQ ID NO: 9528 - DNA, 17 bp, Homo sapiens
acacccgtctatgtagc

SEQ ID NO: 9529 - DNA, 18 bp, Homo sapiens
acacccgtctatgtagca

SEQ ID NO: 9530 - DNA, 27 bp, Homo sapiens
acacccgtctatgtagcaaaatagtgg

SEQ ID NO: 9531 - DNA, 16 bp, Homo sapiens
cacccgtctatgtagc

SEQ ID NO: 9532 - DNA, 17 bp, Homo sapiens
cacccgtctatgtagca

SEQ ID NO: 9533 - DNA, 18 bp, Homo sapiens
cacccgtctatgtagcaa

SEQ ID NO: 9534 - DNA, 19 bp, Homo sapiens
cacccgtctatgtagcaaa

SEQ ID NO: 9535 - DNA, 20 bp, Homo sapiens
cacccgtctatgtagcaaaa

SEQ ID NO: 9536 - DNA, 21 bp, Homo sapiens
cacccgtctatgtagcaaaat

SEQ ID NO: 9537 - DNA, 22 bp, Homo sapiens
cacccgtctatgtagcaaaata

SEQ ID NO: 9538 - DNA, 23 bp, Homo sapiens
cacccgtctatgtagcaaaatag

SEQ ID NO: 9539 - DNA, 24 bp, Homo sapiens
cacccgtctatgtagcaaaatagt

SEQ ID NO: 9540 - DNA, 25 bp, Homo sapiens
cacccgtctatgtagcaaaatagtg

SEQ ID NO: 9541 - DNA, 26 bp, Homo sapiens
cacccgtctatgtagcaaaatagtgg

SEQ ID NO: 9542 - DNA, 27 bp, Homo sapiens
cacccgtctatgtagcaaaatagtggg

SEQ ID NO: 9543 - DNA, 18 bp, Homo sapiens
cccgtctatgtagcaaaa

SEQ ID NO: 9544 - DNA, 20 bp, Homo sapiens
cccgtctatgtagcaaaata

SEQ ID NO: 9545 - DNA, 22 bp, Homo sapiens
cccgtctatgtagcaaaatagt

SEQ ID NO: 9546 - DNA, 23 bp, Homo sapiens
cccgtctatgtagcaaaatagtg

SEQ ID NO: 9547 - DNA, 24 bp, Homo sapiens
cccgtctatgtagcaaaatagtgg

SEQ ID NO: 9548 - DNA, 28 bp, Homo sapiens
cgtctatgtagcaaaatagtgggaagat

SEQ ID NO: 9549 - DNA, 18 bp, Homo sapiens
gtctatgtagcaaaatag

SEQ ID NO: 9550 - DNA, 27 bp, Homo sapiens
gtctatgtagcaaaatagtgggaagat

SEQ ID NO: 9551 - DNA, 23 bp, Homo sapiens
atgtagcaaaatagtgggaagat

SEQ ID NO: 9552 - DNA, 25 bp, Homo sapiens
aaatagtgggaagatttataggtag

SEQ ID NO: 9553 - DNA, 26 bp, Homo sapiens
aaatagtgggaagatttataggtaga

SEQ ID NO: 9554 - DNA, 30 bp, Homo sapiens
aaatagtgggaagatttataggtagaggcg

SEQ ID NO: 9555 - DNA, 32 bp, Homo sapiens
aaatagtgggaagatttataggtagaggcgac

SEQ ID NO: 9556 - DNA, 33 bp, Homo sapiens; identical to SEQ ID NO: 1064

SEQ ID NO: 9557 - DNA, 37 bp, Homo sapiens
aaatagtgggaagatttataggtagaggcgacaaacc

SEQ ID NO: 9558 - DNA, 32 bp, Homo sapiens
aatagtgggaagatttataggtagaggcgaca

SEQ ID NO: 9559 - DNA, 31 bp, Homo sapiens
atagtgggaagatttataggtagaggcgaca

SEQ ID NO: 9560 - DNA, 30 bp, Homo sapiens
tagtgggaagatttataggtagaggcgaca

SEQ ID NO: 9561 - DNA, 29 bp, Homo sapiens
agtgggaagatttataggtagaggcgaca

SEQ ID NO: 9562 - DNA, 33 bp, Homo sapiens
agtgggaagatttataggtagaggcgacaaacc

SEQ ID NO: 9563 - DNA, 30 bp, Homo sapiens
gggaagatttataggtagaggcgacaaacc

SEQ ID NO: 9564 - DNA, 25 bp, Homo sapiens
ggaagatttataggtagaggcgaca

SEQ ID NO: 9565 - DNA, 29 bp, Homo sapiens
ggaagatttataggtagaggcgacaaacc

SEQ ID NO: 9566 - DNA, 30 bp, Homo sapiens
ggaagatttataggtagaggcgacaaacct

SEQ ID NO: 9567 - DNA, 23 bp, Homo sapiens
gaagatttataggtagaggcgac

SEQ ID NO: 9568 - DNA, 24 bp, Homo sapiens
gaagatttataggtagaggcgaca

SEQ ID NO: 9569 - DNA, 28 bp, Homo sapiens
gaagatttataggtagaggcgacaaacc

SEQ ID NO: 9570 - DNA, 29 bp, Homo sapiens
gaagatttataggtagaggcgacaaacct

SEQ ID NO: 9571 - DNA, 22 bp, Homo sapiens
aagatttataggtagaggcgac

SEQ ID NO: 9572 - DNA, 23 bp, Homo sapiens
aagatttataggtagaggcgaca

SEQ ID NO: 9573 - DNA, 27 bp, Homo sapiens
aagatttataggtagaggcgacaaacc

SEQ ID NO: 9574 - DNA, 28 bp, Homo sapiens
aagatttataggtagaggcgacaaacct

SEQ ID NO: 9575 - DNA, 20 bp, Homo sapiens
gatttataggtagaggcgac

SEQ ID NO: 9576 - DNA, 21 bp, Homo sapiens
gatttataggtagaggcgaca

SEQ ID NO: 9577 - DNA, 25 bp, Homo sapiens
gatttataggtagaggcgacaaacc

SEQ ID NO: 9578 - DNA, 19 bp, Homo sapiens
atttataggtagaggcgac

SEQ ID NO: 9579 - DNA, 20 bp, Homo sapiens
atttataggtagaggcgaca

SEQ ID NO: 9580 - DNA, 24 bp, Homo sapiens
atttataggtagaggcgacaaacc

SEQ ID NO: 9581 - DNA, 17 bp, Homo sapiens
tttataggtagaggcga

SEQ ID NO: 9582 - DNA, 18 bp, Homo sapiens
tttataggtagaggcgac

SEQ ID NO: 9583 - DNA, 19 bp, Homo sapiens
tttataggtagaggcgaca

SEQ ID NO: 9584 - DNA, 22 bp, Homo sapiens
tttataggtagaggcgacaaac

SEQ ID NO: 9585 - DNA, 17 bp, Homo sapiens
ttataggtagaggcgac

SEQ ID NO: 9586 - DNA, 18 bp, Homo sapiens
ttataggtagaggcgaca

SEQ ID NO: 9587 - DNA, 21 bp, Homo sapiens
ttataggtagaggcgacaaac

SEQ ID NO: 9588 - DNA, 22 bp, Homo sapiens
ttataggtagaggcgacaaacc

SEQ ID NO: 9589 - DNA, 23 bp, Homo sapiens
ttataggtagaggcgacaaacct

SEQ ID NO: 9590 - DNA, 16 bp, Homo sapiens
tataggtagaggcgac

SEQ ID NO: 9591 - DNA, 17 bp, Homo sapiens
tataggtagaggcgaca

SEQ ID NO: 9592 - DNA, 21 bp, Homo sapiens
tataggtagaggcgacaaacc

SEQ ID NO: 9593 - DNA, 16 bp, Homo sapiens
ataggtagaggcgaca

SEQ ID NO: 9594 - DNA, 20 bp, Homo sapiens
ataggtagaggcgacaaacc

SEQ ID NO: 9595 - DNA, 19 bp, Homo sapiens
taggtagaggcgacaaacc

SEQ ID NO: 9596 - DNA, 18 bp, Homo sapiens
aggtagaggcgacaaacc

SEQ ID NO: 9597 - DNA, 33 bp, Homo sapiens
acaaacctaccgagcctggtgatagctggttgt

SEQ ID NO: 9598 - DNA, 19 bp, Homo sapiens
aacctaccgagcctggtga

SEQ ID NO: 9599 - DNA, 25 bp, Homo sapiens
aacctaccgagcctggtgatagctg

SEQ ID NO: 9600 - DNA, 30 bp, Homo sapiens
aacctaccgagcctggtgatagctggttgt

SEQ ID NO: 9601 - DNA, 21 bp, Homo sapiens
taccgagcctggtgatagctg

SEQ ID NO: 9602 - DNA, 28 bp, Homo sapiens
taccgagcctggtgatagctggttgtcc

SEQ ID NO: 9603 - DNA, 29 bp, Homo sapiens
taccgagcctggtgatagctggttgtcca

SEQ ID NO: 9604 - DNA, 31 bp, Homo sapiens; identical to SEQ ID NO: 1077

SEQ ID NO: 9605 - DNA, 32 bp, Homo sapiens; identical to SEQ ID NO: 1078

SEQ ID NO: 9606 - DNA, 33 bp, Homo sapiens; identical to SEQ ID NO: 1079

SEQ ID NO: 9607 - DNA, 34 bp, Homo sapiens
taccgagcctggtgatagctggttgtccaagata

SEQ ID NO: 9608 - DNA, 35 bp, Homo sapiens
taccgagcctggtgatagctggttgtccaagatag

SEQ ID NO: 9609 - DNA, 20 bp, Homo sapiens
accgagcctggtgatagctg

SEQ ID NO: 9610 - DNA, 27 bp, Homo sapiens
accgagcctggtgatagctggttgtcc

SEQ ID NO: 9611 - DNA, 30 bp, Homo sapiens
accgagcctggtgatagctggttgtccaag

SEQ ID NO: 9612 - DNA, 31 bp, Homo sapiens
accgagcctggtgatagctggttgtccaaga

SEQ ID NO: 9613 - DNA, 32 bp, Homo sapiens
accgagcctggtgatagctggttgtccaagat

SEQ ID NO: 9614 - DNA, 31 bp, Homo sapiens
ccgagcctggtgatagctggttgtccaagat

SEQ ID NO: 9615 - DNA, 24 bp, Homo sapiens
gagcctggtgatagctggttgtcc

SEQ ID NO: 9616 - DNA, 27 bp, Homo sapiens
gagcctggtgatagctggttgtccaag

SEQ ID NO: 9617 - DNA, 28 bp, Homo sapiens
gagcctggtgatagctggttgtccaaga

SEQ ID NO: 9618 - DNA, 29 bp, Homo sapiens
gagcctggtgatagctggttgtccaagat

SEQ ID NO: 9619 - DNA, 30 bp, Homo sapiens; identical to SEQ ID NO: 1082

SEQ ID NO: 9620 - DNA, 31 bp, Homo sapiens
gagcctggtgatagctggttgtccaagatag

SEQ ID NO: 9621 - DNA, 32 bp, Homo sapiens
gagcctggtgatagctggttgtccaagataga

SEQ ID NO: 9622 - DNA, 35 bp, Homo sapiens
gagcctggtgatagctggttgtccaagatagaatc

SEQ ID NO: 9623 - DNA, 22 bp, Homo sapiens
agcctggtgatagctggttgtc

SEQ ID NO: 9624 - DNA, 23 bp, Homo sapiens
agcctggtgatagctggttgtcc

SEQ ID NO: 9625 - DNA, 24 bp, Homo sapiens
agcctggtgatagctggttgtcca

SEQ ID NO: 9626 - DNA, 26 bp, Homo sapiens
agcctggtgatagctggttgtccaag

SEQ ID NO: 9627 - DNA, 27 bp, Homo sapiens
agcctggtgatagctggttgtccaaga

SEQ ID NO: 9628 - DNA, 28 bp, Homo sapiens
agcctggtgatagctggttgtccaagat

SEQ ID NO: 9629 - DNA, 29 bp, Homo sapiens
agcctggtgatagctggttgtccaagata

SEQ ID NO: 9630 - DNA, 30 bp, Homo sapiens
agcctggtgatagctggttgtccaagatag

SEQ ID NO: 9631 - DNA, 31 bp, Homo sapiens
agcctggtgatagctggttgtccaagataga

SEQ ID NO: 9632 - DNA, 32 bp, Homo sapiens
agcctggtgatagctggttgtccaagatagaa

SEQ ID NO: 9633 - DNA, 33 bp, Homo sapiens
agcctggtgatagctggttgtccaagatagaat

SEQ ID NO: 9634 - DNA, 35 bp, Homo sapiens
agcctggtgatagctggttgtccaagatagaatct

SEQ ID NO: 9635 - DNA, 33 bp, Homo sapiens
gcctggtgatagctggttgtccaagatagaatc

SEQ ID NO: 9636 - DNA, 32 bp, Homo sapiens
cctggtgatagctggttgtccaagatagaatc

SEQ ID NO: 9637 - DNA, 31 bp, Homo sapiens
ctggtgatagctggttgtccaagatagaatc

SEQ ID NO: 9638 - DNA, 23 bp, Homo sapiens
tggtgatagctggttgtccaaga

SEQ ID NO: 9639 - DNA, 24 bp, Homo sapiens
tggtgatagctggttgtccaagat

SEQ ID NO: 9640 - DNA, 25 bp, Homo sapiens
tggtgatagctggttgtccaagata

SEQ ID NO: 9641 - DNA, 30 bp, Homo sapiens
tggtgatagctggttgtccaagatagaatc

SEQ ID NO: 9642 - DNA, 22 bp, Homo sapiens
ggtgatagctggttgtccaaga

SEQ ID NO: 9643 - DNA, 23 bp, Homo sapiens
ggtgatagctggttgtccaagat

SEQ ID NO: 9644 - DNA, 24 bp, Homo sapiens
ggtgatagctggttgtccaagata

SEQ ID NO: 9645 - DNA, 29 bp, Homo sapiens
ggtgatagctggttgtccaagatagaatc

SEQ ID NO: 9646 - DNA, 30 bp, Homo sapiens
ggtgatagctggttgtccaagatagaatct

SEQ ID NO: 9647 - DNA, 21 bp, Homo sapiens
tagctggttgtccaagataga

SEQ ID NO: 9648 - DNA, 23 bp, Homo sapiens
tagctggttgtccaagatagaat

SEQ ID NO: 9649 - DNA, 25 bp, Homo sapiens
tagctggttgtccaagatagaatct

SEQ ID NO: 9650 - DNA, 29 bp, Homo sapiens
tagctggttgtccaagatagaatcttagt

SEQ ID NO: 9651 - DNA, 20 bp, Homo sapiens
agctggttgtccaagataga

SEQ ID NO: 9652 - DNA, 22 bp, Homo sapiens
agctggttgtccaagatagaat

SEQ ID NO: 9653 - DNA, 24 bp, Homo sapiens
agctggttgtccaagatagaatct

SEQ ID NO: 9654 - DNA, 28 bp, Homo sapiens
agctggttgtccaagatagaatcttagt

SEQ ID NO: 9655 - DNA, 22 bp, Homo sapiens
gctggttgtccaagatagaatc

SEQ ID NO: 9656 - DNA, 19 bp, Homo sapiens
ggttgtccaagatagaatc

SEQ ID NO: 9657 - DNA, 32 bp, Homo sapiens
agatagaatcttagttcaactttaaatttgcc

SEQ ID NO: 9658 - DNA, 33 bp, Homo sapiens; identical to SEQ ID NO: 1089

SEQ ID NO: 9659 - DNA, 32 bp, Homo sapiens
gatagaatcttagttcaactttaaatttgccc

SEQ ID NO: 9660 - DNA, 31 bp, Homo sapiens
atagaatcttagttcaactttaaatttgccc

SEQ ID NO: 9661 - DNA, 29 bp, Homo sapiens
agaatcttagttcaactttaaatttgccc

SEQ ID NO: 9662 - DNA, 32 bp, Homo sapiens
agaatcttagttcaactttaaatttgcccaca

SEQ ID NO: 9663 - DNA, 28 bp, Homo sapiens
gaatcttagttcaactttaaatttgccc

SEQ ID NO: 9664 - DNA, 31 bp, Homo sapiens
gaatcttagttcaactttaaatttgcccaca

SEQ ID NO: 9665 - DNA, 26 bp, Homo sapiens
aatcttagttcaactttaaatttgcc

SEQ ID NO: 9666 - DNA, 27 bp, Homo sapiens
aatcttagttcaactttaaatttgccc

SEQ ID NO: 9667 - DNA, 26 bp, Homo sapiens
atcttagttcaactttaaatttgccc

SEQ ID NO: 9668 - DNA, 24 bp, Homo sapiens
tcttagttcaactttaaatttgcc

SEQ ID NO: 9669 - DNA, 25 bp, Homo sapiens
tcttagttcaactttaaatttgccc

SEQ ID NO: 9670 - DNA, 26 bp, Homo sapiens
tcttagttcaactttaaatttgccca

SEQ ID NO: 9671 - DNA, 28 bp, Homo sapiens
tcttagttcaactttaaatttgcccaca

SEQ ID NO: 9672 - DNA, 33 bp, Homo sapiens; identical to SEQ ID NO: 1092

SEQ ID NO: 9673 - DNA, 23 bp, Homo sapiens
cttagttcaactttaaatttgcc

SEQ ID NO: 9674 - DNA, 24 bp, Homo sapiens
cttagttcaactttaaatttgccc

SEQ ID NO: 9675 - DNA, 27 bp, Homo sapiens
cttagttcaactttaaatttgcccaca

SEQ ID NO: 9676 - DNA, 32 bp, Homo sapiens; identical to SEQ ID NO: 1093

SEQ ID NO: 9677 - DNA, 33 bp, Homo sapiens
cttagttcaactttaaatttgcccacagaaccc

SEQ ID NO: 9678 - DNA, 23 bp, Homo sapiens
ttagttcaactttaaatttgccc

SEQ ID NO: 9679 - DNA, 31 bp, Homo sapiens
ttagttcaactttaaatttgcccacagaacc

SEQ ID NO: 9680 - DNA, 32 bp, Homo sapiens
ttagttcaactttaaatttgcccacagaaccc

SEQ ID NO: 9681 - DNA, 33 bp, Homo sapiens
ttagttcaactttaaatttgcccacagaaccct

SEQ ID NO: 9682 - DNA, 21 bp, Homo sapiens
tagttcaactttaaatttgcc

SEQ ID NO: 9683 - DNA, 22 bp, Homo sapiens
tagttcaactttaaatttgccc

SEQ ID NO: 9684 - DNA, 30 bp, Homo sapiens
tagttcaactttaaatttgcccacagaacc

SEQ ID NO: 9685 - DNA, 31 bp, Homo sapiens
tagttcaactttaaatttgcccacagaaccc

SEQ ID NO: 9686 - DNA, 32 bp, Homo sapiens
tagttcaactttaaatttgcccacagaaccct

SEQ ID NO: 9687 - DNA, 20 bp, Homo sapiens
gttcaactttaaatttgccc

SEQ ID NO: 9688 - DNA, 26 bp, Homo sapiens
caactttaaatttgcccacagaaccc

SEQ ID NO: 9689 - DNA, 25 bp, Homo sapiens
aactttaaatttgcccacagaaccc

SEQ ID NO: 9690 - DNA, 23 bp, Homo sapiens
actttaaatttgcccacagaacc

SEQ ID NO: 9691 - DNA, 24 bp, Homo sapiens
actttaaatttgcccacagaaccc

SEQ ID NO: 9692 - DNA, 25 bp, Homo sapiens
actttaaatttgcccacagaaccct

SEQ ID NO: 9693 - DNA, 33 bp, Homo sapiens
actttaaatttgcccacagaaccctctaaatcc

SEQ ID NO: 9694 - DNA, 23 bp, Homo sapiens
ctttaaatttgcccacagaaccc

SEQ ID NO: 9695 - DNA, 33 bp, Homo sapiens
ctttaaatttgcccacagaaccctctaaatccc

SEQ ID NO: 9696 - DNA, 22 bp, Homo sapiens
tttaaatttgcccacagaaccc

SEQ ID NO: 9697 - DNA, 31 bp, Homo sapiens
tttaaatttgcccacagaaccctctaaatcc

SEQ ID NO: 9698 - DNA, 32 bp, Homo sapiens
tttaaatttgcccacagaaccctctaaatccc

SEQ ID NO: 9699 - DNA, 20 bp, Homo sapiens
ttaaatttgcccacagaacc

SEQ ID NO: 9700 - DNA, 21 bp, Homo sapiens
ttaaatttgcccacagaaccc

SEQ ID NO: 9701 - DNA, 22 bp, Homo sapiens
ttaaatttgcccacagaaccct

SEQ ID NO: 9702 - DNA, 26 bp, Homo sapiens
ttaaatttgcccacagaaccctctaa

SEQ ID NO: 9703 - DNA, 30 bp, Homo sapiens
ttaaatttgcccacagaaccctctaaatcc

SEQ ID NO: 9704 - DNA, 31 bp, Homo sapiens
ttaaatttgcccacagaaccctctaaatccc

SEQ ID NO: 9705 - DNA, 32 bp, Homo sapiens
ttaaatttgcccacagaaccctctaaatcccc

SEQ ID NO: 9706 - DNA, 33 bp, Homo sapiens
ttaaatttgcccacagaaccctctaaatcccct

SEQ ID NO: 9707 - DNA, 20 bp, Homo sapiens
taaatttgcccacagaaccc

SEQ ID NO: 9708 - DNA, 29 bp, Homo sapiens
taaatttgcccacagaaccctctaaatcc

SEQ ID NO: 9709 - DNA, 30 bp, Homo sapiens
taaatttgcccacagaaccctctaaatccc

SEQ ID NO: 9710 - DNA, 19 bp, Homo sapiens
aaatttgcccacagaaccc

SEQ ID NO: 9711 - DNA, 20 bp, Homo sapiens
aaatttgcccacagaaccct

SEQ ID NO: 9712 - DNA, 28 bp, Homo sapiens
aaatttgcccacagaaccctctaaatcc

SEQ ID NO: 9713 - DNA, 29 bp, Homo sapiens
aaatttgcccacagaaccctctaaatccc

SEQ ID NO: 9714 - DNA, 18 bp, Homo sapiens
aatttgcccacagaaccc

SEQ ID NO: 9715 - DNA, 19 bp, Homo sapiens
aatttgcccacagaaccct

SEQ ID NO: 9716 - DNA, 27 bp, Homo sapiens
aatttgcccacagaaccctctaaatcc

SEQ ID NO: 9717 - DNA, 28 bp, Homo sapiens
aatttgcccacagaaccctctaaatccc

SEQ ID NO: 9718 - DNA, 29 bp, Homo sapiens
aatttgcccacagaaccctctaaatcccc

SEQ ID NO: 9719 - DNA, 30 bp, Homo sapiens
aatttgcccacagaaccctctaaatcccct

SEQ ID NO: 9720 - DNA, 17 bp, Homo sapiens
atttgcccacagaaccc

SEQ ID NO: 9721 - DNA, 26 bp, Homo sapiens
atttgcccacagaaccctctaaatcc

SEQ ID NO: 9722 - DNA, 27 bp, Homo sapiens
atttgcccacagaaccctctaaatccc

SEQ ID NO: 9723 - DNA, 28 bp, Homo sapiens
atttgcccacagaaccctctaaatcccc

SEQ ID NO: 9724 - DNA, 29 bp, Homo sapiens
atttgcccacagaaccctctaaatcccct

SEQ ID NO: 9725 - DNA, 23 bp, Homo sapiens
tttgcccacagaaccctctaaat

SEQ ID NO: 9726 - DNA, 25 bp, Homo sapiens
tttgcccacagaaccctctaaatcc

SEQ ID NO: 9727 - DNA, 26 bp, Homo sapiens
tttgcccacagaaccctctaaatccc

SEQ ID NO: 9728 - DNA, 27 bp, Homo sapiens
tttgcccacagaaccctctaaatcccc

SEQ ID NO: 9729 - DNA, 33 bp, Homo sapiens; identical to SEQ ID NO: 1095

SEQ ID NO: 9730 - DNA, 21 bp, Homo sapiens
ttgcccacagaaccctctaaa

SEQ ID NO: 9731 - DNA, 24 bp, Homo sapiens
ttgcccacagaaccctctaaatcc

SEQ ID NO: 9732 - DNA, 25 bp, Homo sapiens
ttgcccacagaaccctctaaatccc

SEQ ID NO: 9733 - DNA, 26 bp, Homo sapiens
ttgcccacagaaccctctaaatcccc

SEQ ID NO: 9734 - DNA, 27 bp, Homo sapiens
ttgcccacagaaccctctaaatcccct

SEQ ID NO: 9735 - DNA, 32 bp, Homo sapiens
ttgcccacagaaccctctaaatccccttgtaa

SEQ ID NO: 9736 - DNA, 23 bp, Homo sapiens
tgcccacagaaccctctaaatcc

SEQ ID NO: 9737 - DNA, 24 bp, Homo sapiens
tgcccacagaaccctctaaatccc

SEQ ID NO: 9738 - DNA, 25 bp, Homo sapiens
tgcccacagaaccctctaaatcccc

SEQ ID NO: 9739 - DNA, 26 bp, Homo sapiens
tgcccacagaaccctctaaatcccct

SEQ ID NO: 9740 - DNA, 31 bp, Homo sapiens
tgcccacagaaccctctaaatccccttgtaa

SEQ ID NO: 9741 - DNA, 23 bp, Homo sapiens
gcccacagaaccctctaaatccc

SEQ ID NO: 9742 - DNA, 21 bp, Homo sapiens
cccacagaaccctctaaatcc

SEQ ID NO: 9743 - DNA, 18 bp, Homo sapiens
cacagaaccctctaaatc

SEQ ID NO: 9744 - DNA, 19 bp, Homo sapiens
cacagaaccctctaaatcc

SEQ ID NO: 9745 - DNA, 20 bp, Homo sapiens
cacagaaccctctaaatccc

SEQ ID NO: 9746 - DNA, 21 bp, Homo sapiens
cacagaaccctctaaatcccc

SEQ ID NO: 9747 - DNA, 22 bp, Homo sapiens
cacagaaccctctaaatcccct

SEQ ID NO: 9748 - DNA, 17 bp, Homo sapiens
acagaaccctctaaatc

SEQ ID NO: 9749 - DNA, 18 bp, Homo sapiens
acagaaccctctaaatcc

SEQ ID NO: 9750 - DNA, 19 bp, Homo sapiens
acagaaccctctaaatccc

SEQ ID NO: 9751 - DNA, 20 bp, Homo sapiens
acagaaccctctaaatcccc

SEQ ID NO: 9752 - DNA, 21 bp, Homo sapiens
acagaaccctctaaatcccct

SEQ ID NO: 9753 - DNA, 33 bp, Homo sapiens
acagaaccctctaaatccccttgtaaatttaac

SEQ ID NO: 9754 - DNA, 35 bp, Homo sapiens
acagaaccctctaaatccccttgtaaatttaactg

SEQ ID NO: 9755 - DNA, 16 bp, Homo sapiens
cagaaccctctaaatc

SEQ ID NO: 9756 - DNA, 17 bp, Homo sapiens
cagaaccctctaaatcc

SEQ ID NO: 9757 - DNA, 18 bp, Homo sapiens
cagaaccctctaaatccc

SEQ ID NO: 9758 - DNA, 19 bp, Homo sapiens
cagaaccctctaaatcccc

SEQ ID NO: 9759 - DNA, 20 bp, Homo sapiens
cagaaccctctaaatcccct

SEQ ID NO: 9760 - DNA, 25 bp, Homo sapiens
cagaaccctctaaatccccttgtaa

SEQ ID NO: 9761 - DNA, 27 bp, Homo sapiens
cagaaccctctaaatccccttgtaaat

SEQ ID NO: 9762 - DNA, 28 bp, Homo sapiens
cagaaccctctaaatccccttgtaaatt

SEQ ID NO: 9763 - DNA, 32 bp, Homo sapiens
cagaaccctctaaatccccttgtaaatttaac

SEQ ID NO: 9764 - DNA, 33 bp, Homo sapiens; identical to SEQ ID NO: 1109

SEQ ID NO: 9765 - DNA, 34 bp, Homo sapiens
cagaaccctctaaatccccttgtaaatttaactg

SEQ ID NO: 9766 - DNA, 16 bp, Homo sapiens
agaaccctctaaatcc

SEQ ID NO: 9767 - DNA, 17 bp, Homo sapiens
agaaccctctaaatccc

SEQ ID NO: 9768 - DNA, 18 bp, Homo sapiens
agaaccctctaaatcccc

SEQ ID NO: 9769 - DNA, 33 bp, Homo sapiens
agaaccctctaaatccccttgtaaatttaactg

SEQ ID NO: 9770 - DNA, 16 bp, Homo sapiens
gaaccctctaaatccc

SEQ ID NO: 9771 - DNA, 17 bp, Homo sapiens
gaaccctctaaatcccc

SEQ ID NO: 9772 - DNA, 18 bp, Homo sapiens
gaaccctctaaatcccct

SEQ ID NO: 9773 - DNA, 31 bp, Homo sapiens
gaaccctctaaatccccttgtaaatttaact

SEQ ID NO: 9774 - DNA, 32 bp, Homo sapiens; identical to SEQ ID NO: 1112

SEQ ID NO: 9775 - DNA, 31 bp, Homo sapiens; identical to SEQ ID NO: 1113

SEQ ID NO: 9776 - DNA, 27 bp, Homo sapiens
ctctaaatccccttgtaaatttaactg

SEQ ID NO: 9777 - DNA, 26 bp, Homo sapiens
tctaaatccccttgtaaatttaactg

SEQ ID NO: 9778 - DNA, 37 bp, Homo sapiens
tctaaatccccttgtaaatttaactgttagtccaaag

SEQ ID NO: 9779 - DNA, 25 bp, Homo sapiens
ctaaatccccttgtaaatttaactg

SEQ ID NO: 9780 - DNA, 24 bp, Homo sapiens
taaatccccttgtaaatttaactg

SEQ ID NO: 9781 - DNA, 23 bp, Homo sapiens
aaatccccttgtaaatttaactg

SEQ ID NO: 9782 - DNA, 22 bp, Homo sapiens
aatccccttgtaaatttaactg

SEQ ID NO: 9783 - DNA, 33 bp, Homo sapiens; identical to SEQ ID NO: 1119

SEQ ID NO: 9784 - DNA, 21 bp, Homo sapiens
atccccttgtaaatttaactg

SEQ ID NO: 9785 - DNA, 32 bp, Homo sapiens
atccccttgtaaatttaactgttagtccaaag

SEQ ID NO: 9786 - DNA, 30 bp, Homo sapiens
ccccttgtaaatttaactgttagtccaaag

SEQ ID NO: 9787 - DNA, 29 bp, Homo sapiens
cccttgtaaatttaactgttagtccaaag

SEQ ID NO: 9788 - DNA, 17 bp, Homo sapiens
ccttgtaaatttaactg

SEQ ID NO: 9789 - DNA, 27 bp, Homo sapiens
ccttgtaaatttaactgttagtccaaa

SEQ ID NO: 9790 - DNA, 28 bp, Homo sapiens
ccttgtaaatttaactgttagtccaaag

SEQ ID NO: 9791 - DNA, 29 bp, Homo sapiens
ccttgtaaatttaactgttagtccaaaga

SEQ ID NO: 9792 - DNA, 30 bp, Homo sapiens
ccttgtaaatttaactgttagtccaaagag

SEQ ID NO: 9793 - DNA, 31 bp, Homo sapiens
ccttgtaaatttaactgttagtccaaagagg

SEQ ID NO: 9794 - DNA, 35 bp, Homo sapiens
ccttgtaaatttaactgttagtccaaagaggaaca

SEQ ID NO: 9795 - DNA, 23 bp, Homo sapiens
cttgtaaatttaactgttagtcc

SEQ ID NO: 9796 - DNA, 26 bp, Homo sapiens
cttgtaaatttaactgttagtccaaa

SEQ ID NO: 9797 - DNA, 27 bp, Homo sapiens
cttgtaaatttaactgttagtccaaag

SEQ ID NO: 9798 - DNA, 28 bp, Homo sapiens
cttgtaaatttaactgttagtccaaaga

SEQ ID NO: 9799 - DNA, 29 bp, Homo sapiens
cttgtaaatttaactgttagtccaaagag

SEQ ID NO: 9800 - DNA, 30 bp, Homo sapiens
cttgtaaatttaactgttagtccaaagagg

SEQ ID NO: 9801 - DNA, 33 bp, Homo sapiens; identical to SEQ ID NO: 1124

SEQ ID NO: 9802 - DNA, 34 bp, Homo sapiens
cttgtaaatttaactgttagtccaaagaggaaca

SEQ ID NO: 9803 - DNA, 22 bp, Homo sapiens
ttgtaaatttaactgttagtcc

SEQ ID NO: 9804 - DNA, 25 bp, Homo sapiens
ttgtaaatttaactgttagtccaaa

SEQ ID NO: 9805 - DNA, 26 bp, Homo sapiens
ttgtaaatttaactgttagtccaaag

SEQ ID NO: 9806 - DNA, 27 bp, Homo sapiens
ttgtaaatttaactgttagtccaaaga

SEQ ID NO: 9807 - DNA, 28 bp, Homo sapiens
ttgtaaatttaactgttagtccaaagag

SEQ ID NO: 9808 - DNA, 29 bp, Homo sapiens
ttgtaaatttaactgttagtccaaagagg

SEQ ID NO: 9809 - DNA, 30 bp, Homo sapiens
ttgtaaatttaactgttagtccaaagagga

SEQ ID NO: 9810 - DNA, 31 bp, Homo sapiens
ttgtaaatttaactgttagtccaaagaggaa

SEQ ID NO: 9811 - DNA, 32 bp, Homo sapiens; identical to SEQ ID NO: 1128

SEQ ID NO: 9812 - DNA, 33 bp, Homo sapiens; identical to SEQ ID NO: 1129

SEQ ID NO: 9813 - DNA, 25 bp, Homo sapiens
tgtaaatttaactgttagtccaaag

SEQ ID NO: 9814 - DNA, 26 bp, Homo sapiens
tgtaaatttaactgttagtccaaaga

SEQ ID NO: 9815 - DNA, 27 bp, Homo sapiens
tgtaaatttaactgttagtccaaagag

SEQ ID NO: 9816 - DNA, 32 bp, Homo sapiens; identical to SEQ ID NO: 1131

SEQ ID NO: 9817 - DNA, 24 bp, Homo sapiens
gtaaatttaactgttagtccaaag

SEQ ID NO: 9818 - DNA, 30 bp, Homo sapiens
taaatttaactgttagtccaaagaggaaca

SEQ ID NO: 9819 - DNA, 29 bp, Homo sapiens
aaatttaactgttagtccaaagaggaaca

SEQ ID NO: 9820 - DNA, 21 bp, Homo sapiens
aatttaactgttagtccaaag

SEQ ID NO: 9821 - DNA, 23 bp, Homo sapiens
aatttaactgttagtccaaagag

SEQ ID NO: 9822 - DNA, 28 bp, Homo sapiens
aatttaactgttagtccaaagaggaaca

SEQ ID NO: 9823 - DNA, 27 bp, Homo sapiens
atttaactgttagtccaaagaggaaca

SEQ ID NO: 9824 - DNA, 26 bp, Homo sapiens
tttaactgttagtccaaagaggaaca

SEQ ID NO: 9825 - DNA, 25 bp, Homo sapiens
ttaactgttagtccaaagaggaaca

SEQ ID NO: 9826 - DNA, 24 bp, Homo sapiens
taactgttagtccaaagaggaaca

SEQ ID NO: 9827 - DNA, 23 bp, Homo sapiens
aactgttagtccaaagaggaaca

SEQ ID NO: 9828 - DNA, 19 bp, Homo sapiens
gttagtccaaagaggaaca

SEQ ID NO: 9829 - DNA, 25 bp, Homo sapiens
aaagaggaacagctctttggacact

SEQ ID NO: 9830 - DNA, 24 bp, Homo sapiens
aagaggaacagctctttggacact

SEQ ID NO: 9831 - DNA, 27 bp, Homo sapiens
aagaggaacagctctttggacactagg

SEQ ID NO: 9832 - DNA, 28 bp, Homo sapiens
aagaggaacagctctttggacactagga

SEQ ID NO: 9833 - DNA, 29 bp, Homo sapiens
aagaggaacagctctttggacactaggaa

SEQ ID NO: 9834 - DNA, 30 bp, Homo sapiens
aagaggaacagctctttggacactaggaaa

SEQ ID NO: 9835 - DNA, 31 bp, Homo sapiens
aagaggaacagctctttggacactaggaaaa

SEQ ID NO: 9836 - DNA, 32 bp, Homo sapiens
aagaggaacagctctttggacactaggaaaaa

SEQ ID NO: 9837 - DNA, 35 bp, Homo sapiens
aagaggaacagctctttggacactaggaaaaaacc

SEQ ID NO: 9838 - DNA, 20 bp, Homo sapiens
agaggaacagctctttggac

SEQ ID NO: 9839 - DNA, 23 bp, Homo sapiens
agaggaacagctctttggacact

SEQ ID NO: 9840 - DNA, 26 bp, Homo sapiens
agaggaacagctctttggacactagg

SEQ ID NO: 9841 - DNA, 27 bp, Homo sapiens
agaggaacagctctttggacactagga

SEQ ID NO: 9842 - DNA, 28 bp, Homo sapiens
agaggaacagctctttggacactaggaa

SEQ ID NO: 9843 - DNA, 29 bp, Homo sapiens
agaggaacagctctttggacactaggaaa

SEQ ID NO: 9844 - DNA, 33 bp, Homo sapiens
agaggaacagctctttggacactaggaaaaaac

SEQ ID NO: 9845 - DNA, 34 bp, Homo sapiens
agaggaacagctctttggacactaggaaaaaacc

SEQ ID NO: 9846 - DNA, 19 bp, Homo sapiens
gaggaacagctctttggac

SEQ ID NO: 9847 - DNA, 20 bp, Homo sapiens
gaggaacagctctttggaca

SEQ ID NO: 9848 - DNA, 21 bp, Homo sapiens
gaggaacagctctttggacac

SEQ ID NO: 9849 - DNA, 22 bp, Homo sapiens
gaggaacagctctttggacact

SEQ ID NO: 9850 - DNA, 23 bp, Homo sapiens
gaggaacagctctttggacacta

SEQ ID NO: 9851 - DNA, 24 bp, Homo sapiens
gaggaacagctctttggacactag

SEQ ID NO: 9852 - DNA, 25 bp, Homo sapiens
gaggaacagctctttggacactagg

SEQ ID NO: 9853 - DNA, 26 bp, Homo sapiens
gaggaacagctctttggacactagga

SEQ ID NO: 9854 - DNA, 27 bp, Homo sapiens
gaggaacagctctttggacactaggaa

SEQ ID NO: 9855 - DNA, 28 bp, Homo sapiens
gaggaacagctctttggacactaggaaa

SEQ ID NO: 9856 - DNA, 29 bp, Homo sapiens
gaggaacagctctttggacactaggaaaa

SEQ ID NO: 9857 - DNA, 32 bp, Homo sapiens; identical to SEQ ID NO: 1146

SEQ ID NO: 9858 - DNA, 33 bp, Homo sapiens; identical to SEQ ID NO: 1147

SEQ ID NO: 9859 - DNA, 34 bp, Homo sapiens
gaggaacagctctttggacactaggaaaaaacct

SEQ ID NO: 9860 - DNA, 18 bp, Homo sapiens
aggaacagctctttggac

SEQ ID NO: 9861 - DNA, 19 bp, Homo sapiens
aggaacagctctttggaca

SEQ ID NO: 9862 - DNA, 20 bp, Homo sapiens
aggaacagctctttggacac

SEQ ID NO: 9863 - DNA, 21 bp, Homo sapiens
aggaacagctctttggacact

SEQ ID NO: 9864 - DNA, 22 bp, Homo sapiens
aggaacagctctttggacacta

SEQ ID NO: 9865 - DNA, 24 bp, Homo sapiens
aggaacagctctttggacactagg

SEQ ID NO: 9866 - DNA, 25 bp, Homo sapiens
aggaacagctctttggacactagga

SEQ ID NO: 9867 - DNA, 26 bp, Homo sapiens
aggaacagctctttggacactaggaa

SEQ ID NO: 9868 - DNA, 27 bp, Homo sapiens
aggaacagctctttggacactaggaaa

SEQ ID NO: 9869 - DNA, 28 bp, Homo sapiens
aggaacagctctttggacactaggaaaa

SEQ ID NO: 9870 - DNA, 29 bp, Homo sapiens
aggaacagctctttggacactaggaaaaa

SEQ ID NO: 9871 - DNA, 30 bp, Homo sapiens
aggaacagctctttggacactaggaaaaaa

SEQ ID NO: 9872 - DNA, 31 bp, Homo sapiens; identical to SEQ ID NO: 1154

SEQ ID NO: 9873 - DNA, 32 bp, Homo sapiens; identical to SEQ ID NO: 1155

SEQ ID NO: 9874 - DNA, 33 bp, Homo sapiens
aggaacagctctttggacactaggaaaaaacct

SEQ ID NO: 9875 - DNA, 17 bp, Homo sapiens
ggaacagctctttggac

SEQ ID NO: 9876 - DNA, 18 bp, Homo sapiens
ggaacagctctttggaca

SEQ ID NO: 9877 - DNA, 19 bp, Homo sapiens
ggaacagctctttggacac

SEQ ID NO: 9878 - DNA, 20 bp, Homo sapiens
ggaacagctctttggacact

SEQ ID NO: 9879 - DNA, 24 bp, Homo sapiens
ggaacagctctttggacactagga

SEQ ID NO: 9880 - DNA, 31 bp, Homo sapiens; identical to SEQ ID NO: 1159

SEQ ID NO: 9881 - DNA, 16 bp, Homo sapiens
gaacagctctttggac

SEQ ID NO: 9882 - DNA, 18 bp, Homo sapiens
gaacagctctttggacac

SEQ ID NO: 9883 - DNA, 19 bp, Homo sapiens
gaacagctctttggacact

SEQ ID NO: 9884 - DNA, 20 bp, Homo sapiens
gaacagctctttggacacta

SEQ ID NO: 9885 - DNA, 21 bp, Homo sapiens
gaacagctctttggacactag

SEQ ID NO: 9886 - DNA, 22 bp, Homo sapiens
gaacagctctttggacactagg

SEQ ID NO: 9887 - DNA, 23 bp, Homo sapiens
gaacagctctttggacactagga

SEQ ID NO: 9888 - DNA, 24 bp, Homo sapiens
gaacagctctttggacactaggaa

SEQ ID NO: 9889 - DNA, 25 bp, Homo sapiens
gaacagctctttggacactaggaaa

SEQ ID NO: 9890 - DNA, 26 bp, Homo sapiens
gaacagctctttggacactaggaaaa

SEQ ID NO: 9891 - DNA, 27 bp, Homo sapiens
gaacagctctttggacactaggaaaaa

SEQ ID NO: 9892 - DNA, 28 bp, Homo sapiens
gaacagctctttggacactaggaaaaaa

SEQ ID NO: 9893 - DNA, 29 bp, Homo sapiens
gaacagctctttggacactaggaaaaaac

SEQ ID NO: 9894 - DNA, 30 bp, Homo sapiens; identical to SEQ ID NO: 1163

SEQ ID NO: 9895 - DNA, 31 bp, Homo sapiens; identical to SEQ ID NO: 1164

SEQ ID NO: 9896 - DNA, 33 bp, Homo sapiens
gaacagctctttggacactaggaaaaaaccttg

SEQ ID NO: 9897 - DNA, 18 bp, Homo sapiens
aacagctctttggacact

SEQ ID NO: 9898 - DNA, 21 bp, Homo sapiens
aacagctctttggacactagg

SEQ ID NO: 9899 - DNA, 28 bp, Homo sapiens
aacagctctttggacactaggaaaaaac

SEQ ID NO: 9900 - DNA, 29 bp, Homo sapiens
aacagctctttggacactaggaaaaaacc

SEQ ID NO: 9901 - DNA, 30 bp, Homo sapiens; identical to SEQ ID NO: 1166

SEQ ID NO: 9902 - DNA, 16 bp, Homo sapiens
acagctctttggacac

SEQ ID NO: 9903 - DNA, 28 bp, Homo sapiens
acagctctttggacactaggaaaaaacc

SEQ ID NO: 9904 - DNA, 16 bp, Homo sapiens
cagctctttggacact

SEQ ID NO: 9905 - DNA, 27 bp, Homo sapiens
cagctctttggacactaggaaaaaacc

SEQ ID NO: 9906 - DNA, 28 bp, Homo sapiens
cagctctttggacactaggaaaaaacct

SEQ ID NO: 9907 - DNA, 26 bp, Homo sapiens
agctctttggacactaggaaaaaacc

SEQ ID NO: 9908 - DNA, 16 bp, Homo sapiens
gctctttggacactag

SEQ ID NO: 9909 - DNA, 17 bp, Homo sapiens
gctctttggacactagg

SEQ ID NO: 9910 - DNA, 20 bp, Homo sapiens
gctctttggacactaggaaa

SEQ ID NO: 9911 - DNA, 21 bp, Homo sapiens
gctctttggacactaggaaaa

SEQ ID NO: 9912 - DNA, 22 bp, Homo sapiens
gctctttggacactaggaaaaa

SEQ ID NO: 9913 - DNA, 23 bp, Homo sapiens
gctctttggacactaggaaaaaa

SEQ ID NO: 9914 - DNA, 24 bp, Homo sapiens
gctctttggacactaggaaaaaac

SEQ ID NO: 9915 - DNA, 25 bp, Homo sapiens
gctctttggacactaggaaaaaacc

SEQ ID NO: 9916 - DNA, 26 bp, Homo sapiens
gctctttggacactaggaaaaaacct

SEQ ID NO: 9917 - DNA, 28 bp, Homo sapiens
gctctttggacactaggaaaaaaccttg

SEQ ID NO: 9918 - DNA, 33 bp, Homo sapiens
gctctttggacactaggaaaaaaccttgtagag

SEQ ID NO: 9919 - DNA, 24 bp, Homo sapiens
ctctttggacactaggaaaaaacc

SEQ ID NO: 9920 - DNA, 25 bp, Homo sapiens
ctctttggacactaggaaaaaacct

SEQ ID NO: 9921 - DNA, 27 bp, Homo sapiens
ctctttggacactaggaaaaaaccttg

SEQ ID NO: 9922 - DNA, 23 bp, Homo sapiens
tctttggacactaggaaaaaacc

SEQ ID NO: 9923 - DNA, 24 bp, Homo sapiens
tctttggacactaggaaaaaacct

SEQ ID NO: 9924 - DNA, 22 bp, Homo sapiens
ctttggacactaggaaaaaacc

SEQ ID NO: 9925 - DNA, 23 bp, Homo sapiens
ctttggacactaggaaaaaacct

SEQ ID NO: 9926 - DNA, 32 bp, Homo sapiens
ctttggacactaggaaaaaaccttgtagagag

SEQ ID NO: 9927 - DNA, 21 bp, Homo sapiens
tttggacactaggaaaaaacc

SEQ ID NO: 9928 - DNA, 20 bp, Homo sapiens
ttggacactaggaaaaaacc

SEQ ID NO: 9929 - DNA, 21 bp, Homo sapiens
ttggacactaggaaaaaacct

SEQ ID NO: 9930 - DNA, 30 bp, Homo sapiens
ctaggaaaaaaccttgtagagagagtaaaa

SEQ ID NO: 9931 - DNA, 25 bp, Homo sapiens
aggaaaaaaccttgtagagagagta

SEQ ID NO: 9932 - DNA, 28 bp, Homo sapiens
aggaaaaaaccttgtagagagagtaaaa

SEQ ID NO: 9933 - DNA, 33 bp, Homo sapiens; identical to SEQ ID NO: 1181

SEQ ID NO: 9934 - DNA, 32 bp, Homo sapiens; identical to SEQ ID NO: 1182

SEQ ID NO: 9935 - DNA, 33 bp, Homo sapiens; identical to SEQ ID NO: 1183

SEQ ID NO: 9936 - DNA, 31 bp, Homo sapiens
accttgtagagagagtaaaaaatttaacacc

SEQ ID NO: 9937 - DNA, 32 bp, Homo sapiens
accttgtagagagagtaaaaaatttaacaccc

SEQ ID NO: 9938 - DNA, 30 bp, Homo sapiens
ccttgtagagagagtaaaaaatttaacacc

SEQ ID NO: 9939 - DNA, 31 bp, Homo sapiens
ccttgtagagagagtaaaaaatttaacaccc

SEQ ID NO: 9940 - DNA, 29 bp, Homo sapiens
cttgtagagagagtaaaaaatttaacacc

SEQ ID NO: 9941 - DNA, 30 bp, Homo sapiens
cttgtagagagagtaaaaaatttaacaccc

SEQ ID NO: 9942 - DNA, 16 bp, Homo sapiens
ttgtagagagagtaaa

SEQ ID NO: 9943 - DNA, 17 bp, Homo sapiens
ttgtagagagagtaaaa

SEQ ID NO: 9944 - DNA, 18 bp, Homo sapiens
ttgtagagagagtaaaaa

SEQ ID NO: 9945 - DNA, 19 bp, Homo sapiens
ttgtagagagagtaaaaaa

SEQ ID NO: 9946 - DNA, 20 bp, Homo sapiens
ttgtagagagagtaaaaaat

SEQ ID NO: 9947 - DNA, 21 bp, Homo sapiens
ttgtagagagagtaaaaaatt

SEQ ID NO: 9948 - DNA, 22 bp, Homo sapiens
ttgtagagagagtaaaaaattt

SEQ ID NO: 9949 - DNA, 23 bp, Homo sapiens
ttgtagagagagtaaaaaattta

SEQ ID NO: 9950 - DNA, 25 bp, Homo sapiens
ttgtagagagagtaaaaaatttaac

SEQ ID NO: 9951 - DNA, 26 bp, Homo sapiens
ttgtagagagagtaaaaaatttaaca

SEQ ID NO: 9952 - DNA, 28 bp, Homo sapiens
ttgtagagagagtaaaaaatttaacacc

SEQ ID NO: 9953 - DNA, 29 bp, Homo sapiens
ttgtagagagagtaaaaaatttaacaccc

SEQ ID NO: 9954 - DNA, 30 bp, Homo sapiens; identical to SEQ ID NO: 1189

SEQ ID NO: 9955 - DNA, 40 bp, Homo sapiens
ttgtagagagagtaaaaaatttaacacccatagtaggcct

SEQ ID NO: 9956 - DNA, 27 bp, Homo sapiens
tgtagagagagtaaaaaatttaacacc

SEQ ID NO: 9957 - DNA, 28 bp, Homo sapiens
tgtagagagagtaaaaaatttaacaccc

SEQ ID NO: 9958 - DNA, 24 bp, Homo sapiens
aaatttaacacccatagtaggcct

SEQ ID NO: 9959 - DNA, 22 bp, Homo sapiens
aatttaacacccatagtaggcc

SEQ ID NO: 9960 - DNA, 23 bp, Homo sapiens
aatttaacacccatagtaggcct

SEQ ID NO: 9961 - DNA, 22 bp, Homo sapiens
atttaacacccatagtaggcct

SEQ ID NO: 9962 - DNA, 35 bp, Homo sapiens
atttaacacccatagtaggcctaaaagcagccacc

SEQ ID NO: 9963 - DNA, 21 bp, Homo sapiens
tttaacacccatagtaggcct

SEQ ID NO: 9964 - DNA, 20 bp, Homo sapiens
ttaacacccatagtaggcct

SEQ ID NO: 9965 - DNA, 33 bp, Homo sapiens
ttaacacccatagtaggcctaaaagcagccacc

SEQ ID NO: 9966 - DNA, 19 bp, Homo sapiens
taacacccatagtaggcct

SEQ ID NO: 9967 - DNA, 32 bp, Homo sapiens; identical to SEQ ID NO: 1195

SEQ ID NO: 9968 - DNA, 18 bp, Homo sapiens
aacacccatagtaggcct

SEQ ID NO: 9969 - DNA, 31 bp, Homo sapiens; identical to SEQ ID NO: 1197

SEQ ID NO: 9970 - DNA, 17 bp, Homo sapiens
acacccatagtaggcct

SEQ ID NO: 9971 - DNA, 30 bp, Homo sapiens
acacccatagtaggcctaaaagcagccacc

SEQ ID NO: 9972 - DNA, 16 bp, Homo sapiens
cacccatagtaggcct

SEQ ID NO: 9973 - DNA, 29 bp, Homo sapiens
cacccatagtaggcctaaaagcagccacc

SEQ ID NO: 9974 - DNA, 28 bp, Homo sapiens
acccatagtaggcctaaaagcagccacc

SEQ ID NO: 9975 - DNA, 21 bp, Homo sapiens
cccatagtaggcctaaaagca

SEQ ID NO: 9976 - DNA, 23 bp, Homo sapiens
cccatagtaggcctaaaagcagc

SEQ ID NO: 9977 - DNA, 24 bp, Homo sapiens
cccatagtaggcctaaaagcagcc

SEQ ID NO: 9978 - DNA, 25 bp, Homo sapiens
cccatagtaggcctaaaagcagcca

SEQ ID NO: 9979 - DNA, 26 bp, Homo sapiens
cccatagtaggcctaaaagcagccac

SEQ ID NO: 9980 - DNA, 27 bp, Homo sapiens
cccatagtaggcctaaaagcagccacc

SEQ ID NO: 9981 - DNA, 28 bp, Homo sapiens
cccatagtaggcctaaaagcagccacca

SEQ ID NO: 9982 - DNA, 31 bp, Homo sapiens
cccatagtaggcctaaaagcagccaccaatt

SEQ ID NO: 9983 - DNA, 35 bp, Homo sapiens
cccatagtaggcctaaaagcagccaccaattaaga

SEQ ID NO: 9984 - DNA, 23 bp, Homo sapiens
ccatagtaggcctaaaagcagcc

SEQ ID NO: 9985 - DNA, 26 bp, Homo sapiens
ccatagtaggcctaaaagcagccacc

SEQ ID NO: 9986 - DNA, 19 bp, Homo sapiens
catagtaggcctaaaagca

SEQ ID NO: 9987 - DNA, 22 bp, Homo sapiens
catagtaggcctaaaagcagcc

SEQ ID NO: 9988 - DNA, 23 bp, Homo sapiens
catagtaggcctaaaagcagcca

SEQ ID NO: 9989 - DNA, 25 bp, Homo sapiens
catagtaggcctaaaagcagccacc

SEQ ID NO: 9990 - DNA, 26 bp, Homo sapiens
catagtaggcctaaaagcagccacca

SEQ ID NO: 9991 - DNA, 32 bp, Homo sapiens
catagtaggcctaaaagcagccaccaattaag

SEQ ID NO: 9992 - DNA, 33 bp, Homo sapiens
catagtaggcctaaaagcagccaccaattaaga

SEQ ID NO: 9993 - DNA, 21 bp, Homo sapiens
atagtaggcctaaaagcagcc

SEQ ID NO: 9994 - DNA, 24 bp, Homo sapiens
atagtaggcctaaaagcagccacc

SEQ ID NO: 9995 - DNA, 20 bp, Homo sapiens
tagtaggcctaaaagcagcc

SEQ ID NO: 9996 - DNA, 23 bp, Homo sapiens
tagtaggcctaaaagcagccacc

SEQ ID NO: 9997 - DNA, 18 bp, Homo sapiens
agcagccaccaattaaga

SEQ ID NO: 9998 - DNA, 32 bp, Homo sapiens
caccaattaagaaagcgttcaagctcaacacc

SEQ ID NO: 9999 - DNA, 28 bp, Homo sapiens
aattaagaaagcgttcaagctcaacacc

SEQ ID NO: 10000 - DNA, 29 bp, Homo sapiens
aattaagaaagcgttcaagctcaacaccc

SEQ ID NO: 10001 - DNA, 30 bp, Homo sapiens
aattaagaaagcgttcaagctcaacaccca

SEQ ID NO: 10002 - DNA, 35 bp, Homo sapiens
aattaagaaagcgttcaagctcaacacccactacc

SEQ ID NO: 10003 - DNA, 36 bp, Homo sapiens
aattaagaaagcgttcaagctcaacacccactacct

SEQ ID NO: 10004 - DNA, 27 bp, Homo sapiens
attaagaaagcgttcaagctcaacacc

SEQ ID NO: 10005 - DNA, 28 bp, Homo sapiens
attaagaaagcgttcaagctcaacaccc

SEQ ID NO: 10006 - DNA, 29 bp, Homo sapiens
attaagaaagcgttcaagctcaacaccca

SEQ ID NO: 10007 - DNA, 34 bp, Homo sapiens
attaagaaagcgttcaagctcaacacccactacc

SEQ ID NO: 10008 - DNA, 26 bp, Homo sapiens
taagaaagcgttcaagctcaacaccc

SEQ ID NO: 10009 - DNA, 32 bp, Homo sapiens
taagaaagcgttcaagctcaacacccactacc

SEQ ID NO: 10010 - DNA, 33 bp, Homo sapiens
taagaaagcgttcaagctcaacacccactacct

SEQ ID NO: 10011 - DNA, 27 bp, Homo sapiens
agcgttcaagctcaacacccactacct

SEQ ID NO: 10012 - DNA, 19 bp, Homo sapiens
gcgttcaagctcaacaccc

SEQ ID NO: 10013 - DNA, 18 bp, Homo sapiens
cgttcaagctcaacaccc

SEQ ID NO: 10014 - DNA, 24 bp, Homo sapiens
cgttcaagctcaacacccactacc

SEQ ID NO: 10015 - DNA, 16 bp, Homo sapiens
gttcaagctcaacacc

SEQ ID NO: 10016 - DNA, 17 bp, Homo sapiens
gttcaagctcaacaccc

SEQ ID NO: 10017 - DNA, 20 bp, Homo sapiens
gttcaagctcaacacccact

SEQ ID NO: 10018 - DNA, 23 bp, Homo sapiens
gttcaagctcaacacccactacc

SEQ ID NO: 10019 - DNA, 17 bp, Homo sapiens
cactacctaaaaaatcc

SEQ ID NO: 10020 - DNA, 18 bp, Homo sapiens
cactacctaaaaaatccc

SEQ ID NO: 10021 - DNA, 19 bp, Homo sapiens
cactacctaaaaaatccca

SEQ ID NO: 10022 - DNA, 30 bp, Homo sapiens
cactacctaaaaaatcccaaacatataact

SEQ ID NO: 10023 - DNA, 31 bp, Homo sapiens; identical to SEQ ID NO: 1212

SEQ ID NO: 10024 - DNA, 44 bp, Homo sapiens
cactacctaaaaaatcccaaacatataactgaactcctcacacc

SEQ ID NO: 10025 - DNA, 45 bp, Homo sapiens
cactacctaaaaaatcccaaacatataactgaactcctcacaccc

SEQ ID NO: 10026 - DNA, 17 bp, Homo sapiens
actacctaaaaaatccc

SEQ ID NO: 10027 - DNA, 29 bp, Homo sapiens
actacctaaaaaatcccaaacatataact

SEQ ID NO: 10028 - DNA, 30 bp, Homo sapiens; identical to SEQ ID NO: 1213

SEQ ID NO: 10029 - DNA, 37 bp, Homo sapiens
actacctaaaaaatcccaaacatataactgaactcct

SEQ ID NO: 10030 - DNA, 43 bp, Homo sapiens
actacctaaaaaatcccaaacatataactgaactcctcacacc

SEQ ID NO: 10031 - DNA, 44 bp, Homo sapiens
actacctaaaaaatcccaaacatataactgaactcctcacaccc

SEQ ID NO: 10032 - DNA, 29 bp, Homo sapiens
ctacctaaaaaatcccaaacatataactg

SEQ ID NO: 10033 - DNA, 42 bp, Homo sapiens
ctacctaaaaaatcccaaacatataactgaactcctcacacc

SEQ ID NO: 10034 - DNA, 43 bp, Homo sapiens
ctacctaaaaaatcccaaacatataactgaactcctcacaccc

SEQ ID NO: 10035 - DNA, 28 bp, Homo sapiens
tacctaaaaaatcccaaacatataactg

SEQ ID NO: 10036 - DNA, 27 bp, Homo sapiens
acctaaaaaatcccaaacatataactg

SEQ ID NO: 10037 - DNA, 41 bp, Homo sapiens
acctaaaaaatcccaaacatataactgaactcctcacaccc

SEQ ID NO: 10038 - DNA, 26 bp, Homo sapiens
cctaaaaaatcccaaacatataactg

SEQ ID NO: 10039 - DNA, 33 bp, Homo sapiens
cctaaaaaatcccaaacatataactgaactcct

SEQ ID NO: 10040 - DNA, 32 bp, Homo sapiens
ctaaaaaatcccaaacatataactgaactcct

SEQ ID NO: 10041 - DNA, 38 bp, Homo sapiens
ctaaaaaatcccaaacatataactgaactcctcacacc

SEQ ID NO: 10042 - DNA, 39 bp, Homo sapiens
ctaaaaaatcccaaacatataactgaactcctcacaccc

SEQ ID NO: 10043 - DNA, 24 bp, Homo sapiens
taaaaaatcccaaacatataactg

SEQ ID NO: 10044 - DNA, 30 bp, Homo sapiens
taaaaaatcccaaacatataactgaactcc

SEQ ID NO: 10045 - DNA, 31 bp, Homo sapiens; identical to SEQ ID NO: 1217

SEQ ID NO: 10046 - DNA, 33 bp, Homo sapiens
taaaaaatcccaaacatataactgaactcctca

SEQ ID NO: 10047 - DNA, 35 bp, Homo sapiens
taaaaaatcccaaacatataactgaactcctcaca

SEQ ID NO: 10048 - DNA, 37 bp, Homo sapiens
taaaaaatcccaaacatataactgaactcctcacacc

SEQ ID NO: 10049 - DNA, 38 bp, Homo sapiens
taaaaaatcccaaacatataactgaactcctcacaccc

SEQ ID NO: 10050 - DNA, 39 bp, Homo sapiens
taaaaaatcccaaacatataactgaactcctcacaccca

SEQ ID NO: 10051 - DNA, 23 bp, Homo sapiens
aaaaaatcccaaacatataactg

SEQ ID NO: 10052 - DNA, 29 bp, Homo sapiens
aaaaaatcccaaacatataactgaactcc

SEQ ID NO: 10053 - DNA, 30 bp, Homo sapiens; identical to SEQ ID NO: 1218

SEQ ID NO: 10054 - DNA, 36 bp, Homo sapiens
aaaaaatcccaaacatataactgaactcctcacacc

SEQ ID NO: 10055 - DNA, 37 bp, Homo sapiens
aaaaaatcccaaacatataactgaactcctcacaccc

SEQ ID NO: 10056 - DNA, 38 bp, Homo sapiens
aaaaaatcccaaacatataactgaactcctcacaccca

SEQ ID NO: 10057 - DNA, 22 bp, Homo sapiens
aaaaatcccaaacatataactg

SEQ ID NO: 10058 - DNA, 29 bp, Homo sapiens
aaaaatcccaaacatataactgaactcct

SEQ ID NO: 10059 - DNA, 35 bp, Homo sapiens
aaaaatcccaaacatataactgaactcctcacacc

SEQ ID NO: 10060 - DNA, 36 bp, Homo sapiens
aaaaatcccaaacatataactgaactcctcacaccc

SEQ ID NO: 10061 - DNA, 28 bp, Homo sapiens
aaaatcccaaacatataactgaactcct

SEQ ID NO: 10062 - DNA, 34 bp, Homo sapiens
aaaatcccaaacatataactgaactcctcacacc

SEQ ID NO: 10063 - DNA, 35 bp, Homo sapiens
aaaatcccaaacatataactgaactcctcacaccc

SEQ ID NO: 10064 - DNA, 27 bp, Homo sapiens
aaatcccaaacatataactgaactcct

SEQ ID NO: 10065 - DNA, 33 bp, Homo sapiens; identical to SEQ ID NO: 1219

SEQ ID NO: 10066 - DNA, 34 bp, Homo sapiens
aaatcccaaacatataactgaactcctcacaccc

SEQ ID NO: 10067 - DNA, 19 bp, Homo sapiens
aatcccaaacatataactg

SEQ ID NO: 10068 - DNA, 25 bp, Homo sapiens
aatcccaaacatataactgaactcc

SEQ ID NO: 10069 - DNA, 26 bp, Homo sapiens
aatcccaaacatataactgaactcct

SEQ ID NO: 10070 - DNA, 30 bp, Homo sapiens
aatcccaaacatataactgaactcctcaca

SEQ ID NO: 10071 - DNA, 32 bp, Homo sapiens; identical to SEQ ID NO: 1221

SEQ ID NO: 10072 - DNA, 33 bp, Homo sapiens; identical to SEQ ID NO: 1222

SEQ ID NO: 10073 - DNA, 34 bp, Homo sapiens
aatcccaaacatataactgaactcctcacaccca

SEQ ID NO: 10074 - DNA, 22 bp, Homo sapiens
atcccaaacatataactgaact

SEQ ID NO: 10075 - DNA, 25 bp, Homo sapiens
atcccaaacatataactgaactcct

SEQ ID NO: 10076 - DNA, 31 bp, Homo sapiens; identical to SEQ ID NO: 1223

SEQ ID NO: 10077 - DNA, 32 bp, Homo sapiens; identical to SEQ ID NO: 1224

SEQ ID NO: 10078 - DNA, 33 bp, Homo sapiens; identical to SEQ ID NO: 1225

SEQ ID NO: 10079 - DNA, 30 bp, Homo sapiens; identical to SEQ ID NO: 1226

SEQ ID NO: 10080 - DNA, 31 bp, Homo sapiens; identical to SEQ ID NO: 1227

SEQ ID NO: 10081 - DNA, 32 bp, Homo sapiens
tcccaaacatataactgaactcctcacaccca

SEQ ID NO: 10082 - DNA, 29 bp, Homo sapiens
cccaaacatataactgaactcctcacacc

SEQ ID NO: 10083 - DNA, 30 bp, Homo sapiens; identical to SEQ ID NO: 1229

SEQ ID NO: 10084 - DNA, 31 bp, Homo sapiens
cccaaacatataactgaactcctcacaccca

SEQ ID NO: 10085 - DNA, 33 bp, Homo sapiens; identical to SEQ ID NO: 1230

SEQ ID NO: 10086 - DNA, 22 bp, Homo sapiens
ccaaacatataactgaactcct

SEQ ID NO: 10087 - DNA, 28 bp, Homo sapiens
ccaaacatataactgaactcctcacacc

SEQ ID NO: 10088 - DNA, 29 bp, Homo sapiens
ccaaacatataactgaactcctcacaccc

SEQ ID NO: 10089 - DNA, 30 bp, Homo sapiens; identical to SEQ ID NO: 1234

SEQ ID NO: 10090 - DNA, 32 bp, Homo sapiens; identical to SEQ ID NO: 1235

SEQ ID NO: 10091 - DNA, 20 bp, Homo sapiens
caaacatataactgaactcc

SEQ ID NO: 10092 - DNA, 21 bp, Homo sapiens
caaacatataactgaactcct

SEQ ID NO: 10093 - DNA, 25 bp, Homo sapiens
caaacatataactgaactcctcaca

SEQ ID NO: 10094 - DNA, 27 bp, Homo sapiens
caaacatataactgaactcctcacacc

SEQ ID NO: 10095 - DNA, 28 bp, Homo sapiens
caaacatataactgaactcctcacaccc

SEQ ID NO: 10096 - DNA, 29 bp, Homo sapiens
caaacatataactgaactcctcacaccca

SEQ ID NO: 10097 - DNA, 30 bp, Homo sapiens
caaacatataactgaactcctcacacccaa

SEQ ID NO: 10098 - DNA, 31 bp, Homo sapiens
caaacatataactgaactcctcacacccaat

SEQ ID NO: 10099 - DNA, 32 bp, Homo sapiens
caaacatataactgaactcctcacacccaatt

SEQ ID NO: 10100 - DNA, 33 bp, Homo sapiens
caaacatataactgaactcctcacacccaattg

SEQ ID NO: 10101 - DNA, 34 bp, Homo sapiens
caaacatataactgaactcctcacacccaattgg

SEQ ID NO: 10102 - DNA, 37 bp, Homo sapiens
caaacatataactgaactcctcacacccaattggacc

SEQ ID NO: 10103 - DNA, 19 bp, Homo sapiens
aaacatataactgaactcc

SEQ ID NO: 10104 - DNA, 20 bp, Homo sapiens
aaacatataactgaactcct

SEQ ID NO: 10105 - DNA, 21 bp, Homo sapiens
aaacatataactgaactcctc

SEQ ID NO: 10106 - DNA, 22 bp, Homo sapiens
aaacatataactgaactcctca

SEQ ID NO: 10107 - DNA, 23 bp, Homo sapiens
aaacatataactgaactcctcac

SEQ ID NO: 10108 - DNA, 24 bp, Homo sapiens
aaacatataactgaactcctcaca

SEQ ID NO: 10109 - DNA, 25 bp, Homo sapiens
aaacatataactgaactcctcacac

SEQ ID NO: 10110 - DNA, 26 bp, Homo sapiens
aaacatataactgaactcctcacacc

SEQ ID NO: 10111 - DNA, 27 bp, Homo sapiens
aaacatataactgaactcctcacaccc

SEQ ID NO: 10112 - DNA, 28 bp, Homo sapiens
aaacatataactgaactcctcacaccca

SEQ ID NO: 10113 - DNA, 29 bp, Homo sapiens
aaacatataactgaactcctcacacccaa

SEQ ID NO: 10114 - DNA, 30 bp, Homo sapiens; identical to SEQ ID NO: 1248

SEQ ID NO: 10115 - DNA, 31 bp, Homo sapiens; identical to SEQ ID NO: 1249

SEQ ID NO: 10116 - DNA, 32 bp, Homo sapiens; identical to SEQ ID NO: 1250

SEQ ID NO: 10117 - DNA, 33 bp, Homo sapiens; identical to SEQ ID NO: 1251

SEQ ID NO: 10118 - DNA, 36 bp, Homo sapiens
aaacatataactgaactcctcacacccaattggacc

SEQ ID NO: 10119 - DNA, 40 bp, Homo sapiens
aaacatataactgaactcctcacacccaattggaccaatc

SEQ ID NO: 10120 - DNA, 41 bp, Homo sapiens
aaacatataactgaactcctcacacccaattggaccaatct

SEQ ID NO: 10121 - DNA, 43 bp, Homo sapiens
aaacatataactgaactcctcacacccaattggaccaatctat

SEQ ID NO: 10122 - DNA, 44 bp, Homo sapiens
aaacatataactgaactcctcacacccaattggaccaatctatc

SEQ ID NO: 10123 - DNA, 47 bp, Homo sapiens
aaacatataactgaactcctcacacccaattggaccaatctatcacc

SEQ ID NO: 10124 - DNA, 18 bp, Homo sapiens
aacatataactgaactcc

SEQ ID NO: 10125 - DNA, 19 bp, Homo sapiens
aacatataactgaactcct

SEQ ID NO: 10126 - DNA, 21 bp, Homo sapiens
aacatataactgaactcctca

SEQ ID NO: 10127 - DNA, 23 bp, Homo sapiens
aacatataactgaactcctcaca

SEQ ID NO: 10128 - DNA, 24 bp, Homo sapiens
aacatataactgaactcctcacac

SEQ ID NO: 10129 - DNA, 25 bp, Homo sapiens
aacatataactgaactcctcacacc

SEQ ID NO: 10130 - DNA, 26 bp, Homo sapiens
aacatataactgaactcctcacaccc

SEQ ID NO: 10131 - DNA, 27 bp, Homo sapiens
aacatataactgaactcctcacaccca

SEQ ID NO: 10132 - DNA, 28 bp, Homo sapiens
aacatataactgaactcctcacacccaa

SEQ ID NO: 10133 - DNA, 29 bp, Homo sapiens
aacatataactgaactcctcacacccaat

SEQ ID NO: 10134 - DNA, 30 bp, Homo sapiens; identical to SEQ ID NO: 1259

SEQ ID NO: 10135 - DNA, 31 bp, Homo sapiens; identical to SEQ ID NO: 1260

SEQ ID NO: 10136 - DNA, 32 bp, Homo sapiens; identical to SEQ ID NO: 1261

SEQ ID NO: 10137 - DNA, 33 bp, Homo sapiens; identical to SEQ ID NO: 1262

SEQ ID NO: 10138 - DNA, 35 bp, Homo sapiens
aacatataactgaactcctcacacccaattggacc

SEQ ID NO: 10139 - DNA, 39 bp, Homo sapiens
aacatataactgaactcctcacacccaattggaccaatc

SEQ ID NO: 10140 - DNA, 42 bp, Homo sapiens
aacatataactgaactcctcacacccaattggaccaatctat

SEQ ID NO: 10141 - DNA, 43 bp, Homo sapiens
aacatataactgaactcctcacacccaattggaccaatctatc

SEQ ID NO: 10142 - DNA, 46 bp, Homo sapiens
aacatataactgaactcctcacacccaattggaccaatctatcacc

SEQ ID NO: 10143 - DNA, 47 bp, Homo sapiens
aacatataactgaactcctcacacccaattggaccaatctatcaccc

SEQ ID NO: 10144 - DNA, 18 bp, Homo sapiens
acatataactgaactcct

SEQ ID NO: 10145 - DNA, 24 bp, Homo sapiens
acatataactgaactcctcacacc

SEQ ID NO: 10146 - DNA, 25 bp, Homo sapiens
acatataactgaactcctcacaccc

SEQ ID NO: 10147 - DNA, 26 bp, Homo sapiens
acatataactgaactcctcacaccca

SEQ ID NO: 10148 - DNA, 31 bp, Homo sapiens
acatataactgaactcctcacacccaattgg

SEQ ID NO: 10149 - DNA, 32 bp, Homo sapiens
acatataactgaactcctcacacccaattgga

SEQ ID NO: 10150 - DNA, 46 bp, Homo sapiens
acatataactgaactcctcacacccaattggaccaatctatcaccc

SEQ ID NO: 10151 - DNA, 17 bp, Homo sapiens
catataactgaactcct

SEQ ID NO: 10152 - DNA, 23 bp, Homo sapiens
catataactgaactcctcacacc

SEQ ID NO: 10153 - DNA, 24 bp, Homo sapiens
catataactgaactcctcacaccc

SEQ ID NO: 10154 - DNA, 25 bp, Homo sapiens
catataactgaactcctcacaccca

SEQ ID NO: 10155 - DNA, 30 bp, Homo sapiens
catataactgaactcctcacacccaattgg

SEQ ID NO: 10156 - DNA, 31 bp, Homo sapiens
catataactgaactcctcacacccaattgga

SEQ ID NO: 10157 - DNA, 33 bp, Homo sapiens; identical to SEQ ID NO: 1270

SEQ ID NO: 10158 - DNA, 45 bp, Homo sapiens
catataactgaactcctcacacccaattggaccaatctatcaccc

SEQ ID NO: 10159 - DNA, 16 bp, Homo sapiens
atataactgaactcct

SEQ ID NO: 10160 - DNA, 20 bp, Homo sapiens
atataactgaactcctcaca

SEQ ID NO: 10161 - DNA, 22 bp, Homo sapiens
atataactgaactcctcacacc

SEQ ID NO: 10162 - DNA, 23 bp, Homo sapiens
atataactgaactcctcacaccc

SEQ ID NO: 10163 - DNA, 24 bp, Homo sapiens
atataactgaactcctcacaccca

SEQ ID NO: 10164 - DNA, 29 bp, Homo sapiens
atataactgaactcctcacacccaattgg

SEQ ID NO: 10165 - DNA, 30 bp, Homo sapiens; identical to SEQ ID NO: 1275

SEQ ID NO: 10166 - DNA, 31 bp, Homo sapiens
atataactgaactcctcacacccaattggac

SEQ ID NO: 10167 - DNA, 32 bp, Homo sapiens; identical to SEQ ID NO: 1276

SEQ ID NO: 10168 - DNA, 33 bp, Homo sapiens
atataactgaactcctcacacccaattggacca

SEQ ID NO: 10169 - DNA, 43 bp, Homo sapiens
atataactgaactcctcacacccaattggaccaatctatcacc

SEQ ID NO: 10170 - DNA, 44 bp, Homo sapiens
atataactgaactcctcacacccaattggaccaatctatcaccc

SEQ ID NO: 10171 - DNA, 17 bp, Homo sapiens
tataactgaactcctca

SEQ ID NO: 10172 - DNA, 19 bp, Homo sapiens
tataactgaactcctcaca

SEQ ID NO: 10173 - DNA, 20 bp, Homo sapiens
tataactgaactcctcacac

SEQ ID NO: 10174 - DNA, 21 bp, Homo sapiens
tataactgaactcctcacacc

SEQ ID NO: 10175 - DNA, 22 bp, Homo sapiens
tataactgaactcctcacaccc

SEQ ID NO: 10176 - DNA, 23 bp, Homo sapiens
tataactgaactcctcacaccca

SEQ ID NO: 10177 - DNA, 24 bp, Homo sapiens
tataactgaactcctcacacccaa

SEQ ID NO: 10178 - DNA, 25 bp, Homo sapiens
tataactgaactcctcacacccaat

SEQ ID NO: 10179 - DNA, 26 bp, Homo sapiens
tataactgaactcctcacacccaatt

SEQ ID NO: 10180 - DNA, 27 bp, Homo sapiens
tataactgaactcctcacacccaattg

SEQ ID NO: 10181 - DNA, 28 bp, Homo sapiens
tataactgaactcctcacacccaattgg

SEQ ID NO: 10182 - DNA, 29 bp, Homo sapiens
tataactgaactcctcacacccaattgga

SEQ ID NO: 10183 - DNA, 30 bp, Homo sapiens
tataactgaactcctcacacccaattggac

SEQ ID NO: 10184 - DNA, 31 bp, Homo sapiens; identical to SEQ ID NO: 1283

SEQ ID NO: 10185 - DNA, 32 bp, Homo sapiens
tataactgaactcctcacacccaattggacca

SEQ ID NO: 10186 - DNA, 35 bp, Homo sapiens
tataactgaactcctcacacccaattggaccaatc

SEQ ID NO: 10187 - DNA, 39 bp, Homo sapiens
tataactgaactcctcacacccaattggaccaatctatc

SEQ ID NO: 10188 - DNA, 42 bp, Homo sapiens
tataactgaactcctcacacccaattggaccaatctatcacc

SEQ ID NO: 10189 - DNA, 43 bp, Homo sapiens
tataactgaactcctcacacccaattggaccaatctatcaccc

SEQ ID NO: 10190 - DNA, 44 bp, Homo sapiens
tataactgaactcctcacacccaattggaccaatctatcaccct

SEQ ID NO: 10191 - DNA, 45 bp, Homo sapiens
tataactgaactcctcacacccaattggaccaatctatcacccta

SEQ ID NO: 10192 - DNA, 46 bp, Homo sapiens
tataactgaactcctcacacccaattggaccaatctatcaccctat

SEQ ID NO: 10193 - DNA, 47 bp, Homo sapiens
tataactgaactcctcacacccaattggaccaatctatcaccctata

SEQ ID NO: 10194 - DNA, 18 bp, Homo sapiens
ataactgaactcctcaca

SEQ ID NO: 10195 - DNA, 20 bp, Homo sapiens
ataactgaactcctcacacc

SEQ ID NO: 10196 - DNA, 21 bp, Homo sapiens
ataactgaactcctcacaccc

SEQ ID NO: 10197 - DNA, 22 bp, Homo sapiens
ataactgaactcctcacaccca

SEQ ID NO: 10198 - DNA, 27 bp, Homo sapiens
ataactgaactcctcacacccaattgg

SEQ ID NO: 10199 - DNA, 28 bp, Homo sapiens
ataactgaactcctcacacccaattgga

SEQ ID NO: 10200 - DNA, 30 bp, Homo sapiens; identical to SEQ ID NO: 1287

SEQ ID NO: 10201 - DNA, 41 bp, Homo sapiens
ataactgaactcctcacacccaattggaccaatctatcacc

SEQ ID NO: 10202 - DNA, 42 bp, Homo sapiens
ataactgaactcctcacacccaattggaccaatctatcaccc

SEQ ID NO: 10203 - DNA, 43 bp, Homo sapiens
ataactgaactcctcacacccaattggaccaatctatcaccct

SEQ ID NO: 10204 - DNA, 17 bp, Homo sapiens
taactgaactcctcaca

SEQ ID NO: 10205 - DNA, 19 bp, Homo sapiens
taactgaactcctcacacc

SEQ ID NO: 10206 - DNA, 20 bp, Homo sapiens
taactgaactcctcacaccc

SEQ ID NO: 10207 - DNA, 21 bp, Homo sapiens
taactgaactcctcacaccca

SEQ ID NO: 10208 - DNA, 26 bp, Homo sapiens
taactgaactcctcacacccaattgg

SEQ ID NO: 10209 - DNA, 27 bp, Homo sapiens
taactgaactcctcacacccaattgga

SEQ ID NO: 10210 - DNA, 29 bp, Homo sapiens
taactgaactcctcacacccaattggacc

SEQ ID NO: 10211 - DNA, 32 bp, Homo sapiens
taactgaactcctcacacccaattggaccaat

SEQ ID NO: 10212 - DNA, 33 bp, Homo sapiens
taactgaactcctcacacccaattggaccaatc

SEQ ID NO: 10213 - DNA, 40 bp, Homo sapiens
taactgaactcctcacacccaattggaccaatctatcacc

SEQ ID NO: 10214 - DNA, 41 bp, Homo sapiens
taactgaactcctcacacccaattggaccaatctatcaccc

SEQ ID NO: 10215 - DNA, 42 bp, Homo sapiens
taactgaactcctcacacccaattggaccaatctatcaccct

SEQ ID NO: 10216 - DNA, 16 bp, Homo sapiens
aactgaactcctcaca

SEQ ID NO: 10217 - DNA, 17 bp, Homo sapiens
aactgaactcctcacac

SEQ ID NO: 10218 - DNA, 18 bp, Homo sapiens
aactgaactcctcacacc

SEQ ID NO: 10219 - DNA, 19 bp, Homo sapiens
aactgaactcctcacaccc

SEQ ID NO: 10220 - DNA, 20 bp, Homo sapiens
aactgaactcctcacaccca

SEQ ID NO: 10221 - DNA, 22 bp, Homo sapiens
aactgaactcctcacacccaat

SEQ ID NO: 10222 - DNA, 24 bp, Homo sapiens
aactgaactcctcacacccaattg

SEQ ID NO: 10223 - DNA, 25 bp, Homo sapiens
aactgaactcctcacacccaattgg

SEQ ID NO: 10224 - DNA, 26 bp, Homo sapiens
aactgaactcctcacacccaattgga

SEQ ID NO: 10225 - DNA, 28 bp, Homo sapiens
aactgaactcctcacacccaattggacc

SEQ ID NO: 10226 - DNA, 29 bp, Homo sapiens
aactgaactcctcacacccaattggacca

SEQ ID NO: 10227 - DNA, 31 bp, Homo sapiens
aactgaactcctcacacccaattggaccaat

SEQ ID NO: 10228 - DNA, 32 bp, Homo sapiens; identical to SEQ ID NO: 1299

SEQ ID NO: 10229 - DNA, 33 bp, Homo sapiens; identical to SEQ ID NO: 1300

SEQ ID NO: 10230 - DNA, 39 bp, Homo sapiens
aactgaactcctcacacccaattggaccaatctatcacc

SEQ ID NO: 10231 - DNA, 40 bp, Homo sapiens
aactgaactcctcacacccaattggaccaatctatcaccc

SEQ ID NO: 10232 - DNA, 41 bp, Homo sapiens
aactgaactcctcacacccaattggaccaatctatcaccct

SEQ ID NO: 10233 - DNA, 43 bp, Homo sapiens
aactgaactcctcacacccaattggaccaatctatcaccctat

SEQ ID NO: 10234 - DNA, 47 bp, Homo sapiens
aactgaactcctcacacccaattggaccaatctatcaccctatagaa

SEQ ID NO: 10235 - DNA, 16 bp, Homo sapiens
actgaactcctcacac

SEQ ID NO: 10236 - DNA, 17 bp, Homo sapiens
actgaactcctcacacc

SEQ ID NO: 10237 - DNA, 18 bp, Homo sapiens
actgaactcctcacaccc

SEQ ID NO: 10238 - DNA, 19 bp, Homo sapiens
actgaactcctcacaccca

SEQ ID NO: 10239 - DNA, 23 bp, Homo sapiens
actgaactcctcacacccaattg

SEQ ID NO: 10240 - DNA, 24 bp, Homo sapiens
actgaactcctcacacccaattgg

SEQ ID NO: 10241 - DNA, 25 bp, Homo sapiens
actgaactcctcacacccaattgga

SEQ ID NO: 10242 - DNA, 27 bp, Homo sapiens
actgaactcctcacacccaattggacc

SEQ ID NO: 10243 - DNA, 28 bp, Homo sapiens
actgaactcctcacacccaattggacca

SEQ ID NO: 10244 - DNA, 30 bp, Homo sapiens
actgaactcctcacacccaattggaccaat

SEQ ID NO: 10245 - DNA, 31 bp, Homo sapiens
actgaactcctcacacccaattggaccaatc

SEQ ID NO: 10246 - DNA, 32 bp, Homo sapiens
actgaactcctcacacccaattggaccaatct

SEQ ID NO: 10247 - DNA, 35 bp, Homo sapiens
actgaactcctcacacccaattggaccaatctatc

SEQ ID NO: 10248 - DNA, 38 bp, Homo sapiens
actgaactcctcacacccaattggaccaatctatcacc

SEQ ID NO: 10249 - DNA, 39 bp, Homo sapiens
actgaactcctcacacccaattggaccaatctatcaccc

SEQ ID NO: 10250 - DNA, 40 bp, Homo sapiens
actgaactcctcacacccaattggaccaatctatcaccct

SEQ ID NO: 10251 - DNA, 41 bp, Homo sapiens
actgaactcctcacacccaattggaccaatctatcacccta

SEQ ID NO: 10252 - DNA, 46 bp, Homo sapiens
actgaactcctcacacccaattggaccaatctatcaccctatagaa

SEQ ID NO: 10253 - DNA, 16 bp, Homo sapiens
ctgaactcctcacacc

SEQ ID NO: 10254 - DNA, 17 bp, Homo sapiens
ctgaactcctcacaccc

SEQ ID NO: 10255 - DNA, 18 bp, Homo sapiens
ctgaactcctcacaccca

SEQ ID NO: 10256 - DNA, 23 bp, Homo sapiens
ctgaactcctcacacccaattgg

SEQ ID NO: 10257 - DNA, 24 bp, Homo sapiens
ctgaactcctcacacccaattgga

SEQ ID NO: 10258 - DNA, 26 bp, Homo sapiens
ctgaactcctcacacccaattggacc

SEQ ID NO: 10259 - DNA, 27 bp, Homo sapiens
ctgaactcctcacacccaattggacca

SEQ ID NO: 10260 - DNA, 30 bp, Homo sapiens
ctgaactcctcacacccaattggaccaatc

SEQ ID NO: 10261 - DNA, 33 bp, Homo sapiens
ctgaactcctcacacccaattggaccaatctat

SEQ ID NO: 10262 - DNA, 37 bp, Homo sapiens
ctgaactcctcacacccaattggaccaatctatcacc

SEQ ID NO: 10263 - DNA, 38 bp, Homo sapiens
ctgaactcctcacacccaattggaccaatctatcaccc

SEQ ID NO: 10264 - DNA, 39 bp, Homo sapiens
ctgaactcctcacacccaattggaccaatctatcaccct

SEQ ID NO: 10265 - DNA, 45 bp, Homo sapiens
ctgaactcctcacacccaattggaccaatctatcaccctatagaa

SEQ ID NO: 10266 - DNA, 16 bp, Homo sapiens
tgaactcctcacaccc

SEQ ID NO: 10267 - DNA, 17 bp, Homo sapiens
tgaactcctcacaccca

SEQ ID NO: 10268 - DNA, 23 bp, Homo sapiens
tgaactcctcacacccaattgga

SEQ ID NO: 10269 - DNA, 25 bp, Homo sapiens
tgaactcctcacacccaattggacc

SEQ ID NO: 10270 - DNA, 16 bp, Homo sapiens
gaactcctcacaccca

SEQ ID NO: 10271 - DNA, 24 bp, Homo sapiens
gaactcctcacacccaattggacc

SEQ ID NO: 10272 - DNA, 32 bp, Homo sapiens
gaactcctcacacccaattggaccaatctatc

SEQ ID NO: 10273 - DNA, 33 bp, Homo sapiens
ctcctcacacccaattggaccaatctatcaccc

SEQ ID NO: 10274 - DNA, 20 bp, Homo sapiens
tcctcacacccaattggacc

SEQ ID NO: 10275 - DNA, 18 bp, Homo sapiens
cctcacacccaattggac

SEQ ID NO: 10276 - DNA, 19 bp, Homo sapiens
cctcacacccaattggacc

SEQ ID NO: 10277 - DNA, 32 bp, Homo sapiens
cctcacacccaattggaccaatctatcaccct

SEQ ID NO: 10278 - DNA, 43 bp, Homo sapiens
cctcacacccaattggaccaatctatcaccctatagaagaact

SEQ ID NO: 10279 - DNA, 18 bp, Homo sapiens
ctcacacccaattggacc

SEQ ID NO: 10280 - DNA, 29 bp, Homo sapiens
ctcacacccaattggaccaatctatcacc

SEQ ID NO: 10281 - DNA, 30 bp, Homo sapiens
ctcacacccaattggaccaatctatcaccc

SEQ ID NO: 10282 - DNA, 31 bp, Homo sapiens
ctcacacccaattggaccaatctatcaccct

SEQ ID NO: 10283 - DNA, 17 bp, Homo sapiens
tcacacccaattggacc

SEQ ID NO: 10284 - DNA, 25 bp, Homo sapiens
tcacacccaattggaccaatctatc

SEQ ID NO: 10285 - DNA, 28 bp, Homo sapiens
tcacacccaattggaccaatctatcacc

SEQ ID NO: 10286 - DNA, 29 bp, Homo sapiens
tcacacccaattggaccaatctatcaccc

SEQ ID NO: 10287 - DNA, 30 bp, Homo sapiens; identical to SEQ ID NO: 1315

SEQ ID NO: 10288 - DNA, 31 bp, Homo sapiens
tcacacccaattggaccaatctatcacccta

SEQ ID NO: 10289 - DNA, 33 bp, Homo sapiens
tcacacccaattggaccaatctatcaccctata

SEQ ID NO: 10290 - DNA, 41 bp, Homo sapiens
tcacacccaattggaccaatctatcaccctatagaagaact

SEQ ID NO: 10291 - DNA, 16 bp, Homo sapiens
cacacccaattggacc

SEQ ID NO: 10292 - DNA, 24 bp, Homo sapiens
cacacccaattggaccaatctatc

SEQ ID NO: 10293 - DNA, 27 bp, Homo sapiens
cacacccaattggaccaatctatcacc

SEQ ID NO: 10294 - DNA, 28 bp, Homo sapiens
cacacccaattggaccaatctatcaccc

SEQ ID NO: 10295 - DNA, 29 bp, Homo sapiens
cacacccaattggaccaatctatcaccct

SEQ ID NO: 10296 - DNA, 30 bp, Homo sapiens
cacacccaattggaccaatctatcacccta

SEQ ID NO: 10297 - DNA, 32 bp, Homo sapiens
cacacccaattggaccaatctatcaccctata

SEQ ID NO: 10298 - DNA, 33 bp, Homo sapiens
cacacccaattggaccaatctatcaccctatag

SEQ ID NO: 10299 - DNA, 35 bp, Homo sapiens
cacacccaattggaccaatctatcaccctatagaa

SEQ ID NO: 10300 - DNA, 39 bp, Homo sapiens
cacacccaattggaccaatctatcaccctatagaagaac

SEQ ID NO: 10301 - DNA, 40 bp, Homo sapiens
cacacccaattggaccaatctatcaccctatagaagaact

SEQ ID NO: 10302 - DNA, 26 bp, Homo sapiens
acacccaattggaccaatctatcacc

SEQ ID NO: 10303 - DNA, 27 bp, Homo sapiens
acacccaattggaccaatctatcaccc

SEQ ID NO: 10304 - DNA, 28 bp, Homo sapiens
acacccaattggaccaatctatcaccct

SEQ ID NO: 10305 - DNA, 31 bp, Homo sapiens
acacccaattggaccaatctatcaccctata

SEQ ID NO: 10306 - DNA, 39 bp, Homo sapiens
acacccaattggaccaatctatcaccctatagaagaact

SEQ ID NO: 10307 - DNA, 25 bp, Homo sapiens
cacccaattggaccaatctatcacc

SEQ ID NO: 10308 - DNA, 26 bp, Homo sapiens
cacccaattggaccaatctatcaccc

SEQ ID NO: 10309 - DNA, 27 bp, Homo sapiens
cacccaattggaccaatctatcaccct

SEQ ID NO: 10310 - DNA, 28 bp, Homo sapiens
cacccaattggaccaatctatcacccta

SEQ ID NO: 10311 - DNA, 29 bp, Homo sapiens
cacccaattggaccaatctatcaccctat

SEQ ID NO: 10312 - DNA, 30 bp, Homo sapiens; identical to SEQ ID NO: 1324

SEQ ID NO: 10313 - DNA, 31 bp, Homo sapiens; identical to SEQ ID NO: 1325

SEQ ID NO: 10314 - DNA, 33 bp, Homo sapiens; identical to SEQ ID NO: 1326

SEQ ID NO: 10315 - DNA, 37 bp, Homo sapiens
cacccaattggaccaatctatcaccctatagaagaac

SEQ ID NO: 10316 - DNA, 38 bp, Homo sapiens
cacccaattggaccaatctatcaccctatagaagaact

SEQ ID NO: 10317 - DNA, 39 bp, Homo sapiens
cacccaattggaccaatctatcaccctatagaagaacta

SEQ ID NO: 10318 - DNA, 26 bp, Homo sapiens
acccaattggaccaatctatcaccct

SEQ ID NO: 10319 - DNA, 27 bp, Homo sapiens
acccaattggaccaatctatcacccta

SEQ ID NO: 10320 - DNA, 37 bp, Homo sapiens
acccaattggaccaatctatcaccctatagaagaact

SEQ ID NO: 10321 - DNA, 23 bp, Homo sapiens
cccaattggaccaatctatcacc

SEQ ID NO: 10322 - DNA, 24 bp, Homo sapiens
cccaattggaccaatctatcaccc

SEQ ID NO: 10323 - DNA, 25 bp, Homo sapiens
cccaattggaccaatctatcaccct

SEQ ID NO: 10324 - DNA, 26 bp, Homo sapiens
cccaattggaccaatctatcacccta

SEQ ID NO: 10325 - DNA, 27 bp, Homo sapiens
cccaattggaccaatctatcaccctat

SEQ ID NO: 10326 - DNA, 29 bp, Homo sapiens
cccaattggaccaatctatcaccctatag

SEQ ID NO: 10327 - DNA, 30 bp, Homo sapiens
cccaattggaccaatctatcaccctataga

SEQ ID NO: 10328 - DNA, 31 bp, Homo sapiens; identical to SEQ ID NO: 1329

SEQ ID NO: 10329 - DNA, 32 bp, Homo sapiens
cccaattggaccaatctatcaccctatagaag

SEQ ID NO: 10330 - DNA, 36 bp, Homo sapiens
cccaattggaccaatctatcaccctatagaagaact

SEQ ID NO: 10331 - DNA, 22 bp, Homo sapiens
ccaattggaccaatctatcacc

SEQ ID NO: 10332 - DNA, 23 bp, Homo sapiens
ccaattggaccaatctatcaccc

SEQ ID NO: 10333 - DNA, 24 bp, Homo sapiens
ccaattggaccaatctatcaccct

SEQ ID NO: 10334 - DNA, 25 bp, Homo sapiens
ccaattggaccaatctatcacccta

SEQ ID NO: 10335 - DNA, 26 bp, Homo sapiens
ccaattggaccaatctatcaccctat

SEQ ID NO: 10336 - DNA, 28 bp, Homo sapiens
ccaattggaccaatctatcaccctatag

SEQ ID NO: 10337 - DNA, 29 bp, Homo sapiens
ccaattggaccaatctatcaccctataga

SEQ ID NO: 10338 - DNA, 30 bp, Homo sapiens; identical to SEQ ID NO: 1332

SEQ ID NO: 10339 - DNA, 31 bp, Homo sapiens
ccaattggaccaatctatcaccctatagaag

SEQ ID NO: 10340 - DNA, 18 bp, Homo sapiens
caattggaccaatctatc

SEQ ID NO: 10341 - DNA, 21 bp, Homo sapiens
caattggaccaatctatcacc

SEQ ID NO: 10342 - DNA, 22 bp, Homo sapiens
caattggaccaatctatcaccc

SEQ ID NO: 10343 - DNA, 23 bp, Homo sapiens
caattggaccaatctatcaccct

SEQ ID NO: 10344 - DNA, 24 bp, Homo sapiens
caattggaccaatctatcacccta

SEQ ID NO: 10345 - DNA, 25 bp, Homo sapiens
caattggaccaatctatcaccctat

SEQ ID NO: 10346 - DNA, 26 bp, Homo sapiens
caattggaccaatctatcaccctata

SEQ ID NO: 10347 - DNA, 27 bp, Homo sapiens
caattggaccaatctatcaccctatag

SEQ ID NO: 10348 - DNA, 28 bp, Homo sapiens
caattggaccaatctatcaccctataga

SEQ ID NO: 10349 - DNA, 29 bp, Homo sapiens
caattggaccaatctatcaccctatagaa

SEQ ID NO: 10350 - DNA, 30 bp, Homo sapiens; identical to SEQ ID NO: 1342

SEQ ID NO: 10351 - DNA, 31 bp, Homo sapiens; identical to SEQ ID NO: 1343

SEQ ID NO: 10352 - DNA, 32 bp, Homo sapiens; identical to SEQ ID NO: 1344

SEQ ID NO: 10353 - DNA, 33 bp, Homo sapiens; identical to SEQ ID NO: 1345

SEQ ID NO: 10354 - DNA, 34 bp, Homo sapiens
caattggaccaatctatcaccctatagaagaact

SEQ ID NO: 10355 - DNA, 35 bp, Homo sapiens
caattggaccaatctatcaccctatagaagaacta

SEQ ID NO: 10356 - DNA, 37 bp, Homo sapiens
caattggaccaatctatcaccctatagaagaactaat

SEQ ID NO: 10357 - DNA, 43 bp, Homo sapiens
caattggaccaatctatcaccctatagaagaactaatgttagt

SEQ ID NO: 10358 - DNA, 17 bp, Homo sapiens
aattggaccaatctatc

SEQ ID NO: 10359 - DNA, 20 bp, Homo sapiens
aattggaccaatctatcacc

SEQ ID NO: 10360 - DNA, 21 bp, Homo sapiens
aattggaccaatctatcaccc

SEQ ID NO: 10361 - DNA, 22 bp, Homo sapiens
aattggaccaatctatcaccct

SEQ ID NO: 10362 - DNA, 23 bp, Homo sapiens
aattggaccaatctatcacccta

SEQ ID NO: 10363 - DNA, 24 bp, Homo sapiens
aattggaccaatctatcaccctat

SEQ ID NO: 10364 - DNA, 25 bp, Homo sapiens
aattggaccaatctatcaccctata

SEQ ID NO: 10365 - DNA, 26 bp, Homo sapiens
aattggaccaatctatcaccctatag

SEQ ID NO: 10366 - DNA, 27 bp, Homo sapiens
aattggaccaatctatcaccctataga

SEQ ID NO: 10367 - DNA, 28 bp, Homo sapiens
aattggaccaatctatcaccctatagaa

SEQ ID NO: 10368 - DNA, 29 bp, Homo sapiens
aattggaccaatctatcaccctatagaag

SEQ ID NO: 10369 - DNA, 30 bp, Homo sapiens; identical to SEQ ID NO: 1357

SEQ ID NO: 10370 - DNA, 31 bp, Homo sapiens; identical to SEQ ID NO: 1358

SEQ ID NO: 10371 - DNA, 32 bp, Homo sapiens; identical to SEQ ID NO: 1359

SEQ ID NO: 10372 - DNA, 33 bp, Homo sapiens; identical to SEQ ID NO: 1360

SEQ ID NO: 10373 - DNA, 34 bp, Homo sapiens
aattggaccaatctatcaccctatagaagaacta

SEQ ID NO: 10374 - DNA, 36 bp, Homo sapiens
aattggaccaatctatcaccctatagaagaactaat

SEQ ID NO: 10375 - DNA, 42 bp, Homo sapiens
aattggaccaatctatcaccctatagaagaactaatgttagt

SEQ ID NO: 10376 - DNA, 44 bp, Homo sapiens
aattggaccaatctatcaccctatagaagaactaatgttagtat

SEQ ID NO: 10377 - DNA, 45 bp, Homo sapiens
aattggaccaatctatcaccctatagaagaactaatgttagtata

SEQ ID NO: 10378 - DNA, 16 bp, Homo sapiens
attggaccaatctatc

SEQ ID NO: 10379 - DNA, 19 bp, Homo sapiens
attggaccaatctatcacc

SEQ ID NO: 10380 - DNA, 20 bp, Homo sapiens
attggaccaatctatcaccc

SEQ ID NO: 10381 - DNA, 21 bp, Homo sapiens
attggaccaatctatcaccct

SEQ ID NO: 10382 - DNA, 22 bp, Homo sapiens
attggaccaatctatcacccta

SEQ ID NO: 10383 - DNA, 23 bp, Homo sapiens
attggaccaatctatcaccctat

SEQ ID NO: 10384 - DNA, 24 bp, Homo sapiens
attggaccaatctatcaccctata

SEQ ID NO: 10385 - DNA, 26 bp, Homo sapiens
attggaccaatctatcaccctataga

SEQ ID NO: 10386 - DNA, 27 bp, Homo sapiens
attggaccaatctatcaccctatagaa

SEQ ID NO: 10387 - DNA, 28 bp, Homo sapiens
attggaccaatctatcaccctatagaag

SEQ ID NO: 10388 - DNA, 29 bp, Homo sapiens
attggaccaatctatcaccctatagaaga

SEQ ID NO: 10389 - DNA, 30 bp, Homo sapiens
attggaccaatctatcaccctatagaagaa

SEQ ID NO: 10390 - DNA, 31 bp, Homo sapiens; identical to SEQ ID NO: 1370

SEQ ID NO: 10391 - DNA, 32 bp, Homo sapiens; identical to SEQ ID NO: 1371

SEQ ID NO: 10392 - DNA, 33 bp, Homo sapiens
attggaccaatctatcaccctatagaagaacta

SEQ ID NO: 10393 - DNA, 41 bp, Homo sapiens
attggaccaatctatcaccctatagaagaactaatgttagt

SEQ ID NO: 10394 - DNA, 18 bp, Homo sapiens
ttggaccaatctatcacc

SEQ ID NO: 10395 - DNA, 19 bp, Homo sapiens
ttggaccaatctatcaccc

SEQ ID NO: 10396 - DNA, 20 bp, Homo sapiens
ttggaccaatctatcaccct

SEQ ID NO: 10397 - DNA, 21 bp, Homo sapiens
ttggaccaatctatcacccta

SEQ ID NO: 10398 - DNA, 24 bp, Homo sapiens
ttggaccaatctatcaccctatag

SEQ ID NO: 10399 - DNA, 25 bp, Homo sapiens
ttggaccaatctatcaccctataga

SEQ ID NO: 10400 - DNA, 26 bp, Homo sapiens
ttggaccaatctatcaccctatagaa

SEQ ID NO: 10401 - DNA, 27 bp, Homo sapiens
ttggaccaatctatcaccctatagaag

SEQ ID NO: 10402 - DNA, 30 bp, Homo sapiens
ttggaccaatctatcaccctatagaagaac

SEQ ID NO: 10403 - DNA, 31 bp, Homo sapiens; identical to SEQ ID NO: 1376

SEQ ID NO: 10404 - DNA, 32 bp, Homo sapiens
ctatagaagaactaatgttagtataagtaaca

SEQ ID NO: 10405 - DNA, 31 bp, Homo sapiens
tatagaagaactaatgttagtataagtaaca

SEQ ID NO: 10406 - DNA, 33 bp, Homo sapiens
gtaacatgaaaacattctcctccgcataagcct

SEQ ID NO: 10407 - DNA, 17 bp, Homo sapiens
attctcctccgcataag

SEQ ID NO: 10408 - DNA, 39 bp, Homo sapiens
tcctccgcataagcctgcgtcagattaaaacactgaact

SEQ ID NO: 10409 - DNA, 38 bp, Homo sapiens
cctccgcataagcctgcgtcagattaaaacactgaact

SEQ ID NO: 10410 - DNA, 42 bp, Homo sapiens
cctccgcataagcctgcgtcagattaaaacactgaactgaca

SEQ ID NO: 10411 - DNA, 37 bp, Homo sapiens
ctccgcataagcctgcgtcagattaaaacactgaact

SEQ ID NO: 10412 - DNA, 36 bp, Homo sapiens
tccgcataagcctgcgtcagattaaaacactgaact

SEQ ID NO: 10413 - DNA, 40 bp, Homo sapiens
tccgcataagcctgcgtcagattaaaacactgaactgaca

SEQ ID NO: 10414 - DNA, 35 bp, Homo sapiens
ccgcataagcctgcgtcagattaaaacactgaact

SEQ ID NO: 10415 - DNA, 39 bp, Homo sapiens
ccgcataagcctgcgtcagattaaaacactgaactgaca

SEQ ID NO: 10416 - DNA, 19 bp, Homo sapiens
gcataagcctgcgtcagat

SEQ ID NO: 10417 - DNA, 20 bp, Homo sapiens
gcataagcctgcgtcagatt

SEQ ID NO: 10418 - DNA, 21 bp, Homo sapiens
gcataagcctgcgtcagatta

SEQ ID NO: 10419 - DNA, 28 bp, Homo sapiens
gcataagcctgcgtcagattaaaacact

SEQ ID NO: 10420 - DNA, 33 bp, Homo sapiens; identical to SEQ ID NO: 1379

SEQ ID NO: 10421 - DNA, 37 bp, Homo sapiens
gcataagcctgcgtcagattaaaacactgaactgaca

SEQ ID NO: 10422 - DNA, 47 bp, Homo sapiens
gcataagcctgcgtcagattaaaacactgaactgacaattaacagcc

SEQ ID NO: 10423 - DNA, 18 bp, Homo sapiens
cataagcctgcgtcagat

SEQ ID NO: 10424 - DNA, 19 bp, Homo sapiens
cataagcctgcgtcagatt

SEQ ID NO: 10425 - DNA, 20 bp, Homo sapiens
cataagcctgcgtcagatta

SEQ ID NO: 10426 - DNA, 23 bp, Homo sapiens
cataagcctgcgtcagattaaaa

SEQ ID NO: 10427 - DNA, 24 bp, Homo sapiens
cataagcctgcgtcagattaaaac

SEQ ID NO: 10428 - DNA, 25 bp, Homo sapiens
cataagcctgcgtcagattaaaaca

SEQ ID NO: 10429 - DNA, 26 bp, Homo sapiens
cataagcctgcgtcagattaaaacac

SEQ ID NO: 10430 - DNA, 27 bp, Homo sapiens
cataagcctgcgtcagattaaaacact

SEQ ID NO: 10431 - DNA, 28 bp, Homo sapiens
cataagcctgcgtcagattaaaacactg

SEQ ID NO: 10432 - DNA, 30 bp, Homo sapiens
cataagcctgcgtcagattaaaacactgaa

SEQ ID NO: 10433 - DNA, 31 bp, Homo sapiens; identical to SEQ ID NO: 1387

SEQ ID NO: 10434 - DNA, 32 bp, Homo sapiens; identical to SEQ ID NO: 1388

SEQ ID NO: 10435 - DNA, 33 bp, Homo sapiens
cataagcctgcgtcagattaaaacactgaactg

SEQ ID NO: 10436 - DNA, 35 bp, Homo sapiens
cataagcctgcgtcagattaaaacactgaactgac

SEQ ID NO: 10437 - DNA, 36 bp, Homo sapiens
cataagcctgcgtcagattaaaacactgaactgaca

SEQ ID NO: 10438 - DNA, 46 bp, Homo sapiens
cataagcctgcgtcagattaaaacactgaactgacaattaacagcc

SEQ ID NO: 10439 - DNA, 47 bp, Homo sapiens
cataagcctgcgtcagattaaaacactgaactgacaattaacagccc

SEQ ID NO: 10440 - DNA, 17 bp, Homo sapiens
ataagcctgcgtcagat

SEQ ID NO: 10441 - DNA, 25 bp, Homo sapiens
ataagcctgcgtcagattaaaacac

SEQ ID NO: 10442 - DNA, 26 bp, Homo sapiens
ataagcctgcgtcagattaaaacact

SEQ ID NO: 10443 - DNA, 31 bp, Homo sapiens; identical to SEQ ID NO: 1390

SEQ ID NO: 10444 - DNA, 35 bp, Homo sapiens
ataagcctgcgtcagattaaaacactgaactgaca

SEQ ID NO: 10445 - DNA, 16 bp, Homo sapiens
taagcctgcgtcagat

SEQ ID NO: 10446 - DNA, 17 bp, Homo sapiens
taagcctgcgtcagatt

SEQ ID NO: 10447 - DNA, 18 bp, Homo sapiens
taagcctgcgtcagatta

SEQ ID NO: 10448 - DNA, 21 bp, Homo sapiens
taagcctgcgtcagattaaaa

SEQ ID NO: 10449 - DNA, 22 bp, Homo sapiens
taagcctgcgtcagattaaaac

SEQ ID NO: 10450 - DNA, 23 bp, Homo sapiens
taagcctgcgtcagattaaaaca

SEQ ID NO: 10451 - DNA, 24 bp, Homo sapiens
taagcctgcgtcagattaaaacac

SEQ ID NO: 10452 - DNA, 25 bp, Homo sapiens
taagcctgcgtcagattaaaacact

SEQ ID NO: 10453 - DNA, 26 bp, Homo sapiens
taagcctgcgtcagattaaaacactg

SEQ ID NO: 10454 - DNA, 28 bp, Homo sapiens
taagcctgcgtcagattaaaacactgaa

SEQ ID NO: 10455 - DNA, 29 bp, Homo sapiens
taagcctgcgtcagattaaaacactgaac

SEQ ID NO: 10456 - DNA, 30 bp, Homo sapiens; identical to SEQ ID NO: 1395

SEQ ID NO: 10457 - DNA, 32 bp, Homo sapiens
taagcctgcgtcagattaaaacactgaactga

SEQ ID NO: 10458 - DNA, 33 bp, Homo sapiens; identical to SEQ ID NO: 1396

SEQ ID NO: 10459 - DNA, 34 bp, Homo sapiens
taagcctgcgtcagattaaaacactgaactgaca

SEQ ID NO: 10460 - DNA, 44 bp, Homo sapiens
taagcctgcgtcagattaaaacactgaactgacaattaacagcc

SEQ ID NO: 10461 - DNA, 45 bp, Homo sapiens
taagcctgcgtcagattaaaacactgaactgacaattaacagccc

SEQ ID NO: 10462 - DNA, 16 bp, Homo sapiens
aagcctgcgtcagatt

SEQ ID NO: 10463 - DNA, 17 bp, Homo sapiens
aagcctgcgtcagatta

SEQ ID NO: 10464 - DNA, 20 bp, Homo sapiens
aagcctgcgtcagattaaaa

SEQ ID NO: 10465 - DNA, 21 bp, Homo sapiens
aagcctgcgtcagattaaaac

SEQ ID NO: 10466 - DNA, 22 bp, Homo sapiens
aagcctgcgtcagattaaaaca

SEQ ID NO: 10467 - DNA, 23 bp, Homo sapiens
aagcctgcgtcagattaaaacac

SEQ ID NO: 10468 - DNA, 24 bp, Homo sapiens
aagcctgcgtcagattaaaacact

SEQ ID NO: 10469 - DNA, 28 bp, Homo sapiens
aagcctgcgtcagattaaaacactgaac

SEQ ID NO: 10470 - DNA, 29 bp, Homo sapiens
aagcctgcgtcagattaaaacactgaact

SEQ ID NO: 10471 - DNA, 32 bp, Homo sapiens; identical to SEQ ID NO: 1399

SEQ ID NO: 10472 - DNA, 33 bp, Homo sapiens; identical to SEQ ID NO: 1400

SEQ ID NO: 10473 - DNA, 44 bp, Homo sapiens
aagcctgcgtcagattaaaacactgaactgacaattaacagccc

SEQ ID NO: 10474 - DNA, 16 bp, Homo sapiens
agcctgcgtcagatta

SEQ ID NO: 10475 - DNA, 21 bp, Homo sapiens
agcctgcgtcagattaaaaca

SEQ ID NO: 10476 - DNA, 22 bp, Homo sapiens
agcctgcgtcagattaaaacac

SEQ ID NO: 10477 - DNA, 23 bp, Homo sapiens
agcctgcgtcagattaaaacact

SEQ ID NO: 10478 - DNA, 24 bp, Homo sapiens
agcctgcgtcagattaaaacactg

SEQ ID NO: 10479 - DNA, 26 bp, Homo sapiens
agcctgcgtcagattaaaacactgaa

SEQ ID NO: 10480 - DNA, 27 bp, Homo sapiens
agcctgcgtcagattaaaacactgaac

SEQ ID NO: 10481 - DNA, 28 bp, Homo sapiens
agcctgcgtcagattaaaacactgaact

SEQ ID NO: 10482 - DNA, 30 bp, Homo sapiens
agcctgcgtcagattaaaacactgaactga

SEQ ID NO: 10483 - DNA, 31 bp, Homo sapiens; identical to SEQ ID NO: 1403

SEQ ID NO: 10484 - DNA, 32 bp, Homo sapiens; identical to SEQ ID NO: 1404

SEQ ID NO: 10485 - DNA, 43 bp, Homo sapiens
agcctgcgtcagattaaaacactgaactgacaattaacagccc

SEQ ID NO: 10486 - DNA, 27 bp, Homo sapiens
gcctgcgtcagattaaaacactgaact

SEQ ID NO: 10487 - DNA, 30 bp, Homo sapiens
gcctgcgtcagattaaaacactgaactgac

SEQ ID NO: 10488 - DNA, 31 bp, Homo sapiens; identical to SEQ ID NO: 1406

SEQ ID NO: 10489 - DNA, 21 bp, Homo sapiens
cctgcgtcagattaaaacact

SEQ ID NO: 10490 - DNA, 26 bp, Homo sapiens
cctgcgtcagattaaaacactgaact

SEQ ID NO: 10491 - DNA, 30 bp, Homo sapiens
cctgcgtcagattaaaacactgaactgaca

SEQ ID NO: 10492 - DNA, 20 bp, Homo sapiens
ctgcgtcagattaaaacact

SEQ ID NO: 10493 - DNA, 19 bp, Homo sapiens
tgcgtcagattaaaacact

SEQ ID NO: 10494 - DNA, 24 bp, Homo sapiens
tgcgtcagattaaaacactgaact

SEQ ID NO: 10495 - DNA, 28 bp, Homo sapiens
tgcgtcagattaaaacactgaactgaca

SEQ ID NO: 10496 - DNA, 38 bp, Homo sapiens
tgcgtcagattaaaacactgaactgacaattaacagcc

SEQ ID NO: 10497 - DNA, 39 bp, Homo sapiens
tgcgtcagattaaaacactgaactgacaattaacagccc

SEQ ID NO: 10498 - DNA, 18 bp, Homo sapiens
agattaaaacactgaact

SEQ ID NO: 10499 - DNA, 25 bp, Homo sapiens
agattaaaacactgaactgacaatt

SEQ ID NO: 10500 - DNA, 26 bp, Homo sapiens
agattaaaacactgaactgacaatta

SEQ ID NO: 10501 - DNA, 33 bp, Homo sapiens
agattaaaacactgaactgacaattaacagccc

SEQ ID NO: 10502 - DNA, 17 bp, Homo sapiens
gattaaaacactgaact

SEQ ID NO: 10503 - DNA, 31 bp, Homo sapiens; identical to SEQ ID NO: 1411

SEQ ID NO: 10504 - DNA, 32 bp, Homo sapiens; identical to SEQ ID NO: 1412

SEQ ID NO: 10505 - DNA, 16 bp, Homo sapiens
attaaaacactgaact

SEQ ID NO: 10506 - DNA, 30 bp, Homo sapiens; identical to SEQ ID NO: 1413

SEQ ID NO: 10507 - DNA, 31 bp, Homo sapiens; identical to SEQ ID NO: 1414

SEQ ID NO: 10508 - DNA, 23 bp, Homo sapiens
ttaaaacactgaactgacaatta

SEQ ID NO: 10509 - DNA, 26 bp, Homo sapiens
ttaaaacactgaactgacaattaaca

SEQ ID NO: 10510 - DNA, 29 bp, Homo sapiens
ttaaaacactgaactgacaattaacagcc

SEQ ID NO: 10511 - DNA, 30 bp, Homo sapiens
ttaaaacactgaactgacaattaacagccc

SEQ ID NO: 10512 - DNA, 28 bp, Homo sapiens
taaaacactgaactgacaattaacagcc

SEQ ID NO: 10513 - DNA, 29 bp, Homo sapiens
taaaacactgaactgacaattaacagccc

SEQ ID NO: 10514 - DNA, 27 bp, Homo sapiens
aaaacactgaactgacaattaacagcc

SEQ ID NO: 10515 - DNA, 28 bp, Homo sapiens
aaaacactgaactgacaattaacagccc

SEQ ID NO: 10516 - DNA, 19 bp, Homo sapiens
aaacactgaactgacaatt

SEQ ID NO: 10517 - DNA, 26 bp, Homo sapiens
aaacactgaactgacaattaacagcc

SEQ ID NO: 10518 - DNA, 27 bp, Homo sapiens
aaacactgaactgacaattaacagccc

SEQ ID NO: 10519 - DNA, 28 bp, Homo sapiens
aaacactgaactgacaattaacagccca

SEQ ID NO: 10520 - DNA, 25 bp, Homo sapiens
aacactgaactgacaattaacagcc

SEQ ID NO: 10521 - DNA, 26 bp, Homo sapiens
aacactgaactgacaattaacagccc

SEQ ID NO: 10522 - DNA, 24 bp, Homo sapiens
acactgaactgacaattaacagcc

SEQ ID NO: 10523 - DNA, 25 bp, Homo sapiens
acactgaactgacaattaacagccc

SEQ ID NO: 10524 - DNA, 23 bp, Homo sapiens
cactgaactgacaattaacagcc

SEQ ID NO: 10525 - DNA, 24 bp, Homo sapiens
cactgaactgacaattaacagccc

SEQ ID NO: 10526 - DNA, 22 bp, Homo sapiens
actgaactgacaattaacagcc

SEQ ID NO: 10527 - DNA, 23 bp, Homo sapiens
actgaactgacaattaacagccc

SEQ ID NO: 10528 - DNA, 21 bp, Homo sapiens
ctgaactgacaattaacagcc

SEQ ID NO: 10529 - DNA, 22 bp, Homo sapiens
ctgaactgacaattaacagccc

SEQ ID NO: 10530 - DNA, 28 bp, Homo sapiens
ctgaactgacaattaacagcccaatatc

SEQ ID NO: 10531 - DNA, 29 bp, Homo sapiens
ctgaactgacaattaacagcccaatatct

SEQ ID NO: 10532 - DNA, 32 bp, Homo sapiens
ctgaactgacaattaacagcccaatatctaca

SEQ ID NO: 10533 - DNA, 21 bp, Homo sapiens
tgaactgacaattaacagccc

SEQ ID NO: 10534 - DNA, 22 bp, Homo sapiens
agatattgggctgttaattgtc

SEQ ID NO: 10535 - DNA, 24 bp, Homo sapiens
gtagatattgggctgttaattgtc

SEQ ID NO: 10536 - DNA, 32 bp, Homo sapiens
gacaattaacagcccaatatctacaatcaacc

SEQ ID NO: 10537 - DNA, 29 bp, Homo sapiens
aattaacagcccaatatctacaatcaacc

SEQ ID NO: 10538 - DNA, 33 bp, Homo sapiens
aattaacagcccaatatctacaatcaaccaaca

SEQ ID NO: 10539 - DNA, 21 bp, Homo sapiens
attaacagcccaatatctaca

SEQ ID NO: 10540 - DNA, 28 bp, Homo sapiens
attaacagcccaatatctacaatcaacc

SEQ ID NO: 10541 - DNA, 32 bp, Homo sapiens; identical to SEQ ID NO: 1426

SEQ ID NO: 10542 - DNA, 31 bp, Homo sapiens
ttaacagcccaatatctacaatcaaccaaca

SEQ ID NO: 10543 - DNA, 25 bp, Homo sapiens
aacagcccaatatctacaatcaacc

SEQ ID NO: 10544 - DNA, 26 bp, Homo sapiens
aacagcccaatatctacaatcaacca

SEQ ID NO: 10545 - DNA, 29 bp, Homo sapiens
aacagcccaatatctacaatcaaccaaca

SEQ ID NO: 10546 - DNA, 33 bp, Homo sapiens
aacagcccaatatctacaatcaaccaacaagtc

SEQ ID NO: 10547 - DNA, 24 bp, Homo sapiens
acagcccaatatctacaatcaacc

SEQ ID NO: 10548 - DNA, 28 bp, Homo sapiens
acagcccaatatctacaatcaaccaaca

SEQ ID NO: 10549 - DNA, 22 bp, Homo sapiens
agcccaatatctacaatcaacc

SEQ ID NO: 10550 - DNA, 21 bp, Homo sapiens
gcccaatatctacaatcaacc

SEQ ID NO: 10551 - DNA, 25 bp, Homo sapiens
gcccaatatctacaatcaaccaaca

SEQ ID NO: 10552 - DNA, 28 bp, Homo sapiens
gcccaatatctacaatcaaccaacaagt

SEQ ID NO: 10553 - DNA, 18 bp, Homo sapiens
caatatctacaatcaacc

SEQ ID NO: 10554 - DNA, 22 bp, Homo sapiens
caatatctacaatcaaccaaca

SEQ ID NO: 10555 - DNA, 26 bp, Homo sapiens
caatatctacaatcaaccaacaagtc

SEQ ID NO: 10556 - DNA, 35 bp, Homo sapiens
caatatctacaatcaaccaacaagtcattattacc

SEQ ID NO: 10557 - DNA, 41 bp, Homo sapiens
caatatctacaatcaaccaacaagtcattattaccctcact

SEQ ID NO: 10558 - DNA, 21 bp, Homo sapiens
aatatctacaatcaaccaaca

SEQ ID NO: 10559 - DNA, 25 bp, Homo sapiens
aatatctacaatcaaccaacaagtc

SEQ ID NO: 10560 - DNA, 34 bp, Homo sapiens
aatatctacaatcaaccaacaagtcattattacc

SEQ ID NO: 10561 - DNA, 35 bp, Homo sapiens
aatatctacaatcaaccaacaagtcattattaccc

SEQ ID NO: 10562 - DNA, 40 bp, Homo sapiens
aatatctacaatcaaccaacaagtcattattaccctcact

SEQ ID NO: 10563 - DNA, 20 bp, Homo sapiens
atatctacaatcaaccaaca

SEQ ID NO: 10564 - DNA, 24 bp, Homo sapiens
atatctacaatcaaccaacaagtc

SEQ ID NO: 10565 - DNA, 33 bp, Homo sapiens; identical to SEQ ID NO: 1431

SEQ ID NO: 10566 - DNA, 29 bp, Homo sapiens
ctacaatcaaccaacaagtcattattacc

SEQ ID NO: 10567 - DNA, 28 bp, Homo sapiens
tacaatcaaccaacaagtcattattacc

SEQ ID NO: 10568 - DNA, 29 bp, Homo sapiens
tacaatcaaccaacaagtcattattaccc

SEQ ID NO: 10569 - DNA, 27 bp, Homo sapiens
acaatcaaccaacaagtcattattacc

SEQ ID NO: 10570 - DNA, 28 bp, Homo sapiens
acaatcaaccaacaagtcattattaccc

SEQ ID NO: 10571 - DNA, 33 bp, Homo sapiens; identical to SEQ ID NO: 1433

SEQ ID NO: 10572 - DNA, 32 bp, Homo sapiens
caatcaaccaacaagtcattattaccctcact

SEQ ID NO: 10573 - DNA, 25 bp, Homo sapiens
aatcaaccaacaagtcattattacc

SEQ ID NO: 10574 - DNA, 24 bp, Homo sapiens
atcaaccaacaagtcattattacc

SEQ ID NO: 10575 - DNA, 30 bp, Homo sapiens; identical to SEQ ID NO: 1434

SEQ ID NO: 10576 - DNA, 33 bp, Homo sapiens
atcaaccaacaagtcattattaccctcactgtc

SEQ ID NO: 10577 - DNA, 28 bp, Homo sapiens
caaccaacaagtcattattaccctcact

SEQ ID NO: 10578 - DNA, 21 bp, Homo sapiens
aaccaacaagtcattattacc

SEQ ID NO: 10579 - DNA, 27 bp, Homo sapiens
aaccaacaagtcattattaccctcact

SEQ ID NO: 10580 - DNA, 30 bp, Homo sapiens
aaccaacaagtcattattaccctcactgtc

SEQ ID NO: 10581 - DNA, 34 bp, Homo sapiens
aaccaacaagtcattattaccctcactgtcaacc

SEQ ID NO: 10582 - DNA, 35 bp, Homo sapiens
aaccaacaagtcattattaccctcactgtcaaccc

SEQ ID NO: 10583 - DNA, 26 bp, Homo sapiens
accaacaagtcattattaccctcact

SEQ ID NO: 10584 - DNA, 29 bp, Homo sapiens
accaacaagtcattattaccctcactgtc

SEQ ID NO: 10585 - DNA, 33 bp, Homo sapiens
accaacaagtcattattaccctcactgtcaacc

SEQ ID NO: 10586 - DNA, 34 bp, Homo sapiens
accaacaagtcattattaccctcactgtcaaccc

SEQ ID NO: 10587 - DNA, 26 bp, Homo sapiens
caacaagtcattattaccctcactgt

SEQ ID NO: 10588 - DNA, 31 bp, Homo sapiens
caacaagtcattattaccctcactgtcaacc

SEQ ID NO: 10589 - DNA, 32 bp, Homo sapiens
caacaagtcattattaccctcactgtcaaccc

SEQ ID NO: 10590 - DNA, 17 bp, Homo sapiens
aacaagtcattattacc

SEQ ID NO: 10591 - DNA, 23 bp, Homo sapiens
aacaagtcattattaccctcact

SEQ ID NO: 10592 - DNA, 24 bp, Homo sapiens
aacaagtcattattaccctcactg

SEQ ID NO: 10593 - DNA, 25 bp, Homo sapiens
aacaagtcattattaccctcactgt

SEQ ID NO: 10594 - DNA, 26 bp, Homo sapiens
aacaagtcattattaccctcactgtc

SEQ ID NO: 10595 - DNA, 27 bp, Homo sapiens
aacaagtcattattaccctcactgtca

SEQ ID NO: 10596 - DNA, 30 bp, Homo sapiens; identical to SEQ ID NO: 1439

SEQ ID NO: 10597 - DNA, 31 bp, Homo sapiens; identical to SEQ ID NO: 1440

SEQ ID NO: 10598 - DNA, 22 bp, Homo sapiens
acaagtcattattaccctcact

SEQ ID NO: 10599 - DNA, 24 bp, Homo sapiens
acaagtcattattaccctcactgt

SEQ ID NO: 10600 - DNA, 25 bp, Homo sapiens
acaagtcattattaccctcactgtc

SEQ ID NO: 10601 - DNA, 29 bp, Homo sapiens
acaagtcattattaccctcactgtcaacc

SEQ ID NO: 10602 - DNA, 30 bp, Homo sapiens; identical to SEQ ID NO: 1443

SEQ ID NO: 10603 - DNA, 28 bp, Homo sapiens
caagtcattattaccctcactgtcaacc

SEQ ID NO: 10604 - DNA, 29 bp, Homo sapiens
caagtcattattaccctcactgtcaaccc

SEQ ID NO: 10605 - DNA, 28 bp, Homo sapiens
aagtcattattaccctcactgtcaaccc

SEQ ID NO: 10606 - DNA, 22 bp, Homo sapiens
agtcattattaccctcactgtc

SEQ ID NO: 10607 - DNA, 26 bp, Homo sapiens
agtcattattaccctcactgtcaacc

SEQ ID NO: 10608 - DNA, 27 bp, Homo sapiens
agtcattattaccctcactgtcaaccc

SEQ ID NO: 10609 - DNA, 26 bp, Homo sapiens
gtcattattaccctcactgtcaaccc

SEQ ID NO: 10610 - DNA, 25 bp, Homo sapiens
tcattattaccctcactgtcaaccc

SEQ ID NO: 10611 - DNA, 24 bp, Homo sapiens
cattattaccctcactgtcaaccc

SEQ ID NO: 10612 - DNA, 25 bp, Homo sapiens
cattattaccctcactgtcaaccca

SEQ ID NO: 10613 - DNA, 18 bp, Homo sapiens
attattaccctcactgtc

SEQ ID NO: 10614 - DNA, 22 bp, Homo sapiens
attattaccctcactgtcaacc

SEQ ID NO: 10615 - DNA, 23 bp, Homo sapiens
attattaccctcactgtcaaccc

SEQ ID NO: 10616 - DNA, 17 bp, Homo sapiens
ttattaccctcactgtc

SEQ ID NO: 10617 - DNA, 21 bp, Homo sapiens
ttattaccctcactgtcaacc

SEQ ID NO: 10618 - DNA, 22 bp, Homo sapiens
ttattaccctcactgtcaaccc

SEQ ID NO: 10619 - DNA, 20 bp, Homo sapiens
tattaccctcactgtcaacc

SEQ ID NO: 10620 - DNA, 21 bp, Homo sapiens
tattaccctcactgtcaaccc

SEQ ID NO: 10621 - DNA, 19 bp, Homo sapiens
attaccctcactgtcaacc

SEQ ID NO: 10622 - DNA, 20 bp, Homo sapiens
attaccctcactgtcaaccc

SEQ ID NO: 10623 - DNA, 24 bp, Homo sapiens
attaccctcactgtcaacccaaca

SEQ ID NO: 10624 - DNA, 18 bp, Homo sapiens
ttaccctcactgtcaacc

SEQ ID NO: 10625 - DNA, 19 bp, Homo sapiens
ttaccctcactgtcaaccc

SEQ ID NO: 10626 - DNA, 17 bp, Homo sapiens
taccctcactgtcaacc

SEQ ID NO: 10627 - DNA, 18 bp, Homo sapiens
taccctcactgtcaaccc

SEQ ID NO: 10628 - DNA, 16 bp, Homo sapiens
accctcactgtcaacc

SEQ ID NO: 10629 - DNA, 17 bp, Homo sapiens
accctcactgtcaaccc

SEQ ID NO: 10630 - DNA, 16 bp, Homo sapiens
ccctcactgtcaaccc

SEQ ID NO: 10631 - DNA, 28 bp, Homo sapiens
ctcactgtcaacccaacacaggcatgct

SEQ ID NO: 10632 - DNA, 30 bp, Homo sapiens
ctcactgtcaacccaacacaggcatgctca

SEQ ID NO: 10633 - DNA, 30 bp, Homo sapiens
aacccaacacaggcatgctcataaggaaag

SEQ ID NO: 10634 - DNA, 29 bp, Homo sapiens
acccaacacaggcatgctcataaggaaag

SEQ ID NO: 10635 - DNA, 16 bp, Homo sapiens
caacacaggcatgctc

SEQ ID NO: 10636 - DNA, 26 bp, Homo sapiens
caacacaggcatgctcataaggaaag

SEQ ID NO: 10637 - DNA, 29 bp, Homo sapiens
caacacaggcatgctcataaggaaaggtt

SEQ ID NO: 10638 - DNA, 25 bp, Homo sapiens
aacacaggcatgctcataaggaaag

SEQ ID NO: 10639 - DNA, 27 bp, Homo sapiens
aacacaggcatgctcataaggaaaggt

SEQ ID NO: 10640 - DNA, 28 bp, Homo sapiens
aacacaggcatgctcataaggaaaggtt

SEQ ID NO: 10641 - DNA, 24 bp, Homo sapiens
acacaggcatgctcataaggaaag

SEQ ID NO: 10642 - DNA, 21 bp, Homo sapiens
caggcatgctcataaggaaag

SEQ ID NO: 10643 - DNA, 19 bp, Homo sapiens
ggcatgctcataaggaaag

SEQ ID NO: 10644 - DNA, 33 bp, Homo sapiens; identical to SEQ ID NO: 1457

SEQ ID NO: 10645 - DNA, 38 bp, Homo sapiens
cataaggaaaggttaaaaaaagtaaaaggaactcggca

SEQ ID NO: 10646 - DNA, 32 bp, Homo sapiens
ataaggaaaggttaaaaaaagtaaaaggaact

SEQ ID NO: 10647 - DNA, 31 bp, Homo sapiens; identical to SEQ ID NO: 1458

SEQ ID NO: 10648 - DNA, 32 bp, Homo sapiens
taaggaaaggttaaaaaaagtaaaaggaactc

SEQ ID NO: 10649 - DNA, 36 bp, Homo sapiens
taaggaaaggttaaaaaaagtaaaaggaactcggca

SEQ ID NO: 10650 - DNA, 30 bp, Homo sapiens; identical to SEQ ID NO: 1459

SEQ ID NO: 10651 - DNA, 31 bp, Homo sapiens
aaggaaaggttaaaaaaagtaaaaggaactc

SEQ ID NO: 10652 - DNA, 29 bp, Homo sapiens
aggaaaggttaaaaaaagtaaaaggaact

SEQ ID NO: 10653 - DNA, 30 bp, Homo sapiens
aggaaaggttaaaaaaagtaaaaggaactc

SEQ ID NO: 10654 - DNA, 29 bp, Homo sapiens
ggaaaggttaaaaaaagtaaaaggaactc

SEQ ID NO: 10655 - DNA, 33 bp, Homo sapiens
ggaaaggttaaaaaaagtaaaaggaactcggca

SEQ ID NO: 10656 - DNA, 27 bp, Homo sapiens
gaaaggttaaaaaaagtaaaaggaact

SEQ ID NO: 10657 - DNA, 28 bp, Homo sapiens
gaaaggttaaaaaaagtaaaaggaactc

SEQ ID NO: 10658 - DNA, 32 bp, Homo sapiens; identical to SEQ ID NO: 1460

SEQ ID NO: 10659 - DNA, 26 bp, Homo sapiens
aaaggttaaaaaaagtaaaaggaact

SEQ ID NO: 10660 - DNA, 31 bp, Homo sapiens
aaaggttaaaaaaagtaaaaggaactcggca

SEQ ID NO: 10661 - DNA, 25 bp, Homo sapiens
aaggttaaaaaaagtaaaaggaact

SEQ ID NO: 10662 - DNA, 30 bp, Homo sapiens
aaggttaaaaaaagtaaaaggaactcggca

SEQ ID NO: 10663 - DNA, 29 bp, Homo sapiens
aggttaaaaaaagtaaaaggaactcggca

SEQ ID NO: 10664 - DNA, 33 bp, Homo sapiens
aggttaaaaaaagtaaaaggaactcggcaaatc

SEQ ID NO: 10665 - DNA, 32 bp, Homo sapiens
ggttaaaaaaagtaaaaggaactcggcaaatc

SEQ ID NO: 10666 - DNA, 27 bp, Homo sapiens
gttaaaaaaagtaaaaggaactcggca

SEQ ID NO: 10667 - DNA, 31 bp, Homo sapiens; identical to SEQ ID NO: 1461

SEQ ID NO: 10668 - DNA, 32 bp, Homo sapiens
gttaaaaaaagtaaaaggaactcggcaaatct

SEQ ID NO: 10669 - DNA, 26 bp, Homo sapiens
ttaaaaaaagtaaaaggaactcggca

SEQ ID NO: 10670 - DNA, 30 bp, Homo sapiens
ttaaaaaaagtaaaaggaactcggcaaatc

SEQ ID NO: 10671 - DNA, 31 bp, Homo sapiens
ttaaaaaaagtaaaaggaactcggcaaatct

SEQ ID NO: 10672 - DNA, 25 bp, Homo sapiens
taaaaaaagtaaaaggaactcggca

SEQ ID NO: 10673 - DNA, 29 bp, Homo sapiens
taaaaaaagtaaaaggaactcggcaaatc

SEQ ID NO: 10674 - DNA, 30 bp, Homo sapiens
taaaaaaagtaaaaggaactcggcaaatct

SEQ ID NO: 10675 - DNA, 24 bp, Homo sapiens
aaaaaaagtaaaaggaactcggca

SEQ ID NO: 10676 - DNA, 28 bp, Homo sapiens
aaaaaaagtaaaaggaactcggcaaatc

SEQ ID NO: 10677 - DNA, 29 bp, Homo sapiens
aaaaaaagtaaaaggaactcggcaaatct

SEQ ID NO: 10678 - DNA, 33 bp, Homo sapiens; identical to SEQ ID NO: 1466

SEQ ID NO: 10679 - DNA, 23 bp, Homo sapiens
aaaaaagtaaaaggaactcggca

SEQ ID NO: 10680 - DNA, 27 bp, Homo sapiens
aaaaaagtaaaaggaactcggcaaatc

SEQ ID NO: 10681 - DNA, 28 bp, Homo sapiens
aaaaaagtaaaaggaactcggcaaatct

SEQ ID NO: 10682 - DNA, 32 bp, Homo sapiens; identical to SEQ ID NO: 1469

SEQ ID NO: 10683 - DNA, 33 bp, Homo sapiens
aaaaaagtaaaaggaactcggcaaatcttaccc

SEQ ID NO: 10684 - DNA, 22 bp, Homo sapiens
aaaaagtaaaaggaactcggca

SEQ ID NO: 10685 - DNA, 26 bp, Homo sapiens
aaaaagtaaaaggaactcggcaaatc

SEQ ID NO: 10686 - DNA, 27 bp, Homo sapiens
aaaaagtaaaaggaactcggcaaatct

SEQ ID NO: 10687 - DNA, 31 bp, Homo sapiens; identical to SEQ ID NO: 1473

SEQ ID NO: 10688 - DNA, 32 bp, Homo sapiens
aaaaagtaaaaggaactcggcaaatcttaccc

SEQ ID NO: 10689 - DNA, 33 bp, Homo sapiens
aaaaagtaaaaggaactcggcaaatcttacccc

SEQ ID NO: 10690 - DNA, 16 bp, Homo sapiens
aaaagtaaaaggaact

SEQ ID NO: 10691 - DNA, 21 bp, Homo sapiens
aaaagtaaaaggaactcggca

SEQ ID NO: 10692 - DNA, 23 bp, Homo sapiens
aaaagtaaaaggaactcggcaaa

SEQ ID NO: 10693 - DNA, 25 bp, Homo sapiens
aaaagtaaaaggaactcggcaaatc

SEQ ID NO: 10694 - DNA, 26 bp, Homo sapiens
aaaagtaaaaggaactcggcaaatct

SEQ ID NO: 10695 - DNA, 30 bp, Homo sapiens; identical to SEQ ID NO: 1477

SEQ ID NO: 10696 - DNA, 31 bp, Homo sapiens; identical to SEQ ID NO: 1478

SEQ ID NO: 10697 - DNA, 32 bp, Homo sapiens
aaaagtaaaaggaactcggcaaatcttacccc

SEQ ID NO: 10698 - DNA, 36 bp, Homo sapiens
aaaagtaaaaggaactcggcaaatcttaccccgcct

SEQ ID NO: 10699 - DNA, 20 bp, Homo sapiens
aaagtaaaaggaactcggca

SEQ ID NO: 10700 - DNA, 24 bp, Homo sapiens
aaagtaaaaggaactcggcaaatc

SEQ ID NO: 10701 - DNA, 25 bp, Homo sapiens
aaagtaaaaggaactcggcaaatct

SEQ ID NO: 10702 - DNA, 29 bp, Homo sapiens
aaagtaaaaggaactcggcaaatcttacc

SEQ ID NO: 10703 - DNA, 30 bp, Homo sapiens; identical to SEQ ID NO: 1483

SEQ ID NO: 10704 - DNA, 31 bp, Homo sapiens
aaagtaaaaggaactcggcaaatcttacccc

SEQ ID NO: 10705 - DNA, 35 bp, Homo sapiens
aaagtaaaaggaactcggcaaatcttaccccgcct

SEQ ID NO: 10706 - DNA, 19 bp, Homo sapiens
aagtaaaaggaactcggca

SEQ ID NO: 10707 - DNA, 23 bp, Homo sapiens
aagtaaaaggaactcggcaaatc

SEQ ID NO: 10708 - DNA, 24 bp, Homo sapiens
aagtaaaaggaactcggcaaatct

SEQ ID NO: 10709 - DNA, 27 bp, Homo sapiens
aagtaaaaggaactcggcaaatcttac

SEQ ID NO: 10710 - DNA, 28 bp, Homo sapiens
aagtaaaaggaactcggcaaatcttacc

SEQ ID NO: 10711 - DNA, 29 bp, Homo sapiens
aagtaaaaggaactcggcaaatcttaccc

SEQ ID NO: 10712 - DNA, 30 bp, Homo sapiens
aagtaaaaggaactcggcaaatcttacccc

SEQ ID NO: 10713 - DNA, 34 bp, Homo sapiens
aagtaaaaggaactcggcaaatcttaccccgcct

SEQ ID NO: 10714 - DNA, 18 bp, Homo sapiens
agtaaaaggaactcggca

SEQ ID NO: 10715 - DNA, 22 bp, Homo sapiens
agtaaaaggaactcggcaaatc

SEQ ID NO: 10716 - DNA, 23 bp, Homo sapiens
agtaaaaggaactcggcaaatct

SEQ ID NO: 10717 - DNA, 27 bp, Homo sapiens
agtaaaaggaactcggcaaatcttacc

SEQ ID NO: 10718 - DNA, 28 bp, Homo sapiens
agtaaaaggaactcggcaaatcttaccc

SEQ ID NO: 10719 - DNA, 29 bp, Homo sapiens
agtaaaaggaactcggcaaatcttacccc

SEQ ID NO: 10720 - DNA, 33 bp, Homo sapiens
agtaaaaggaactcggcaaatcttaccccgcct

SEQ ID NO: 10721 - DNA, 17 bp, Homo sapiens
gtaaaaggaactcggca

SEQ ID NO: 10722 - DNA, 21 bp, Homo sapiens
gtaaaaggaactcggcaaatc

SEQ ID NO: 10723 - DNA, 22 bp, Homo sapiens
gtaaaaggaactcggcaaatct

SEQ ID NO: 10724 - DNA, 26 bp, Homo sapiens
gtaaaaggaactcggcaaatcttacc

SEQ ID NO: 10725 - DNA, 27 bp, Homo sapiens
gtaaaaggaactcggcaaatcttaccc

SEQ ID NO: 10726 - DNA, 28 bp, Homo sapiens
gtaaaaggaactcggcaaatcttacccc

SEQ ID NO: 10727 - DNA, 32 bp, Homo sapiens
gtaaaaggaactcggcaaatcttaccccgcct

SEQ ID NO: 10728 - DNA, 16 bp, Homo sapiens
taaaaggaactcggca

SEQ ID NO: 10729 - DNA, 20 bp, Homo sapiens
taaaaggaactcggcaaatc

SEQ ID NO: 10730 - DNA, 21 bp, Homo sapiens
taaaaggaactcggcaaatct

SEQ ID NO: 10731 - DNA, 25 bp, Homo sapiens
taaaaggaactcggcaaatcttacc

SEQ ID NO: 10732 - DNA, 26 bp, Homo sapiens
taaaaggaactcggcaaatcttaccc

SEQ ID NO: 10733 - DNA, 27 bp, Homo sapiens
taaaaggaactcggcaaatcttacccc

SEQ ID NO: 10734 - DNA, 30 bp, Homo sapiens
taaaaggaactcggcaaatcttaccccgcc

SEQ ID NO: 10735 - DNA, 31 bp, Homo sapiens
taaaaggaactcggcaaatcttaccccgcct

SEQ ID NO: 10736 - DNA, 19 bp, Homo sapiens
aaaaggaactcggcaaatc

SEQ ID NO: 10737 - DNA, 20 bp, Homo sapiens
aaaaggaactcggcaaatct

SEQ ID NO: 10738 - DNA, 24 bp, Homo sapiens
aaaaggaactcggcaaatcttacc

SEQ ID NO: 10739 - DNA, 25 bp, Homo sapiens
aaaaggaactcggcaaatcttaccc

SEQ ID NO: 10740 - DNA, 26 bp, Homo sapiens
aaaaggaactcggcaaatcttacccc

SEQ ID NO: 10741 - DNA, 29 bp, Homo sapiens
aaaaggaactcggcaaatcttaccccgcc

SEQ ID NO: 10742 - DNA, 30 bp, Homo sapiens
aaaaggaactcggcaaatcttaccccgcct

SEQ ID NO: 10743 - DNA, 16 bp, Homo sapiens
aaaggaactcggcaaa

SEQ ID NO: 10744 - DNA, 18 bp, Homo sapiens
aaaggaactcggcaaatc

SEQ ID NO: 10745 - DNA, 19 bp, Homo sapiens
aaaggaactcggcaaatct

SEQ ID NO: 10746 - DNA, 23 bp, Homo sapiens
aaaggaactcggcaaatcttacc

SEQ ID NO: 10747 - DNA, 24 bp, Homo sapiens
aaaggaactcggcaaatcttaccc

SEQ ID NO: 10748 - DNA, 25 bp, Homo sapiens
aaaggaactcggcaaatcttacccc

SEQ ID NO: 10749 - DNA, 26 bp, Homo sapiens
aaaggaactcggcaaatcttaccccg

SEQ ID NO: 10750 - DNA, 28 bp, Homo sapiens
aaaggaactcggcaaatcttaccccgcc

SEQ ID NO: 10751 - DNA, 29 bp, Homo sapiens
aaaggaactcggcaaatcttaccccgcct

SEQ ID NO: 10752 - DNA, 36 bp, Homo sapiens
aaaggaactcggcaaatcttaccccgcctgtttacc

SEQ ID NO: 10753 - DNA, 17 bp, Homo sapiens
aaggaactcggcaaatc

SEQ ID NO: 10754 - DNA, 18 bp, Homo sapiens
aaggaactcggcaaatct

SEQ ID NO: 10755 - DNA, 22 bp, Homo sapiens
aaggaactcggcaaatcttacc

SEQ ID NO: 10756 - DNA, 23 bp, Homo sapiens
aaggaactcggcaaatcttaccc

SEQ ID NO: 10757 - DNA, 24 bp, Homo sapiens
aaggaactcggcaaatcttacccc

SEQ ID NO: 10758 - DNA, 27 bp, Homo sapiens
aaggaactcggcaaatcttaccccgcc

SEQ ID NO: 10759 - DNA, 28 bp, Homo sapiens
aaggaactcggcaaatcttaccccgcct

SEQ ID NO: 10760 - DNA, 16 bp, Homo sapiens
aggaactcggcaaatc

SEQ ID NO: 10761 - DNA, 17 bp, Homo sapiens
aggaactcggcaaatct

SEQ ID NO: 10762 - DNA, 21 bp, Homo sapiens
aggaactcggcaaatcttacc

SEQ ID NO: 10763 - DNA, 22 bp, Homo sapiens
aggaactcggcaaatcttaccc

SEQ ID NO: 10764 - DNA, 23 bp, Homo sapiens
aggaactcggcaaatcttacccc

SEQ ID NO: 10765 - DNA, 26 bp, Homo sapiens
aggaactcggcaaatcttaccccgcc

SEQ ID NO: 10766 - DNA, 27 bp, Homo sapiens
aggaactcggcaaatcttaccccgcct

SEQ ID NO: 10767 - DNA, 27 bp, Homo sapiens
cggcaaatcttaccccgcctgtttacc

SEQ ID NO: 10768 - DNA, 18 bp, Homo sapiens
gcaaatcttaccccgcct

SEQ ID NO: 10769 - DNA, 25 bp, Homo sapiens
gcaaatcttaccccgcctgtttacc

SEQ ID NO: 10770 - DNA, 24 bp, Homo sapiens
caaatcttaccccgcctgtttacc

SEQ ID NO: 10771 - DNA, 22 bp, Homo sapiens
aatcttaccccgcctgtttacc

SEQ ID NO: 10772 - DNA, 23 bp, Homo sapiens
aatcttaccccgcctgtttacca

SEQ ID NO: 10773 - DNA, 21 bp, Homo sapiens
atcttaccccgcctgtttacc

SEQ ID NO: 10774 - DNA, 26 bp, Homo sapiens
atcttaccccgcctgtttaccaaaaa

SEQ ID NO: 10775 - DNA, 20 bp, Homo sapiens
tcttaccccgcctgtttacc

SEQ ID NO: 10776 - DNA, 19 bp, Homo sapiens
cttaccccgcctgtttacc

SEQ ID NO: 10777 - DNA, 18 bp, Homo sapiens
ttaccccgcctgtttacc

SEQ ID NO: 10778 - DNA, 19 bp, Homo sapiens
ttaccccgcctgtttacca

SEQ ID NO: 10779 - DNA, 17 bp, Homo sapiens
taccccgcctgtttacc

SEQ ID NO: 10780 - DNA, 18 bp, Homo sapiens
taccccgcctgtttacca

SEQ ID NO: 10781 - DNA, 16 bp, Homo sapiens
accccgcctgtttacc

SEQ ID NO: 10782 - DNA, 21 bp, Homo sapiens
ccgcctgtttaccaaaaacat

SEQ ID NO: 10783 - DNA, 26 bp, Homo sapiens
ccgcctgtttaccaaaaacatcacct

SEQ ID NO: 10784 - DNA, 24 bp, Homo sapiens
cgcctgtttaccaaaaacatcacc

SEQ ID NO: 10785 - DNA, 31 bp, Homo sapiens
gtttaccaaaaacatcacctctagcatcacc

SEQ ID NO: 10786 - DNA, 24 bp, Homo sapiens
aaaaacatcacctctagcatcacc

SEQ ID NO: 10787 - DNA, 25 bp, Homo sapiens
aaaaacatcacctctagcatcacca

SEQ ID NO: 10788 - DNA, 33 bp, Homo sapiens
aaaaacatcacctctagcatcaccagtattaga

SEQ ID NO: 10789 - DNA, 23 bp, Homo sapiens
aaaacatcacctctagcatcacc

SEQ ID NO: 10790 - DNA, 32 bp, Homo sapiens
aaaacatcacctctagcatcaccagtattaga

SEQ ID NO: 10791 - DNA, 22 bp, Homo sapiens
aaacatcacctctagcatcacc

SEQ ID NO: 10792 - DNA, 21 bp, Homo sapiens
aacatcacctctagcatcacc

SEQ ID NO: 10793 - DNA, 30 bp, Homo sapiens
aacatcacctctagcatcaccagtattaga

SEQ ID NO: 10794 - DNA, 20 bp, Homo sapiens
acatcacctctagcatcacc

SEQ ID NO: 10795 - DNA, 19 bp, Homo sapiens
catcacctctagcatcacc

SEQ ID NO: 10796 - DNA, 28 bp, Homo sapiens
catcacctctagcatcaccagtattaga

SEQ ID NO: 10797 - DNA, 24 bp, Homo sapiens
acctctagcatcaccagtattaga

SEQ ID NO: 10798 - DNA, 23 bp, Homo sapiens
ctagcatcaccagtattagaggc

SEQ ID NO: 10799 - DNA, 26 bp, Homo sapiens
ctagcatcaccagtattagaggcacc

SEQ ID NO: 10800 - DNA, 27 bp, Homo sapiens
ctagcatcaccagtattagaggcaccg

SEQ ID NO: 10801 - DNA, 24 bp, Homo sapiens
agcatcaccagtattagaggcacc

SEQ ID NO: 10802 - DNA, 18 bp, Homo sapiens
caccagtattagaggcac

SEQ ID NO: 10803 - DNA, 18 bp, Homo sapiens
ccagtattagaggcaccg

SEQ ID NO: 10804 - DNA, 30 bp, Homo sapiens
cagtattagaggcaccgcctgcccagtgac

SEQ ID NO: 10805 - DNA, 19 bp, Homo sapiens
agtattagaggcaccgcct

SEQ ID NO: 10806 - DNA, 29 bp, Homo sapiens
agtattagaggcaccgcctgcccagtgac

SEQ ID NO: 10807 - DNA, 36 bp, Homo sapiens
cctgcccagtgacacatgtttaacggccgcggtacc

SEQ ID NO: 10808 - DNA, 37 bp, Homo sapiens
cctgcccagtgacacatgtttaacggccgcggtaccc

SEQ ID NO: 10809 - DNA, 35 bp, Homo sapiens
ctgcccagtgacacatgtttaacggccgcggtacc

SEQ ID NO: 10810 - DNA, 36 bp, Homo sapiens
ctgcccagtgacacatgtttaacggccgcggtaccc

SEQ ID NO: 10811 - DNA, 33 bp, Homo sapiens
tgcccagtgacacatgtttaacggccgcggtac

SEQ ID NO: 10812 - DNA, 34 bp, Homo sapiens
tgcccagtgacacatgtttaacggccgcggtacc

SEQ ID NO: 10813 - DNA, 35 bp, Homo sapiens
tgcccagtgacacatgtttaacggccgcggtaccc

SEQ ID NO: 10814 - DNA, 36 bp, Homo sapiens
tgcccagtgacacatgtttaacggccgcggtaccct

SEQ ID NO: 10815 - DNA, 37 bp, Homo sapiens
tgcccagtgacacatgtttaacggccgcggtacccta

SEQ ID NO: 10816 - DNA, 33 bp, Homo sapiens; identical to SEQ ID NO: 1520

SEQ ID NO: 10817 - DNA, 34 bp, Homo sapiens
gcccagtgacacatgtttaacggccgcggtaccc

SEQ ID NO: 10818 - DNA, 24 bp, Homo sapiens
cccagtgacacatgtttaacggcc

SEQ ID NO: 10819 - DNA, 32 bp, Homo sapiens; identical to SEQ ID NO: 1521

SEQ ID NO: 10820 - DNA, 33 bp, Homo sapiens; identical to SEQ ID NO: 1522

SEQ ID NO: 10821 - DNA, 35 bp, Homo sapiens
cccagtgacacatgtttaacggccgcggtacccta

SEQ ID NO: 10822 - DNA, 18 bp, Homo sapiens
cagtgacacatgtttaac

SEQ ID NO: 10823 - DNA, 19 bp, Homo sapiens
cagtgacacatgtttaacg

SEQ ID NO: 10824 - DNA, 21 bp, Homo sapiens
cagtgacacatgtttaacggc

SEQ ID NO: 10825 - DNA, 22 bp, Homo sapiens
cagtgacacatgtttaacggcc

SEQ ID NO: 10826 - DNA, 24 bp, Homo sapiens
cagtgacacatgtttaacggccgc

SEQ ID NO: 10827 - DNA, 28 bp, Homo sapiens
cagtgacacatgtttaacggccgcggta

SEQ ID NO: 10828 - DNA, 29 bp, Homo sapiens
cagtgacacatgtttaacggccgcggtac

SEQ ID NO: 10829 - DNA, 30 bp, Homo sapiens; identical to SEQ ID NO: 1525

SEQ ID NO: 10830 - DNA, 31 bp, Homo sapiens; identical to SEQ ID NO: 1526

SEQ ID NO: 10831 - DNA, 32 bp, Homo sapiens; identical to SEQ ID NO: 1527

SEQ ID NO: 10832 - DNA, 33 bp, Homo sapiens; identical to SEQ ID NO: 1528

SEQ ID NO: 10833 - DNA, 36 bp, Homo sapiens
cagtgacacatgtttaacggccgcggtaccctaacc

SEQ ID NO: 10834 - DNA, 17 bp, Homo sapiens
agtgacacatgtttaac

SEQ ID NO: 10835 - DNA, 18 bp, Homo sapiens
agtgacacatgtttaacg

SEQ ID NO: 10836 - DNA, 20 bp, Homo sapiens
agtgacacatgtttaacggc

SEQ ID NO: 10837 - DNA, 21 bp, Homo sapiens
agtgacacatgtttaacggcc

SEQ ID NO: 10838 - DNA, 22 bp, Homo sapiens
agtgacacatgtttaacggccg

SEQ ID NO: 10839 - DNA, 28 bp, Homo sapiens
agtgacacatgtttaacggccgcggtac

SEQ ID NO: 10840 - DNA, 29 bp, Homo sapiens
agtgacacatgtttaacggccgcggtacc

SEQ ID NO: 10841 - DNA, 30 bp, Homo sapiens; identical to SEQ ID NO: 1532

SEQ ID NO: 10842 - DNA, 31 bp, Homo sapiens; identical to SEQ ID NO: 1533

SEQ ID NO: 10843 - DNA, 32 bp, Homo sapiens; identical to SEQ ID NO: 1534

SEQ ID NO: 10844 - DNA, 35 bp, Homo sapiens
agtgacacatgtttaacggccgcggtaccctaacc

SEQ ID NO: 10845 - DNA, 20 bp, Homo sapiens
gtgacacatgtttaacggcc

SEQ ID NO: 10846 - DNA, 27 bp, Homo sapiens
gtgacacatgtttaacggccgcggtac

SEQ ID NO: 10847 - DNA, 28 bp, Homo sapiens
gtgacacatgtttaacggccgcggtacc

SEQ ID NO: 10848 - DNA, 29 bp, Homo sapiens
gtgacacatgtttaacggccgcggtaccc

SEQ ID NO: 10849 - DNA, 30 bp, Homo sapiens; identical to SEQ ID NO: 1537

SEQ ID NO: 10850 - DNA, 31 bp, Homo sapiens; identical to SEQ ID NO: 1538

SEQ ID NO: 10851 - DNA, 19 bp, Homo sapiens
tgacacatgtttaacggcc

SEQ ID NO: 10852 - DNA, 26 bp, Homo sapiens
tgacacatgtttaacggccgcggtac

SEQ ID NO: 10853 - DNA, 27 bp, Homo sapiens
tgacacatgtttaacggccgcggtacc

SEQ ID NO: 10854 - DNA, 28 bp, Homo sapiens
tgacacatgtttaacggccgcggtaccc

SEQ ID NO: 10855 - DNA, 29 bp, Homo sapiens
tgacacatgtttaacggccgcggtaccct

SEQ ID NO: 10856 - DNA, 30 bp, Homo sapiens; identical to SEQ ID NO: 1543

SEQ ID NO: 10857 - DNA, 33 bp, Homo sapiens
tgacacatgtttaacggccgcggtaccctaacc

SEQ ID NO: 10858 - DNA, 18 bp, Homo sapiens
gacacatgtttaacggcc

SEQ ID NO: 10859 - DNA, 25 bp, Homo sapiens
gacacatgtttaacggccgcggtac

SEQ ID NO: 10860 - DNA, 26 bp, Homo sapiens
gacacatgtttaacggccgcggtacc

SEQ ID NO: 10861 - DNA, 27 bp, Homo sapiens
gacacatgtttaacggccgcggtaccc

SEQ ID NO: 10862 - DNA, 28 bp, Homo sapiens
gacacatgtttaacggccgcggtaccct

SEQ ID NO: 10863 - DNA, 29 bp, Homo sapiens
gacacatgtttaacggccgcggtacccta

SEQ ID NO: 10864 - DNA, 17 bp, Homo sapiens
acacatgtttaacggcc

SEQ ID NO: 10865 - DNA, 18 bp, Homo sapiens
acacatgtttaacggccg

SEQ ID NO: 10866 - DNA, 20 bp, Homo sapiens
acacatgtttaacggccgcg

SEQ ID NO: 10867 - DNA, 24 bp, Homo sapiens
acacatgtttaacggccgcggtac

SEQ ID NO: 10868 - DNA, 25 bp, Homo sapiens
acacatgtttaacggccgcggtacc

SEQ ID NO: 10869 - DNA, 26 bp, Homo sapiens
acacatgtttaacggccgcggtaccc

SEQ ID NO: 10870 - DNA, 27 bp, Homo sapiens
acacatgtttaacggccgcggtaccct

SEQ ID NO: 10871 - DNA, 28 bp, Homo sapiens
acacatgtttaacggccgcggtacccta

SEQ ID NO: 10872 - DNA, 31 bp, Homo sapiens; identical to SEQ ID NO: 1554

SEQ ID NO: 10873 - DNA, 32 bp, Homo sapiens
acacatgtttaacggccgcggtaccctaaccg

SEQ ID NO: 10874 - DNA, 16 bp, Homo sapiens
cacatgtttaacggcc

SEQ ID NO: 10875 - DNA, 19 bp, Homo sapiens
cacatgtttaacggccgcg

SEQ ID NO: 10876 - DNA, 23 bp, Homo sapiens
cacatgtttaacggccgcggtac

SEQ ID NO: 10877 - DNA, 24 bp, Homo sapiens
cacatgtttaacggccgcggtacc

SEQ ID NO: 10878 - DNA, 25 bp, Homo sapiens
cacatgtttaacggccgcggtaccc

SEQ ID NO: 10879 - DNA, 26 bp, Homo sapiens
cacatgtttaacggccgcggtaccct

SEQ ID NO: 10880 - DNA, 27 bp, Homo sapiens
cacatgtttaacggccgcggtacccta

SEQ ID NO: 10881 - DNA, 30 bp, Homo sapiens; identical to SEQ ID NO: 1561

SEQ ID NO: 10882 - DNA, 18 bp, Homo sapiens
acatgtttaacggccgcg

SEQ ID NO: 10883 - DNA, 22 bp, Homo sapiens
acatgtttaacggccgcggtac

SEQ ID NO: 10884 - DNA, 23 bp, Homo sapiens
acatgtttaacggccgcggtacc

SEQ ID NO: 10885 - DNA, 24 bp, Homo sapiens
acatgtttaacggccgcggtaccc

SEQ ID NO: 10886 - DNA, 25 bp, Homo sapiens
acatgtttaacggccgcggtaccct

SEQ ID NO: 10887 - DNA, 26 bp, Homo sapiens
acatgtttaacggccgcggtacccta

SEQ ID NO: 10888 - DNA, 17 bp, Homo sapiens
catgtttaacggccgcg

SEQ ID NO: 10889 - DNA, 21 bp, Homo sapiens
catgtttaacggccgcggtac

SEQ ID NO: 10890 - DNA, 22 bp, Homo sapiens
catgtttaacggccgcggtacc

SEQ ID NO: 10891 - DNA, 23 bp, Homo sapiens
catgtttaacggccgcggtaccc

SEQ ID NO: 10892 - DNA, 24 bp, Homo sapiens
catgtttaacggccgcggtaccct

SEQ ID NO: 10893 - DNA, 25 bp, Homo sapiens
catgtttaacggccgcggtacccta

SEQ ID NO: 10894 - DNA, 28 bp, Homo sapiens
catgtttaacggccgcggtaccctaacc

SEQ ID NO: 10895 - DNA, 20 bp, Homo sapiens
atgtttaacggccgcggtac

SEQ ID NO: 10896 - DNA, 21 bp, Homo sapiens
atgtttaacggccgcggtacc

SEQ ID NO: 10897 - DNA, 22 bp, Homo sapiens
atgtttaacggccgcggtaccc

SEQ ID NO: 10898 - DNA, 23 bp, Homo sapiens
atgtttaacggccgcggtaccct

SEQ ID NO: 10899 - DNA, 24 bp, Homo sapiens
atgtttaacggccgcggtacccta

SEQ ID NO: 10900 - DNA, 19 bp, Homo sapiens
tgtttaacggccgcggtac

SEQ ID NO: 10901 - DNA, 20 bp, Homo sapiens
tgtttaacggccgcggtacc

SEQ ID NO: 10902 - DNA, 21 bp, Homo sapiens
tgtttaacggccgcggtaccc

SEQ ID NO: 10903 - DNA, 22 bp, Homo sapiens
tgtttaacggccgcggtaccct

SEQ ID NO: 10904 - DNA, 23 bp, Homo sapiens
tgtttaacggccgcggtacccta

SEQ ID NO: 10905 - DNA, 18 bp, Homo sapiens
gtttaacggccgcggtac

SEQ ID NO: 10906 - DNA, 19 bp, Homo sapiens
gtttaacggccgcggtacc

SEQ ID NO: 10907 - DNA, 20 bp, Homo sapiens
gtttaacggccgcggtaccc

SEQ ID NO: 10908 - DNA, 21 bp, Homo sapiens
gtttaacggccgcggtaccct

SEQ ID NO: 10909 - DNA, 22 bp, Homo sapiens
gtttaacggccgcggtacccta

SEQ ID NO: 10910 - DNA, 17 bp, Homo sapiens
tttaacggccgcggtac

SEQ ID NO: 10911 - DNA, 18 bp, Homo sapiens
tttaacggccgcggtacc

SEQ ID NO: 10912 - DNA, 19 bp, Homo sapiens
tttaacggccgcggtaccc

SEQ ID NO: 10913 - DNA, 20 bp, Homo sapiens
tttaacggccgcggtaccct

SEQ ID NO: 10914 - DNA, 21 bp, Homo sapiens
tttaacggccgcggtacccta

SEQ ID NO: 10915 - DNA, 16 bp, Homo sapiens
ttaacggccgcggtac

SEQ ID NO: 10916 - DNA, 17 bp, Homo sapiens
ttaacggccgcggtacc

SEQ ID NO: 10917 - DNA, 18 bp, Homo sapiens
ttaacggccgcggtaccc

SEQ ID NO: 10918 - DNA, 19 bp, Homo sapiens
ttaacggccgcggtaccct

SEQ ID NO: 10919 - DNA, 20 bp, Homo sapiens
ttaacggccgcggtacccta

SEQ ID NO: 10920 - DNA, 16 bp, Homo sapiens
taacggccgcggtacc

SEQ ID NO: 10921 - DNA, 17 bp, Homo sapiens
taacggccgcggtaccc

SEQ ID NO: 10922 - DNA, 18 bp, Homo sapiens
taacggccgcggtaccct

SEQ ID NO: 10923 - DNA, 19 bp, Homo sapiens
taacggccgcggtacccta

SEQ ID NO: 10924 - DNA, 22 bp, Homo sapiens
taacggccgcggtaccctaacc

SEQ ID NO: 10925 - DNA, 16 bp, Homo sapiens
aacggccgcggtaccc

SEQ ID NO: 10926 - DNA, 17 bp, Homo sapiens
aacggccgcggtaccct

SEQ ID NO: 10927 - DNA, 18 bp, Homo sapiens
aacggccgcggtacccta

SEQ ID NO: 10928 - DNA, 21 bp, Homo sapiens
aacggccgcggtaccctaacc

SEQ ID NO: 10929 - DNA, 16 bp, Homo sapiens
acggccgcggtaccct

SEQ ID NO: 10930 - DNA, 17 bp, Homo sapiens
acggccgcggtacccta

SEQ ID NO: 10931 - DNA, 32 bp, Homo sapiens
taaccgtgcaaaggtagcataatcacttgttc

SEQ ID NO: 10932 - DNA, 42 bp, Homo sapiens
ttaaatagggacctgtatgaatggctccacgagggttcagct

SEQ ID NO: 10933 - DNA, 21 bp, Homo sapiens
taaatagggacctgtatgaat

SEQ ID NO: 10934 - DNA, 41 bp, Homo sapiens
taaatagggacctgtatgaatggctccacgagggttcagct

SEQ ID NO: 10935 - DNA, 40 bp, Homo sapiens
aaatagggacctgtatgaatggctccacgagggttcagct

SEQ ID NO: 10936 - DNA, 17 bp, Homo sapiens
aatagggacctgtatga

SEQ ID NO: 10937 - DNA, 19 bp, Homo sapiens
aatagggacctgtatgaat

SEQ ID NO: 10938 - DNA, 39 bp, Homo sapiens
aatagggacctgtatgaatggctccacgagggttcagct

SEQ ID NO: 10939 - DNA, 38 bp, Homo sapiens
atagggacctgtatgaatggctccacgagggttcagct

SEQ ID NO: 10940 - DNA, 16 bp, Homo sapiens
tagggacctgtatgaa

SEQ ID NO: 10941 - DNA, 17 bp, Homo sapiens
tagggacctgtatgaat

SEQ ID NO: 10942 - DNA, 32 bp, Homo sapiens
tagggacctgtatgaatggctccacgagggtt

SEQ ID NO: 10943 - DNA, 37 bp, Homo sapiens
tagggacctgtatgaatggctccacgagggttcagct

SEQ ID NO: 10944 - DNA, 16 bp, Homo sapiens
agggacctgtatgaat

SEQ ID NO: 10945 - DNA, 17 bp, Homo sapiens
agggacctgtatgaatg

SEQ ID NO: 10946 - DNA, 19 bp, Homo sapiens
agggacctgtatgaatggc

SEQ ID NO: 10947 - DNA, 20 bp, Homo sapiens
agggacctgtatgaatggct

SEQ ID NO: 10948 - DNA, 21 bp, Homo sapiens
agggacctgtatgaatggctc

SEQ ID NO: 10949 - DNA, 22 bp, Homo sapiens
agggacctgtatgaatggctcc

SEQ ID NO: 10950 - DNA, 28 bp, Homo sapiens
agggacctgtatgaatggctccacgagg

SEQ ID NO: 10951 - DNA, 30 bp, Homo sapiens
agggacctgtatgaatggctccacgagggt

SEQ ID NO: 10952 - DNA, 31 bp, Homo sapiens; identical to SEQ ID NO: 1592

SEQ ID NO: 10953 - DNA, 32 bp, Homo sapiens; identical to SEQ ID NO: 1593

SEQ ID NO: 10954 - DNA, 33 bp, Homo sapiens; identical to SEQ ID NO: 1594

SEQ ID NO: 10955 - DNA, 35 bp, Homo sapiens
agggacctgtatgaatggctccacgagggttcagc

SEQ ID NO: 10956 - DNA, 36 bp, Homo sapiens
agggacctgtatgaatggctccacgagggttcagct

SEQ ID NO: 10957 - DNA, 40 bp, Homo sapiens
agggacctgtatgaatggctccacgagggttcagctgtct

SEQ ID NO: 10958 - DNA, 16 bp, Homo sapiens
gggacctgtatgaatg

SEQ ID NO: 10959 - DNA, 18 bp, Homo sapiens
gggacctgtatgaatggc

SEQ ID NO: 10960 - DNA, 19 bp, Homo sapiens
gggacctgtatgaatggct

SEQ ID NO: 10961 - DNA, 20 bp, Homo sapiens
gggacctgtatgaatggctc

SEQ ID NO: 10962 - DNA, 21 bp, Homo sapiens
gggacctgtatgaatggctcc

SEQ ID NO: 10963 - DNA, 28 bp, Homo sapiens
gggacctgtatgaatggctccacgaggg

SEQ ID NO: 10964 - DNA, 30 bp, Homo sapiens; identical to SEQ ID NO: 1598

SEQ ID NO: 10965 - DNA, 31 bp, Homo sapiens; identical to SEQ ID NO: 1599

SEQ ID NO: 10966 - DNA, 32 bp, Homo sapiens; identical to SEQ ID NO: 1600

SEQ ID NO: 10967 - DNA, 33 bp, Homo sapiens
gggacctgtatgaatggctccacgagggttcag

SEQ ID NO: 10968 - DNA, 34 bp, Homo sapiens
gggacctgtatgaatggctccacgagggttcagc

SEQ ID NO: 10969 - DNA, 35 bp, Homo sapiens
gggacctgtatgaatggctccacgagggttcagct

SEQ ID NO: 10970 - DNA, 39 bp, Homo sapiens
gggacctgtatgaatggctccacgagggttcagctgtct

SEQ ID NO: 10971 - DNA, 19 bp, Homo sapiens
gacctgtatgaatggctcc

SEQ ID NO: 10972 - DNA, 28 bp, Homo sapiens
gacctgtatgaatggctccacgagggtt

SEQ ID NO: 10973 - DNA, 30 bp, Homo sapiens
gacctgtatgaatggctccacgagggttca

SEQ ID NO: 10974 - DNA, 32 bp, Homo sapiens
gacctgtatgaatggctccacgagggttcagc

SEQ ID NO: 10975 - DNA, 33 bp, Homo sapiens; identical to SEQ ID NO: 1601

SEQ ID NO: 10976 - DNA, 32 bp, Homo sapiens
acctgtatgaatggctccacgagggttcagct

SEQ ID NO: 10977 - DNA, 26 bp, Homo sapiens
ccacgagggttcagctgtctcttact

SEQ ID NO: 10978 - DNA, 32 bp, Homo sapiens
cacgagggttcagctgtctcttacttttaacc

SEQ ID NO: 10979 - DNA, 33 bp, Homo sapiens
cacgagggttcagctgtctcttacttttaacca

SEQ ID NO: 10980 - DNA, 31 bp, Homo sapiens
acgagggttcagctgtctcttacttttaacc

SEQ ID NO: 10981 - DNA, 23 bp, Homo sapiens
cgagggttcagctgtctcttact

SEQ ID NO: 10982 - DNA, 30 bp, Homo sapiens
cgagggttcagctgtctcttacttttaacc

SEQ ID NO: 10983 - DNA, 21 bp, Homo sapiens
agggttcagctgtctcttact

SEQ ID NO: 10984 - DNA, 28 bp, Homo sapiens
agggttcagctgtctcttacttttaacc

SEQ ID NO: 10985 - DNA, 16 bp, Homo sapiens
ggttcagctgtctctt

SEQ ID NO: 10986 - DNA, 26 bp, Homo sapiens
ggttcagctgtctcttacttttaacc

SEQ ID NO: 10987 - DNA, 25 bp, Homo sapiens
gttcagctgtctcttacttttaacc

SEQ ID NO: 10988 - DNA, 22 bp, Homo sapiens
cagctgtctcttacttttaacc

SEQ ID NO: 10989 - DNA, 21 bp, Homo sapiens
agctgtctcttacttttaacc

SEQ ID NO: 10990 - DNA, 20 bp, Homo sapiens
gctgtctcttacttttaacc

SEQ ID NO: 10991 - DNA, 33 bp, Homo sapiens
gctgtctcttacttttaaccagtgaaattgacc

SEQ ID NO: 10992 - DNA, 25 bp, Homo sapiens
ccagtgaaattgacctgcccgtgaa

SEQ ID NO: 10993 - DNA, 18 bp, Homo sapiens
agtgaaattgacctgccc

SEQ ID NO: 10994 - DNA, 22 bp, Homo sapiens
agtgaaattgacctgcccgtga

SEQ ID NO: 10995 - DNA, 23 bp, Homo sapiens
agtgaaattgacctgcccgtgaa

SEQ ID NO: 10996 - DNA, 26 bp, Homo sapiens
agtgaaattgacctgcccgtgaagag

SEQ ID NO: 10997 - DNA, 27 bp, Homo sapiens
agtgaaattgacctgcccgtgaagagg

SEQ ID NO: 10998 - DNA, 29 bp, Homo sapiens
agtgaaattgacctgcccgtgaagaggcg

SEQ ID NO: 10999 - DNA, 30 bp, Homo sapiens
agtgaaattgacctgcccgtgaagaggcgg

SEQ ID NO: 11000 - DNA, 16 bp, Homo sapiens
ccgtgaagaggcgggc

SEQ ID NO: 11001 - DNA, 16 bp, Homo sapiens
cgtgaagaggcgggca

SEQ ID NO: 11002 - DNA, 18 bp, Homo sapiens
cgtgaagaggcgggcata

SEQ ID NO: 11003 - DNA, 17 bp, Homo sapiens
gtgaagaggcgggcata

SEQ ID NO: 11004 - DNA, 16 bp, Homo sapiens
tgaagaggcgggcata

SEQ ID NO: 11005 - DNA, 33 bp, Homo sapiens
gcgggcataacacagcaagacgagaagacccta

SEQ ID NO: 11006 - DNA, 32 bp, Homo sapiens
cgggcataacacagcaagacgagaagacccta

SEQ ID NO: 11007 - DNA, 33 bp, Homo sapiens
taacacagcaagacgagaagaccctatggagct

SEQ ID NO: 11008 - DNA, 32 bp, Homo sapiens
aacacagcaagacgagaagaccctatggagct

SEQ ID NO: 11009 - DNA, 33 bp, Homo sapiens
aacacagcaagacgagaagaccctatggagctt

SEQ ID NO: 11010 - DNA, 31 bp, Homo sapiens
acacagcaagacgagaagaccctatggagct

SEQ ID NO: 11011 - DNA, 32 bp, Homo sapiens
acacagcaagacgagaagaccctatggagctt

SEQ ID NO: 11012 - DNA, 30 bp, Homo sapiens
cacagcaagacgagaagaccctatggagct

SEQ ID NO: 11013 - DNA, 31 bp, Homo sapiens
cacagcaagacgagaagaccctatggagctt

SEQ ID NO: 11014 - DNA, 29 bp, Homo sapiens
acagcaagacgagaagaccctatggagct

SEQ ID NO: 11015 - DNA, 30 bp, Homo sapiens
acagcaagacgagaagaccctatggagctt

SEQ ID NO: 11016 - DNA, 18 bp, Homo sapiens
cagcaagacgagaagacc

SEQ ID NO: 11017 - DNA, 19 bp, Homo sapiens
cagcaagacgagaagaccc

SEQ ID NO: 11018 - DNA, 20 bp, Homo sapiens
cagcaagacgagaagaccct

SEQ ID NO: 11019 - DNA, 22 bp, Homo sapiens
cagcaagacgagaagaccctat

SEQ ID NO: 11020 - DNA, 24 bp, Homo sapiens
cagcaagacgagaagaccctatgg

SEQ ID NO: 11021 - DNA, 25 bp, Homo sapiens
cagcaagacgagaagaccctatgga

SEQ ID NO: 11022 - DNA, 27 bp, Homo sapiens
cagcaagacgagaagaccctatggagc

SEQ ID NO: 11023 - DNA, 28 bp, Homo sapiens
cagcaagacgagaagaccctatggagct

SEQ ID NO: 11024 - DNA, 29 bp, Homo sapiens
cagcaagacgagaagaccctatggagctt

SEQ ID NO: 11025 - DNA, 30 bp, Homo sapiens
cagcaagacgagaagaccctatggagcttt

SEQ ID NO: 11026 - DNA, 31 bp, Homo sapiens
cagcaagacgagaagaccctatggagcttta

SEQ ID NO: 11027 - DNA, 32 bp, Homo sapiens
cagcaagacgagaagaccctatggagctttaa

SEQ ID NO: 11028 - DNA, 33 bp, Homo sapiens
cagcaagacgagaagaccctatggagctttaat

SEQ ID NO: 11029 - DNA, 27 bp, Homo sapiens
agcaagacgagaagaccctatggagct

SEQ ID NO: 11030 - DNA, 28 bp, Homo sapiens
agcaagacgagaagaccctatggagctt

SEQ ID NO: 11031 - DNA, 29 bp, Homo sapiens
agcaagacgagaagaccctatggagcttt

SEQ ID NO: 11032 - DNA, 30 bp, Homo sapiens
agcaagacgagaagaccctatggagcttta

SEQ ID NO: 11033 - DNA, 23 bp, Homo sapiens
gcaagacgagaagaccctatgga

SEQ ID NO: 11034 - DNA, 24 bp, Homo sapiens
gcaagacgagaagaccctatggag

SEQ ID NO: 11035 - DNA, 26 bp, Homo sapiens
gcaagacgagaagaccctatggagct

SEQ ID NO: 11036 - DNA, 27 bp, Homo sapiens
gcaagacgagaagaccctatggagctt

SEQ ID NO: 11037 - DNA, 28 bp, Homo sapiens
gcaagacgagaagaccctatggagcttt

SEQ ID NO: 11038 - DNA, 29 bp, Homo sapiens
gcaagacgagaagaccctatggagcttta

SEQ ID NO: 11039 - DNA, 30 bp, Homo sapiens
gcaagacgagaagaccctatggagctttaa

SEQ ID NO: 11040 - DNA, 31 bp, Homo sapiens
gcaagacgagaagaccctatggagctttaat

SEQ ID NO: 11041 - DNA, 32 bp, Homo sapiens
gcaagacgagaagaccctatggagctttaatt

SEQ ID NO: 11042 - DNA, 33 bp, Homo sapiens
gcaagacgagaagaccctatggagctttaattt

SEQ ID NO: 11043 - DNA, 25 bp, Homo sapiens
caagacgagaagaccctatggagct

SEQ ID NO: 11044 - DNA, 26 bp, Homo sapiens
caagacgagaagaccctatggagctt

SEQ ID NO: 11045 - DNA, 24 bp, Homo sapiens
aagacgagaagaccctatggagct

SEQ ID NO: 11046 - DNA, 25 bp, Homo sapiens
aagacgagaagaccctatggagctt

SEQ ID NO: 11047 - DNA, 23 bp, Homo sapiens
agacgagaagaccctatggagct

SEQ ID NO: 11048 - DNA, 24 bp, Homo sapiens
agacgagaagaccctatggagctt

SEQ ID NO: 11049 - DNA, 25 bp, Homo sapiens
agacgagaagaccctatggagcttt

SEQ ID NO: 11050 - DNA, 23 bp, Homo sapiens
gacgagaagaccctatggagctt

SEQ ID NO: 11051 - DNA, 22 bp, Homo sapiens
acgagaagaccctatggagctt

SEQ ID NO: 11052 - DNA, 20 bp, Homo sapiens
cgagaagaccctatggagct

SEQ ID NO: 11053 - DNA, 21 bp, Homo sapiens
cgagaagaccctatggagctt

SEQ ID NO: 11054 - DNA, 25 bp, Homo sapiens
cgagaagaccctatggagctttaat

SEQ ID NO: 11055 - DNA, 19 bp, Homo sapiens
gagaagaccctatggagct

SEQ ID NO: 11056 - DNA, 20 bp, Homo sapiens
gagaagaccctatggagctt

SEQ ID NO: 11057 - DNA, 33 bp, Homo sapiens
gagaagaccctatggagctttaatttattaatg

SEQ ID NO: 11058 - DNA, 18 bp, Homo sapiens
agaagaccctatggagct

SEQ ID NO: 11059 - DNA, 19 bp, Homo sapiens
agaagaccctatggagctt

SEQ ID NO: 11060 - DNA, 21 bp, Homo sapiens
agaagaccctatggagcttta

SEQ ID NO: 11061 - DNA, 17 bp, Homo sapiens
gaagaccctatggagct

SEQ ID NO: 11062 - DNA, 18 bp, Homo sapiens
gaagaccctatggagctt

SEQ ID NO: 11063 - DNA, 16 bp, Homo sapiens
aagaccctatggagct

SEQ ID NO: 11064 - DNA, 17 bp, Homo sapiens
aagaccctatggagctt

SEQ ID NO: 11065 - DNA, 18 bp, Homo sapiens
aagaccctatggagcttt

SEQ ID NO: 11066 - DNA, 16 bp, Homo sapiens
agaccctatggagctt

SEQ ID NO: 11067 - DNA, 17 bp, Homo sapiens
agaccctatggagcttt

SEQ ID NO: 11068 - DNA, 33 bp, Homo sapiens
taatttattaatgcaaacagtacctaacaaacc

SEQ ID NO: 11069 - DNA, 32 bp, Homo sapiens; identical to SEQ ID NO: 1619

SEQ ID NO: 11070 - DNA, 31 bp, Homo sapiens
atttattaatgcaaacagtacctaacaaacc

SEQ ID NO: 11071 - DNA, 30 bp, Homo sapiens
tttattaatgcaaacagtacctaacaaacc

SEQ ID NO: 11072 - DNA, 29 bp, Homo sapiens
ttattaatgcaaacagtacctaacaaacc

SEQ ID NO: 11073 - DNA, 28 bp, Homo sapiens
tattaatgcaaacagtacctaacaaacc

SEQ ID NO: 11074 - DNA, 27 bp, Homo sapiens
attaatgcaaacagtacctaacaaacc

SEQ ID NO: 11075 - DNA, 20 bp, Homo sapiens
caaacagtacctaacaaacc

SEQ ID NO: 11076 - DNA, 19 bp, Homo sapiens
aaacagtacctaacaaacc

SEQ ID NO: 11077 - DNA, 18 bp, Homo sapiens
aacagtacctaacaaacc

SEQ ID NO: 11078 - DNA, 32 bp, Homo sapiens
gtacctaacaaacccacaggtcctaaactacc

SEQ ID NO: 11079 - DNA, 31 bp, Homo sapiens
tacctaacaaacccacaggtcctaaactacc

SEQ ID NO: 11080 - DNA, 29 bp, Homo sapiens
cctaacaaacccacaggtcctaaactacc

SEQ ID NO: 11081 - DNA, 25 bp, Homo sapiens
ctaacaaacccacaggtcctaaact

SEQ ID NO: 11082 - DNA, 28 bp, Homo sapiens
ctaacaaacccacaggtcctaaactacc

SEQ ID NO: 11083 - DNA, 24 bp, Homo sapiens
taacaaacccacaggtcctaaact

SEQ ID NO: 11084 - DNA, 27 bp, Homo sapiens
taacaaacccacaggtcctaaactacc

SEQ ID NO: 11085 - DNA, 19 bp, Homo sapiens
aacccacaggtcctaaact

SEQ ID NO: 11086 - DNA, 20 bp, Homo sapiens
cccacaggtcctaaactacc

SEQ ID NO: 11087 - DNA, 16 bp, Homo sapiens
ccacaggtcctaaact

SEQ ID NO: 11088 - DNA, 17 bp, Homo sapiens
ccacaggtcctaaacta

SEQ ID NO: 11089 - DNA, 18 bp, Homo sapiens
ccacaggtcctaaactac

SEQ ID NO: 11090 - DNA, 16 bp, Homo sapiens
cacaggtcctaaacta

SEQ ID NO: 11091 - DNA, 17 bp, Homo sapiens
cacaggtcctaaactac

SEQ ID NO: 11092 - DNA, 18 bp, Homo sapiens
cacaggtcctaaactacc

SEQ ID NO: 11093 - DNA, 19 bp, Homo sapiens
cacaggtcctaaactacca

SEQ ID NO: 11094 - DNA, 24 bp, Homo sapiens
cacaggtcctaaactaccaaacct

SEQ ID NO: 11095 - DNA, 16 bp, Homo sapiens
acaggtcctaaactac

SEQ ID NO: 11096 - DNA, 16 bp, Homo sapiens
caggtcctaaactacc

SEQ ID NO: 11097 - DNA, 23 bp, Homo sapiens
caggtcctaaactaccaaacctg

SEQ ID NO: 11098 - DNA, 33 bp, Homo sapiens
ctaaactaccaaacctgcattaaaaatttcggt

SEQ ID NO: 11099 - DNA, 27 bp, Homo sapiens
taccaaacctgcattaaaaatttcggt

SEQ ID NO: 11100 - DNA, 29 bp, Homo sapiens
aaacctgcattaaaaatttcggttggggc

SEQ ID NO: 11101 - DNA, 30 bp, Homo sapiens
aaacctgcattaaaaatttcggttggggcg

SEQ ID NO: 11102 - DNA, 32 bp, Homo sapiens; identical to SEQ ID NO: 1626

SEQ ID NO: 11103 - DNA, 33 bp, Homo sapiens
aaacctgcattaaaaatttcggttggggcgacc

SEQ ID NO: 11104 - DNA, 40 bp, Homo sapiens
aaacctgcattaaaaatttcggttggggcgacctcggagc

SEQ ID NO: 11105 - DNA, 42 bp, Homo sapiens
aaacctgcattaaaaatttcggttggggcgacctcggagcag

SEQ ID NO: 11106 - DNA, 46 bp, Homo sapiens
aaacctgcattaaaaatttcggttggggcgacctcggagcagaacc

SEQ ID NO: 11107 - DNA, 47 bp, Homo sapiens
aaacctgcattaaaaatttcggttggggcgacctcggagcagaaccc

SEQ ID NO: 11108 - DNA, 28 bp, Homo sapiens
aacctgcattaaaaatttcggttggggc

SEQ ID NO: 11109 - DNA, 31 bp, Homo sapiens
aacctgcattaaaaatttcggttggggcgac

SEQ ID NO: 11110 - DNA, 39 bp, Homo sapiens
aacctgcattaaaaatttcggttggggcgacctcggagc

SEQ ID NO: 11111 - DNA, 45 bp, Homo sapiens
aacctgcattaaaaatttcggttggggcgacctcggagcagaacc

SEQ ID NO: 11112 - DNA, 44 bp, Homo sapiens
acctgcattaaaaatttcggttggggcgacctcggagcagaacc

SEQ ID NO: 11113 - DNA, 29 bp, Homo sapiens
ctgcattaaaaatttcggttggggcgacc

SEQ ID NO: 11114 - DNA, 42 bp, Homo sapiens
ctgcattaaaaatttcggttggggcgacctcggagcagaacc

SEQ ID NO: 11115 - DNA, 24 bp, Homo sapiens
tgcattaaaaatttcggttggggc

SEQ ID NO: 11116 - DNA, 25 bp, Homo sapiens
tgcattaaaaatttcggttggggcg

SEQ ID NO: 11117 - DNA, 27 bp, Homo sapiens
tgcattaaaaatttcggttggggcgac

SEQ ID NO: 11118 - DNA, 28 bp, Homo sapiens
tgcattaaaaatttcggttggggcgacc

SEQ ID NO: 11119 - DNA, 29 bp, Homo sapiens
tgcattaaaaatttcggttggggcgacct

SEQ ID NO: 11120 - DNA, 30 bp, Homo sapiens
tgcattaaaaatttcggttggggcgacctc

SEQ ID NO: 11121 - DNA, 41 bp, Homo sapiens
tgcattaaaaatttcggttggggcgacctcggagcagaacc

SEQ ID NO: 11122 - DNA, 42 bp, Homo sapiens
tgcattaaaaatttcggttggggcgacctcggagcagaaccc

SEQ ID NO: 11123 - DNA, 27 bp, Homo sapiens
gcattaaaaatttcggttggggcgacc

SEQ ID NO: 11124 - DNA, 40 bp, Homo sapiens
gcattaaaaatttcggttggggcgacctcggagcagaacc

SEQ ID NO: 11125 - DNA, 41 bp, Homo sapiens
gcattaaaaatttcggttggggcgacctcggagcagaaccc

SEQ ID NO: 11126 - DNA, 26 bp, Homo sapiens
cattaaaaatttcggttggggcgacc

SEQ ID NO: 11127 - DNA, 39 bp, Homo sapiens
cattaaaaatttcggttggggcgacctcggagcagaacc

SEQ ID NO: 11128 - DNA, 21 bp, Homo sapiens
attaaaaatttcggttggggc

SEQ ID NO: 11129 - DNA, 38 bp, Homo sapiens
attaaaaatttcggttggggcgacctcggagcagaacc

SEQ ID NO: 11130 - DNA, 23 bp, Homo sapiens
ttaaaaatttcggttggggcgac

SEQ ID NO: 11131 - DNA, 24 bp, Homo sapiens
ttaaaaatttcggttggggcgacc

SEQ ID NO: 11132 - DNA, 37 bp, Homo sapiens
ttaaaaatttcggttggggcgacctcggagcagaacc

SEQ ID NO: 11133 - DNA, 38 bp, Homo sapiens
ttaaaaatttcggttggggcgacctcggagcagaaccc

SEQ ID NO: 11134 - DNA, 17 bp, Homo sapiens
taaaaatttcggttggg

SEQ ID NO: 11135 - DNA, 23 bp, Homo sapiens
taaaaatttcggttggggcgacc

SEQ ID NO: 11136 - DNA, 36 bp, Homo sapiens
taaaaatttcggttggggcgacctcggagcagaacc

SEQ ID NO: 11137 - DNA, 37 bp, Homo sapiens
taaaaatttcggttggggcgacctcggagcagaaccc

SEQ ID NO: 11138 - DNA, 16 bp, Homo sapiens
aaaaatttcggttggg

SEQ ID NO: 11139 - DNA, 21 bp, Homo sapiens
aaaaatttcggttggggcgac

SEQ ID NO: 11140 - DNA, 22 bp, Homo sapiens
aaaaatttcggttggggcgacc

SEQ ID NO: 11141 - DNA, 29 bp, Homo sapiens
aaaaatttcggttggggcgacctcggagc

SEQ ID NO: 11142 - DNA, 35 bp, Homo sapiens
aaaaatttcggttggggcgacctcggagcagaacc

SEQ ID NO: 11143 - DNA, 36 bp, Homo sapiens
aaaaatttcggttggggcgacctcggagcagaaccc

SEQ ID NO: 11144 - DNA, 20 bp, Homo sapiens
aaaatttcggttggggcgac

SEQ ID NO: 11145 - DNA, 21 bp, Homo sapiens
aaaatttcggttggggcgacc

SEQ ID NO: 11146 - DNA, 23 bp, Homo sapiens
aaaatttcggttggggcgacctc

SEQ ID NO: 11147 - DNA, 28 bp, Homo sapiens
aaaatttcggttggggcgacctcggagc

SEQ ID NO: 11148 - DNA, 29 bp, Homo sapiens
aaaatttcggttggggcgacctcggagca

SEQ ID NO: 11149 - DNA, 32 bp, Homo sapiens
aaaatttcggttggggcgacctcggagcagaa

SEQ ID NO: 11150 - DNA, 34 bp, Homo sapiens
aaaatttcggttggggcgacctcggagcagaacc

SEQ ID NO: 11151 - DNA, 35 bp, Homo sapiens
aaaatttcggttggggcgacctcggagcagaaccc

SEQ ID NO: 11152 - DNA, 19 bp, Homo sapiens
aaatttcggttggggcgac

SEQ ID NO: 11153 - DNA, 20 bp, Homo sapiens
aaatttcggttggggcgacc

SEQ ID NO: 11154 - DNA, 27 bp, Homo sapiens
aaatttcggttggggcgacctcggagc

SEQ ID NO: 11155 - DNA, 28 bp, Homo sapiens
aaatttcggttggggcgacctcggagca

SEQ ID NO: 11156 - DNA, 33 bp, Homo sapiens; identical to SEQ ID NO: 1630

SEQ ID NO: 11157 - DNA, 34 bp, Homo sapiens
aaatttcggttggggcgacctcggagcagaaccc

SEQ ID NO: 11158 - DNA, 18 bp, Homo sapiens
aatttcggttggggcgac

SEQ ID NO: 11159 - DNA, 19 bp, Homo sapiens
aatttcggttggggcgacc

SEQ ID NO: 11160 - DNA, 21 bp, Homo sapiens
aatttcggttggggcgacctc

SEQ ID NO: 11161 - DNA, 26 bp, Homo sapiens
aatttcggttggggcgacctcggagc

SEQ ID NO: 11162 - DNA, 27 bp, Homo sapiens
aatttcggttggggcgacctcggagca

SEQ ID NO: 11163 - DNA, 28 bp, Homo sapiens
aatttcggttggggcgacctcggagcag

SEQ ID NO: 11164 - DNA, 29 bp, Homo sapiens
aatttcggttggggcgacctcggagcaga

SEQ ID NO: 11165 - DNA, 30 bp, Homo sapiens
aatttcggttggggcgacctcggagcagaa

SEQ ID NO: 11166 - DNA, 31 bp, Homo sapiens
aatttcggttggggcgacctcggagcagaac

SEQ ID NO: 11167 - DNA, 32 bp, Homo sapiens; identical to SEQ ID NO: 1633

SEQ ID NO: 11168 - DNA, 33 bp, Homo sapiens; identical to SEQ ID NO: 1634

SEQ ID NO: 11169 - DNA, 17 bp, Homo sapiens
atttcggttggggcgac

SEQ ID NO: 11170 - DNA, 18 bp, Homo sapiens
atttcggttggggcgacc

SEQ ID NO: 11171 - DNA, 25 bp, Homo sapiens
atttcggttggggcgacctcggagc

SEQ ID NO: 11172 - DNA, 26 bp, Homo sapiens
atttcggttggggcgacctcggagca

SEQ ID NO: 11173 - DNA, 29 bp, Homo sapiens
atttcggttggggcgacctcggagcagaa

SEQ ID NO: 11174 - DNA, 30 bp, Homo sapiens
atttcggttggggcgacctcggagcagaac

SEQ ID NO: 11175 - DNA, 31 bp, Homo sapiens; identical to SEQ ID NO: 1636

SEQ ID NO: 11176 - DNA, 32 bp, Homo sapiens; identical to SEQ ID NO: 1637

SEQ ID NO: 11177 - DNA, 16 bp, Homo sapiens
tttcggttggggcgac

SEQ ID NO: 11178 - DNA, 17 bp, Homo sapiens
tttcggttggggcgacc

SEQ ID NO: 11179 - DNA, 24 bp, Homo sapiens
tttcggttggggcgacctcggagc

SEQ ID NO: 11180 - DNA, 25 bp, Homo sapiens
tttcggttggggcgacctcggagca

SEQ ID NO: 11181 - DNA, 30 bp, Homo sapiens; identical to SEQ ID NO: 1638

SEQ ID NO: 11182 - DNA, 31 bp, Homo sapiens; identical to SEQ ID NO: 1639

SEQ ID NO: 11183 - DNA, 16 bp, Homo sapiens
ttcggttggggcgacc

SEQ ID NO: 11184 - DNA, 23 bp, Homo sapiens
ttcggttggggcgacctcggagc

SEQ ID NO: 11185 - DNA, 24 bp, Homo sapiens
ttcggttggggcgacctcggagca

SEQ ID NO: 11186 - DNA, 27 bp, Homo sapiens
ttcggttggggcgacctcggagcagaa

SEQ ID NO: 11187 - DNA, 29 bp, Homo sapiens
ttcggttggggcgacctcggagcagaacc

SEQ ID NO: 11188 - DNA, 30 bp, Homo sapiens; identical to SEQ ID NO: 1642

SEQ ID NO: 11189 - DNA, 23 bp, Homo sapiens
tcggttggggcgacctcggagca

SEQ ID NO: 11190 - DNA, 28 bp, Homo sapiens
tcggttggggcgacctcggagcagaacc

SEQ ID NO: 11191 - DNA, 29 bp, Homo sapiens
tcggttggggcgacctcggagcagaaccc

SEQ ID NO: 11192 - DNA, 22 bp, Homo sapiens
cggttggggcgacctcggagca

SEQ ID NO: 11193 - DNA, 27 bp, Homo sapiens
cggttggggcgacctcggagcagaacc

SEQ ID NO: 11194 - DNA, 28 bp, Homo sapiens
cggttggggcgacctcggagcagaaccc

SEQ ID NO: 11195 - DNA, 26 bp, Homo sapiens
ggttggggcgacctcggagcagaacc

SEQ ID NO: 11196 - DNA, 27 bp, Homo sapiens
ggttggggcgacctcggagcagaaccc

SEQ ID NO: 11197 - DNA, 29 bp, Homo sapiens
ggttggggcgacctcggagcagaacccaa

SEQ ID NO: 11198 - DNA, 20 bp, Homo sapiens
gttggggcgacctcggagca

SEQ ID NO: 11199 - DNA, 23 bp, Homo sapiens
gttggggcgacctcggagcagaa

SEQ ID NO: 11200 - DNA, 25 bp, Homo sapiens
gttggggcgacctcggagcagaacc

SEQ ID NO: 11201 - DNA, 26 bp, Homo sapiens
gttggggcgacctcggagcagaaccc

SEQ ID NO: 11202 - DNA, 24 bp, Homo sapiens
ttggggcgacctcggagcagaacc

SEQ ID NO: 11203 - DNA, 25 bp, Homo sapiens
ttggggcgacctcggagcagaaccc

SEQ ID NO: 11204 - DNA, 23 bp, Homo sapiens
tggggcgacctcggagcagaacc

SEQ ID NO: 11205 - DNA, 24 bp, Homo sapiens
tggggcgacctcggagcagaaccc

SEQ ID NO: 11206 - DNA, 22 bp, Homo sapiens
ggggcgacctcggagcagaacc

SEQ ID NO: 11207 - DNA, 23 bp, Homo sapiens
ggggcgacctcggagcagaaccc

SEQ ID NO: 11208 - DNA, 21 bp, Homo sapiens
gggcgacctcggagcagaacc

SEQ ID NO: 11209 - DNA, 27 bp, Homo sapiens
gggcgacctcggagcagaacccaacct

SEQ ID NO: 11210 - DNA, 20 bp, Homo sapiens
ggcgacctcggagcagaacc

SEQ ID NO: 11211 - DNA, 21 bp, Homo sapiens
ggcgacctcggagcagaaccc

SEQ ID NO: 11212 - DNA, 22 bp, Homo sapiens
ggcgacctcggagcagaaccca

SEQ ID NO: 11213 - DNA, 19 bp, Homo sapiens
gcgacctcggagcagaacc

SEQ ID NO: 11214 - DNA, 20 bp, Homo sapiens
gcgacctcggagcagaaccc

SEQ ID NO: 11215 - DNA, 23 bp, Homo sapiens
gcgacctcggagcagaacccaac

SEQ ID NO: 11216 - DNA, 18 bp, Homo sapiens
cgacctcggagcagaacc

SEQ ID NO: 11217 - DNA, 19 bp, Homo sapiens
cgacctcggagcagaaccc

SEQ ID NO: 11218 - DNA, 17 bp, Homo sapiens
gacctcggagcagaacc

SEQ ID NO: 11219 - DNA, 18 bp, Homo sapiens
gacctcggagcagaaccc

SEQ ID NO: 11220 - DNA, 16 bp, Homo sapiens
acctcggagcagaacc

SEQ ID NO: 11221 - DNA, 17 bp, Homo sapiens
acctcggagcagaaccc

SEQ ID NO: 11222 - DNA, 18 bp, Homo sapiens
acctcggagcagaaccca

SEQ ID NO: 11223 - DNA, 21 bp, Homo sapiens
acctcggagcagaacccaacc

SEQ ID NO: 11224 - DNA, 23 bp, Homo sapiens
acctcggagcagaacccaacctc

SEQ ID NO: 11225 - DNA, 24 bp, Homo sapiens
acctcggagcagaacccaacctcc

SEQ ID NO: 11226 - DNA, 16 bp, Homo sapiens
cctcggagcagaaccc

SEQ ID NO: 11227 - DNA, 23 bp, Homo sapiens
cctcggagcagaacccaacctcc

SEQ ID NO: 11228 - DNA, 20 bp, Homo sapiens
ctcggagcagaacccaacct

SEQ ID NO: 11229 - DNA, 22 bp, Homo sapiens
ctcggagcagaacccaacctcc

SEQ ID NO: 11230 - DNA, 18 bp, Homo sapiens
tcggagcagaacccaacc

SEQ ID NO: 11231 - DNA, 19 bp, Homo sapiens
tcggagcagaacccaacct

SEQ ID NO: 11232 - DNA, 20 bp, Homo sapiens
tcggagcagaacccaacctc

SEQ ID NO: 11233 - DNA, 21 bp, Homo sapiens
tcggagcagaacccaacctcc

SEQ ID NO: 11234 - DNA, 17 bp, Homo sapiens
cggagcagaacccaacc

SEQ ID NO: 11235 - DNA, 18 bp, Homo sapiens
cggagcagaacccaacct

SEQ ID NO: 11236 - DNA, 19 bp, Homo sapiens
cggagcagaacccaacctc

SEQ ID NO: 11237 - DNA, 20 bp, Homo sapiens
cggagcagaacccaacctcc

SEQ ID NO: 11238 - DNA, 29 bp, Homo sapiens
gagcagaacccaacctccgagcagtacat

SEQ ID NO: 11239 - DNA, 21 bp, Homo sapiens
agcagaacccaacctccgagc

SEQ ID NO: 11240 - DNA, 20 bp, Homo sapiens
cagaacccaacctccgagca

SEQ ID NO: 11241 - DNA, 25 bp, Homo sapiens
cagaacccaacctccgagcagtaca

SEQ ID NO: 11242 - DNA, 26 bp, Homo sapiens
cagaacccaacctccgagcagtacat

SEQ ID NO: 11243 - DNA, 40 bp, Homo sapiens
cagaacccaacctccgagcagtacatgctaagacttcacc

SEQ ID NO: 11244 - DNA, 16 bp, Homo sapiens
caacctccgagcagta

SEQ ID NO: 11245 - DNA, 18 bp, Homo sapiens
caacctccgagcagtaca

SEQ ID NO: 11246 - DNA, 20 bp, Homo sapiens
caacctccgagcagtacatg

SEQ ID NO: 11247 - DNA, 22 bp, Homo sapiens
caacctccgagcagtacatgct

SEQ ID NO: 11248 - DNA, 27 bp, Homo sapiens
caacctccgagcagtacatgctaagac

SEQ ID NO: 11249 - DNA, 28 bp, Homo sapiens
caacctccgagcagtacatgctaagact

SEQ ID NO: 11250 - DNA, 29 bp, Homo sapiens
caacctccgagcagtacatgctaagactt

SEQ ID NO: 11251 - DNA, 30 bp, Homo sapiens
caacctccgagcagtacatgctaagacttc

SEQ ID NO: 11252 - DNA, 31 bp, Homo sapiens
caacctccgagcagtacatgctaagacttca

SEQ ID NO: 11253 - DNA, 33 bp, Homo sapiens; identical to SEQ ID NO: 1669

SEQ ID NO: 11254 - DNA, 34 bp, Homo sapiens
caacctccgagcagtacatgctaagacttcacca

SEQ ID NO: 11255 - DNA, 46 bp, Homo sapiens
caacctccgagcagtacatgctaagacttcaccagtcaaagcgaac

SEQ ID NO: 11256 - DNA, 47 bp, Homo sapiens
caacctccgagcagtacatgctaagacttcaccagtcaaagcgaact

SEQ ID NO: 11257 - DNA, 19 bp, Homo sapiens
aacctccgagcagtacatg

SEQ ID NO: 11258 - DNA, 26 bp, Homo sapiens
aacctccgagcagtacatgctaagac

SEQ ID NO: 11259 - DNA, 27 bp, Homo sapiens
aacctccgagcagtacatgctaagact

SEQ ID NO: 11260 - DNA, 28 bp, Homo sapiens
aacctccgagcagtacatgctaagactt

SEQ ID NO: 11261 - DNA, 32 bp, Homo sapiens; identical to SEQ ID NO: 1672

SEQ ID NO: 11262 - DNA, 33 bp, Homo sapiens
aacctccgagcagtacatgctaagacttcacca

SEQ ID NO: 11263 - DNA, 46 bp, Homo sapiens
aacctccgagcagtacatgctaagacttcaccagtcaaagcgaact

SEQ ID NO: 11264 - DNA, 25 bp, Homo sapiens
acctccgagcagtacatgctaagac

SEQ ID NO: 11265 - DNA, 26 bp, Homo sapiens
acctccgagcagtacatgctaagact

SEQ ID NO: 11266 - DNA, 31 bp, Homo sapiens; identical to SEQ ID NO: 1673

SEQ ID NO: 11267 - DNA, 29 bp, Homo sapiens
ctccgagcagtacatgctaagacttcacc

SEQ ID NO: 11268 - DNA, 21 bp, Homo sapiens
ccgagcagtacatgctaagac

SEQ ID NO: 11269 - DNA, 22 bp, Homo sapiens
cagtacatgctaagacttcacc

SEQ ID NO: 11270 - DNA, 20 bp, Homo sapiens
gtacatgctaagacttcacc

SEQ ID NO: 11271 - DNA, 19 bp, Homo sapiens
tacatgctaagacttcacc

SEQ ID NO: 11272 - DNA, 18 bp, Homo sapiens
acatgctaagacttcacc

SEQ ID NO: 11273 - DNA, 17 bp, Homo sapiens
catgctaagacttcacc

SEQ ID NO: 11274 - DNA, 18 bp, Homo sapiens
catgctaagacttcacca

SEQ ID NO: 11275 - DNA, 27 bp, Homo sapiens
catgctaagacttcaccagtcaaagcg

SEQ ID NO: 11276 - DNA, 16 bp, Homo sapiens
atgctaagacttcacc

SEQ ID NO: 11277 - DNA, 25 bp, Homo sapiens
aagacttcaccagtcaaagcgaact

SEQ ID NO: 11278 - DNA, 33 bp, Homo sapiens
aagacttcaccagtcaaagcgaactactatact

SEQ ID NO: 11279 - DNA, 22 bp, Homo sapiens
acttcaccagtcaaagcgaact

SEQ ID NO: 11280 - DNA, 30 bp, Homo sapiens
acttcaccagtcaaagcgaactactatact

SEQ ID NO: 11281 - DNA, 16 bp, Homo sapiens
cttcaccagtcaaagc

SEQ ID NO: 11282 - DNA, 21 bp, Homo sapiens
cttcaccagtcaaagcgaact

SEQ ID NO: 11283 - DNA, 24 bp, Homo sapiens
cttcaccagtcaaagcgaactact

SEQ ID NO: 11284 - DNA, 29 bp, Homo sapiens
cttcaccagtcaaagcgaactactatact

SEQ ID NO: 11285 - DNA, 17 bp, Homo sapiens
ttcaccagtcaaagcga

SEQ ID NO: 11286 - DNA, 20 bp, Homo sapiens
ttcaccagtcaaagcgaact

SEQ ID NO: 11287 - DNA, 18 bp, Homo sapiens
tcaccagtcaaagcgaac

SEQ ID NO: 11288 - DNA, 19 bp, Homo sapiens
tcaccagtcaaagcgaact

SEQ ID NO: 11289 - DNA, 21 bp, Homo sapiens
tcaccagtcaaagcgaactac

SEQ ID NO: 11290 - DNA, 22 bp, Homo sapiens
tcaccagtcaaagcgaactact

SEQ ID NO: 11291 - DNA, 27 bp, Homo sapiens
tcaccagtcaaagcgaactactatact

SEQ ID NO: 11292 - DNA, 32 bp, Homo sapiens
tcaccagtcaaagcgaactactatactcaatt

SEQ ID NO: 11293 - DNA, 17 bp, Homo sapiens
agtcaaagcgaactact

SEQ ID NO: 11294 - DNA, 22 bp, Homo sapiens
agtcaaagcgaactactatact

SEQ ID NO: 11295 - DNA, 23 bp, Homo sapiens
agtcaaagcgaactactatactc

SEQ ID NO: 11296 - DNA, 27 bp, Homo sapiens
agtcaaagcgaactactatactcaatt

SEQ ID NO: 11297 - DNA, 31 bp, Homo sapiens; identical to SEQ ID NO: 1685

SEQ ID NO: 11298 - DNA, 32 bp, Homo sapiens; identical to SEQ ID NO: 1686

SEQ ID NO: 11299 - DNA, 39 bp, Homo sapiens
agtcaaagcgaactactatactcaattgatccaataact

SEQ ID NO: 11300 - DNA, 44 bp, Homo sapiens
agtcaaagcgaactactatactcaattgatccaataacttgacc

SEQ ID NO: 11301 - DNA, 21 bp, Homo sapiens
gtcaaagcgaactactatact

SEQ ID NO: 11302 - DNA, 22 bp, Homo sapiens
gtcaaagcgaactactatactc

SEQ ID NO: 11303 - DNA, 26 bp, Homo sapiens
gtcaaagcgaactactatactcaatt

SEQ ID NO: 11304 - DNA, 30 bp, Homo sapiens; identical to SEQ ID NO: 1688

SEQ ID NO: 11305 - DNA, 31 bp, Homo sapiens
gtcaaagcgaactactatactcaattgatcc

SEQ ID NO: 11306 - DNA, 18 bp, Homo sapiens
aaagcgaactactatact

SEQ ID NO: 11307 - DNA, 28 bp, Homo sapiens
aaagcgaactactatactcaattgatcc

SEQ ID NO: 11308 - DNA, 31 bp, Homo sapiens
aaagcgaactactatactcaattgatccaat

SEQ ID NO: 11309 - DNA, 40 bp, Homo sapiens
aaagcgaactactatactcaattgatccaataacttgacc

SEQ ID NO: 11310 - DNA, 17 bp, Homo sapiens
aagcgaactactatact

SEQ ID NO: 11311 - DNA, 27 bp, Homo sapiens
aagcgaactactatactcaattgatcc

SEQ ID NO: 11312 - DNA, 30 bp, Homo sapiens
aagcgaactactatactcaattgatccaat

SEQ ID NO: 11313 - DNA, 39 bp, Homo sapiens
aagcgaactactatactcaattgatccaataacttgacc

SEQ ID NO: 11314 - DNA, 33 bp, Homo sapiens
agcgaactactatactcaattgatccaataact

SEQ ID NO: 11315 - DNA, 38 bp, Homo sapiens
agcgaactactatactcaattgatccaataacttgacc

SEQ ID NO: 11316 - DNA, 32 bp, Homo sapiens
gcgaactactatactcaattgatccaataact

SEQ ID NO: 11317 - DNA, 37 bp, Homo sapiens
gcgaactactatactcaattgatccaataacttgacc

SEQ ID NO: 11318 - DNA, 31 bp, Homo sapiens
cgaactactatactcaattgatccaataact

SEQ ID NO: 11319 - DNA, 36 bp, Homo sapiens
cgaactactatactcaattgatccaataacttgacc

SEQ ID NO: 11320 - DNA, 29 bp, Homo sapiens
aactactatactcaattgatccaataact

SEQ ID NO: 11321 - DNA, 30 bp, Homo sapiens
aactactatactcaattgatccaataactt

SEQ ID NO: 11322 - DNA, 34 bp, Homo sapiens
aactactatactcaattgatccaataacttgacc

SEQ ID NO: 11323 - DNA, 32 bp, Homo sapiens
ctactatactcaattgatccaataacttgacc

SEQ ID NO: 11324 - DNA, 31 bp, Homo sapiens; identical to SEQ ID NO: 1690

SEQ ID NO: 11325 - DNA, 18 bp, Homo sapiens
actatactcaattgatcc

SEQ ID NO: 11326 - DNA, 21 bp, Homo sapiens
actatactcaattgatccaat

SEQ ID NO: 11327 - DNA, 22 bp, Homo sapiens
actatactcaattgatccaata

SEQ ID NO: 11328 - DNA, 24 bp, Homo sapiens
actatactcaattgatccaataac

SEQ ID NO: 11329 - DNA, 25 bp, Homo sapiens
actatactcaattgatccaataact

SEQ ID NO: 11330 - DNA, 26 bp, Homo sapiens
actatactcaattgatccaataactt

SEQ ID NO: 11331 - DNA, 27 bp, Homo sapiens
actatactcaattgatccaataacttg

SEQ ID NO: 11332 - DNA, 29 bp, Homo sapiens
actatactcaattgatccaataacttgac

SEQ ID NO: 11333 - DNA, 30 bp, Homo sapiens; identical to SEQ ID NO: 1696

SEQ ID NO: 11334 - DNA, 31 bp, Homo sapiens
actatactcaattgatccaataacttgacca

SEQ ID NO: 11335 - DNA, 29 bp, Homo sapiens
ctatactcaattgatccaataacttgacc

SEQ ID NO: 11336 - DNA, 24 bp, Homo sapiens
tatactcaattgatccaataactt

SEQ ID NO: 11337 - DNA, 27 bp, Homo sapiens
tatactcaattgatccaataacttgac

SEQ ID NO: 11338 - DNA, 28 bp, Homo sapiens
tatactcaattgatccaataacttgacc

SEQ ID NO: 11339 - DNA, 22 bp, Homo sapiens
atactcaattgatccaataact

SEQ ID NO: 11340 - DNA, 23 bp, Homo sapiens
atactcaattgatccaataactt

SEQ ID NO: 11341 - DNA, 26 bp, Homo sapiens
atactcaattgatccaataacttgac

SEQ ID NO: 11342 - DNA, 27 bp, Homo sapiens
atactcaattgatccaataacttgacc

SEQ ID NO: 11343 - DNA, 26 bp, Homo sapiens
tactcaattgatccaataacttgacc

SEQ ID NO: 11344 - DNA, 25 bp, Homo sapiens
actcaattgatccaataacttgacc

SEQ ID NO: 11345 - DNA, 24 bp, Homo sapiens
ctcaattgatccaataacttgacc

SEQ ID NO: 11346 - DNA, 23 bp, Homo sapiens
tcaattgatccaataacttgacc

SEQ ID NO: 11347 - DNA, 17 bp, Homo sapiens
caattgatccaataact

SEQ ID NO: 11348 - DNA, 22 bp, Homo sapiens
caattgatccaataacttgacc

SEQ ID NO: 11349 - DNA, 16 bp, Homo sapiens
aattgatccaataact

SEQ ID NO: 11350 - DNA, 17 bp, Homo sapiens
aattgatccaataactt

SEQ ID NO: 11351 - DNA, 20 bp, Homo sapiens
aattgatccaataacttgac

SEQ ID NO: 11352 - DNA, 21 bp, Homo sapiens
aattgatccaataacttgacc

SEQ ID NO: 11353 - DNA, 20 bp, Homo sapiens
attgatccaataacttgacc

SEQ ID NO: 11354 - DNA, 21 bp, Homo sapiens
caataacttgaccaacggaac

SEQ ID NO: 11355 - DNA, 20 bp, Homo sapiens
aataacttgaccaacggaac

SEQ ID NO: 11356 - DNA, 19 bp, Homo sapiens
ataacttgaccaacggaac

SEQ ID NO: 11357 - DNA, 17 bp, Homo sapiens
aacttgaccaacggaac

SEQ ID NO: 11358 - DNA, 25 bp, Homo sapiens
cttgaccaacggaacaagttaccct

SEQ ID NO: 11359 - DNA, 32 bp, Homo sapiens
cttgaccaacggaacaagttaccctagggata

SEQ ID NO: 11360 - DNA, 24 bp, Homo sapiens
ttgaccaacggaacaagttaccct

SEQ ID NO: 11361 - DNA, 31 bp, Homo sapiens
ttgaccaacggaacaagttaccctagggata

SEQ ID NO: 11362 - DNA, 22 bp, Homo sapiens
tgaccaacggaacaagttaccc

SEQ ID NO: 11363 - DNA, 23 bp, Homo sapiens
tgaccaacggaacaagttaccct

SEQ ID NO: 11364 - DNA, 33 bp, Homo sapiens; identical to SEQ ID NO: 1706

SEQ ID NO: 11365 - DNA, 17 bp, Homo sapiens
caacggaacaagttacc

SEQ ID NO: 11366 - DNA, 18 bp, Homo sapiens
caacggaacaagttaccc

SEQ ID NO: 11367 - DNA, 19 bp, Homo sapiens
caacggaacaagttaccct

SEQ ID NO: 11368 - DNA, 25 bp, Homo sapiens
caacggaacaagttaccctagggat

SEQ ID NO: 11369 - DNA, 26 bp, Homo sapiens
caacggaacaagttaccctagggata

SEQ ID NO: 11370 - DNA, 28 bp, Homo sapiens
caacggaacaagttaccctagggataac

SEQ ID NO: 11371 - DNA, 29 bp, Homo sapiens
caacggaacaagttaccctagggataaca

SEQ ID NO: 11372 - DNA, 16 bp, Homo sapiens
aacggaacaagttacc

SEQ ID NO: 11373 - DNA, 17 bp, Homo sapiens
aacggaacaagttaccc

SEQ ID NO: 11374 - DNA, 18 bp, Homo sapiens
aacggaacaagttaccct

SEQ ID NO: 11375 - DNA, 24 bp, Homo sapiens
aacggaacaagttaccctagggat

SEQ ID NO: 11376 - DNA, 25 bp, Homo sapiens
aacggaacaagttaccctagggata

SEQ ID NO: 11377 - DNA, 26 bp, Homo sapiens
aacggaacaagttaccctagggataa

SEQ ID NO: 11378 - DNA, 27 bp, Homo sapiens
aacggaacaagttaccctagggataac

SEQ ID NO: 11379 - DNA, 28 bp, Homo sapiens
aacggaacaagttaccctagggataaca

SEQ ID NO: 11380 - DNA, 30 bp, Homo sapiens
aacggaacaagttaccctagggataacagc

SEQ ID NO: 11381 - DNA, 16 bp, Homo sapiens
acggaacaagttaccc

SEQ ID NO: 11382 - DNA, 17 bp, Homo sapiens
acggaacaagttaccct

SEQ ID NO: 11383 - DNA, 22 bp, Homo sapiens
acggaacaagttaccctaggga

SEQ ID NO: 11384 - DNA, 23 bp, Homo sapiens
acggaacaagttaccctagggat

SEQ ID NO: 11385 - DNA, 25 bp, Homo sapiens
acggaacaagttaccctagggataa

SEQ ID NO: 11386 - DNA, 26 bp, Homo sapiens
acggaacaagttaccctagggataac

SEQ ID NO: 11387 - DNA, 27 bp, Homo sapiens
acggaacaagttaccctagggataaca

SEQ ID NO: 11388 - DNA, 26 bp, Homo sapiens
cggaacaagttaccctagggataaca

SEQ ID NO: 11389 - DNA, 33 bp, Homo sapiens
agagtccatatcaacaatagggtttacgacctc

SEQ ID NO: 11390 - DNA, 29 bp, Homo sapiens
agtccatatcaacaatagggtttacgacc

SEQ ID NO: 11391 - DNA, 31 bp, Homo sapiens
agtccatatcaacaatagggtttacgacctc

SEQ ID NO: 11392 - DNA, 33 bp, Homo sapiens
ccatatcaacaatagggtttacgacctcgatgt

SEQ ID NO: 11393 - DNA, 32 bp, Homo sapiens; identical to SEQ ID NO: 1719

SEQ ID NO: 11394 - DNA, 47 bp, Homo sapiens
catatcaacaatagggtttacgacctcgatgttggatcaggacatcc

SEQ ID NO: 11395 - DNA, 31 bp, Homo sapiens
atatcaacaatagggtttacgacctcgatgt

SEQ ID NO: 11396 - DNA, 45 bp, Homo sapiens
atatcaacaatagggtttacgacctcgatgttggatcaggacatc

SEQ ID NO: 11397 - DNA, 46 bp, Homo sapiens
atatcaacaatagggtttacgacctcgatgttggatcaggacatcc

SEQ ID NO: 11398 - DNA, 47 bp, Homo sapiens
atatcaacaatagggtttacgacctcgatgttggatcaggacatccc

SEQ ID NO: 11399 - DNA, 44 bp, Homo sapiens
tatcaacaatagggtttacgacctcgatgttggatcaggacatc

SEQ ID NO: 11400 - DNA, 45 bp, Homo sapiens
tatcaacaatagggtttacgacctcgatgttggatcaggacatcc

SEQ ID NO: 11401 - DNA, 46 bp, Homo sapiens
tatcaacaatagggtttacgacctcgatgttggatcaggacatccc

SEQ ID NO: 11402 - DNA, 22 bp, Homo sapiens
atcaacaatagggtttacgacc

SEQ ID NO: 11403 - DNA, 44 bp, Homo sapiens
atcaacaatagggtttacgacctcgatgttggatcaggacatcc

SEQ ID NO: 11404 - DNA, 45 bp, Homo sapiens
atcaacaatagggtttacgacctcgatgttggatcaggacatccc

SEQ ID NO: 11405 - DNA, 43 bp, Homo sapiens
tcaacaatagggtttacgacctcgatgttggatcaggacatcc

SEQ ID NO: 11406 - DNA, 44 bp, Homo sapiens
tcaacaatagggtttacgacctcgatgttggatcaggacatccc

SEQ ID NO: 11407 - DNA, 22 bp, Homo sapiens
caacaatagggtttacgacctc

SEQ ID NO: 11408 - DNA, 25 bp, Homo sapiens
caacaatagggtttacgacctcgat

SEQ ID NO: 11409 - DNA, 26 bp, Homo sapiens
caacaatagggtttacgacctcgatg

SEQ ID NO: 11410 - DNA, 27 bp, Homo sapiens
caacaatagggtttacgacctcgatgt

SEQ ID NO: 11411 - DNA, 32 bp, Homo sapiens
caacaatagggtttacgacctcgatgttggat

SEQ ID NO: 11412 - DNA, 42 bp, Homo sapiens
caacaatagggtttacgacctcgatgttggatcaggacatcc

SEQ ID NO: 11413 - DNA, 43 bp, Homo sapiens
caacaatagggtttacgacctcgatgttggatcaggacatccc

SEQ ID NO: 11414 - DNA, 44 bp, Homo sapiens
caacaatagggtttacgacctcgatgttggatcaggacatcccg

SEQ ID NO: 11415 - DNA, 45 bp, Homo sapiens
caacaatagggtttacgacctcgatgttggatcaggacatcccga

SEQ ID NO: 11416 - DNA, 18 bp, Homo sapiens
aacaatagggtttacgac

SEQ ID NO: 11417 - DNA, 19 bp, Homo sapiens
aacaatagggtttacgacc

SEQ ID NO: 11418 - DNA, 31 bp, Homo sapiens
aacaatagggtttacgacctcgatgttggat

SEQ ID NO: 11419 - DNA, 32 bp, Homo sapiens
aacaatagggtttacgacctcgatgttggatc

SEQ ID NO: 11420 - DNA, 45 bp, Homo sapiens
aacaatagggtttacgacctcgatgttggatcaggacatcccgat

SEQ ID NO: 11421 - DNA, 18 bp, Homo sapiens
acaatagggtttacgacc

SEQ ID NO: 11422 - DNA, 30 bp, Homo sapiens
acaatagggtttacgacctcgatgttggat

SEQ ID NO: 11423 - DNA, 31 bp, Homo sapiens
acaatagggtttacgacctcgatgttggatc

SEQ ID NO: 11424 - DNA, 36 bp, Homo sapiens
acaatagggtttacgacctcgatgttggatcaggac

SEQ ID NO: 11425 - DNA, 40 bp, Homo sapiens
acaatagggtttacgacctcgatgttggatcaggacatcc

SEQ ID NO: 11426 - DNA, 41 bp, Homo sapiens
acaatagggtttacgacctcgatgttggatcaggacatccc

SEQ ID NO: 11427 - DNA, 44 bp, Homo sapiens
acaatagggtttacgacctcgatgttggatcaggacatcccgat

SEQ ID NO: 11428 - DNA, 16 bp, Homo sapiens
aatagggtttacgacc

SEQ ID NO: 11429 - DNA, 29 bp, Homo sapiens
aatagggtttacgacctcgatgttggatc

SEQ ID NO: 11430 - DNA, 33 bp, Homo sapiens
aatagggtttacgacctcgatgttggatcagga

SEQ ID NO: 11431 - DNA, 28 bp, Homo sapiens
atagggtttacgacctcgatgttggatc

SEQ ID NO: 11432 - DNA, 31 bp, Homo sapiens
atagggtttacgacctcgatgttggatcagg

SEQ ID NO: 11433 - DNA, 32 bp, Homo sapiens
atagggtttacgacctcgatgttggatcagga

SEQ ID NO: 11434 - DNA, 38 bp, Homo sapiens
atagggtttacgacctcgatgttggatcaggacatccc

SEQ ID NO: 11435 - DNA, 24 bp, Homo sapiens
ggtttacgacctcgatgttggatc

SEQ ID NO: 11436 - DNA, 32 bp, Homo sapiens
ggtttacgacctcgatgttggatcaggacatc

SEQ ID NO: 11437 - DNA, 33 bp, Homo sapiens; identical to SEQ ID NO: 1722

SEQ ID NO: 11438 - DNA, 23 bp, Homo sapiens
gtttacgacctcgatgttggatc

SEQ ID NO: 11439 - DNA, 31 bp, Homo sapiens
gtttacgacctcgatgttggatcaggacatc

SEQ ID NO: 11440 - DNA, 32 bp, Homo sapiens; identical to SEQ ID NO: 1724

SEQ ID NO: 11441 - DNA, 33 bp, Homo sapiens
gtttacgacctcgatgttggatcaggacatccc

SEQ ID NO: 11442 - DNA, 31 bp, Homo sapiens
tttacgacctcgatgttggatcaggacatcc

SEQ ID NO: 11443 - DNA, 30 bp, Homo sapiens; identical to SEQ ID NO: 1725

SEQ ID NO: 11444 - DNA, 33 bp, Homo sapiens
ttacgacctcgatgttggatcaggacatcccga

SEQ ID NO: 11445 - DNA, 29 bp, Homo sapiens
tacgacctcgatgttggatcaggacatcc

SEQ ID NO: 11446 - DNA, 30 bp, Homo sapiens
tacgacctcgatgttggatcaggacatccc

SEQ ID NO: 11447 - DNA, 27 bp, Homo sapiens
acgacctcgatgttggatcaggacatc

SEQ ID NO: 11448 - DNA, 28 bp, Homo sapiens
acgacctcgatgttggatcaggacatcc

SEQ ID NO: 11449 - DNA, 29 bp, Homo sapiens
acgacctcgatgttggatcaggacatccc

SEQ ID NO: 11450 - DNA, 21 bp, Homo sapiens
cgacctcgatgttggatcagg

SEQ ID NO: 11451 - DNA, 27 bp, Homo sapiens
cgacctcgatgttggatcaggacatcc

SEQ ID NO: 11452 - DNA, 28 bp, Homo sapiens
cgacctcgatgttggatcaggacatccc

SEQ ID NO: 11453 - DNA, 29 bp, Homo sapiens
cgacctcgatgttggatcaggacatcccg

SEQ ID NO: 11454 - DNA, 30 bp, Homo sapiens
cgacctcgatgttggatcaggacatcccga

SEQ ID NO: 11455 - DNA, 17 bp, Homo sapiens
gacctcgatgttggatc

SEQ ID NO: 11456 - DNA, 20 bp, Homo sapiens
gacctcgatgttggatcagg

SEQ ID NO: 11457 - DNA, 25 bp, Homo sapiens
gacctcgatgttggatcaggacatc

SEQ ID NO: 11458 - DNA, 26 bp, Homo sapiens
gacctcgatgttggatcaggacatcc

SEQ ID NO: 11459 - DNA, 27 bp, Homo sapiens
gacctcgatgttggatcaggacatccc

SEQ ID NO: 11460 - DNA, 28 bp, Homo sapiens
gacctcgatgttggatcaggacatcccg

SEQ ID NO: 11461 - DNA, 29 bp, Homo sapiens
gacctcgatgttggatcaggacatcccga

SEQ ID NO: 11462 - DNA, 30 bp, Homo sapiens; identical to SEQ ID NO: 1734

SEQ ID NO: 11463 - DNA, 31 bp, Homo sapiens; identical to SEQ ID NO: 1735

SEQ ID NO: 11464 - DNA, 32 bp, Homo sapiens
gacctcgatgttggatcaggacatcccgatgg

SEQ ID NO: 11465 - DNA, 33 bp, Homo sapiens; identical to SEQ ID NO: 1736

SEQ ID NO: 11466 - DNA, 40 bp, Homo sapiens
gacctcgatgttggatcaggacatcccgatggtgcagccg

SEQ ID NO: 11467 - DNA, 16 bp, Homo sapiens
acctcgatgttggatc

SEQ ID NO: 11468 - DNA, 17 bp, Homo sapiens
acctcgatgttggatca

SEQ ID NO: 11469 - DNA, 19 bp, Homo sapiens
acctcgatgttggatcagg

SEQ ID NO: 11470 - DNA, 24 bp, Homo sapiens
acctcgatgttggatcaggacatc

SEQ ID NO: 11471 - DNA, 25 bp, Homo sapiens
acctcgatgttggatcaggacatcc

SEQ ID NO: 11472 - DNA, 26 bp, Homo sapiens
acctcgatgttggatcaggacatccc

SEQ ID NO: 11473 - DNA, 27 bp, Homo sapiens
acctcgatgttggatcaggacatcccg

SEQ ID NO: 11474 - DNA, 28 bp, Homo sapiens
acctcgatgttggatcaggacatcccga

SEQ ID NO: 11475 - DNA, 29 bp, Homo sapiens
acctcgatgttggatcaggacatcccgat

SEQ ID NO: 11476 - DNA, 30 bp, Homo sapiens; identical to SEQ ID NO: 1742

SEQ ID NO: 11477 - DNA, 31 bp, Homo sapiens
acctcgatgttggatcaggacatcccgatgg

SEQ ID NO: 11478 - DNA, 32 bp, Homo sapiens
acctcgatgttggatcaggacatcccgatggt

SEQ ID NO: 11479 - DNA, 38 bp, Homo sapiens
acctcgatgttggatcaggacatcccgatggtgcagcc

SEQ ID NO: 11480 - DNA, 39 bp, Homo sapiens
acctcgatgttggatcaggacatcccgatggtgcagccg

SEQ ID NO: 11481 - DNA, 24 bp, Homo sapiens
cctcgatgttggatcaggacatcc

SEQ ID NO: 11482 - DNA, 37 bp, Homo sapiens
cctcgatgttggatcaggacatcccgatggtgcagcc

SEQ ID NO: 11483 - DNA, 22 bp, Homo sapiens
ctcgatgttggatcaggacatc

SEQ ID NO: 11484 - DNA, 23 bp, Homo sapiens
ctcgatgttggatcaggacatcc

SEQ ID NO: 11485 - DNA, 24 bp, Homo sapiens
ctcgatgttggatcaggacatccc

SEQ ID NO: 11486 - DNA, 33 bp, Homo sapiens
ctcgatgttggatcaggacatcccgatggtgca

SEQ ID NO: 11487 - DNA, 36 bp, Homo sapiens
ctcgatgttggatcaggacatcccgatggtgcagcc

SEQ ID NO: 11488 - DNA, 37 bp, Homo sapiens
ctcgatgttggatcaggacatcccgatggtgcagccg

SEQ ID NO: 11489 - DNA, 18 bp, Homo sapiens
tcgatgttggatcaggac

SEQ ID NO: 11490 - DNA, 19 bp, Homo sapiens
tcgatgttggatcaggaca

SEQ ID NO: 11491 - DNA, 20 bp, Homo sapiens
tcgatgttggatcaggacat

SEQ ID NO: 11492 - DNA, 21 bp, Homo sapiens
tcgatgttggatcaggacatc

SEQ ID NO: 11493 - DNA, 22 bp, Homo sapiens
tcgatgttggatcaggacatcc

SEQ ID NO: 11494 - DNA, 23 bp, Homo sapiens
tcgatgttggatcaggacatccc

SEQ ID NO: 11495 - DNA, 28 bp, Homo sapiens
tcgatgttggatcaggacatcccgatgg

SEQ ID NO: 11496 - DNA, 30 bp, Homo sapiens
tcgatgttggatcaggacatcccgatggtg

SEQ ID NO: 11497 - DNA, 31 bp, Homo sapiens; identical to SEQ ID NO: 1745

SEQ ID NO: 11498 - DNA, 32 bp, Homo sapiens; identical to SEQ ID NO: 1746

SEQ ID NO: 11499 - DNA, 33 bp, Homo sapiens
tcgatgttggatcaggacatcccgatggtgcag

SEQ ID NO: 11500 - DNA, 34 bp, Homo sapiens
tcgatgttggatcaggacatcccgatggtgcagc

SEQ ID NO: 11501 - DNA, 35 bp, Homo sapiens
tcgatgttggatcaggacatcccgatggtgcagcc

SEQ ID NO: 11502 - DNA, 36 bp, Homo sapiens
tcgatgttggatcaggacatcccgatggtgcagccg

SEQ ID NO: 11503 - DNA, 37 bp, Homo sapiens
tcgatgttggatcaggacatcccgatggtgcagccgc

SEQ ID NO: 11504 - DNA, 38 bp, Homo sapiens
tcgatgttggatcaggacatcccgatggtgcagccgct

SEQ ID NO: 11505 - DNA, 41 bp, Homo sapiens
tcgatgttggatcaggacatcccgatggtgcagccgctatt

SEQ ID NO: 11506 - DNA, 18 bp, Homo sapiens
cgatgttggatcaggaca

SEQ ID NO: 11507 - DNA, 19 bp, Homo sapiens
cgatgttggatcaggacat

SEQ ID NO: 11508 - DNA, 20 bp, Homo sapiens
cgatgttggatcaggacatc

SEQ ID NO: 11509 - DNA, 22 bp, Homo sapiens
cgatgttggatcaggacatccc

SEQ ID NO: 11510 - DNA, 29 bp, Homo sapiens
cgatgttggatcaggacatcccgatggtg

SEQ ID NO: 11511 - DNA, 30 bp, Homo sapiens; identical to SEQ ID NO: 1747

SEQ ID NO: 11512 - DNA, 31 bp, Homo sapiens; identical to SEQ ID NO: 1748

SEQ ID NO: 11513 - DNA, 32 bp, Homo sapiens
cgatgttggatcaggacatcccgatggtgcag

SEQ ID NO: 11514 - DNA, 33 bp, Homo sapiens
cgatgttggatcaggacatcccgatggtgcagc

SEQ ID NO: 11515 - DNA, 34 bp, Homo sapiens
cgatgttggatcaggacatcccgatggtgcagcc

SEQ ID NO: 11516 - DNA, 35 bp, Homo sapiens
cgatgttggatcaggacatcccgatggtgcagccg

SEQ ID NO: 11517 - DNA, 37 bp, Homo sapiens
cgatgttggatcaggacatcccgatggtgcagccgct

SEQ ID NO: 11518 - DNA, 47 bp, Homo sapiens
cgatgttggatcaggacatcccgatggtgcagccgctattaaaggtt

SEQ ID NO: 11519 - DNA, 17 bp, Homo sapiens
gatgttggatcaggaca

SEQ ID NO: 11520 - DNA, 19 bp, Homo sapiens
gatgttggatcaggacatc

SEQ ID NO: 11521 - DNA, 20 bp, Homo sapiens
gatgttggatcaggacatcc

SEQ ID NO: 11522 - DNA, 21 bp, Homo sapiens
gatgttggatcaggacatccc

SEQ ID NO: 11523 - DNA, 24 bp, Homo sapiens
gatgttggatcaggacatcccgat

SEQ ID NO: 11524 - DNA, 29 bp, Homo sapiens
gatgttggatcaggacatcccgatggtgc

SEQ ID NO: 11525 - DNA, 30 bp, Homo sapiens
gatgttggatcaggacatcccgatggtgca

SEQ ID NO: 11526 - DNA, 32 bp, Homo sapiens
gatgttggatcaggacatcccgatggtgcagc

SEQ ID NO: 11527 - DNA, 33 bp, Homo sapiens; identical to SEQ ID NO: 1750

SEQ ID NO: 11528 - DNA, 36 bp, Homo sapiens
gatgttggatcaggacatcccgatggtgcagccgct

SEQ ID NO: 11529 - DNA, 46 bp, Homo sapiens
gatgttggatcaggacatcccgatggtgcagccgctattaaaggtt

SEQ ID NO: 11530 - DNA, 16 bp, Homo sapiens
atgttggatcaggaca

SEQ ID NO: 11531 - DNA, 18 bp, Homo sapiens
atgttggatcaggacatc

SEQ ID NO: 11532 - DNA, 19 bp, Homo sapiens
atgttggatcaggacatcc

SEQ ID NO: 11533 - DNA, 20 bp, Homo sapiens
atgttggatcaggacatccc

SEQ ID NO: 11534 - DNA, 21 bp, Homo sapiens
atgttggatcaggacatcccg

SEQ ID NO: 11535 - DNA, 22 bp, Homo sapiens
atgttggatcaggacatcccga

SEQ ID NO: 11536 - DNA, 23 bp, Homo sapiens
atgttggatcaggacatcccgat

SEQ ID NO: 11537 - DNA, 24 bp, Homo sapiens
atgttggatcaggacatcccgatg

SEQ ID NO: 11538 - DNA, 26 bp, Homo sapiens
atgttggatcaggacatcccgatggt

SEQ ID NO: 11539 - DNA, 27 bp, Homo sapiens
atgttggatcaggacatcccgatggtg

SEQ ID NO: 11540 - DNA, 28 bp, Homo sapiens
atgttggatcaggacatcccgatggtgc

SEQ ID NO: 11541 - DNA, 29 bp, Homo sapiens
atgttggatcaggacatcccgatggtgca

SEQ ID NO: 11542 - DNA, 31 bp, Homo sapiens; identical to SEQ ID NO: 1757

SEQ ID NO: 11543 - DNA, 32 bp, Homo sapiens; identical to SEQ ID NO: 1758

SEQ ID NO: 11544 - DNA, 33 bp, Homo sapiens; identical to SEQ ID NO: 1759

SEQ ID NO: 11545 - DNA, 35 bp, Homo sapiens
atgttggatcaggacatcccgatggtgcagccgct

SEQ ID NO: 11546 - DNA, 45 bp, Homo sapiens
atgttggatcaggacatcccgatggtgcagccgctattaaaggtt

SEQ ID NO: 11547 - DNA, 17 bp, Homo sapiens
gttggatcaggacatcc

SEQ ID NO: 11548 - DNA, 18 bp, Homo sapiens
gttggatcaggacatccc

SEQ ID NO: 11549 - DNA, 16 bp, Homo sapiens
ttggatcaggacatcc

SEQ ID NO: 11550 - DNA, 17 bp, Homo sapiens
ttggatcaggacatccc

SEQ ID NO: 11551 - DNA, 29 bp, Homo sapiens
ttggatcaggacatcccgatggtgcagcc

SEQ ID NO: 11552 - DNA, 30 bp, Homo sapiens
ttggatcaggacatcccgatggtgcagccg

SEQ ID NO: 11553 - DNA, 32 bp, Homo sapiens
ttggatcaggacatcccgatggtgcagccgct

SEQ ID NO: 11554 - DNA, 23 bp, Homo sapiens
caggacatcccgatggtgcagcc

SEQ ID NO: 11555 - DNA, 22 bp, Homo sapiens
aggacatcccgatggtgcagcc

SEQ ID NO: 11556 - DNA, 18 bp, Homo sapiens
atcccgatggtgcagccg

SEQ ID NO: 11557 - DNA, 30 bp, Homo sapiens
cagccgctattaaaggttcgtttgttcaac

SEQ ID NO: 11558 - DNA, 26 bp, Homo sapiens
cgctattaaaggttcgtttgttcaac

SEQ ID NO: 11559 - DNA, 22 bp, Homo sapiens
gctattaaaggttcgtttgttc

SEQ ID NO: 11560 - DNA, 23 bp, Homo sapiens
gctattaaaggttcgtttgttca

SEQ ID NO: 11561 - DNA, 24 bp, Homo sapiens
gctattaaaggttcgtttgttcaa

SEQ ID NO: 11562 - DNA, 25 bp, Homo sapiens
gctattaaaggttcgtttgttcaac

SEQ ID NO: 11563 - DNA, 23 bp, Homo sapiens
ctattaaaggttcgtttgttcaa

SEQ ID NO: 11564 - DNA, 25 bp, Homo sapiens
ctattaaaggttcgtttgttcaacg

SEQ ID NO: 11565 - DNA, 23 bp, Homo sapiens
tattaaaggttcgtttgttcaac

SEQ ID NO: 11566 - DNA, 19 bp, Homo sapiens
attaaaggttcgtttgttc

SEQ ID NO: 11567 - DNA, 20 bp, Homo sapiens
attaaaggttcgtttgttca

SEQ ID NO: 11568 - DNA, 21 bp, Homo sapiens
attaaaggttcgtttgttcaa

SEQ ID NO: 11569 - DNA, 22 bp, Homo sapiens
attaaaggttcgtttgttcaac

SEQ ID NO: 11570 - DNA, 23 bp, Homo sapiens
attaaaggttcgtttgttcaacg

SEQ ID NO: 11571 - DNA, 20 bp, Homo sapiens
ttaaaggttcgtttgttcaa

SEQ ID NO: 11572 - DNA, 21 bp, Homo sapiens
ttaaaggttcgtttgttcaac

SEQ ID NO: 11573 - DNA, 22 bp, Homo sapiens
ttaaaggttcgtttgttcaacg

SEQ ID NO: 11574 - DNA, 20 bp, Homo sapiens
taaaggttcgtttgttcaac

SEQ ID NO: 11575 - DNA, 21 bp, Homo sapiens
taaaggttcgtttgttcaacg

SEQ ID NO: 11576 - DNA, 16 bp, Homo sapiens
aaaggttcgtttgttc

SEQ ID NO: 11577 - DNA, 17 bp, Homo sapiens
aaaggttcgtttgttca

SEQ ID NO: 11578 - DNA, 18 bp, Homo sapiens
aaaggttcgtttgttcaa

SEQ ID NO: 11579 - DNA, 19 bp, Homo sapiens
aaaggttcgtttgttcaac

SEQ ID NO: 11580 - DNA, 20 bp, Homo sapiens
aaaggttcgtttgttcaacg

SEQ ID NO: 11581 - DNA, 16 bp, Homo sapiens
aaggttcgtttgttca

SEQ ID NO: 11582 - DNA, 17 bp, Homo sapiens
aaggttcgtttgttcaa

SEQ ID NO: 11583 - DNA, 18 bp, Homo sapiens
aaggttcgtttgttcaac

SEQ ID NO: 11584 - DNA, 19 bp, Homo sapiens
aaggttcgtttgttcaacg

SEQ ID NO: 11585 - DNA, 17 bp, Homo sapiens
aggttcgtttgttcaac

SEQ ID NO: 11586 - DNA, 16 bp, Homo sapiens
ggttcgtttgttcaac

SEQ ID NO: 11587 - DNA, 23 bp, Homo sapiens
gtttgttcaacgattaaagtcct

SEQ ID NO: 11588 - DNA, 26 bp, Homo sapiens
gtttgttcaacgattaaagtcctacg

SEQ ID NO: 11589 - DNA, 35 bp, Homo sapiens
aacgattaaagtcctacgtgatctgagttcagacc

SEQ ID NO: 11590 - DNA, 36 bp, Homo sapiens
aacgattaaagtcctacgtgatctgagttcagaccg

SEQ ID NO: 11591 - DNA, 28 bp, Homo sapiens
acgattaaagtcctacgtgatctgagtt

SEQ ID NO: 11592 - DNA, 29 bp, Homo sapiens
acgattaaagtcctacgtgatctgagttc

SEQ ID NO: 11593 - DNA, 35 bp, Homo sapiens
acgattaaagtcctacgtgatctgagttcagaccg

SEQ ID NO: 11594 - DNA, 33 bp, Homo sapiens
cgattaaagtcctacgtgatctgagttcagacc

SEQ ID NO: 11595 - DNA, 34 bp, Homo sapiens
cgattaaagtcctacgtgatctgagttcagaccg

SEQ ID NO: 11596 - DNA, 31 bp, Homo sapiens
gattaaagtcctacgtgatctgagttcagac

SEQ ID NO: 11597 - DNA, 32 bp, Homo sapiens; identical to SEQ ID NO: 1770

SEQ ID NO: 11598 - DNA, 33 bp, Homo sapiens; identical to SEQ ID NO: 1771

SEQ ID NO: 11599 - DNA, 27 bp, Homo sapiens
attaaagtcctacgtgatctgagttca

SEQ ID NO: 11600 - DNA, 30 bp, Homo sapiens
attaaagtcctacgtgatctgagttcagac

SEQ ID NO: 11601 - DNA, 31 bp, Homo sapiens; identical to SEQ ID NO: 1772

SEQ ID NO: 11602 - DNA, 32 bp, Homo sapiens; identical to SEQ ID NO: 1773

SEQ ID NO: 11603 - DNA, 30 bp, Homo sapiens; identical to SEQ ID NO: 1774

SEQ ID NO: 11604 - DNA, 29 bp, Homo sapiens
taaagtcctacgtgatctgagttcagacc

SEQ ID NO: 11605 - DNA, 30 bp, Homo sapiens
taaagtcctacgtgatctgagttcagaccg

SEQ ID NO: 11606 - DNA, 27 bp, Homo sapiens
aaagtcctacgtgatctgagttcagac

SEQ ID NO: 11607 - DNA, 28 bp, Homo sapiens
aaagtcctacgtgatctgagttcagacc

SEQ ID NO: 11608 - DNA, 29 bp, Homo sapiens
aaagtcctacgtgatctgagttcagaccg

SEQ ID NO: 11609 - DNA, 26 bp, Homo sapiens
aagtcctacgtgatctgagttcagac

SEQ ID NO: 11610 - DNA, 27 bp, Homo sapiens
aagtcctacgtgatctgagttcagacc

SEQ ID NO: 11611 - DNA, 28 bp, Homo sapiens
aagtcctacgtgatctgagttcagaccg

SEQ ID NO: 11612 - DNA, 26 bp, Homo sapiens
agtcctacgtgatctgagttcagacc

SEQ ID NO: 11613 - DNA, 27 bp, Homo sapiens
agtcctacgtgatctgagttcagaccg

SEQ ID NO: 11614 - DNA, 24 bp, Homo sapiens
gtcctacgtgatctgagttcagac

SEQ ID NO: 11615 - DNA, 25 bp, Homo sapiens
gtcctacgtgatctgagttcagacc

SEQ ID NO: 11616 - DNA, 26 bp, Homo sapiens
gtcctacgtgatctgagttcagaccg

SEQ ID NO: 11617 - DNA, 24 bp, Homo sapiens
tcctacgtgatctgagttcagacc

SEQ ID NO: 11618 - DNA, 25 bp, Homo sapiens
tcctacgtgatctgagttcagaccg

SEQ ID NO: 11619 - DNA, 19 bp, Homo sapiens
cctacgtgatctgagttca

SEQ ID NO: 11620 - DNA, 23 bp, Homo sapiens
cctacgtgatctgagttcagacc

SEQ ID NO: 11621 - DNA, 24 bp, Homo sapiens
cctacgtgatctgagttcagaccg

SEQ ID NO: 11622 - DNA, 18 bp, Homo sapiens
ctacgtgatctgagttca

SEQ ID NO: 11623 - DNA, 21 bp, Homo sapiens
ctacgtgatctgagttcagac

SEQ ID NO: 11624 - DNA, 22 bp, Homo sapiens
ctacgtgatctgagttcagacc

SEQ ID NO: 11625 - DNA, 23 bp, Homo sapiens
ctacgtgatctgagttcagaccg

SEQ ID NO: 11626 - DNA, 16 bp, Homo sapiens
tacgtgatctgagttc

SEQ ID NO: 11627 - DNA, 17 bp, Homo sapiens
tacgtgatctgagttca

SEQ ID NO: 11628 - DNA, 20 bp, Homo sapiens
tacgtgatctgagttcagac

SEQ ID NO: 11629 - DNA, 21 bp, Homo sapiens
tacgtgatctgagttcagacc

SEQ ID NO: 11630 - DNA, 22 bp, Homo sapiens
tacgtgatctgagttcagaccg

SEQ ID NO: 11631 - DNA, 26 bp, Homo sapiens
tacgtgatctgagttcagaccggagt

SEQ ID NO: 11632 - DNA, 36 bp, Homo sapiens
tacgtgatctgagttcagaccggagtaatccaggtc

SEQ ID NO: 11633 - DNA, 37 bp, Homo sapiens
tacgtgatctgagttcagaccggagtaatccaggtcg

SEQ ID NO: 11634 - DNA, 40 bp, Homo sapiens
tacgtgatctgagttcagaccggagtaatccaggtcggtt

SEQ ID NO: 11635 - DNA, 42 bp, Homo sapiens
tacgtgatctgagttcagaccggagtaatccaggtcggtttc

SEQ ID NO: 11636 - DNA, 16 bp, Homo sapiens
acgtgatctgagttca

SEQ ID NO: 11637 - DNA, 19 bp, Homo sapiens
acgtgatctgagttcagac

SEQ ID NO: 11638 - DNA, 20 bp, Homo sapiens
acgtgatctgagttcagacc

SEQ ID NO: 11639 - DNA, 21 bp, Homo sapiens
acgtgatctgagttcagaccg

SEQ ID NO: 11640 - DNA, 19 bp, Homo sapiens
cgtgatctgagttcagacc

SEQ ID NO: 11641 - DNA, 33 bp, Homo sapiens
tctgagttcagaccggagtaatccaggtcggtt

SEQ ID NO: 11642 - DNA, 24 bp, Homo sapiens
ccggagtaatccaggtcggtttct

SEQ ID NO: 11643 - DNA, 20 bp, Homo sapiens
cggagtaatccaggtcggtt

SEQ ID NO: 11644 - DNA, 22 bp, Homo sapiens
cggagtaatccaggtcggtttc

SEQ ID NO: 11645 - DNA, 23 bp, Homo sapiens
cggagtaatccaggtcggtttct

SEQ ID NO: 11646 - DNA, 26 bp, Homo sapiens
cggagtaatccaggtcggtttctatc

SEQ ID NO: 11647 - DNA, 27 bp, Homo sapiens
cggagtaatccaggtcggtttctatct

SEQ ID NO: 11648 - DNA, 21 bp, Homo sapiens
ggagtaatccaggtcggtttc

SEQ ID NO: 11649 - DNA, 22 bp, Homo sapiens
ggagtaatccaggtcggtttct

SEQ ID NO: 11650 - DNA, 18 bp, Homo sapiens
gagtaatccaggtcggtt

SEQ ID NO: 11651 - DNA, 19 bp, Homo sapiens
gagtaatccaggtcggttt

SEQ ID NO: 11652 - DNA, 20 bp, Homo sapiens
gagtaatccaggtcggtttc

SEQ ID NO: 11653 - DNA, 21 bp, Homo sapiens
gagtaatccaggtcggtttct

SEQ ID NO: 11654 - DNA, 22 bp, Homo sapiens
gagtaatccaggtcggtttcta

SEQ ID NO: 11655 - DNA, 25 bp, Homo sapiens
gagtaatccaggtcggtttctatct

SEQ ID NO: 11656 - DNA, 19 bp, Homo sapiens
agtaatccaggtcggtttc

SEQ ID NO: 11657 - DNA, 20 bp, Homo sapiens
agtaatccaggtcggtttct

SEQ ID NO: 11658 - DNA, 21 bp, Homo sapiens
taatccaggtcggtttctatc

SEQ ID NO: 11659 - DNA, 22 bp, Homo sapiens
taatccaggtcggtttctatct

SEQ ID NO: 11660 - DNA, 16 bp, Homo sapiens
aatccaggtcggtttc

SEQ ID NO: 11661 - DNA, 17 bp, Homo sapiens
aatccaggtcggtttct

SEQ ID NO: 11662 - DNA, 21 bp, Homo sapiens
aatccaggtcggtttctatct

SEQ ID NO: 11663 - DNA, 16 bp, Homo sapiens
atccaggtcggtttct

SEQ ID NO: 11664 - DNA, 19 bp, Homo sapiens
atccaggtcggtttctatc

SEQ ID NO: 11665 - DNA, 20 bp, Homo sapiens
atccaggtcggtttctatct

SEQ ID NO: 11666 - DNA, 22 bp, Homo sapiens
atccaggtcggtttctatctac

SEQ ID NO: 11667 - DNA, 18 bp, Homo sapiens
tccaggtcggtttctatc

SEQ ID NO: 11668 - DNA, 17 bp, Homo sapiens
ccaggtcggtttctatc

SEQ ID NO: 11669 - DNA, 16 bp, Homo sapiens
caggtcggtttctatc

SEQ ID NO: 11670 - DNA, 16 bp, Homo sapiens
aggtcggtttctatct

SEQ ID NO: 11671 - DNA, 24 bp, Homo sapiens
ttcaaattcctccctgtacgaaag

SEQ ID NO: 11672 - DNA, 27 bp, Homo sapiens
ttcaaattcctccctgtacgaaaggac

SEQ ID NO: 11673 - DNA, 30 bp, Homo sapiens
ttcaaattcctccctgtacgaaaggacaag

SEQ ID NO: 11674 - DNA, 23 bp, Homo sapiens
tcaaattcctccctgtacgaaag

SEQ ID NO: 11675 - DNA, 26 bp, Homo sapiens
tcaaattcctccctgtacgaaaggac

SEQ ID NO: 11676 - DNA, 27 bp, Homo sapiens
tcaaattcctccctgtacgaaaggaca

SEQ ID NO: 11677 - DNA, 29 bp, Homo sapiens
tcaaattcctccctgtacgaaaggacaag

SEQ ID NO: 11678 - DNA, 33 bp, Homo sapiens
tcaaattcctccctgtacgaaaggacaagagaa

SEQ ID NO: 11679 - DNA, 22 bp, Homo sapiens
caaattcctccctgtacgaaag

SEQ ID NO: 11680 - DNA, 25 bp, Homo sapiens
caaattcctccctgtacgaaaggac

SEQ ID NO: 11681 - DNA, 28 bp, Homo sapiens
caaattcctccctgtacgaaaggacaag

SEQ ID NO: 11682 - DNA, 32 bp, Homo sapiens
caaattcctccctgtacgaaaggacaagagaa

SEQ ID NO: 11683 - DNA, 21 bp, Homo sapiens
aaattcctccctgtacgaaag

SEQ ID NO: 11684 - DNA, 24 bp, Homo sapiens
aaattcctccctgtacgaaaggac

SEQ ID NO: 11685 - DNA, 25 bp, Homo sapiens
aaattcctccctgtacgaaaggaca

SEQ ID NO: 11686 - DNA, 27 bp, Homo sapiens
aaattcctccctgtacgaaaggacaag

SEQ ID NO: 11687 - DNA, 29 bp, Homo sapiens
aaattcctccctgtacgaaaggacaagag

SEQ ID NO: 11688 - DNA, 31 bp, Homo sapiens
aaattcctccctgtacgaaaggacaagagaa

SEQ ID NO: 11689 - DNA, 19 bp, Homo sapiens
aattcctccctgtacgaaa

SEQ ID NO: 11690 - DNA, 20 bp, Homo sapiens
aattcctccctgtacgaaag

SEQ ID NO: 11691 - DNA, 23 bp, Homo sapiens
aattcctccctgtacgaaaggac

SEQ ID NO: 11692 - DNA, 24 bp, Homo sapiens
aattcctccctgtacgaaaggaca

SEQ ID NO: 11693 - DNA, 25 bp, Homo sapiens
aattcctccctgtacgaaaggacaa

SEQ ID NO: 11694 - DNA, 26 bp, Homo sapiens
aattcctccctgtacgaaaggacaag

SEQ ID NO: 11695 - DNA, 28 bp, Homo sapiens
aattcctccctgtacgaaaggacaagag

SEQ ID NO: 11696 - DNA, 29 bp, Homo sapiens
aattcctccctgtacgaaaggacaagaga

SEQ ID NO: 11697 - DNA, 30 bp, Homo sapiens; identical to SEQ ID NO: 1818

SEQ ID NO: 11698 - DNA, 38 bp, Homo sapiens
aattcctccctgtacgaaaggacaagagaaataaggcc

SEQ ID NO: 11699 - DNA, 19 bp, Homo sapiens
attcctccctgtacgaaag

SEQ ID NO: 11700 - DNA, 22 bp, Homo sapiens
attcctccctgtacgaaaggac

SEQ ID NO: 11701 - DNA, 23 bp, Homo sapiens
attcctccctgtacgaaaggaca

SEQ ID NO: 11702 - DNA, 25 bp, Homo sapiens
attcctccctgtacgaaaggacaag

SEQ ID NO: 11703 - DNA, 26 bp, Homo sapiens
attcctccctgtacgaaaggacaaga

SEQ ID NO: 11704 - DNA, 27 bp, Homo sapiens
attcctccctgtacgaaaggacaagag

SEQ ID NO: 11705 - DNA, 28 bp, Homo sapiens
attcctccctgtacgaaaggacaagaga

SEQ ID NO: 11706 - DNA, 22 bp, Homo sapiens
ttcctccctgtacgaaaggaca

SEQ ID NO: 11707 - DNA, 24 bp, Homo sapiens
ttcctccctgtacgaaaggacaag

SEQ ID NO: 11708 - DNA, 25 bp, Homo sapiens
ttcctccctgtacgaaaggacaaga

SEQ ID NO: 11709 - DNA, 21 bp, Homo sapiens
tcctccctgtacgaaaggaca

SEQ ID NO: 11710 - DNA, 19 bp, Homo sapiens
cctccctgtacgaaaggac

SEQ ID NO: 11711 - DNA, 20 bp, Homo sapiens
cctccctgtacgaaaggaca

SEQ ID NO: 11712 - DNA, 22 bp, Homo sapiens
cctccctgtacgaaaggacaag

SEQ ID NO: 11713 - DNA, 23 bp, Homo sapiens
cctccctgtacgaaaggacaaga

SEQ ID NO: 11714 - DNA, 18 bp, Homo sapiens
ctccctgtacgaaaggac

SEQ ID NO: 11715 - DNA, 19 bp, Homo sapiens
ctccctgtacgaaaggaca

SEQ ID NO: 11716 - DNA, 21 bp, Homo sapiens
ctccctgtacgaaaggacaag

SEQ ID NO: 11717 - DNA, 33 bp, Homo sapiens; identical to SEQ ID NO: 1827

SEQ ID NO: 11718 - DNA, 17 bp, Homo sapiens
tccctgtacgaaaggac

SEQ ID NO: 11719 - DNA, 18 bp, Homo sapiens
tccctgtacgaaaggaca

SEQ ID NO: 11720 - DNA, 32 bp, Homo sapiens; identical to SEQ ID NO: 1829

SEQ ID NO: 11721 - DNA, 33 bp, Homo sapiens; identical to SEQ ID NO: 1830

SEQ ID NO: 11722 - DNA, 17 bp, Homo sapiens
ccctgtacgaaaggaca

SEQ ID NO: 11723 - DNA, 23 bp, Homo sapiens
ccctgtacgaaaggacaagagaa

SEQ ID NO: 11724 - DNA, 31 bp, Homo sapiens; identical to SEQ ID NO: 1832

SEQ ID NO: 11725 - DNA, 32 bp, Homo sapiens; identical to SEQ ID NO: 1833

SEQ ID NO: 11726 - DNA, 16 bp, Homo sapiens
cctgtacgaaaggaca

SEQ ID NO: 11727 - DNA, 30 bp, Homo sapiens; identical to SEQ ID NO: 1834

SEQ ID NO: 11728 - DNA, 31 bp, Homo sapiens
cctgtacgaaaggacaagagaaataaggcct

SEQ ID NO: 11729 - DNA, 21 bp, Homo sapiens
ctgtacgaaaggacaagagaa

SEQ ID NO: 11730 - DNA, 29 bp, Homo sapiens
ctgtacgaaaggacaagagaaataaggcc

SEQ ID NO: 11731 - DNA, 30 bp, Homo sapiens; identical to SEQ ID NO: 1836

SEQ ID NO: 11732 - DNA, 33 bp, Homo sapiens; identical to SEQ ID NO: 1837

SEQ ID NO: 11733 - DNA, 20 bp, Homo sapiens
tgtacgaaaggacaagagaa

SEQ ID NO: 11734 - DNA, 28 bp, Homo sapiens
tgtacgaaaggacaagagaaataaggcc

SEQ ID NO: 11735 - DNA, 29 bp, Homo sapiens
tgtacgaaaggacaagagaaataaggcct

SEQ ID NO: 11736 - DNA, 32 bp, Homo sapiens; identical to SEQ ID NO: 1840

SEQ ID NO: 11737 - DNA, 33 bp, Homo sapiens
tgtacgaaaggacaagagaaataaggcctactt

SEQ ID NO: 11738 - DNA, 27 bp, Homo sapiens
gtacgaaaggacaagagaaataaggcc

SEQ ID NO: 11739 - DNA, 28 bp, Homo sapiens
gtacgaaaggacaagagaaataaggcct

SEQ ID NO: 11740 - DNA, 31 bp, Homo sapiens; identical to SEQ ID NO: 1843

SEQ ID NO: 11741 - DNA, 26 bp, Homo sapiens
tacgaaaggacaagagaaataaggcc

SEQ ID NO: 11742 - DNA, 27 bp, Homo sapiens
tacgaaaggacaagagaaataaggcct

SEQ ID NO: 11743 - DNA, 30 bp, Homo sapiens; identical to SEQ ID NO: 1845

SEQ ID NO: 11744 - DNA, 25 bp, Homo sapiens
acgaaaggacaagagaaataaggcc

SEQ ID NO: 11745 - DNA, 26 bp, Homo sapiens
acgaaaggacaagagaaataaggcct

SEQ ID NO: 11746 - DNA, 29 bp, Homo sapiens
acgaaaggacaagagaaataaggcctact

SEQ ID NO: 11747 - DNA, 46 bp, Homo sapiens
acgaaaggacaagagaaataaggcctacttcacaaagcgccttccc

SEQ ID NO: 11748 - DNA, 47 bp, Homo sapiens
acgaaaggacaagagaaataaggcctacttcacaaagcgccttcccc

SEQ ID NO: 11749 - DNA, 24 bp, Homo sapiens
cgaaaggacaagagaaataaggcc

SEQ ID NO: 11750 - DNA, 25 bp, Homo sapiens
cgaaaggacaagagaaataaggcct

SEQ ID NO: 11751 - DNA, 28 bp, Homo sapiens
cgaaaggacaagagaaataaggcctact

SEQ ID NO: 11752 - DNA, 45 bp, Homo sapiens
cgaaaggacaagagaaataaggcctacttcacaaagcgccttccc

SEQ ID NO: 11753 - DNA, 23 bp, Homo sapiens
gaaaggacaagagaaataaggcc

SEQ ID NO: 11754 - DNA, 24 bp, Homo sapiens
gaaaggacaagagaaataaggcct

SEQ ID NO: 11755 - DNA, 27 bp, Homo sapiens
gaaaggacaagagaaataaggcctact

SEQ ID NO: 11756 - DNA, 44 bp, Homo sapiens
gaaaggacaagagaaataaggcctacttcacaaagcgccttccc

SEQ ID NO: 11757 - DNA, 19 bp, Homo sapiens
aaaggacaagagaaataag

SEQ ID NO: 11758 - DNA, 21 bp, Homo sapiens
aaaggacaagagaaataaggc

SEQ ID NO: 11759 - DNA, 22 bp, Homo sapiens
aaaggacaagagaaataaggcc

SEQ ID NO: 11760 - DNA, 23 bp, Homo sapiens
aaaggacaagagaaataaggcct

SEQ ID NO: 11761 - DNA, 26 bp, Homo sapiens
aaaggacaagagaaataaggcctact

SEQ ID NO: 11762 - DNA, 27 bp, Homo sapiens
aaaggacaagagaaataaggcctactt

SEQ ID NO: 11763 - DNA, 28 bp, Homo sapiens
aaaggacaagagaaataaggcctacttc

SEQ ID NO: 11764 - DNA, 29 bp, Homo sapiens
aaaggacaagagaaataaggcctacttca

SEQ ID NO: 11765 - DNA, 31 bp, Homo sapiens
aaaggacaagagaaataaggcctacttcaca

SEQ ID NO: 11766 - DNA, 42 bp, Homo sapiens
aaaggacaagagaaataaggcctacttcacaaagcgccttcc

SEQ ID NO: 11767 - DNA, 43 bp, Homo sapiens
aaaggacaagagaaataaggcctacttcacaaagcgccttccc

SEQ ID NO: 11768 - DNA, 44 bp, Homo sapiens
aaaggacaagagaaataaggcctacttcacaaagcgccttcccc

SEQ ID NO: 11769 - DNA, 45 bp, Homo sapiens
aaaggacaagagaaataaggcctacttcacaaagcgccttccccc

SEQ ID NO: 11770 - DNA, 19 bp, Homo sapiens
aaggacaagagaaataagg

SEQ ID NO: 11771 - DNA, 21 bp, Homo sapiens
aaggacaagagaaataaggcc

SEQ ID NO: 11772 - DNA, 22 bp, Homo sapiens
aaggacaagagaaataaggcct

SEQ ID NO: 11773 - DNA, 25 bp, Homo sapiens
aaggacaagagaaataaggcctact

SEQ ID NO: 11774 - DNA, 30 bp, Homo sapiens
aaggacaagagaaataaggcctacttcaca

SEQ ID NO: 11775 - DNA, 20 bp, Homo sapiens
aggacaagagaaataaggcc

SEQ ID NO: 11776 - DNA, 21 bp, Homo sapiens
aggacaagagaaataaggcct

SEQ ID NO: 11777 - DNA, 24 bp, Homo sapiens
aggacaagagaaataaggcctact

SEQ ID NO: 11778 - DNA, 18 bp, Homo sapiens
gacaagagaaataaggcc

SEQ ID NO: 11779 - DNA, 28 bp, Homo sapiens
cctacttcacaaagcgccttcccccgta

SEQ ID NO: 11780 - DNA, 16 bp, Homo sapiens
acttcacaaagcgcct

SEQ ID NO: 11781 - DNA, 32 bp, Homo sapiens
agcgccttcccccgtaaatgatatcatctcaa

SEQ ID NO: 11782 - DNA, 21 bp, Homo sapiens
cccgtaaatgatatcatctca

SEQ ID NO: 11783 - DNA, 24 bp, Homo sapiens
cccgtaaatgatatcatctcaact

SEQ ID NO: 11784 - DNA, 28 bp, Homo sapiens
cccgtaaatgatatcatctcaacttagt

SEQ ID NO: 11785 - DNA, 29 bp, Homo sapiens
cccgtaaatgatatcatctcaacttagta

SEQ ID NO: 11786 - DNA, 30 bp, Homo sapiens
cccgtaaatgatatcatctcaacttagtat

SEQ ID NO: 11787 - DNA, 31 bp, Homo sapiens
cccgtaaatgatatcatctcaacttagtatt

SEQ ID NO: 11788 - DNA, 32 bp, Homo sapiens
cccgtaaatgatatcatctcaacttagtatta

SEQ ID NO: 11789 - DNA, 34 bp, Homo sapiens
cccgtaaatgatatcatctcaacttagtattata

SEQ ID NO: 11790 - DNA, 27 bp, Homo sapiens
ccgtaaatgatatcatctcaacttagt

SEQ ID NO: 11791 - DNA, 28 bp, Homo sapiens
ccgtaaatgatatcatctcaacttagta

SEQ ID NO: 11792 - DNA, 31 bp, Homo sapiens
ccgtaaatgatatcatctcaacttagtatta

SEQ ID NO: 11793 - DNA, 26 bp, Homo sapiens
cgtaaatgatatcatctcaacttagt

SEQ ID NO: 11794 - DNA, 27 bp, Homo sapiens
cgtaaatgatatcatctcaacttagta

SEQ ID NO: 11795 - DNA, 26 bp, Homo sapiens
gtaaatgatatcatctcaacttagta

SEQ ID NO: 11796 - DNA, 33 bp, Homo sapiens
gtaaatgatatcatctcaacttagtattatacc

SEQ ID NO: 11797 - DNA, 33 bp, Homo sapiens
taaatgatatcatctcaacttagtattataccc

SEQ ID NO: 11798 - DNA, 39 bp, Homo sapiens
taaatgatatcatctcaacttagtattatacccacaccc

SEQ ID NO: 11799 - DNA, 30 bp, Homo sapiens
aatgatatcatctcaacttagtattatacc

SEQ ID NO: 11800 - DNA, 31 bp, Homo sapiens
aatgatatcatctcaacttagtattataccc

SEQ ID NO: 11801 - DNA, 37 bp, Homo sapiens
aatgatatcatctcaacttagtattatacccacaccc

SEQ ID NO: 11802 - DNA, 41 bp, Homo sapiens
aatgatatcatctcaacttagtattatacccacacccaccc

SEQ ID NO: 11803 - DNA, 20 bp, Homo sapiens
tgatatcatctcaacttagt

SEQ ID NO: 11804 - DNA, 21 bp, Homo sapiens
tgatatcatctcaacttagta

SEQ ID NO: 11805 - DNA, 33 bp, Homo sapiens
gatatcatctcaacttagtattatacccacacc

SEQ ID NO: 11806 - DNA, 34 bp, Homo sapiens
gatatcatctcaacttagtattatacccacaccc

SEQ ID NO: 11807 - DNA, 38 bp, Homo sapiens
gatatcatctcaacttagtattatacccacacccaccc

SEQ ID NO: 11808 - DNA, 26 bp, Homo sapiens
atatcatctcaacttagtattatacc

SEQ ID NO: 11809 - DNA, 27 bp, Homo sapiens
atatcatctcaacttagtattataccc

SEQ ID NO: 11810 - DNA, 32 bp, Homo sapiens
atatcatctcaacttagtattatacccacacc

SEQ ID NO: 11811 - DNA, 33 bp, Homo sapiens; identical to SEQ ID NO: 1860

SEQ ID NO: 11812 - DNA, 37 bp, Homo sapiens
atatcatctcaacttagtattatacccacacccaccc

SEQ ID NO: 11813 - DNA, 32 bp, Homo sapiens
tatcatctcaacttagtattatacccacaccc

SEQ ID NO: 11814 - DNA, 31 bp, Homo sapiens
atcatctcaacttagtattatacccacaccc

SEQ ID NO: 11815 - DNA, 30 bp, Homo sapiens
tcatctcaacttagtattatacccacaccc

SEQ ID NO: 11816 - DNA, 23 bp, Homo sapiens
catctcaacttagtattataccc

SEQ ID NO: 11817 - DNA, 28 bp, Homo sapiens
catctcaacttagtattatacccacacc

SEQ ID NO: 11818 - DNA, 29 bp, Homo sapiens
catctcaacttagtattatacccacaccc

SEQ ID NO: 11819 - DNA, 30 bp, Homo sapiens
catctcaacttagtattatacccacaccca

SEQ ID NO: 11820 - DNA, 32 bp, Homo sapiens
catctcaacttagtattatacccacacccacc

SEQ ID NO: 11821 - DNA, 33 bp, Homo sapiens
catctcaacttagtattatacccacacccaccc

SEQ ID NO: 11822 - DNA, 28 bp, Homo sapiens
atctcaacttagtattatacccacaccc

SEQ ID NO: 11823 - DNA, 29 bp, Homo sapiens
atctcaacttagtattatacccacaccca

SEQ ID NO: 11824 - DNA, 32 bp, Homo sapiens
atctcaacttagtattatacccacacccaccc

SEQ ID NO: 11825 - DNA, 26 bp, Homo sapiens
tctcaacttagtattatacccacacc

SEQ ID NO: 11826 - DNA, 27 bp, Homo sapiens
tctcaacttagtattatacccacaccc

SEQ ID NO: 11827 - DNA, 31 bp, Homo sapiens
tctcaacttagtattatacccacacccaccc

SEQ ID NO: 11828 - DNA, 26 bp, Homo sapiens
ctcaacttagtattatacccacaccc

SEQ ID NO: 11829 - DNA, 30 bp, Homo sapiens
ctcaacttagtattatacccacacccaccc

SEQ ID NO: 11830 - DNA, 29 bp, Homo sapiens
tcaacttagtattatacccacacccaccc

SEQ ID NO: 11831 - DNA, 23 bp, Homo sapiens
caacttagtattatacccacacc

SEQ ID NO: 11832 - DNA, 24 bp, Homo sapiens
caacttagtattatacccacaccc

SEQ ID NO: 11833 - DNA, 27 bp, Homo sapiens
caacttagtattatacccacacccacc

SEQ ID NO: 11834 - DNA, 28 bp, Homo sapiens
caacttagtattatacccacacccaccc

SEQ ID NO: 11835 - DNA, 29 bp, Homo sapiens
caacttagtattatacccacacccaccca

SEQ ID NO: 11836 - DNA, 31 bp, Homo sapiens
caacttagtattatacccacacccacccaag

SEQ ID NO: 11837 - DNA, 33 bp, Homo sapiens
caacttagtattatacccacacccacccaagaa

SEQ ID NO: 11838 - DNA, 22 bp, Homo sapiens
aacttagtattatacccacacc

SEQ ID NO: 11839 - DNA, 23 bp, Homo sapiens
aacttagtattatacccacaccc

SEQ ID NO: 11840 - DNA, 27 bp, Homo sapiens
aacttagtattatacccacacccaccc

SEQ ID NO: 11841 - DNA, 22 bp, Homo sapiens
acttagtattatacccacaccc

SEQ ID NO: 11842 - DNA, 25 bp, Homo sapiens
acttagtattatacccacacccacc

SEQ ID NO: 11843 - DNA, 26 bp, Homo sapiens
acttagtattatacccacacccaccc

SEQ ID NO: 11844 - DNA, 25 bp, Homo sapiens
cttagtattatacccacacccaccc

SEQ ID NO: 11845 - DNA, 23 bp, Homo sapiens
tagtattatacccacacccaccc

SEQ ID NO: 11846 - DNA, 32 bp, Homo sapiens
tattatacccacacccacccaagaacagggtt

SEQ ID NO: 11847 - DNA, 33 bp, Homo sapiens
attatacccacacccacccaagaacagggtttg

SEQ ID NO: 11848 - DNA, 33 bp, Homo sapiens
atacccacacccacccaagaacagggtttgtta

SEQ ID NO: 11849 - DNA, 30 bp, Homo sapiens
cccacacccacccaagaacagggtttgtta

SEQ ID NO: 11850 - DNA, 18 bp, Homo sapiens
cacacccacccaagaaca

SEQ ID NO: 11851 - DNA, 17 bp, Homo sapiens
cccaagaacagggtttg

SEQ ID NO: 11852 - DNA, 18 bp, Homo sapiens
cccaagaacagggtttgt

SEQ ID NO: 11853 - DNA, 20 bp, Homo sapiens
cccaagaacagggtttgtta

SEQ ID NO: 11854 - DNA, 21 bp, Homo sapiens
cccaagaacagggtttgttaa

SEQ ID NO: 11855 - DNA, 16 bp, Homo sapiens
ccaagaacagggtttg

SEQ ID NO: 11856 - DNA, 17 bp, Homo sapiens
ccaagaacagggtttgt

SEQ ID NO: 11857 - DNA, 19 bp, Homo sapiens
ccaagaacagggtttgtta

SEQ ID NO: 11858 - DNA, 16 bp, Homo sapiens
caagaacagggtttgt

SEQ ID NO: 11859 - DNA, 17 bp, Homo sapiens
caagaacagggtttgtt

SEQ ID NO: 11860 - DNA, 18 bp, Homo sapiens
caagaacagggtttgtta

SEQ ID NO: 11861 - DNA, 19 bp, Homo sapiens
caagaacagggtttgttaa

SEQ ID NO: 11862 - DNA, 16 bp, Homo sapiens
aagaacagggtttgtt

SEQ ID NO: 11863 - DNA, 17 bp, Homo sapiens
aagaacagggtttgtta

SEQ ID NO: 11864 - DNA, 18 bp, Homo sapiens
aagaacagggtttgttaa

SEQ ID NO: 11865 - DNA, 20 bp, Homo sapiens
aagaacagggtttgttaaga

SEQ ID NO: 11866 - DNA, 16 bp, Homo sapiens
agaacagggtttgtta

SEQ ID NO: 11867 - DNA, 22 bp, Homo sapiens
aggcaggagaatcgcttgaacc

SEQ ID NO: 11868 - DNA, 16 bp, Homo sapiens
ggagaatcgcttgaac

SEQ ID NO: 11869 - DNA, 24 bp, Homo sapiens
ctgaggcaggagaatcgcttgaac

SEQ ID NO: 11870 - DNA, 20 bp, Homo sapiens
cctgcctcagcctcccgagt

SEQ ID NO: 11871 - DNA, 17 bp, Homo sapiens
gctactcgggaggctga

SEQ ID NO: 11872 - DNA, 16 bp, Homo sapiens
ggagaatcgcttgaac

SEQ ID NO: 11873 - DNA, 24 bp, Homo sapiens
ctgaggcaggagaatcgcttgaac

SEQ ID NO: 11874 - DNA, 16 bp, Homo sapiens
cccaggctggagtgca

SEQ ID NO: 11875 - DNA, 33 bp, Homo sapiens
tgaggcaggagaatggcgtgaacccgggaggcg

SEQ ID NO: 11876 - DNA, 19 bp, Homo sapiens
atggcgtgaacccgggagg

SEQ ID NO: 11877 - DNA, 26 bp, Homo sapiens
tgaggcaggagaatggcgtgaacccg

SEQ ID NO: 11878 - DNA, 24 bp, Homo sapiens
cgggcgcctgtagtcccagctact

SEQ ID NO: 11879 - DNA, 24 bp, Homo sapiens
ctgaggcaggagaatcgcttgaac

SEQ ID NO: 11880 - DNA, 22 bp, Homo sapiens
aggcaggagaatcgcttgaacc

SEQ ID NO: 11881 - DNA, 16 bp, Homo sapiens
ggagaatcgcttgaac

SEQ ID NO: 11882 - DNA, 24 bp, Homo sapiens
ctgaggcaggagaatcgcttgaac

SEQ ID NO: 11883 - DNA, 22 bp, Homo sapiens
aggcaggagaatcgcttgaacc

SEQ ID NO: 11884 - DNA, 16 bp, Homo sapiens
ggagaatcgcttgaac

SEQ ID NO: 11885 - DNA, 18 bp, Homo sapiens
cgagatcgcgccactgca

SEQ ID NO: 11886 - DNA, 22 bp, Homo sapiens
aggcaggagaatcgcttgaacc

SEQ ID NO: 11887 - DNA, 16 bp, Homo sapiens
ggagaatcgcttgaac

SEQ ID NO: 11888 - DNA, 24 bp, Homo sapiens
ctgaggcaggagaatcgcttgaac

SEQ ID NO: 11889 - DNA, 16 bp, Homo sapiens
gtgggggagaggctgt

SEQ ID NO: 11890 - DNA, 17 bp, Homo sapiens
gtgggggagaggctgtc

SEQ ID NO: 11891 - DNA, 24 bp, Homo sapiens
gctgacacgctgtcctctggcgac

SEQ ID NO: 11892 - DNA, 25 bp, Homo sapiens
gctgacacgctgtcctctggcgacc

SEQ ID NO: 11893 - DNA, 26 bp, Homo sapiens
gctgacacgctgtcctctggcgacct

SEQ ID NO: 11894 - DNA, 27 bp, Homo sapiens
gctgacacgctgtcctctggcgacctg

SEQ ID NO: 11895 - DNA, 23 bp, Homo sapiens
ttccccggagtggggggttggcc

SEQ ID NO: 11896 - DNA, 23 bp, Homo sapiens
tcttcgtgatcgatgtggtgacg

SEQ ID NO: 11897 - DNA, 25 bp, Homo sapiens
tcttcgtgatcgatgtggtgacgtc

SEQ ID NO: 11898 - DNA, 30 bp, Homo sapiens; identical to SEQ ID NO: 1870

SEQ ID NO: 11899 - DNA, 32 bp, Homo sapiens
tcttcgtgatcgatgtggtgacgtcgtgctct

SEQ ID NO: 11900 - DNA, 17 bp, Homo sapiens
cttcgtgatcgatgtgg

SEQ ID NO: 11901 - DNA, 20 bp, Homo sapiens
cttcgtgatcgatgtggtga

SEQ ID NO: 11902 - DNA, 21 bp, Homo sapiens
cttcgtgatcgatgtggtgac

SEQ ID NO: 11903 - DNA, 22 bp, Homo sapiens
cttcgtgatcgatgtggtgacg

SEQ ID NO: 11904 - DNA, 23 bp, Homo sapiens
cttcgtgatcgatgtggtgacgt

SEQ ID NO: 11905 - DNA, 24 bp, Homo sapiens
cttcgtgatcgatgtggtgacgtc

SEQ ID NO: 11906 - DNA, 25 bp, Homo sapiens
cttcgtgatcgatgtggtgacgtcg

SEQ ID NO: 11907 - DNA, 27 bp, Homo sapiens
cttcgtgatcgatgtggtgacgtcgtg

SEQ ID NO: 11908 - DNA, 28 bp, Homo sapiens
cttcgtgatcgatgtggtgacgtcgtgc

SEQ ID NO: 11909 - DNA, 29 bp, Homo sapiens
cttcgtgatcgatgtggtgacgtcgtgct

SEQ ID NO: 11910 - DNA, 30 bp, Homo sapiens; identical to SEQ ID NO: 1878

SEQ ID NO: 11911 - DNA, 31 bp, Homo sapiens; identical to SEQ ID NO: 1879

SEQ ID NO: 11912 - DNA, 32 bp, Homo sapiens; identical to SEQ ID NO: 1880

SEQ ID NO: 11913 - DNA, 33 bp, Homo sapiens; identical to SEQ ID NO: 1881

SEQ ID NO: 11914 - DNA, 34 bp, Homo sapiens
cttcgtgatcgatgtggtgacgtcgtgctctccc

SEQ ID NO: 11915 - DNA, 35 bp, Homo sapiens
cttcgtgatcgatgtggtgacgtcgtgctctcccg

SEQ ID NO: 11916 - DNA, 36 bp, Homo sapiens
cttcgtgatcgatgtggtgacgtcgtgctctcccgg

SEQ ID NO: 11917 - DNA, 37 bp, Homo sapiens
cttcgtgatcgatgtggtgacgtcgtgctctcccggg

SEQ ID NO: 11918 - DNA, 38 bp, Homo sapiens
cttcgtgatcgatgtggtgacgtcgtgctctcccgggc

SEQ ID NO: 11919 - DNA, 39 bp, Homo sapiens
cttcgtgatcgatgtggtgacgtcgtgctctcccgggcc

SEQ ID NO: 11920 - DNA, 40 bp, Homo sapiens
cttcgtgatcgatgtggtgacgtcgtgctctcccgggccg

SEQ ID NO: 11921 - DNA, 41 bp, Homo sapiens
cttcgtgatcgatgtggtgacgtcgtgctctcccgggccgg

SEQ ID NO: 11922 - DNA, 42 bp, Homo sapiens
cttcgtgatcgatgtggtgacgtcgtgctctcccgggccggg

SEQ ID NO: 11923 - DNA, 43 bp, Homo sapiens
cttcgtgatcgatgtggtgacgtcgtgctctcccgggccgggt

SEQ ID NO: 11924 - DNA, 44 bp, Homo sapiens
cttcgtgatcgatgtggtgacgtcgtgctctcccgggccgggtc

SEQ ID NO: 11925 - DNA, 45 bp, Homo sapiens
cttcgtgatcgatgtggtgacgtcgtgctctcccgggccgggtcc

SEQ ID NO: 11926 - DNA, 46 bp, Homo sapiens
cttcgtgatcgatgtggtgacgtcgtgctctcccgggccgggtccg

SEQ ID NO: 11927 - DNA, 47 bp, Homo sapiens
cttcgtgatcgatgtggtgacgtcgtgctctcccgggccgggtccga

SEQ ID NO: 11928 - DNA, 16 bp, Homo sapiens
ttcgtgatcgatgtgg

SEQ ID NO: 11929 - DNA, 19 bp, Homo sapiens
ttcgtgatcgatgtggtga

SEQ ID NO: 11930 - DNA, 20 bp, Homo sapiens
ttcgtgatcgatgtggtgac

SEQ ID NO: 11931 - DNA, 21 bp, Homo sapiens
ttcgtgatcgatgtggtgacg

SEQ ID NO: 11932 - DNA, 22 bp, Homo sapiens
ttcgtgatcgatgtggtgacgt

SEQ ID NO: 11933 - DNA, 23 bp, Homo sapiens
ttcgtgatcgatgtggtgacgtc

SEQ ID NO: 11934 - DNA, 24 bp, Homo sapiens
ttcgtgatcgatgtggtgacgtcg

SEQ ID NO: 11935 - DNA, 26 bp, Homo sapiens
ttcgtgatcgatgtggtgacgtcgtg

SEQ ID NO: 11936 - DNA, 27 bp, Homo sapiens
ttcgtgatcgatgtggtgacgtcgtgc

SEQ ID NO: 11937 - DNA, 28 bp, Homo sapiens
ttcgtgatcgatgtggtgacgtcgtgct

SEQ ID NO: 11938 - DNA, 29 bp, Homo sapiens
ttcgtgatcgatgtggtgacgtcgtgctc

SEQ ID NO: 11939 - DNA, 30 bp, Homo sapiens; identical to SEQ ID NO: 1888

SEQ ID NO: 11940 - DNA, 31 bp, Homo sapiens
ttcgtgatcgatgtggtgacgtcgtgctctc

SEQ ID NO: 11941 - DNA, 32 bp, Homo sapiens; identical to SEQ ID NO: 1889

SEQ ID NO: 11942 - DNA, 33 bp, Homo sapiens
ttcgtgatcgatgtggtgacgtcgtgctctccc

SEQ ID NO: 11943 - DNA, 34 bp, Homo sapiens
ttcgtgatcgatgtggtgacgtcgtgctctcccg

SEQ ID NO: 11944 - DNA, 35 bp, Homo sapiens
ttcgtgatcgatgtggtgacgtcgtgctctcccgg

SEQ ID NO: 11945 - DNA, 36 bp, Homo sapiens
ttcgtgatcgatgtggtgacgtcgtgctctcccggg

SEQ ID NO: 11946 - DNA, 37 bp, Homo sapiens
ttcgtgatcgatgtggtgacgtcgtgctctcccgggc

SEQ ID NO: 11947 - DNA, 38 bp, Homo sapiens
ttcgtgatcgatgtggtgacgtcgtgctctcccgggcc

SEQ ID NO: 11948 - DNA, 41 bp, Homo sapiens
ttcgtgatcgatgtggtgacgtcgtgctctcccgggccggg

SEQ ID NO: 11949 - DNA, 42 bp, Homo sapiens
ttcgtgatcgatgtggtgacgtcgtgctctcccgggccgggt

SEQ ID NO: 11950 - DNA, 43 bp, Homo sapiens
ttcgtgatcgatgtggtgacgtcgtgctctcccgggccgggtc

SEQ ID NO: 11951 - DNA, 44 bp, Homo sapiens
ttcgtgatcgatgtggtgacgtcgtgctctcccgggccgggtcc

SEQ ID NO: 11952 - DNA, 45 bp, Homo sapiens
ttcgtgatcgatgtggtgacgtcgtgctctcccgggccgggtccg

SEQ ID NO: 11953 - DNA, 46 bp, Homo sapiens
ttcgtgatcgatgtggtgacgtcgtgctctcccgggccgggtccga

SEQ ID NO: 11954 - DNA, 47 bp, Homo sapiens
ttcgtgatcgatgtggtgacgtcgtgctctcccgggccgggtccgag

SEQ ID NO: 11955 - DNA, 20 bp, Homo sapiens
tcgtgatcgatgtggtgacg

SEQ ID NO: 11956 - DNA, 22 bp, Homo sapiens
tcgtgatcgatgtggtgacgtc

SEQ ID NO: 11957 - DNA, 27 bp, Homo sapiens
tcgtgatcgatgtggtgacgtcgtgct

SEQ ID NO: 11958 - DNA, 25 bp, Homo sapiens
gtgatcgatgtggtgacgtcgtgct

SEQ ID NO: 11959 - DNA, 26 bp, Homo sapiens
gtgatcgatgtggtgacgtcgtgctc

SEQ ID NO: 11960 - DNA, 33 bp, Homo sapiens
gtgatcgatgtggtgacgtcgtgctctcccggg

SEQ ID NO: 11961 - DNA, 24 bp, Homo sapiens
tgatcgatgtggtgacgtcgtgct

SEQ ID NO: 11962 - DNA, 31 bp, Homo sapiens
tgatcgatgtggtgacgtcgtgctctcccgg

SEQ ID NO: 11963 - DNA, 32 bp, Homo sapiens
tgatcgatgtggtgacgtcgtgctctcccggg

SEQ ID NO: 11964 - DNA, 16 bp, Homo sapiens
gatcgatgtggtgacg

SEQ ID NO: 11965 - DNA, 18 bp, Homo sapiens
gatcgatgtggtgacgtc

SEQ ID NO: 11966 - DNA, 23 bp, Homo sapiens
gatcgatgtggtgacgtcgtgct

SEQ ID NO: 11967 - DNA, 24 bp, Homo sapiens
gatcgatgtggtgacgtcgtgctc

SEQ ID NO: 11968 - DNA, 25 bp, Homo sapiens
gatcgatgtggtgacgtcgtgctct

SEQ ID NO: 11969 - DNA, 28 bp, Homo sapiens
gatcgatgtggtgacgtcgtgctctccc

SEQ ID NO: 11970 - DNA, 29 bp, Homo sapiens
gatcgatgtggtgacgtcgtgctctcccg

SEQ ID NO: 11971 - DNA, 30 bp, Homo sapiens; identical to SEQ ID NO: 1894

SEQ ID NO: 11972 - DNA, 31 bp, Homo sapiens; identical to SEQ ID NO: 1895

SEQ ID NO: 11973 - DNA, 32 bp, Homo sapiens
gatcgatgtggtgacgtcgtgctctcccgggc

SEQ ID NO: 11974 - DNA, 33 bp, Homo sapiens
gatcgatgtggtgacgtcgtgctctcccgggcc

SEQ ID NO: 11975 - DNA, 35 bp, Homo sapiens
gatcgatgtggtgacgtcgtgctctcccgggccgg

SEQ ID NO: 11976 - DNA, 36 bp, Homo sapiens
gatcgatgtggtgacgtcgtgctctcccgggccggg

SEQ ID NO: 11977 - DNA, 38 bp, Homo sapiens
gatcgatgtggtgacgtcgtgctctcccgggccgggtc

SEQ ID NO: 11978 - DNA, 39 bp, Homo sapiens
gatcgatgtggtgacgtcgtgctctcccgggccgggtcc

SEQ ID NO: 11979 - DNA, 40 bp, Homo sapiens
gatcgatgtggtgacgtcgtgctctcccgggccgggtccg

SEQ ID NO: 11980 - DNA, 41 bp, Homo sapiens
gatcgatgtggtgacgtcgtgctctcccgggccgggtccga

SEQ ID NO: 11981 - DNA, 42 bp, Homo sapiens
gatcgatgtggtgacgtcgtgctctcccgggccgggtccgag

SEQ ID NO: 11982 - DNA, 43 bp, Homo sapiens
gatcgatgtggtgacgtcgtgctctcccgggccgggtccgagc

SEQ ID NO: 11983 - DNA, 47 bp, Homo sapiens
gatcgatgtggtgacgtcgtgctctcccgggccgggtccgagccgcg

SEQ ID NO: 11984 - DNA, 16 bp, Homo sapiens
atcgatgtggtgacgt

SEQ ID NO: 11985 - DNA, 17 bp, Homo sapiens
atcgatgtggtgacgtc

SEQ ID NO: 11986 - DNA, 20 bp, Homo sapiens
atcgatgtggtgacgtcgtg

SEQ ID NO: 11987 - DNA, 22 bp, Homo sapiens
atcgatgtggtgacgtcgtgct

SEQ ID NO: 11988 - DNA, 23 bp, Homo sapiens
atcgatgtggtgacgtcgtgctc

SEQ ID NO: 11989 - DNA, 24 bp, Homo sapiens
atcgatgtggtgacgtcgtgctct

SEQ ID NO: 11990 - DNA, 25 bp, Homo sapiens
atcgatgtggtgacgtcgtgctctc

SEQ ID NO: 11991 - DNA, 26 bp, Homo sapiens
atcgatgtggtgacgtcgtgctctcc

SEQ ID NO: 11992 - DNA, 27 bp, Homo sapiens
atcgatgtggtgacgtcgtgctctccc

SEQ ID NO: 11993 - DNA, 28 bp, Homo sapiens
atcgatgtggtgacgtcgtgctctcccg

SEQ ID NO: 11994 - DNA, 29 bp, Homo sapiens
atcgatgtggtgacgtcgtgctctcccgg

SEQ ID NO: 11995 - DNA, 30 bp, Homo sapiens; identical to SEQ ID NO: 1904

SEQ ID NO: 11996 - DNA, 31 bp, Homo sapiens; identical to SEQ ID NO: 1905

SEQ ID NO: 11997 - DNA, 32 bp, Homo sapiens; identical to SEQ ID NO: 1906

SEQ ID NO: 11998 - DNA, 33 bp, Homo sapiens; identical to SEQ ID NO: 1907

SEQ ID NO: 11999 - DNA, 34 bp, Homo sapiens
atcgatgtggtgacgtcgtgctctcccgggccgg

SEQ ID NO: 12000 - DNA, 35 bp, Homo sapiens
atcgatgtggtgacgtcgtgctctcccgggccggg

SEQ ID NO: 12001 - DNA, 36 bp, Homo sapiens
atcgatgtggtgacgtcgtgctctcccgggccgggt

SEQ ID NO: 12002 - DNA, 37 bp, Homo sapiens
atcgatgtggtgacgtcgtgctctcccgggccgggtc

SEQ ID NO: 12003 - DNA, 38 bp, Homo sapiens
atcgatgtggtgacgtcgtgctctcccgggccgggtcc

SEQ ID NO: 12004 - DNA, 39 bp, Homo sapiens
atcgatgtggtgacgtcgtgctctcccgggccgggtccg

SEQ ID NO: 12005 - DNA, 40 bp, Homo sapiens
atcgatgtggtgacgtcgtgctctcccgggccgggtccga

SEQ ID NO: 12006 - DNA, 41 bp, Homo sapiens
atcgatgtggtgacgtcgtgctctcccgggccgggtccgag

SEQ ID NO: 12007 - DNA, 42 bp, Homo sapiens
atcgatgtggtgacgtcgtgctctcccgggccgggtccgagc

SEQ ID NO: 12008 - DNA, 43 bp, Homo sapiens
atcgatgtggtgacgtcgtgctctcccgggccgggtccgagcc

SEQ ID NO: 12009 - DNA, 44 bp, Homo sapiens
atcgatgtggtgacgtcgtgctctcccgggccgggtccgagccg

SEQ ID NO: 12010 - DNA, 45 bp, Homo sapiens
atcgatgtggtgacgtcgtgctctcccgggccgggtccgagccgc

SEQ ID NO: 12011 - DNA, 46 bp, Homo sapiens
atcgatgtggtgacgtcgtgctctcccgggccgggtccgagccgcg

SEQ ID NO: 12012 - DNA, 47 bp, Homo sapiens
atcgatgtggtgacgtcgtgctctcccgggccgggtccgagccgcga

SEQ ID NO: 12013 - DNA, 21 bp, Homo sapiens
tcgatgtggtgacgtcgtgct

SEQ ID NO: 12014 - DNA, 23 bp, Homo sapiens
tcgatgtggtgacgtcgtgctct

SEQ ID NO: 12015 - DNA, 27 bp, Homo sapiens
tcgatgtggtgacgtcgtgctctcccg

SEQ ID NO: 12016 - DNA, 28 bp, Homo sapiens
tcgatgtggtgacgtcgtgctctcccgg

SEQ ID NO: 12017 - DNA, 29 bp, Homo sapiens
tcgatgtggtgacgtcgtgctctcccggg

SEQ ID NO: 12018 - DNA, 33 bp, Homo sapiens; identical to SEQ ID NO: 1910

SEQ ID NO: 12019 - DNA, 34 bp, Homo sapiens
tcgatgtggtgacgtcgtgctctcccgggccggg

SEQ ID NO: 12020 - DNA, 36 bp, Homo sapiens
tcgatgtggtgacgtcgtgctctcccgggccgggtc

SEQ ID NO: 12021 - DNA, 37 bp, Homo sapiens
tcgatgtggtgacgtcgtgctctcccgggccgggtcc

SEQ ID NO: 12022 - DNA, 38 bp, Homo sapiens
tcgatgtggtgacgtcgtgctctcccgggccgggtccg

SEQ ID NO: 12023 - DNA, 39 bp, Homo sapiens
tcgatgtggtgacgtcgtgctctcccgggccgggtccga

SEQ ID NO: 12024 - DNA, 16 bp, Homo sapiens
tggtgacgtcgtgctc

SEQ ID NO: 12025 - DNA, 17 bp, Homo sapiens
ggtgacgtcgtgctctc

SEQ ID NO: 12026 - DNA, 32 bp, Homo sapiens
cgtgctctcccgggccgggtccgagccgcgac

SEQ ID NO: 12027 - DNA, 37 bp, Homo sapiens
gtgctctcccgggccgggtccgagccgcgacgggcga

SEQ ID NO: 12028 - DNA, 28 bp, Homo sapiens
tctcccgggccgggtccgagccgcgacg

SEQ ID NO: 12029 - DNA, 27 bp, Homo sapiens
ctcccgggccgggtccgagccgcgacg

SEQ ID NO: 12030 - DNA, 26 bp, Homo sapiens
tcccgggccgggtccgagccgcgacg

SEQ ID NO: 12031 - DNA, 24 bp, Homo sapiens
gacgggcgaggggcggacgttcgt

SEQ ID NO: 12032 - DNA, 21 bp, Homo sapiens
gacctcgccgtcccgcccgcc

SEQ ID NO: 12033 - DNA, 26 bp, Homo sapiens
gcgcgagcgtcggctccgcctgggcc

SEQ ID NO: 12034 - DNA, 25 bp, Homo sapiens
cgcgagcgtcggctccgcctgggcc

SEQ ID NO: 12035 - DNA, 26 bp, Homo sapiens
cgcgagcgtcggctccgcctgggccc

SEQ ID NO: 12036 - DNA, 27 bp, Homo sapiens
cgcgagcgtcggctccgcctgggccct

SEQ ID NO: 12037 - DNA, 21 bp, Homo sapiens
gagcgtcggctccgcctgggc

SEQ ID NO: 12038 - DNA, 22 bp, Homo sapiens
gagcgtcggctccgcctgggcc

SEQ ID NO: 12039 - DNA, 23 bp, Homo sapiens
gagcgtcggctccgcctgggccc

SEQ ID NO: 12040 - DNA, 24 bp, Homo sapiens
gagcgtcggctccgcctgggccct

SEQ ID NO: 12041 - DNA, 21 bp, Homo sapiens
tggccgagtgcggctcgtcgc

SEQ ID NO: 12042 - DNA, 22 bp, Homo sapiens
tggccgagtgcggctcgtcgcc

SEQ ID NO: 12043 - DNA, 23 bp, Homo sapiens
tggccgagtgcggctcgtcgcct

SEQ ID NO: 12044 - DNA, 21 bp, Homo sapiens
cgggggaggatcccgccgggc

SEQ ID NO: 12045 - DNA, 28 bp, Homo sapiens
agcgtcccacggtgggggcgcgccggtc

SEQ ID NO: 12046 - DNA, 23 bp, Homo sapiens
ggatggacgagaatcacgagcga

SEQ ID NO: 12047 - DNA, 21 bp, Homo sapiens
atggacgagaatcacgagcga

SEQ ID NO: 12048 - DNA, 22 bp, Homo sapiens
atggacgagaatcacgagcgac

SEQ ID NO: 12049 - DNA, 23 bp, Homo sapiens
atggacgagaatcacgagcgacg

SEQ ID NO: 12050 - DNA, 24 bp, Homo sapiens
atggacgagaatcacgagcgacgg

SEQ ID NO: 12051 - DNA, 20 bp, Homo sapiens
tggacgagaatcacgagcga

SEQ ID NO: 12052 - DNA, 17 bp, Homo sapiens
ggtcccccgtcccgggc

SEQ ID NO: 12053 - DNA, 32 bp, Homo sapiens
aagaagcgtcgcgggtctgtggcgcggggccc

SEQ ID NO: 12054 - DNA, 33 bp, Homo sapiens
gaagcgtcgcgggtctgtggcgcggggccccgg

SEQ ID NO: 12055 - DNA, 16 bp, Homo sapiens
cgtccgtccgtccgtc

SEQ ID NO: 12056 - DNA, 16 bp, Homo sapiens
tacctggttgatcctg

SEQ ID NO: 12057 - DNA, 17 bp, Homo sapiens
tacctggttgatcctgc

SEQ ID NO: 12058 - DNA, 18 bp, Homo sapiens
tacctggttgatcctgcc

SEQ ID NO: 12059 - DNA, 19 bp, Homo sapiens
tacctggttgatcctgcca

SEQ ID NO: 12060 - DNA, 20 bp, Homo sapiens
tacctggttgatcctgccag

SEQ ID NO: 12061 - DNA, 21 bp, Homo sapiens
tacctggttgatcctgccagt

SEQ ID NO: 12062 - DNA, 22 bp, Homo sapiens
tacctggttgatcctgccagta

SEQ ID NO: 12063 - DNA, 23 bp, Homo sapiens
tacctggttgatcctgccagtag

SEQ ID NO: 12064 - DNA, 24 bp, Homo sapiens
tacctggttgatcctgccagtagc

SEQ ID NO: 12065 - DNA, 25 bp, Homo sapiens
tacctggttgatcctgccagtagca

SEQ ID NO: 12066 - DNA, 26 bp, Homo sapiens
tacctggttgatcctgccagtagcat

SEQ ID NO: 12067 - DNA, 30 bp, Homo sapiens
tacctggttgatcctgccagtagcatatgc

SEQ ID NO: 12068 - DNA, 31 bp, Homo sapiens
tacctggttgatcctgccagtagcatatgct

SEQ ID NO: 12069 - DNA, 32 bp, Homo sapiens
tacctggttgatcctgccagtagcatatgctt

SEQ ID NO: 12070 - DNA, 33 bp, Homo sapiens
tacctggttgatcctgccagtagcatatgcttg

SEQ ID NO: 12071 - DNA, 35 bp, Homo sapiens
tacctggttgatcctgccagtagcatatgcttgtc

SEQ ID NO: 12072 - DNA, 36 bp, Homo sapiens
tacctggttgatcctgccagtagcatatgcttgtct

SEQ ID NO: 12073 - DNA, 37 bp, Homo sapiens
tacctggttgatcctgccagtagcatatgcttgtctc

SEQ ID NO: 12074 - DNA, 38 bp, Homo sapiens
tacctggttgatcctgccagtagcatatgcttgtctca

SEQ ID NO: 12075 - DNA, 40 bp, Homo sapiens
tacctggttgatcctgccagtagcatatgcttgtctcaaa

SEQ ID NO: 12076 - DNA, 41 bp, Homo sapiens
tacctggttgatcctgccagtagcatatgcttgtctcaaag

SEQ ID NO: 12077 - DNA, 42 bp, Homo sapiens
tacctggttgatcctgccagtagcatatgcttgtctcaaaga

SEQ ID NO: 12078 - DNA, 43 bp, Homo sapiens
tacctggttgatcctgccagtagcatatgcttgtctcaaagat

SEQ ID NO: 12079 - DNA, 44 bp, Homo sapiens
tacctggttgatcctgccagtagcatatgcttgtctcaaagatt

SEQ ID NO: 12080 - DNA, 17 bp, Homo sapiens
acctggttgatcctgcc

SEQ ID NO: 12081 - DNA, 16 bp, Homo sapiens
cctggttgatcctgcc

SEQ ID NO: 12082 - DNA, 17 bp, Homo sapiens
tggttgatcctgccagt

SEQ ID NO: 12083 - DNA, 32 bp, Homo sapiens
tggttgatcctgccagtagcatatgcttgtct

SEQ ID NO: 12084 - DNA, 18 bp, Homo sapiens
gttgatcctgccagtagc

SEQ ID NO: 12085 - DNA, 29 bp, Homo sapiens
gttgatcctgccagtagcatatgcttgtc

SEQ ID NO: 12086 - DNA, 31 bp, Homo sapiens
gttgatcctgccagtagcatatgcttgtctc

SEQ ID NO: 12087 - DNA, 16 bp, Homo sapiens
ttgatcctgccagtag

SEQ ID NO: 12088 - DNA, 17 bp, Homo sapiens
ttgatcctgccagtagc

SEQ ID NO: 12089 - DNA, 23 bp, Homo sapiens
ttgatcctgccagtagcatatgc

SEQ ID NO: 12090 - DNA, 28 bp, Homo sapiens
ttgatcctgccagtagcatatgcttgtc

SEQ ID NO: 12091 - DNA, 31 bp, Homo sapiens
ttgatcctgccagtagcatatgcttgtctca

SEQ ID NO: 12092 - DNA, 16 bp, Homo sapiens
tgatcctgccagtagc

SEQ ID NO: 12093 - DNA, 32 bp, Homo sapiens
cctgccagtagcatatgcttgtctcaaagatt

SEQ ID NO: 12094 - DNA, 29 bp, Homo sapiens
gccagtagcatatgcttgtctcaaagatt

SEQ ID NO: 12095 - DNA, 28 bp, Homo sapiens
ccagtagcatatgcttgtctcaaagatt

SEQ ID NO: 12096 - DNA, 27 bp, Homo sapiens
cagtagcatatgcttgtctcaaagatt

SEQ ID NO: 12097 - DNA, 26 bp, Homo sapiens
agtagcatatgcttgtctcaaagatt

SEQ ID NO: 12098 - DNA, 25 bp, Homo sapiens
gtagcatatgcttgtctcaaagatt

SEQ ID NO: 12099 - DNA, 24 bp, Homo sapiens
tagcatatgcttgtctcaaagatt

SEQ ID NO: 12100 - DNA, 23 bp, Homo sapiens
agcatatgcttgtctcaaagatt

SEQ ID NO: 12101 - DNA, 26 bp, Homo sapiens
agcatatgcttgtctcaaagattaag

SEQ ID NO: 12102 - DNA, 22 bp, Homo sapiens
gcatatgcttgtctcaaagatt

SEQ ID NO: 12103 - DNA, 16 bp, Homo sapiens
catatgcttgtctcaa

SEQ ID NO: 12104 - DNA, 18 bp, Homo sapiens
catatgcttgtctcaaag

SEQ ID NO: 12105 - DNA, 21 bp, Homo sapiens
catatgcttgtctcaaagatt

SEQ ID NO: 12106 - DNA, 17 bp, Homo sapiens
atatgcttgtctcaaag

SEQ ID NO: 12107 - DNA, 20 bp, Homo sapiens
atatgcttgtctcaaagatt

SEQ ID NO: 12108 - DNA, 16 bp, Homo sapiens
tatgcttgtctcaaag

SEQ ID NO: 12109 - DNA, 17 bp, Homo sapiens
tatgcttgtctcaaaga

SEQ ID NO: 12110 - DNA, 19 bp, Homo sapiens
tatgcttgtctcaaagatt

SEQ ID NO: 12111 - DNA, 22 bp, Homo sapiens
tatgcttgtctcaaagattaag

SEQ ID NO: 12112 - DNA, 16 bp, Homo sapiens
atgcttgtctcaaaga

SEQ ID NO: 12113 - DNA, 18 bp, Homo sapiens
atgcttgtctcaaagatt

SEQ ID NO: 12114 - DNA, 16 bp, Homo sapiens
gcttgtctcaaagatt

SEQ ID NO: 12115 - DNA, 19 bp, Homo sapiens
gcttgtctcaaagattaag

SEQ ID NO: 12116 - DNA, 19 bp, Homo sapiens
tgtctgagtacgcacggcc

SEQ ID NO: 12117 - DNA, 17 bp, Homo sapiens
agtacgcacggccggta

SEQ ID NO: 12118 - DNA, 18 bp, Homo sapiens
agtacgcacggccggtac

SEQ ID NO: 12119 - DNA, 19 bp, Homo sapiens
agtacgcacggccggtaca

SEQ ID NO: 12120 - DNA, 22 bp, Homo sapiens
agtacgcacggccggtacagtg

SEQ ID NO: 12121 - DNA, 26 bp, Homo sapiens
agtacgcacggccggtacagtgaaac

SEQ ID NO: 12122 - DNA, 27 bp, Homo sapiens
agtacgcacggccggtacagtgaaact

SEQ ID NO: 12123 - DNA, 29 bp, Homo sapiens
agtacgcacggccggtacagtgaaactgc

SEQ ID NO: 12124 - DNA, 30 bp, Homo sapiens
agtacgcacggccggtacagtgaaactgcg

SEQ ID NO: 12125 - DNA, 36 bp, Homo sapiens
agtacgcacggccggtacagtgaaactgcgaatggc

SEQ ID NO: 12126 - DNA, 16 bp, Homo sapiens
gtacgcacggccggta

SEQ ID NO: 12127 - DNA, 17 bp, Homo sapiens
gtacgcacggccggtac

SEQ ID NO: 12128 - DNA, 18 bp, Homo sapiens
gtacgcacggccggtaca

SEQ ID NO: 12129 - DNA, 26 bp, Homo sapiens
gtacgcacggccggtacagtgaaact

SEQ ID NO: 12130 - DNA, 28 bp, Homo sapiens
gtacgcacggccggtacagtgaaactgc

SEQ ID NO: 12131 - DNA, 29 bp, Homo sapiens
gtacgcacggccggtacagtgaaactgcg

SEQ ID NO: 12132 - DNA, 33 bp, Homo sapiens
gtacgcacggccggtacagtgaaactgcgaatg

SEQ ID NO: 12133 - DNA, 35 bp, Homo sapiens
gtacgcacggccggtacagtgaaactgcgaatggc

SEQ ID NO: 12134 - DNA, 16 bp, Homo sapiens
tacgcacggccggtac

SEQ ID NO: 12135 - DNA, 17 bp, Homo sapiens
tacgcacggccggtaca

SEQ ID NO: 12136 - DNA, 19 bp, Homo sapiens
tacgcacggccggtacagt

SEQ ID NO: 12137 - DNA, 20 bp, Homo sapiens
tacgcacggccggtacagtg

SEQ ID NO: 12138 - DNA, 24 bp, Homo sapiens
tacgcacggccggtacagtgaaac

SEQ ID NO: 12139 - DNA, 25 bp, Homo sapiens
tacgcacggccggtacagtgaaact

SEQ ID NO: 12140 - DNA, 27 bp, Homo sapiens
tacgcacggccggtacagtgaaactgc

SEQ ID NO: 12141 - DNA, 28 bp, Homo sapiens
tacgcacggccggtacagtgaaactgcg

SEQ ID NO: 12142 - DNA, 30 bp, Homo sapiens
tacgcacggccggtacagtgaaactgcgaa

SEQ ID NO: 12143 - DNA, 32 bp, Homo sapiens
tacgcacggccggtacagtgaaactgcgaatg

SEQ ID NO: 12144 - DNA, 33 bp, Homo sapiens
tacgcacggccggtacagtgaaactgcgaatgg

SEQ ID NO: 12145 - DNA, 34 bp, Homo sapiens
tacgcacggccggtacagtgaaactgcgaatggc

SEQ ID NO: 12146 - DNA, 19 bp, Homo sapiens
acgcacggccggtacagtg

SEQ ID NO: 12147 - DNA, 23 bp, Homo sapiens
acgcacggccggtacagtgaaac

SEQ ID NO: 12148 - DNA, 24 bp, Homo sapiens
acgcacggccggtacagtgaaact

SEQ ID NO: 12149 - DNA, 25 bp, Homo sapiens
acgcacggccggtacagtgaaactg

SEQ ID NO: 12150 - DNA, 26 bp, Homo sapiens
acgcacggccggtacagtgaaactgc

SEQ ID NO: 12151 - DNA, 27 bp, Homo sapiens
acgcacggccggtacagtgaaactgcg

SEQ ID NO: 12152 - DNA, 31 bp, Homo sapiens
acgcacggccggtacagtgaaactgcgaatg

SEQ ID NO: 12153 - DNA, 33 bp, Homo sapiens
acgcacggccggtacagtgaaactgcgaatggc

SEQ ID NO: 12154 - DNA, 16 bp, Homo sapiens
cgcacggccggtacag

SEQ ID NO: 12155 - DNA, 17 bp, Homo sapiens
cgcacggccggtacagt

SEQ ID NO: 12156 - DNA, 18 bp, Homo sapiens
cgcacggccggtacagtg

SEQ ID NO: 12157 - DNA, 19 bp, Homo sapiens
cgcacggccggtacagtga

SEQ ID NO: 12158 - DNA, 21 bp, Homo sapiens
cgcacggccggtacagtgaaa

SEQ ID NO: 12159 - DNA, 22 bp, Homo sapiens
cgcacggccggtacagtgaaac

SEQ ID NO: 12160 - DNA, 23 bp, Homo sapiens
cgcacggccggtacagtgaaact

SEQ ID NO: 12161 - DNA, 24 bp, Homo sapiens
cgcacggccggtacagtgaaactg

SEQ ID NO: 12162 - DNA, 25 bp, Homo sapiens
cgcacggccggtacagtgaaactgc

SEQ ID NO: 12163 - DNA, 26 bp, Homo sapiens
cgcacggccggtacagtgaaactgcg

SEQ ID NO: 12164 - DNA, 27 bp, Homo sapiens
cgcacggccggtacagtgaaactgcga

SEQ ID NO: 12165 - DNA, 28 bp, Homo sapiens
cgcacggccggtacagtgaaactgcgaa

SEQ ID NO: 12166 - DNA, 29 bp, Homo sapiens
cgcacggccggtacagtgaaactgcgaat

SEQ ID NO: 12167 - DNA, 30 bp, Homo sapiens; identical to SEQ ID NO: 1941

SEQ ID NO: 12168 - DNA, 31 bp, Homo sapiens
cgcacggccggtacagtgaaactgcgaatgg

SEQ ID NO: 12169 - DNA, 32 bp, Homo sapiens; identical to SEQ ID NO: 1942

SEQ ID NO: 12170 - DNA, 33 bp, Homo sapiens; identical to SEQ ID NO: 1943

SEQ ID NO: 12171 - DNA, 16 bp, Homo sapiens
gcacggccggtacagt

SEQ ID NO: 12172 - DNA, 22 bp, Homo sapiens
gcacggccggtacagtgaaact

SEQ ID NO: 12173 - DNA, 23 bp, Homo sapiens
gcacggccggtacagtgaaactg

SEQ ID NO: 12174 - DNA, 24 bp, Homo sapiens
gcacggccggtacagtgaaactgc

SEQ ID NO: 12175 - DNA, 25 bp, Homo sapiens
gcacggccggtacagtgaaactgcg

SEQ ID NO: 12176 - DNA, 27 bp, Homo sapiens
gcacggccggtacagtgaaactgcgaa

SEQ ID NO: 12177 - DNA, 28 bp, Homo sapiens
gcacggccggtacagtgaaactgcgaat

SEQ ID NO: 12178 - DNA, 29 bp, Homo sapiens
gcacggccggtacagtgaaactgcgaatg

SEQ ID NO: 12179 - DNA, 30 bp, Homo sapiens; identical to SEQ ID NO: 1949

SEQ ID NO: 12180 - DNA, 20 bp, Homo sapiens
cacggccggtacagtgaaac

SEQ ID NO: 12181 - DNA, 21 bp, Homo sapiens
cacggccggtacagtgaaact

SEQ ID NO: 12182 - DNA, 22 bp, Homo sapiens
cacggccggtacagtgaaactg

SEQ ID NO: 12183 - DNA, 23 bp, Homo sapiens
cacggccggtacagtgaaactgc

SEQ ID NO: 12184 - DNA, 24 bp, Homo sapiens
cacggccggtacagtgaaactgcg

SEQ ID NO: 12185 - DNA, 28 bp, Homo sapiens
cacggccggtacagtgaaactgcgaatg

SEQ ID NO: 12186 - DNA, 29 bp, Homo sapiens
cacggccggtacagtgaaactgcgaatgg

SEQ ID NO: 12187 - DNA, 30 bp, Homo sapiens
cacggccggtacagtgaaactgcgaatggc

SEQ ID NO: 12188 - DNA, 19 bp, Homo sapiens
acggccggtacagtgaaac

SEQ ID NO: 12189 - DNA, 20 bp, Homo sapiens
acggccggtacagtgaaact

SEQ ID NO: 12190 - DNA, 21 bp, Homo sapiens
acggccggtacagtgaaactg

SEQ ID NO: 12191 - DNA, 22 bp, Homo sapiens
acggccggtacagtgaaactgc

SEQ ID NO: 12192 - DNA, 27 bp, Homo sapiens
acggccggtacagtgaaactgcgaatg

SEQ ID NO: 12193 - DNA, 28 bp, Homo sapiens
acggccggtacagtgaaactgcgaatgg

SEQ ID NO: 12194 - DNA, 16 bp, Homo sapiens
cggccggtacagtgaa

SEQ ID NO: 12195 - DNA, 17 bp, Homo sapiens
cggccggtacagtgaaa

SEQ ID NO: 12196 - DNA, 18 bp, Homo sapiens
cggccggtacagtgaaac

SEQ ID NO: 12197 - DNA, 19 bp, Homo sapiens
cggccggtacagtgaaact

SEQ ID NO: 12198 - DNA, 20 bp, Homo sapiens
cggccggtacagtgaaactg

SEQ ID NO: 12199 - DNA, 21 bp, Homo sapiens
cggccggtacagtgaaactgc

SEQ ID NO: 12200 - DNA, 22 bp, Homo sapiens
cggccggtacagtgaaactgcg

SEQ ID NO: 12201 - DNA, 23 bp, Homo sapiens
cggccggtacagtgaaactgcga

SEQ ID NO: 12202 - DNA, 24 bp, Homo sapiens
cggccggtacagtgaaactgcgaa

SEQ ID NO: 12203 - DNA, 26 bp, Homo sapiens
cggccggtacagtgaaactgcgaatg

SEQ ID NO: 12204 - DNA, 27 bp, Homo sapiens
cggccggtacagtgaaactgcgaatgg

SEQ ID NO: 12205 - DNA, 28 bp, Homo sapiens
cggccggtacagtgaaactgcgaatggc

SEQ ID NO: 12206 - DNA, 18 bp, Homo sapiens
ggccggtacagtgaaact

SEQ ID NO: 12207 - DNA, 19 bp, Homo sapiens
ggccggtacagtgaaactg

SEQ ID NO: 12208 - DNA, 20 bp, Homo sapiens
ggccggtacagtgaaactgc

SEQ ID NO: 12209 - DNA, 25 bp, Homo sapiens
ggccggtacagtgaaactgcgaatg

SEQ ID NO: 12210 - DNA, 26 bp, Homo sapiens
ggccggtacagtgaaactgcgaatgg

SEQ ID NO: 12211 - DNA, 27 bp, Homo sapiens
ggccggtacagtgaaactgcgaatggc

SEQ ID NO: 12212 - DNA, 16 bp, Homo sapiens
gccggtacagtgaaac

SEQ ID NO: 12213 - DNA, 17 bp, Homo sapiens
gccggtacagtgaaact

SEQ ID NO: 12214 - DNA, 18 bp, Homo sapiens
gccggtacagtgaaactg

SEQ ID NO: 12215 - DNA, 19 bp, Homo sapiens
gccggtacagtgaaactgc

SEQ ID NO: 12216 - DNA, 20 bp, Homo sapiens
gccggtacagtgaaactgcg

SEQ ID NO: 12217 - DNA, 24 bp, Homo sapiens
gccggtacagtgaaactgcgaatg

SEQ ID NO: 12218 - DNA, 25 bp, Homo sapiens
gccggtacagtgaaactgcgaatgg

SEQ ID NO: 12219 - DNA, 16 bp, Homo sapiens
ccggtacagtgaaact

SEQ ID NO: 12220 - DNA, 18 bp, Homo sapiens
ccggtacagtgaaactgc

SEQ ID NO: 12221 - DNA, 26 bp, Homo sapiens
ccggtacagtgaaactgcgaatggct

SEQ ID NO: 12222 - DNA, 27 bp, Homo sapiens
ccggtacagtgaaactgcgaatggctc

SEQ ID NO: 12223 - DNA, 24 bp, Homo sapiens
cggtacagtgaaactgcgaatggc

SEQ ID NO: 12224 - DNA, 25 bp, Homo sapiens
cggtacagtgaaactgcgaatggct

SEQ ID NO: 12225 - DNA, 26 bp, Homo sapiens
cggtacagtgaaactgcgaatggctc

SEQ ID NO: 12226 - DNA, 21 bp, Homo sapiens
ggtacagtgaaactgcgaatg

SEQ ID NO: 12227 - DNA, 24 bp, Homo sapiens
ggtacagtgaaactgcgaatggct

SEQ ID NO: 12228 - DNA, 25 bp, Homo sapiens
ggtacagtgaaactgcgaatggctc

SEQ ID NO: 12229 - DNA, 23 bp, Homo sapiens
gtacagtgaaactgcgaatggct

SEQ ID NO: 12230 - DNA, 24 bp, Homo sapiens
gtacagtgaaactgcgaatggctc

SEQ ID NO: 12231 - DNA, 22 bp, Homo sapiens
tacagtgaaactgcgaatggct

SEQ ID NO: 12232 - DNA, 23 bp, Homo sapiens
tacagtgaaactgcgaatggctc

SEQ ID NO: 12233 - DNA, 31 bp, Homo sapiens
tacagtgaaactgcgaatggctcattaaatc

SEQ ID NO: 12234 - DNA, 21 bp, Homo sapiens
acagtgaaactgcgaatggct

SEQ ID NO: 12235 - DNA, 22 bp, Homo sapiens
acagtgaaactgcgaatggctc

SEQ ID NO: 12236 - DNA, 19 bp, Homo sapiens
cagtgaaactgcgaatggc

SEQ ID NO: 12237 - DNA, 20 bp, Homo sapiens
cagtgaaactgcgaatggct

SEQ ID NO: 12238 - DNA, 21 bp, Homo sapiens
cagtgaaactgcgaatggctc

SEQ ID NO: 12239 - DNA, 29 bp, Homo sapiens
cagtgaaactgcgaatggctcattaaatc

SEQ ID NO: 12240 - DNA, 16 bp, Homo sapiens
agtgaaactgcgaatg

SEQ ID NO: 12241 - DNA, 19 bp, Homo sapiens
agtgaaactgcgaatggct

SEQ ID NO: 12242 - DNA, 20 bp, Homo sapiens
agtgaaactgcgaatggctc

SEQ ID NO: 12243 - DNA, 23 bp, Homo sapiens
agtgaaactgcgaatggctcatt

SEQ ID NO: 12244 - DNA, 33 bp, Homo sapiens; identical to SEQ ID NO: 1983

SEQ ID NO: 12245 - DNA, 17 bp, Homo sapiens
gtgaaactgcgaatggc

SEQ ID NO: 12246 - DNA, 18 bp, Homo sapiens
gtgaaactgcgaatggct

SEQ ID NO: 12247 - DNA, 19 bp, Homo sapiens
gtgaaactgcgaatggctc

SEQ ID NO: 12248 - DNA, 16 bp, Homo sapiens
tgaaactgcgaatggc

SEQ ID NO: 12249 - DNA, 18 bp, Homo sapiens
tgaaactgcgaatggctc

SEQ ID NO: 12250 - DNA, 17 bp, Homo sapiens
gaaactgcgaatggctc

SEQ ID NO: 12251 - DNA, 16 bp, Homo sapiens
aaactgcgaatggctc

SEQ ID NO: 12252 - DNA, 24 bp, Homo sapiens
aaactgcgaatggctcattaaatc

SEQ ID NO: 12253 - DNA, 24 bp, Homo sapiens
aactgcgaatggctcattaaatca

SEQ ID NO: 12254 - DNA, 33 bp, Homo sapiens
gcgaatggctcattaaatcagttatggttcctt

SEQ ID NO: 12255 - DNA, 16 bp, Homo sapiens
aatggctcattaaatc

SEQ ID NO: 12256 - DNA, 42 bp, Homo sapiens
aatggctcattaaatcagttatggttcctttggtcgctcgct

SEQ ID NO: 12257 - DNA, 45 bp, Homo sapiens
aatggctcattaaatcagttatggttcctttggtcgctcgctcct

SEQ ID NO: 12258 - DNA, 31 bp, Homo sapiens
tcattaaatcagttatggttcctttggtcgc

SEQ ID NO: 12259 - DNA, 32 bp, Homo sapiens
tcattaaatcagttatggttcctttggtcgct

SEQ ID NO: 12260 - DNA, 33 bp, Homo sapiens
tcattaaatcagttatggttcctttggtcgctc

SEQ ID NO: 12261 - DNA, 28 bp, Homo sapiens
cattaaatcagttatggttcctttggtc

SEQ ID NO: 12262 - DNA, 31 bp, Homo sapiens
cattaaatcagttatggttcctttggtcgct

SEQ ID NO: 12263 - DNA, 32 bp, Homo sapiens; identical to SEQ ID NO: 1990

SEQ ID NO: 12264 - DNA, 33 bp, Homo sapiens; identical to SEQ ID NO: 1991

SEQ ID NO: 12265 - DNA, 34 bp, Homo sapiens
cattaaatcagttatggttcctttggtcgctcgc

SEQ ID NO: 12266 - DNA, 35 bp, Homo sapiens
cattaaatcagttatggttcctttggtcgctcgct

SEQ ID NO: 12267 - DNA, 36 bp, Homo sapiens
cattaaatcagttatggttcctttggtcgctcgctc

SEQ ID NO: 12268 - DNA, 37 bp, Homo sapiens
cattaaatcagttatggttcctttggtcgctcgctcc

SEQ ID NO: 12269 - DNA, 38 bp, Homo sapiens
cattaaatcagttatggttcctttggtcgctcgctcct

SEQ ID NO: 12270 - DNA, 41 bp, Homo sapiens
cattaaatcagttatggttcctttggtcgctcgctcctctc

SEQ ID NO: 12271 - DNA, 42 bp, Homo sapiens
cattaaatcagttatggttcctttggtcgctcgctcctctcc

SEQ ID NO: 12272 - DNA, 29 bp, Homo sapiens
attaaatcagttatggttcctttggtcgc

SEQ ID NO: 12273 - DNA, 30 bp, Homo sapiens
attaaatcagttatggttcctttggtcgct

SEQ ID NO: 12274 - DNA, 31 bp, Homo sapiens; identical to SEQ ID NO: 1992

SEQ ID NO: 12275 - DNA, 32 bp, Homo sapiens; identical to SEQ ID NO: 1993

SEQ ID NO: 12276 - DNA, 33 bp, Homo sapiens; identical to SEQ ID NO: 1994

SEQ ID NO: 12277 - DNA, 25 bp, Homo sapiens
aaatcagttatggttcctttggtcg

SEQ ID NO: 12278 - DNA, 26 bp, Homo sapiens
aaatcagttatggttcctttggtcgc

SEQ ID NO: 12279 - DNA, 27 bp, Homo sapiens
aaatcagttatggttcctttggtcgct

SEQ ID NO: 12280 - DNA, 28 bp, Homo sapiens
aaatcagttatggttcctttggtcgctc

SEQ ID NO: 12281 - DNA, 29 bp, Homo sapiens
aaatcagttatggttcctttggtcgctcg

SEQ ID NO: 12282 - DNA, 30 bp, Homo sapiens; identical to SEQ ID NO: 1997

SEQ ID NO: 12283 - DNA, 31 bp, Homo sapiens; identical to SEQ ID NO: 1998

SEQ ID NO: 12284 - DNA, 32 bp, Homo sapiens; identical to SEQ ID NO: 1999

SEQ ID NO: 12285 - DNA, 33 bp, Homo sapiens; identical to SEQ ID NO: 2000

SEQ ID NO: 12286 - DNA, 37 bp, Homo sapiens
aaatcagttatggttcctttggtcgctcgctcctctc

SEQ ID NO: 12287 - DNA, 39 bp, Homo sapiens
aaatcagttatggttcctttggtcgctcgctcctctcct

SEQ ID NO: 12288 - DNA, 25 bp, Homo sapiens
aatcagttatggttcctttggtcgc

SEQ ID NO: 12289 - DNA, 26 bp, Homo sapiens
aatcagttatggttcctttggtcgct

SEQ ID NO: 12290 - DNA, 27 bp, Homo sapiens
aatcagttatggttcctttggtcgctc

SEQ ID NO: 12291 - DNA, 28 bp, Homo sapiens
aatcagttatggttcctttggtcgctcg

SEQ ID NO: 12292 - DNA, 29 bp, Homo sapiens
aatcagttatggttcctttggtcgctcgc

SEQ ID NO: 12293 - DNA, 30 bp, Homo sapiens; identical to SEQ ID NO: 2001

SEQ ID NO: 12294 - DNA, 31 bp, Homo sapiens; identical to SEQ ID NO: 2002

SEQ ID NO: 12295 - DNA, 32 bp, Homo sapiens; identical to SEQ ID NO: 2003

SEQ ID NO: 12296 - DNA, 33 bp, Homo sapiens; identical to SEQ ID NO: 2004

SEQ ID NO: 12297 - DNA, 36 bp, Homo sapiens
aatcagttatggttcctttggtcgctcgctcctctc

SEQ ID NO: 12298 - DNA, 37 bp, Homo sapiens
aatcagttatggttcctttggtcgctcgctcctctcc

SEQ ID NO: 12299 - DNA, 38 bp, Homo sapiens
aatcagttatggttcctttggtcgctcgctcctctcct

SEQ ID NO: 12300 - DNA, 27 bp, Homo sapiens
atcagttatggttcctttggtcgctcg

SEQ ID NO: 12301 - DNA, 28 bp, Homo sapiens
atcagttatggttcctttggtcgctcgc

SEQ ID NO: 12302 - DNA, 29 bp, Homo sapiens
atcagttatggttcctttggtcgctcgct

SEQ ID NO: 12303 - DNA, 30 bp, Homo sapiens
atcagttatggttcctttggtcgctcgctc

SEQ ID NO: 12304 - DNA, 32 bp, Homo sapiens; identical to SEQ ID NO: 2005

SEQ ID NO: 12305 - DNA, 26 bp, Homo sapiens
tcagttatggttcctttggtcgctcg

SEQ ID NO: 12306 - DNA, 29 bp, Homo sapiens
tcagttatggttcctttggtcgctcgctc

SEQ ID NO: 12307 - DNA, 31 bp, Homo sapiens
tcagttatggttcctttggtcgctcgctcct

SEQ ID NO: 12308 - DNA, 33 bp, Homo sapiens
tcagttatggttcctttggtcgctcgctcctct

SEQ ID NO: 12309 - DNA, 25 bp, Homo sapiens
cagttatggttcctttggtcgctcg

SEQ ID NO: 12310 - DNA, 27 bp, Homo sapiens
cagttatggttcctttggtcgctcgct

SEQ ID NO: 12311 - DNA, 28 bp, Homo sapiens
cagttatggttcctttggtcgctcgctc

SEQ ID NO: 12312 - DNA, 30 bp, Homo sapiens; identical to SEQ ID NO: 2006

SEQ ID NO: 12313 - DNA, 32 bp, Homo sapiens
cagttatggttcctttggtcgctcgctcctct

SEQ ID NO: 12314 - DNA, 33 bp, Homo sapiens
cagttatggttcctttggtcgctcgctcctctc

SEQ ID NO: 12315 - DNA, 19 bp, Homo sapiens
agttatggttcctttggtc

SEQ ID NO: 12316 - DNA, 21 bp, Homo sapiens
agttatggttcctttggtcgc

SEQ ID NO: 12317 - DNA, 22 bp, Homo sapiens
agttatggttcctttggtcgct

SEQ ID NO: 12318 - DNA, 23 bp, Homo sapiens
agttatggttcctttggtcgctc

SEQ ID NO: 12319 - DNA, 24 bp, Homo sapiens
agttatggttcctttggtcgctcg

SEQ ID NO: 12320 - DNA, 25 bp, Homo sapiens
agttatggttcctttggtcgctcgc

SEQ ID NO: 12321 - DNA, 26 bp, Homo sapiens
agttatggttcctttggtcgctcgct

SEQ ID NO: 12322 - DNA, 27 bp, Homo sapiens
agttatggttcctttggtcgctcgctc

SEQ ID NO: 12323 - DNA, 28 bp, Homo sapiens
agttatggttcctttggtcgctcgctcc

SEQ ID NO: 12324 - DNA, 29 bp, Homo sapiens
agttatggttcctttggtcgctcgctcct

SEQ ID NO: 12325 - DNA, 30 bp, Homo sapiens
agttatggttcctttggtcgctcgctcctc

SEQ ID NO: 12326 - DNA, 31 bp, Homo sapiens; identical to SEQ ID NO: 2014

SEQ ID NO: 12327 - DNA, 32 bp, Homo sapiens; identical to SEQ ID NO: 2015

SEQ ID NO: 12328 - DNA, 33 bp, Homo sapiens; identical to SEQ ID NO: 2016

SEQ ID NO: 12329 - DNA, 18 bp, Homo sapiens
gttatggttcctttggtc

SEQ ID NO: 12330 - DNA, 21 bp, Homo sapiens
gttatggttcctttggtcgct

SEQ ID NO: 12331 - DNA, 22 bp, Homo sapiens
gttatggttcctttggtcgctc

SEQ ID NO: 12332 - DNA, 23 bp, Homo sapiens
gttatggttcctttggtcgctcg

SEQ ID NO: 12333 - DNA, 24 bp, Homo sapiens
gttatggttcctttggtcgctcgc

SEQ ID NO: 12334 - DNA, 25 bp, Homo sapiens
gttatggttcctttggtcgctcgct

SEQ ID NO: 12335 - DNA, 26 bp, Homo sapiens
gttatggttcctttggtcgctcgctc

SEQ ID NO: 12336 - DNA, 27 bp, Homo sapiens
gttatggttcctttggtcgctcgctcc

SEQ ID NO: 12337 - DNA, 28 bp, Homo sapiens
gttatggttcctttggtcgctcgctcct

SEQ ID NO: 12338 - DNA, 29 bp, Homo sapiens
gttatggttcctttggtcgctcgctcctc

SEQ ID NO: 12339 - DNA, 30 bp, Homo sapiens; identical to SEQ ID NO: 2022

SEQ ID NO: 12340 - DNA, 31 bp, Homo sapiens
gttatggttcctttggtcgctcgctcctctc

SEQ ID NO: 12341 - DNA, 32 bp, Homo sapiens; identical to SEQ ID NO: 2023

SEQ ID NO: 12342 - DNA, 33 bp, Homo sapiens; identical to SEQ ID NO: 2024

SEQ ID NO: 12343 - DNA, 22 bp, Homo sapiens
ttatggttcctttggtcgctcg

SEQ ID NO: 12344 - DNA, 24 bp, Homo sapiens
ttatggttcctttggtcgctcgct

SEQ ID NO: 12345 - DNA, 25 bp, Homo sapiens
ttatggttcctttggtcgctcgctc

SEQ ID NO: 12346 - DNA, 27 bp, Homo sapiens
ttatggttcctttggtcgctcgctcct

SEQ ID NO: 12347 - DNA, 28 bp, Homo sapiens
ttatggttcctttggtcgctcgctcctc

SEQ ID NO: 12348 - DNA, 29 bp, Homo sapiens
ttatggttcctttggtcgctcgctcctct

SEQ ID NO: 12349 - DNA, 30 bp, Homo sapiens
ttatggttcctttggtcgctcgctcctctc

SEQ ID NO: 12350 - DNA, 31 bp, Homo sapiens
ttatggttcctttggtcgctcgctcctctcc

SEQ ID NO: 12351 - DNA, 32 bp, Homo sapiens
ttatggttcctttggtcgctcgctcctctcct

SEQ ID NO: 12352 - DNA, 23 bp, Homo sapiens
tatggttcctttggtcgctcgct

SEQ ID NO: 12353 - DNA, 24 bp, Homo sapiens
tatggttcctttggtcgctcgctc

SEQ ID NO: 12354 - DNA, 26 bp, Homo sapiens
tatggttcctttggtcgctcgctcct

SEQ ID NO: 12355 - DNA, 28 bp, Homo sapiens
tatggttcctttggtcgctcgctcctct

SEQ ID NO: 12356 - DNA, 17 bp, Homo sapiens
atggttcctttggtcgc

SEQ ID NO: 12357 - DNA, 18 bp, Homo sapiens
atggttcctttggtcgct

SEQ ID NO: 12358 - DNA, 19 bp, Homo sapiens
atggttcctttggtcgctc

SEQ ID NO: 12359 - DNA, 20 bp, Homo sapiens
atggttcctttggtcgctcg

SEQ ID NO: 12360 - DNA, 21 bp, Homo sapiens
atggttcctttggtcgctcgc

SEQ ID NO: 12361 - DNA, 22 bp, Homo sapiens
atggttcctttggtcgctcgct

SEQ ID NO: 12362 - DNA, 23 bp, Homo sapiens
atggttcctttggtcgctcgctc

SEQ ID NO: 12363 - DNA, 24 bp, Homo sapiens
atggttcctttggtcgctcgctcc

SEQ ID NO: 12364 - DNA, 25 bp, Homo sapiens
atggttcctttggtcgctcgctcct

SEQ ID NO: 12365 - DNA, 26 bp, Homo sapiens
atggttcctttggtcgctcgctcctc

SEQ ID NO: 12366 - DNA, 27 bp, Homo sapiens
atggttcctttggtcgctcgctcctct

SEQ ID NO: 12367 - DNA, 28 bp, Homo sapiens
atggttcctttggtcgctcgctcctctc

SEQ ID NO: 12368 - DNA, 29 bp, Homo sapiens
atggttcctttggtcgctcgctcctctcc

SEQ ID NO: 12369 - DNA, 30 bp, Homo sapiens; identical to SEQ ID NO: 2038

SEQ ID NO: 12370 - DNA, 31 bp, Homo sapiens
atggttcctttggtcgctcgctcctctccta

SEQ ID NO: 12371 - DNA, 33 bp, Homo sapiens; identical to SEQ ID NO: 2039

SEQ ID NO: 12372 - DNA, 18 bp, Homo sapiens
tggttcctttggtcgctc

SEQ ID NO: 12373 - DNA, 21 bp, Homo sapiens
tggttcctttggtcgctcgct

SEQ ID NO: 12374 - DNA, 22 bp, Homo sapiens
tggttcctttggtcgctcgctc

SEQ ID NO: 12375 - DNA, 23 bp, Homo sapiens
tggttcctttggtcgctcgctcc

SEQ ID NO: 12376 - DNA, 24 bp, Homo sapiens
tggttcctttggtcgctcgctcct

SEQ ID NO: 12377 - DNA, 25 bp, Homo sapiens
tggttcctttggtcgctcgctcctc

SEQ ID NO: 12378 - DNA, 26 bp, Homo sapiens
tggttcctttggtcgctcgctcctct

SEQ ID NO: 12379 - DNA, 29 bp, Homo sapiens
tggttcctttggtcgctcgctcctctcct

SEQ ID NO: 12380 - DNA, 30 bp, Homo sapiens
tggttcctttggtcgctcgctcctctccta

SEQ ID NO: 12381 - DNA, 32 bp, Homo sapiens
tggttcctttggtcgctcgctcctctcctact

SEQ ID NO: 12382 - DNA, 18 bp, Homo sapiens
ggttcctttggtcgctcg

SEQ ID NO: 12383 - DNA, 19 bp, Homo sapiens
ggttcctttggtcgctcgc

SEQ ID NO: 12384 - DNA, 20 bp, Homo sapiens
ggttcctttggtcgctcgct

SEQ ID NO: 12385 - DNA, 21 bp, Homo sapiens
ggttcctttggtcgctcgctc

SEQ ID NO: 12386 - DNA, 22 bp, Homo sapiens
ggttcctttggtcgctcgctcc

SEQ ID NO: 12387 - DNA, 23 bp, Homo sapiens
ggttcctttggtcgctcgctcct

SEQ ID NO: 12388 - DNA, 24 bp, Homo sapiens
ggttcctttggtcgctcgctcctc

SEQ ID NO: 12389 - DNA, 25 bp, Homo sapiens
ggttcctttggtcgctcgctcctct

SEQ ID NO: 12390 - DNA, 26 bp, Homo sapiens
ggttcctttggtcgctcgctcctctc

SEQ ID NO: 12391 - DNA, 27 bp, Homo sapiens
ggttcctttggtcgctcgctcctctcc

SEQ ID NO: 12392 - DNA, 28 bp, Homo sapiens
ggttcctttggtcgctcgctcctctcct

SEQ ID NO: 12393 - DNA, 31 bp, Homo sapiens
ggttcctttggtcgctcgctcctctcctact

SEQ ID NO: 12394 - DNA, 32 bp, Homo sapiens
ggttcctttggtcgctcgctcctctcctactt

SEQ ID NO: 12395 - DNA, 16 bp, Homo sapiens
gttcctttggtcgctc

SEQ ID NO: 12396 - DNA, 17 bp, Homo sapiens
gttcctttggtcgctcg

SEQ ID NO: 12397 - DNA, 18 bp, Homo sapiens
gttcctttggtcgctcgc

SEQ ID NO: 12398 - DNA, 19 bp, Homo sapiens
gttcctttggtcgctcgct

SEQ ID NO: 12399 - DNA, 20 bp, Homo sapiens
gttcctttggtcgctcgctc

SEQ ID NO: 12400 - DNA, 21 bp, Homo sapiens
gttcctttggtcgctcgctcc

SEQ ID NO: 12401 - DNA, 22 bp, Homo sapiens
gttcctttggtcgctcgctcct

SEQ ID NO: 12402 - DNA, 23 bp, Homo sapiens
gttcctttggtcgctcgctcctc

SEQ ID NO: 12403 - DNA, 24 bp, Homo sapiens
gttcctttggtcgctcgctcctct

SEQ ID NO: 12404 - DNA, 25 bp, Homo sapiens
gttcctttggtcgctcgctcctctc

SEQ ID NO: 12405 - DNA, 26 bp, Homo sapiens
gttcctttggtcgctcgctcctctcc

SEQ ID NO: 12406 - DNA, 27 bp, Homo sapiens
gttcctttggtcgctcgctcctctcct

SEQ ID NO: 12407 - DNA, 28 bp, Homo sapiens
gttcctttggtcgctcgctcctctccta

SEQ ID NO: 12408 - DNA, 30 bp, Homo sapiens
gttcctttggtcgctcgctcctctcctact

SEQ ID NO: 12409 - DNA, 16 bp, Homo sapiens
ttcctttggtcgctcg

SEQ ID NO: 12410 - DNA, 17 bp, Homo sapiens
ttcctttggtcgctcgc

SEQ ID NO: 12411 - DNA, 18 bp, Homo sapiens
ttcctttggtcgctcgct

SEQ ID NO: 12412 - DNA, 19 bp, Homo sapiens
ttcctttggtcgctcgctc

SEQ ID NO: 12413 - DNA, 20 bp, Homo sapiens
ttcctttggtcgctcgctcc

SEQ ID NO: 12414 - DNA, 21 bp, Homo sapiens
ttcctttggtcgctcgctcct

SEQ ID NO: 12415 - DNA, 22 bp, Homo sapiens
ttcctttggtcgctcgctcctc

SEQ ID NO: 12416 - DNA, 23 bp, Homo sapiens
ttcctttggtcgctcgctcctct

SEQ ID NO: 12417 - DNA, 25 bp, Homo sapiens
ttcctttggtcgctcgctcctctcc

SEQ ID NO: 12418 - DNA, 26 bp, Homo sapiens
ttcctttggtcgctcgctcctctcct

SEQ ID NO: 12419 - DNA, 27 bp, Homo sapiens
ttcctttggtcgctcgctcctctccta

SEQ ID NO: 12420 - DNA, 33 bp, Homo sapiens
ttcctttggtcgctcgctcctctcctacttgga

SEQ ID NO: 12421 - DNA, 16 bp, Homo sapiens
tcctttggtcgctcgc

SEQ ID NO: 12422 - DNA, 17 bp, Homo sapiens
tcctttggtcgctcgct

SEQ ID NO: 12423 - DNA, 18 bp, Homo sapiens
tcctttggtcgctcgctc

SEQ ID NO: 12424 - DNA, 19 bp, Homo sapiens
tcctttggtcgctcgctcc

SEQ ID NO: 12425 - DNA, 20 bp, Homo sapiens
tcctttggtcgctcgctcct

SEQ ID NO: 12426 - DNA, 21 bp, Homo sapiens
tcctttggtcgctcgctcctc

SEQ ID NO: 12427 - DNA, 22 bp, Homo sapiens
tcctttggtcgctcgctcctct

SEQ ID NO: 12428 - DNA, 24 bp, Homo sapiens
tcctttggtcgctcgctcctctcc

SEQ ID NO: 12429 - DNA, 25 bp, Homo sapiens
tcctttggtcgctcgctcctctcct

SEQ ID NO: 12430 - DNA, 28 bp, Homo sapiens
tcctttggtcgctcgctcctctcctact

SEQ ID NO: 12431 - DNA, 30 bp, Homo sapiens
tcctttggtcgctcgctcctctcctacttg

SEQ ID NO: 12432 - DNA, 31 bp, Homo sapiens
tcctttggtcgctcgctcctctcctacttgg

SEQ ID NO: 12433 - DNA, 32 bp, Homo sapiens
tcctttggtcgctcgctcctctcctacttgga

SEQ ID NO: 12434 - DNA, 22 bp, Homo sapiens
ctttggtcgctcgctcctctcc

SEQ ID NO: 12435 - DNA, 23 bp, Homo sapiens
ctttggtcgctcgctcctctcct

SEQ ID NO: 12436 - DNA, 30 bp, Homo sapiens
ctttggtcgctcgctcctctcctacttgga

SEQ ID NO: 12437 - DNA, 32 bp, Homo sapiens
ctttggtcgctcgctcctctcctacttggata

SEQ ID NO: 12438 - DNA, 33 bp, Homo sapiens
ctttggtcgctcgctcctctcctacttggataa

SEQ ID NO: 12439 - DNA, 16 bp, Homo sapiens
tttggtcgctcgctcc

SEQ ID NO: 12440 - DNA, 17 bp, Homo sapiens
tttggtcgctcgctcct

SEQ ID NO: 12441 - DNA, 18 bp, Homo sapiens
tttggtcgctcgctcctc

SEQ ID NO: 12442 - DNA, 19 bp, Homo sapiens
tttggtcgctcgctcctct

SEQ ID NO: 12443 - DNA, 20 bp, Homo sapiens
tttggtcgctcgctcctctc

SEQ ID NO: 12444 - DNA, 21 bp, Homo sapiens
tttggtcgctcgctcctctcc

SEQ ID NO: 12445 - DNA, 22 bp, Homo sapiens
tttggtcgctcgctcctctcct

SEQ ID NO: 12446 - DNA, 25 bp, Homo sapiens
tttggtcgctcgctcctctcctact

SEQ ID NO: 12447 - DNA, 29 bp, Homo sapiens
tttggtcgctcgctcctctcctacttgga

SEQ ID NO: 12448 - DNA, 30 bp, Homo sapiens
tttggtcgctcgctcctctcctacttggat

SEQ ID NO: 12449 - DNA, 31 bp, Homo sapiens; identical to SEQ ID NO: 2067

SEQ ID NO: 12450 - DNA, 33 bp, Homo sapiens
tttggtcgctcgctcctctcctacttggataac

SEQ ID NO: 12451 - DNA, 16 bp, Homo sapiens
ttggtcgctcgctcct

SEQ ID NO: 12452 - DNA, 21 bp, Homo sapiens
ttggtcgctcgctcctctcct

SEQ ID NO: 12453 - DNA, 33 bp, Homo sapiens
ttggtcgctcgctcctctcctacttggataact

SEQ ID NO: 12454 - DNA, 20 bp, Homo sapiens
tggtcgctcgctcctctcct

SEQ ID NO: 12455 - DNA, 23 bp, Homo sapiens
tggtcgctcgctcctctcctact

SEQ ID NO: 12456 - DNA, 33 bp, Homo sapiens
tggtcgctcgctcctctcctacttggataactg

SEQ ID NO: 12457 - DNA, 26 bp, Homo sapiens
tcgctcctctcctacttggataactg

SEQ ID NO: 12458 - DNA, 16 bp, Homo sapiens
cctctcctacttggat

SEQ ID NO: 12459 - DNA, 30 bp, Homo sapiens
ctctcctacttggataactgtggtaattct

SEQ ID NO: 12460 - DNA, 36 bp, Homo sapiens
ctctcctacttggataactgtggtaattctagagct

SEQ ID NO: 12461 - DNA, 29 bp, Homo sapiens
tctcctacttggataactgtggtaattct

SEQ ID NO: 12462 - DNA, 30 bp, Homo sapiens
tctcctacttggataactgtggtaattcta

SEQ ID NO: 12463 - DNA, 33 bp, Homo sapiens
tctcctacttggataactgtggtaattctagag

SEQ ID NO: 12464 - DNA, 35 bp, Homo sapiens
tctcctacttggataactgtggtaattctagagct

SEQ ID NO: 12465 - DNA, 43 bp, Homo sapiens
tctcctacttggataactgtggtaattctagagctaatacatg

SEQ ID NO: 12466 - DNA, 45 bp, Homo sapiens
tctcctacttggataactgtggtaattctagagctaatacatgcc

SEQ ID NO: 12467 - DNA, 28 bp, Homo sapiens
ctcctacttggataactgtggtaattct

SEQ ID NO: 12468 - DNA, 29 bp, Homo sapiens
ctcctacttggataactgtggtaattcta

SEQ ID NO: 12469 - DNA, 30 bp, Homo sapiens; identical to SEQ ID NO: 2071

SEQ ID NO: 12470 - DNA, 32 bp, Homo sapiens; identical to SEQ ID NO: 2072

SEQ ID NO: 12471 - DNA, 33 bp, Homo sapiens; identical to SEQ ID NO: 2073

SEQ ID NO: 12472 - DNA, 34 bp, Homo sapiens
ctcctacttggataactgtggtaattctagagct

SEQ ID NO: 12473 - DNA, 42 bp, Homo sapiens
ctcctacttggataactgtggtaattctagagctaatacatg

SEQ ID NO: 12474 - DNA, 44 bp, Homo sapiens
ctcctacttggataactgtggtaattctagagctaatacatgcc

SEQ ID NO: 12475 - DNA, 27 bp, Homo sapiens
tcctacttggataactgtggtaattct

SEQ ID NO: 12476 - DNA, 28 bp, Homo sapiens
tcctacttggataactgtggtaattcta

SEQ ID NO: 12477 - DNA, 29 bp, Homo sapiens
tcctacttggataactgtggtaattctag

SEQ ID NO: 12478 - DNA, 31 bp, Homo sapiens
tcctacttggataactgtggtaattctagag

SEQ ID NO: 12479 - DNA, 32 bp, Homo sapiens
tcctacttggataactgtggtaattctagagc

SEQ ID NO: 12480 - DNA, 33 bp, Homo sapiens; identical to SEQ ID NO: 2075

SEQ ID NO: 12481 - DNA, 41 bp, Homo sapiens
tcctacttggataactgtggtaattctagagctaatacatg

SEQ ID NO: 12482 - DNA, 43 bp, Homo sapiens
tcctacttggataactgtggtaattctagagctaatacatgcc

SEQ ID NO: 12483 - DNA, 16 bp, Homo sapiens
cctacttggataactg

SEQ ID NO: 12484 - DNA, 25 bp, Homo sapiens
cctacttggataactgtggtaattc

SEQ ID NO: 12485 - DNA, 26 bp, Homo sapiens
cctacttggataactgtggtaattct

SEQ ID NO: 12486 - DNA, 27 bp, Homo sapiens
cctacttggataactgtggtaattcta

SEQ ID NO: 12487 - DNA, 28 bp, Homo sapiens
cctacttggataactgtggtaattctag

SEQ ID NO: 12488 - DNA, 30 bp, Homo sapiens; identical to SEQ ID NO: 2081

SEQ ID NO: 12489 - DNA, 31 bp, Homo sapiens; identical to SEQ ID NO: 2082

SEQ ID NO: 12490 - DNA, 32 bp, Homo sapiens; identical to SEQ ID NO: 2083

SEQ ID NO: 12491 - DNA, 33 bp, Homo sapiens
cctacttggataactgtggtaattctagagcta

SEQ ID NO: 12492 - DNA, 40 bp, Homo sapiens
cctacttggataactgtggtaattctagagctaatacatg

SEQ ID NO: 12493 - DNA, 42 bp, Homo sapiens
cctacttggataactgtggtaattctagagctaatacatgcc

SEQ ID NO: 12494 - DNA, 45 bp, Homo sapiens
cctacttggataactgtggtaattctagagctaatacatgccgac

SEQ ID NO: 12495 - DNA, 24 bp, Homo sapiens
ctacttggataactgtggtaattc

SEQ ID NO: 12496 - DNA, 25 bp, Homo sapiens
ctacttggataactgtggtaattct

SEQ ID NO: 12497 - DNA, 26 bp, Homo sapiens
ctacttggataactgtggtaattcta

SEQ ID NO: 12498 - DNA, 27 bp, Homo sapiens
ctacttggataactgtggtaattctag

SEQ ID NO: 12499 - DNA, 29 bp, Homo sapiens
ctacttggataactgtggtaattctagag

SEQ ID NO: 12500 - DNA, 30 bp, Homo sapiens; identical to SEQ ID NO: 2087

SEQ ID NO: 12501 - DNA, 31 bp, Homo sapiens; identical to SEQ ID NO: 2088

SEQ ID NO: 12502 - DNA, 41 bp, Homo sapiens
ctacttggataactgtggtaattctagagctaatacatgcc

SEQ ID NO: 12503 - DNA, 23 bp, Homo sapiens
tacttggataactgtggtaattc

SEQ ID NO: 12504 - DNA, 24 bp, Homo sapiens
tacttggataactgtggtaattct

SEQ ID NO: 12505 - DNA, 25 bp, Homo sapiens
tacttggataactgtggtaattcta

SEQ ID NO: 12506 - DNA, 26 bp, Homo sapiens
tacttggataactgtggtaattctag

SEQ ID NO: 12507 - DNA, 28 bp, Homo sapiens
tacttggataactgtggtaattctagag

SEQ ID NO: 12508 - DNA, 29 bp, Homo sapiens
tacttggataactgtggtaattctagagc

SEQ ID NO: 12509 - DNA, 30 bp, Homo sapiens; identical to SEQ ID NO: 2094

SEQ ID NO: 12510 - DNA, 31 bp, Homo sapiens; identical to SEQ ID NO: 2095

SEQ ID NO: 12511 - DNA, 40 bp, Homo sapiens
tacttggataactgtggtaattctagagctaatacatgcc

SEQ ID NO: 12512 - DNA, 43 bp, Homo sapiens
tacttggataactgtggtaattctagagctaatacatgccgac

SEQ ID NO: 12513 - DNA, 22 bp, Homo sapiens
acttggataactgtggtaattc

SEQ ID NO: 12514 - DNA, 23 bp, Homo sapiens
acttggataactgtggtaattct

SEQ ID NO: 12515 - DNA, 24 bp, Homo sapiens
acttggataactgtggtaattcta

SEQ ID NO: 12516 - DNA, 25 bp, Homo sapiens
acttggataactgtggtaattctag

SEQ ID NO: 12517 - DNA, 27 bp, Homo sapiens
acttggataactgtggtaattctagag

SEQ ID NO: 12518 - DNA, 28 bp, Homo sapiens
acttggataactgtggtaattctagagc

SEQ ID NO: 12519 - DNA, 29 bp, Homo sapiens
acttggataactgtggtaattctagagct

SEQ ID NO: 12520 - DNA, 30 bp, Homo sapiens; identical to SEQ ID NO: 2102

SEQ ID NO: 12521 - DNA, 39 bp, Homo sapiens
acttggataactgtggtaattctagagctaatacatgcc

SEQ ID NO: 12522 - DNA, 42 bp, Homo sapiens
acttggataactgtggtaattctagagctaatacatgccgac

SEQ ID NO: 12523 - DNA, 21 bp, Homo sapiens
cttggataactgtggtaattc

SEQ ID NO: 12524 - DNA, 22 bp, Homo sapiens
cttggataactgtggtaattct

SEQ ID NO: 12525 - DNA, 23 bp, Homo sapiens
cttggataactgtggtaattcta

SEQ ID NO: 12526 - DNA, 27 bp, Homo sapiens
cttggataactgtggtaattctagagc

SEQ ID NO: 12527 - DNA, 28 bp, Homo sapiens
cttggataactgtggtaattctagagct

SEQ ID NO: 12528 - DNA, 32 bp, Homo sapiens
cttggataactgtggtaattctagagctaata

SEQ ID NO: 12529 - DNA, 20 bp, Homo sapiens
ttggataactgtggtaattc

SEQ ID NO: 12530 - DNA, 21 bp, Homo sapiens
ttggataactgtggtaattct

SEQ ID NO: 12531 - DNA, 22 bp, Homo sapiens
ttggataactgtggtaattcta

SEQ ID NO: 12532 - DNA, 26 bp, Homo sapiens
ttggataactgtggtaattctagagc

SEQ ID NO: 12533 - DNA, 27 bp, Homo sapiens
ttggataactgtggtaattctagagct

SEQ ID NO: 12534 - DNA, 19 bp, Homo sapiens
tggataactgtggtaattc

SEQ ID NO: 12535 - DNA, 20 bp, Homo sapiens
tggataactgtggtaattct

SEQ ID NO: 12536 - DNA, 21 bp, Homo sapiens
tggataactgtggtaattcta

SEQ ID NO: 12537 - DNA, 25 bp, Homo sapiens
tggataactgtggtaattctagagc

SEQ ID NO: 12538 - DNA, 26 bp, Homo sapiens
tggataactgtggtaattctagagct

SEQ ID NO: 12539 - DNA, 18 bp, Homo sapiens
ggataactgtggtaattc

SEQ ID NO: 12540 - DNA, 19 bp, Homo sapiens
ggataactgtggtaattct

SEQ ID NO: 12541 - DNA, 20 bp, Homo sapiens
ggataactgtggtaattcta

SEQ ID NO: 12542 - DNA, 23 bp, Homo sapiens
ggataactgtggtaattctagag

SEQ ID NO: 12543 - DNA, 24 bp, Homo sapiens
ggataactgtggtaattctagagc

SEQ ID NO: 12544 - DNA, 25 bp, Homo sapiens
ggataactgtggtaattctagagct

SEQ ID NO: 12545 - DNA, 26 bp, Homo sapiens
ggataactgtggtaattctagagcta

SEQ ID NO: 12546 - DNA, 35 bp, Homo sapiens
ggataactgtggtaattctagagctaatacatgcc

SEQ ID NO: 12547 - DNA, 17 bp, Homo sapiens
gataactgtggtaattc

SEQ ID NO: 12548 - DNA, 18 bp, Homo sapiens
gataactgtggtaattct

SEQ ID NO: 12549 - DNA, 19 bp, Homo sapiens
gataactgtggtaattcta

SEQ ID NO: 12550 - DNA, 22 bp, Homo sapiens
gataactgtggtaattctagag

SEQ ID NO: 12551 - DNA, 23 bp, Homo sapiens
gataactgtggtaattctagagc

SEQ ID NO: 12552 - DNA, 24 bp, Homo sapiens
gataactgtggtaattctagagct

SEQ ID NO: 12553 - DNA, 25 bp, Homo sapiens
gataactgtggtaattctagagcta

SEQ ID NO: 12554 - DNA, 30 bp, Homo sapiens
gataactgtggtaattctagagctaataca

SEQ ID NO: 12555 - DNA, 32 bp, Homo sapiens
gataactgtggtaattctagagctaatacatg

SEQ ID NO: 12556 - DNA, 33 bp, Homo sapiens; identical to SEQ ID NO: 2113

SEQ ID NO: 12557 - DNA, 34 bp, Homo sapiens
gataactgtggtaattctagagctaatacatgcc

SEQ ID NO: 12558 - DNA, 17 bp, Homo sapiens
ataactgtggtaattct

SEQ ID NO: 12559 - DNA, 21 bp, Homo sapiens
ataactgtggtaattctagag

SEQ ID NO: 12560 - DNA, 22 bp, Homo sapiens
ataactgtggtaattctagagc

SEQ ID NO: 12561 - DNA, 23 bp, Homo sapiens
ataactgtggtaattctagagct

SEQ ID NO: 12562 - DNA, 24 bp, Homo sapiens
ataactgtggtaattctagagcta

SEQ ID NO: 12563 - DNA, 32 bp, Homo sapiens
ataactgtggtaattctagagctaatacatgc

SEQ ID NO: 12564 - DNA, 33 bp, Homo sapiens; identical to SEQ ID NO: 2115

SEQ ID NO: 12565 - DNA, 16 bp, Homo sapiens
taactgtggtaattct

SEQ ID NO: 12566 - DNA, 17 bp, Homo sapiens
taactgtggtaattcta

SEQ ID NO: 12567 - DNA, 22 bp, Homo sapiens
taactgtggtaattctagagct

SEQ ID NO: 12568 - DNA, 23 bp, Homo sapiens
taactgtggtaattctagagcta

SEQ ID NO: 12569 - DNA, 26 bp, Homo sapiens
taactgtggtaattctagagctaata

SEQ ID NO: 12570 - DNA, 28 bp, Homo sapiens
taactgtggtaattctagagctaataca

SEQ ID NO: 12571 - DNA, 32 bp, Homo sapiens; identical to SEQ ID NO: 2116

SEQ ID NO: 12572 - DNA, 33 bp, Homo sapiens
taactgtggtaattctagagctaatacatgccg

SEQ ID NO: 12573 - DNA, 16 bp, Homo sapiens
aactgtggtaattcta

SEQ ID NO: 12574 - DNA, 19 bp, Homo sapiens
aactgtggtaattctagag

SEQ ID NO: 12575 - DNA, 20 bp, Homo sapiens
aactgtggtaattctagagc

SEQ ID NO: 12576 - DNA, 21 bp, Homo sapiens
aactgtggtaattctagagct

SEQ ID NO: 12577 - DNA, 30 bp, Homo sapiens; identical to SEQ ID NO: 2119

SEQ ID NO: 12578 - DNA, 31 bp, Homo sapiens; identical to SEQ ID NO: 2120

SEQ ID NO: 12579 - DNA, 32 bp, Homo sapiens; identical to SEQ ID NO: 2121

SEQ ID NO: 12580 - DNA, 20 bp, Homo sapiens
actgtggtaattctagagct

SEQ ID NO: 12581 - DNA, 21 bp, Homo sapiens
actgtggtaattctagagcta

SEQ ID NO: 12582 - DNA, 24 bp, Homo sapiens
actgtggtaattctagagctaata

SEQ ID NO: 12583 - DNA, 26 bp, Homo sapiens
actgtggtaattctagagctaataca

SEQ ID NO: 12584 - DNA, 30 bp, Homo sapiens; identical to SEQ ID NO: 2123

SEQ ID NO: 12585 - DNA, 31 bp, Homo sapiens; identical to SEQ ID NO: 2124

SEQ ID NO: 12586 - DNA, 32 bp, Homo sapiens
actgtggtaattctagagctaatacatgccga

SEQ ID NO: 12587 - DNA, 33 bp, Homo sapiens
actgtggtaattctagagctaatacatgccgac

SEQ ID NO: 12588 - DNA, 19 bp, Homo sapiens
ctgtggtaattctagagct

SEQ ID NO: 12589 - DNA, 20 bp, Homo sapiens
ctgtggtaattctagagcta

SEQ ID NO: 12590 - DNA, 23 bp, Homo sapiens
ctgtggtaattctagagctaata

SEQ ID NO: 12591 - DNA, 25 bp, Homo sapiens
ctgtggtaattctagagctaataca

SEQ ID NO: 12592 - DNA, 29 bp, Homo sapiens
ctgtggtaattctagagctaatacatgcc

SEQ ID NO: 12593 - DNA, 31 bp, Homo sapiens
ctgtggtaattctagagctaatacatgccga

SEQ ID NO: 12594 - DNA, 18 bp, Homo sapiens
tgtggtaattctagagct

SEQ ID NO: 12595 - DNA, 28 bp, Homo sapiens
tgtggtaattctagagctaatacatgcc

SEQ ID NO: 12596 - DNA, 17 bp, Homo sapiens
gtggtaattctagagct

SEQ ID NO: 12597 - DNA, 27 bp, Homo sapiens
gtggtaattctagagctaatacatgcc

SEQ ID NO: 12598 - DNA, 46 bp, Homo sapiens
taattctagagctaatacatgccgacgggcgctgacccccttcgcg

SEQ ID NO: 12599 - DNA, 16 bp, Homo sapiens
aattctagagctaata

SEQ ID NO: 12600 - DNA, 18 bp, Homo sapiens
aattctagagctaataca

SEQ ID NO: 12601 - DNA, 45 bp, Homo sapiens
aattctagagctaatacatgccgacgggcgctgacccccttcgcg

SEQ ID NO: 12602 - DNA, 17 bp, Homo sapiens
attctagagctaataca

SEQ ID NO: 12603 - DNA, 31 bp, Homo sapiens
attctagagctaatacatgccgacgggcgct

SEQ ID NO: 12604 - DNA, 44 bp, Homo sapiens
attctagagctaatacatgccgacgggcgctgacccccttcgcg

SEQ ID NO: 12605 - DNA, 18 bp, Homo sapiens
ctagagctaatacatgcc

SEQ ID NO: 12606 - DNA, 21 bp, Homo sapiens
ctagagctaatacatgccgac

SEQ ID NO: 12607 - DNA, 31 bp, Homo sapiens
tagagctaatacatgccgacgggcgctgacc

SEQ ID NO: 12608 - DNA, 22 bp, Homo sapiens
gagctaatacatgccgacgggc

SEQ ID NO: 12609 - DNA, 25 bp, Homo sapiens
taatacatgccgacgggcgctgacc

SEQ ID NO: 12610 - DNA, 26 bp, Homo sapiens
taatacatgccgacgggcgctgaccc

SEQ ID NO: 12611 - DNA, 27 bp, Homo sapiens
taatacatgccgacgggcgctgacccc

SEQ ID NO: 12612 - DNA, 18 bp, Homo sapiens
aatacatgccgacgggcg

SEQ ID NO: 12613 - DNA, 24 bp, Homo sapiens
aatacatgccgacgggcgctgacc

SEQ ID NO: 12614 - DNA, 25 bp, Homo sapiens
aatacatgccgacgggcgctgaccc

SEQ ID NO: 12615 - DNA, 26 bp, Homo sapiens
aatacatgccgacgggcgctgacccc

SEQ ID NO: 12616 - DNA, 27 bp, Homo sapiens
aatacatgccgacgggcgctgaccccc

SEQ ID NO: 12617 - DNA, 28 bp, Homo sapiens
aatacatgccgacgggcgctgaccccct

SEQ ID NO: 12618 - DNA, 29 bp, Homo sapiens
aatacatgccgacgggcgctgaccccctt

SEQ ID NO: 12619 - DNA, 30 bp, Homo sapiens
aatacatgccgacgggcgctgacccccttc

SEQ ID NO: 12620 - DNA, 16 bp, Homo sapiens
atacatgccgacgggc

SEQ ID NO: 12621 - DNA, 17 bp, Homo sapiens
atacatgccgacgggcg

SEQ ID NO: 12622 - DNA, 23 bp, Homo sapiens
atacatgccgacgggcgctgacc

SEQ ID NO: 12623 - DNA, 24 bp, Homo sapiens
atacatgccgacgggcgctgaccc

SEQ ID NO: 12624 - DNA, 25 bp, Homo sapiens
atacatgccgacgggcgctgacccc

SEQ ID NO: 12625 - DNA, 27 bp, Homo sapiens
atacatgccgacgggcgctgaccccct

SEQ ID NO: 12626 - DNA, 33 bp, Homo sapiens
atacatgccgacgggcgctgacccccttcgcgg

SEQ ID NO: 12627 - DNA, 16 bp, Homo sapiens
tacatgccgacgggcg

SEQ ID NO: 12628 - DNA, 22 bp, Homo sapiens
tacatgccgacgggcgctgacc

SEQ ID NO: 12629 - DNA, 23 bp, Homo sapiens
tacatgccgacgggcgctgaccc

SEQ ID NO: 12630 - DNA, 24 bp, Homo sapiens
tacatgccgacgggcgctgacccc

SEQ ID NO: 12631 - DNA, 26 bp, Homo sapiens
tacatgccgacgggcgctgaccccct

SEQ ID NO: 12632 - DNA, 27 bp, Homo sapiens
tacatgccgacgggcgctgaccccctt

SEQ ID NO: 12633 - DNA, 20 bp, Homo sapiens
catgccgacgggcgctgacc

SEQ ID NO: 12634 - DNA, 21 bp, Homo sapiens
catgccgacgggcgctgaccc

SEQ ID NO: 12635 - DNA, 22 bp, Homo sapiens
catgccgacgggcgctgacccc

SEQ ID NO: 12636 - DNA, 24 bp, Homo sapiens
catgccgacgggcgctgaccccct

SEQ ID NO: 12637 - DNA, 29 bp, Homo sapiens
catgccgacgggcgctgacccccttcgcg

SEQ ID NO: 12638 - DNA, 31 bp, Homo sapiens
catgccgacgggcgctgacccccttcgcggg

SEQ ID NO: 12639 - DNA, 23 bp, Homo sapiens
atgccgacgggcgctgaccccct

SEQ ID NO: 12640 - DNA, 19 bp, Homo sapiens
tgccgacgggcgctgaccc

SEQ ID NO: 12641 - DNA, 22 bp, Homo sapiens
tgccgacgggcgctgaccccct

SEQ ID NO: 12642 - DNA, 29 bp, Homo sapiens
tgccgacgggcgctgacccccttcgcggg

SEQ ID NO: 12643 - DNA, 30 bp, Homo sapiens
tgccgacgggcgctgacccccttcgcgggg

SEQ ID NO: 12644 - DNA, 18 bp, Homo sapiens
gccgacgggcgctgaccc

SEQ ID NO: 12645 - DNA, 19 bp, Homo sapiens
gccgacgggcgctgacccc

SEQ ID NO: 12646 - DNA, 21 bp, Homo sapiens
gccgacgggcgctgaccccct

SEQ ID NO: 12647 - DNA, 16 bp, Homo sapiens
ccgacgggcgctgacc

SEQ ID NO: 12648 - DNA, 17 bp, Homo sapiens
ccgacgggcgctgaccc

SEQ ID NO: 12649 - DNA, 18 bp, Homo sapiens
ccgacgggcgctgacccc

SEQ ID NO: 12650 - DNA, 19 bp, Homo sapiens
ccgacgggcgctgaccccc

SEQ ID NO: 12651 - DNA, 20 bp, Homo sapiens
ccgacgggcgctgaccccct

SEQ ID NO: 12652 - DNA, 32 bp, Homo sapiens
ccgacgggcgctgacccccttcgcggggggga

SEQ ID NO: 12653 - DNA, 16 bp, Homo sapiens
cgacgggcgctgaccc

SEQ ID NO: 12654 - DNA, 18 bp, Homo sapiens
cgacgggcgctgaccccc

SEQ ID NO: 12655 - DNA, 19 bp, Homo sapiens
cgacgggcgctgaccccct

SEQ ID NO: 12656 - DNA, 31 bp, Homo sapiens
cgacgggcgctgacccccttcgcggggggga

SEQ ID NO: 12657 - DNA, 33 bp, Homo sapiens; identical to SEQ ID NO: 2142

SEQ ID NO: 12658 - DNA, 18 bp, Homo sapiens
gacgggcgctgaccccct

SEQ ID NO: 12659 - DNA, 32 bp, Homo sapiens; identical to SEQ ID NO: 2143

SEQ ID NO: 12660 - DNA, 33 bp, Homo sapiens; identical to SEQ ID NO: 2144

SEQ ID NO: 12661 - DNA, 31 bp, Homo sapiens
acgggcgctgacccccttcgcgggggggatg

SEQ ID NO: 12662 - DNA, 32 bp, Homo sapiens
acgggcgctgacccccttcgcgggggggatgc

SEQ ID NO: 12663 - DNA, 23 bp, Homo sapiens
cgggcgctgacccccttcgcggg

SEQ ID NO: 12664 - DNA, 24 bp, Homo sapiens
cgggcgctgacccccttcgcgggg

SEQ ID NO: 12665 - DNA, 25 bp, Homo sapiens
cgggcgctgacccccttcgcggggg

SEQ ID NO: 12666 - DNA, 26 bp, Homo sapiens
cgggcgctgacccccttcgcgggggg

SEQ ID NO: 12667 - DNA, 28 bp, Homo sapiens
cgggcgctgacccccttcgcggggggga

SEQ ID NO: 12668 - DNA, 26 bp, Homo sapiens
cgctgacccccttcgcgggggggatg

SEQ ID NO: 12669 - DNA, 25 bp, Homo sapiens
gctgacccccttcgcgggggggatg

SEQ ID NO: 12670 - DNA, 24 bp, Homo sapiens
ctgacccccttcgcgggggggatg

SEQ ID NO: 12671 - DNA, 23 bp, Homo sapiens
cccccttcgcgggggggatgcgt

SEQ ID NO: 12672 - DNA, 33 bp, Homo sapiens
cccccttcgcgggggggatgcgtgcatttatca

SEQ ID NO: 12673 - DNA, 33 bp, Homo sapiens
cccttcgcgggggggatgcgtgcatttatcaga

SEQ ID NO: 12674 - DNA, 32 bp, Homo sapiens
ccttcgcgggggggatgcgtgcatttatcaga

SEQ ID NO: 12675 - DNA, 33 bp, Homo sapiens
ccttcgcgggggggatgcgtgcatttatcagat

SEQ ID NO: 12676 - DNA, 31 bp, Homo sapiens
cttcgcgggggggatgcgtgcatttatcaga

SEQ ID NO: 12677 - DNA, 32 bp, Homo sapiens
cttcgcgggggggatgcgtgcatttatcagat

SEQ ID NO: 12678 - DNA, 30 bp, Homo sapiens
ttcgcgggggggatgcgtgcatttatcaga

SEQ ID NO: 12679 - DNA, 31 bp, Homo sapiens
ttcgcgggggggatgcgtgcatttatcagat

SEQ ID NO: 12680 - DNA, 29 bp, Homo sapiens
tcgcgggggggatgcgtgcatttatcaga

SEQ ID NO: 12681 - DNA, 28 bp, Homo sapiens
cgcgggggggatgcgtgcatttatcaga

SEQ ID NO: 12682 - DNA, 29 bp, Homo sapiens
cgcgggggggatgcgtgcatttatcagat

SEQ ID NO: 12683 - DNA, 26 bp, Homo sapiens
cgggggggatgcgtgcatttatcaga

SEQ ID NO: 12684 - DNA, 17 bp, Homo sapiens
ggggggatgcgtgcatt

SEQ ID NO: 12685 - DNA, 18 bp, Homo sapiens
ggggggatgcgtgcattt

SEQ ID NO: 12686 - DNA, 22 bp, Homo sapiens
ggggggatgcgtgcatttatca

SEQ ID NO: 12687 - DNA, 21 bp, Homo sapiens
gggggatgcgtgcatttatca

SEQ ID NO: 12688 - DNA, 20 bp, Homo sapiens
tgcgtgcatttatcagatca

SEQ ID NO: 12689 - DNA, 23 bp, Homo sapiens
atcagatcaaaaccaacccggtc

SEQ ID NO: 12690 - DNA, 32 bp, Homo sapiens
atcagatcaaaaccaacccggtcagcccctct

SEQ ID NO: 12691 - DNA, 33 bp, Homo sapiens
atcagatcaaaaccaacccggtcagcccctctc

SEQ ID NO: 12692 - DNA, 34 bp, Homo sapiens
atcagatcaaaaccaacccggtcagcccctctcc

SEQ ID NO: 12693 - DNA, 43 bp, Homo sapiens
atcagatcaaaaccaacccggtcagcccctctccggccccggc

SEQ ID NO: 12694 - DNA, 33 bp, Homo sapiens
tcagatcaaaaccaacccggtcagcccctctcc

SEQ ID NO: 12695 - DNA, 32 bp, Homo sapiens
cagatcaaaaccaacccggtcagcccctctcc

SEQ ID NO: 12696 - DNA, 31 bp, Homo sapiens
agatcaaaaccaacccggtcagcccctctcc

SEQ ID NO: 12697 - DNA, 28 bp, Homo sapiens
gatcaaaaccaacccggtcagcccctct

SEQ ID NO: 12698 - DNA, 29 bp, Homo sapiens
gatcaaaaccaacccggtcagcccctctc

SEQ ID NO: 12699 - DNA, 30 bp, Homo sapiens; identical to SEQ ID NO: 2146

SEQ ID NO: 12700 - DNA, 31 bp, Homo sapiens
gatcaaaaccaacccggtcagcccctctccg

SEQ ID NO: 12701 - DNA, 28 bp, Homo sapiens
atcaaaaccaacccggtcagcccctctc

SEQ ID NO: 12702 - DNA, 29 bp, Homo sapiens
atcaaaaccaacccggtcagcccctctcc

SEQ ID NO: 12703 - DNA, 30 bp, Homo sapiens
atcaaaaccaacccggtcagcccctctccg

SEQ ID NO: 12704 - DNA, 28 bp, Homo sapiens
tcaaaaccaacccggtcagcccctctcc

SEQ ID NO: 12705 - DNA, 23 bp, Homo sapiens
cccggtcagcccctctccggccc

SEQ ID NO: 12706 - DNA, 24 bp, Homo sapiens
cccggtcagcccctctccggcccc

SEQ ID NO: 12707 - DNA, 25 bp, Homo sapiens
cccggtcagcccctctccggccccg

SEQ ID NO: 12708 - DNA, 22 bp, Homo sapiens
ccggtcagcccctctccggccc

SEQ ID NO: 12709 - DNA, 23 bp, Homo sapiens
ccggtcagcccctctccggcccc

SEQ ID NO: 12710 - DNA, 24 bp, Homo sapiens
ccggtcagcccctctccggccccg

SEQ ID NO: 12711 - DNA, 42 bp, Homo sapiens
agcccctctccggccccggccggggggcgggcgccggcggct

SEQ ID NO: 12712 - DNA, 16 bp, Homo sapiens
cccctctccggccccg

SEQ ID NO: 12713 - DNA, 29 bp, Homo sapiens
ccctctccggccccggccggggggcgggc

SEQ ID NO: 12714 - DNA, 28 bp, Homo sapiens
cctctccggccccggccggggggcgggc

SEQ ID NO: 12715 - DNA, 23 bp, Homo sapiens
ccggccccggccggggggcgggc

SEQ ID NO: 12716 - DNA, 22 bp, Homo sapiens
cggccccggccggggggcgggc

SEQ ID NO: 12717 - DNA, 33 bp, Homo sapiens
cggccccggccggggggcgggcgccggcggctt

SEQ ID NO: 12718 - DNA, 26 bp, Homo sapiens
gccccggccggggggcgggcgccggc

SEQ ID NO: 12719 - DNA, 27 bp, Homo sapiens
gccccggccggggggcgggcgccggcg

SEQ ID NO: 12720 - DNA, 28 bp, Homo sapiens
gccccggccggggggcgggcgccggcgg

SEQ ID NO: 12721 - DNA, 29 bp, Homo sapiens
gccccggccggggggcgggcgccggcggc

SEQ ID NO: 12722 - DNA, 30 bp, Homo sapiens
gccccggccggggggcgggcgccggcggct

SEQ ID NO: 12723 - DNA, 17 bp, Homo sapiens
gccggggggcgggcgcc

SEQ ID NO: 12724 - DNA, 20 bp, Homo sapiens
ccggggggcgggcgccggcg

SEQ ID NO: 12725 - DNA, 24 bp, Homo sapiens
gggcgccggcggctttggtgactc

SEQ ID NO: 12726 - DNA, 25 bp, Homo sapiens
ggcgccggcggctttggtgactcta

SEQ ID NO: 12727 - DNA, 27 bp, Homo sapiens
ggcgccggcggctttggtgactctaga

SEQ ID NO: 12728 - DNA, 29 bp, Homo sapiens
ggcgccggcggctttggtgactctagata

SEQ ID NO: 12729 - DNA, 24 bp, Homo sapiens
gcgccggcggctttggtgactcta

SEQ ID NO: 12730 - DNA, 26 bp, Homo sapiens
gcgccggcggctttggtgactctaga

SEQ ID NO: 12731 - DNA, 28 bp, Homo sapiens
gcgccggcggctttggtgactctagata

SEQ ID NO: 12732 - DNA, 23 bp, Homo sapiens
cgccggcggctttggtgactcta

SEQ ID NO: 12733 - DNA, 25 bp, Homo sapiens
cgccggcggctttggtgactctaga

SEQ ID NO: 12734 - DNA, 27 bp, Homo sapiens
cgccggcggctttggtgactctagata

SEQ ID NO: 12735 - DNA, 23 bp, Homo sapiens
ccggcggctttggtgactctaga

SEQ ID NO: 12736 - DNA, 16 bp, Homo sapiens
cggcggctttggtgac

SEQ ID NO: 12737 - DNA, 17 bp, Homo sapiens
cggcggctttggtgact

SEQ ID NO: 12738 - DNA, 22 bp, Homo sapiens
cggcggctttggtgactctaga

SEQ ID NO: 12739 - DNA, 21 bp, Homo sapiens
ggcggctttggtgactctaga

SEQ ID NO: 12740 - DNA, 18 bp, Homo sapiens
gcggctttggtgactcta

SEQ ID NO: 12741 - DNA, 20 bp, Homo sapiens
gcggctttggtgactctaga

SEQ ID NO: 12742 - DNA, 22 bp, Homo sapiens
gcggctttggtgactctagata

SEQ ID NO: 12743 - DNA, 16 bp, Homo sapiens
cggctttggtgactct

SEQ ID NO: 12744 - DNA, 17 bp, Homo sapiens
cggctttggtgactcta

SEQ ID NO: 12745 - DNA, 19 bp, Homo sapiens
cggctttggtgactctaga

SEQ ID NO: 12746 - DNA, 21 bp, Homo sapiens
cggctttggtgactctagata

SEQ ID NO: 12747 - DNA, 25 bp, Homo sapiens
ggctttggtgactctagataacctc

SEQ ID NO: 12748 - DNA, 29 bp, Homo sapiens
ggctttggtgactctagataacctcgggc

SEQ ID NO: 12749 - DNA, 38 bp, Homo sapiens
ggctttggtgactctagataacctcgggccgatcgcac

SEQ ID NO: 12750 - DNA, 39 bp, Homo sapiens
ggctttggtgactctagataacctcgggccgatcgcacg

SEQ ID NO: 12751 - DNA, 41 bp, Homo sapiens
ggctttggtgactctagataacctcgggccgatcgcacgcc

SEQ ID NO: 12752 - DNA, 22 bp, Homo sapiens
gctttggtgactctagataacc

SEQ ID NO: 12753 - DNA, 23 bp, Homo sapiens
gctttggtgactctagataacct

SEQ ID NO: 12754 - DNA, 24 bp, Homo sapiens
gctttggtgactctagataacctc

SEQ ID NO: 12755 - DNA, 28 bp, Homo sapiens
gctttggtgactctagataacctcgggc

SEQ ID NO: 12756 - DNA, 29 bp, Homo sapiens
gctttggtgactctagataacctcgggcc

SEQ ID NO: 12757 - DNA, 30 bp, Homo sapiens
gctttggtgactctagataacctcgggccg

SEQ ID NO: 12758 - DNA, 31 bp, Homo sapiens
gctttggtgactctagataacctcgggccga

SEQ ID NO: 12759 - DNA, 32 bp, Homo sapiens
gctttggtgactctagataacctcgggccgat

SEQ ID NO: 12760 - DNA, 33 bp, Homo sapiens
gctttggtgactctagataacctcgggccgatc

SEQ ID NO: 12761 - DNA, 37 bp, Homo sapiens
gctttggtgactctagataacctcgggccgatcgcac

SEQ ID NO: 12762 - DNA, 28 bp, Homo sapiens
ctttggtgactctagataacctcgggcc

SEQ ID NO: 12763 - DNA, 29 bp, Homo sapiens
ctttggtgactctagataacctcgggccg

SEQ ID NO: 12764 - DNA, 32 bp, Homo sapiens
ctttggtgactctagataacctcgggccgatc

SEQ ID NO: 12765 - DNA, 33 bp, Homo sapiens
ctttggtgactctagataacctcgggccgatcg

SEQ ID NO: 12766 - DNA, 35 bp, Homo sapiens
ctttggtgactctagataacctcgggccgatcgca

SEQ ID NO: 12767 - DNA, 36 bp, Homo sapiens
ctttggtgactctagataacctcgggccgatcgcac

SEQ ID NO: 12768 - DNA, 37 bp, Homo sapiens
ctttggtgactctagataacctcgggccgatcgcacg

SEQ ID NO: 12769 - DNA, 19 bp, Homo sapiens
tttggtgactctagataac

SEQ ID NO: 12770 - DNA, 20 bp, Homo sapiens
tttggtgactctagataacc

SEQ ID NO: 12771 - DNA, 27 bp, Homo sapiens
tttggtgactctagataacctcgggcc

SEQ ID NO: 12772 - DNA, 16 bp, Homo sapiens
ttggtgactctagata

SEQ ID NO: 12773 - DNA, 18 bp, Homo sapiens
ttggtgactctagataac

SEQ ID NO: 12774 - DNA, 19 bp, Homo sapiens
ttggtgactctagataacc

SEQ ID NO: 12775 - DNA, 20 bp, Homo sapiens
ttggtgactctagataacct

SEQ ID NO: 12776 - DNA, 24 bp, Homo sapiens
ttggtgactctagataacctcggg

SEQ ID NO: 12777 - DNA, 25 bp, Homo sapiens
ttggtgactctagataacctcgggc

SEQ ID NO: 12778 - DNA, 26 bp, Homo sapiens
ttggtgactctagataacctcgggcc

SEQ ID NO: 12779 - DNA, 28 bp, Homo sapiens
ttggtgactctagataacctcgggccga

SEQ ID NO: 12780 - DNA, 29 bp, Homo sapiens
ttggtgactctagataacctcgggccgat

SEQ ID NO: 12781 - DNA, 30 bp, Homo sapiens; identical to SEQ ID NO: 2158

SEQ ID NO: 12782 - DNA, 31 bp, Homo sapiens
ttggtgactctagataacctcgggccgatcg

SEQ ID NO: 12783 - DNA, 32 bp, Homo sapiens
ttggtgactctagataacctcgggccgatcgc

SEQ ID NO: 12784 - DNA, 33 bp, Homo sapiens; identical to SEQ ID NO: 2159

SEQ ID NO: 12785 - DNA, 34 bp, Homo sapiens
ttggtgactctagataacctcgggccgatcgcac

SEQ ID NO: 12786 - DNA, 35 bp, Homo sapiens
ttggtgactctagataacctcgggccgatcgcacg

SEQ ID NO: 12787 - DNA, 36 bp, Homo sapiens
ttggtgactctagataacctcgggccgatcgcacgc

SEQ ID NO: 12788 - DNA, 37 bp, Homo sapiens
ttggtgactctagataacctcgggccgatcgcacgcc

SEQ ID NO: 12789 - DNA, 40 bp, Homo sapiens
ttggtgactctagataacctcgggccgatcgcacgccccc

SEQ ID NO: 12790 - DNA, 41 bp, Homo sapiens
ttggtgactctagataacctcgggccgatcgcacgcccccc

SEQ ID NO: 12791 - DNA, 18 bp, Homo sapiens
tggtgactctagataacc

SEQ ID NO: 12792 - DNA, 25 bp, Homo sapiens
tggtgactctagataacctcgggcc

SEQ ID NO: 12793 - DNA, 29 bp, Homo sapiens
tggtgactctagataacctcgggccgatc

SEQ ID NO: 12794 - DNA, 32 bp, Homo sapiens
tggtgactctagataacctcgggccgatcgca

SEQ ID NO: 12795 - DNA, 33 bp, Homo sapiens; identical to SEQ ID NO: 2162

SEQ ID NO: 12796 - DNA, 16 bp, Homo sapiens
ggtgactctagataac

SEQ ID NO: 12797 - DNA, 17 bp, Homo sapiens
ggtgactctagataacc

SEQ ID NO: 12798 - DNA, 18 bp, Homo sapiens
ggtgactctagataacct

SEQ ID NO: 12799 - DNA, 19 bp, Homo sapiens
ggtgactctagataacctc

SEQ ID NO: 12800 - DNA, 23 bp, Homo sapiens
ggtgactctagataacctcgggc

SEQ ID NO: 12801 - DNA, 24 bp, Homo sapiens
ggtgactctagataacctcgggcc

SEQ ID NO: 12802 - DNA, 27 bp, Homo sapiens
ggtgactctagataacctcgggccgat

SEQ ID NO: 12803 - DNA, 28 bp, Homo sapiens
ggtgactctagataacctcgggccgatc

SEQ ID NO: 12804 - DNA, 30 bp, Homo sapiens
ggtgactctagataacctcgggccgatcgc

SEQ ID NO: 12805 - DNA, 31 bp, Homo sapiens; identical to SEQ ID NO: 2167

SEQ ID NO: 12806 - DNA, 32 bp, Homo sapiens; identical to SEQ ID NO: 2168

SEQ ID NO: 12807 - DNA, 33 bp, Homo sapiens; identical to SEQ ID NO: 2169

SEQ ID NO: 12808 - DNA, 35 bp, Homo sapiens
ggtgactctagataacctcgggccgatcgcacgcc

SEQ ID NO: 12809 - DNA, 43 bp, Homo sapiens
ggtgactctagataacctcgggccgatcgcacgccccccgtgg

SEQ ID NO: 12810 - DNA, 16 bp, Homo sapiens
gtgactctagataacc

SEQ ID NO: 12811 - DNA, 17 bp, Homo sapiens
gtgactctagataacct

SEQ ID NO: 12812 - DNA, 18 bp, Homo sapiens
gtgactctagataacctc

SEQ ID NO: 12813 - DNA, 21 bp, Homo sapiens
gtgactctagataacctcggg

SEQ ID NO: 12814 - DNA, 22 bp, Homo sapiens
gtgactctagataacctcgggc

SEQ ID NO: 12815 - DNA, 23 bp, Homo sapiens
gtgactctagataacctcgggcc

SEQ ID NO: 12816 - DNA, 27 bp, Homo sapiens
gtgactctagataacctcgggccgatc

SEQ ID NO: 12817 - DNA, 30 bp, Homo sapiens; identical to SEQ ID NO: 2174

SEQ ID NO: 12818 - DNA, 31 bp, Homo sapiens; identical to SEQ ID NO: 2175

SEQ ID NO: 12819 - DNA, 32 bp, Homo sapiens; identical to SEQ ID NO: 2176

SEQ ID NO: 12820 - DNA, 33 bp, Homo sapiens; identical to SEQ ID NO: 2177

SEQ ID NO: 12821 - DNA, 34 bp, Homo sapiens
gtgactctagataacctcgggccgatcgcacgcc

SEQ ID NO: 12822 - DNA, 36 bp, Homo sapiens
gtgactctagataacctcgggccgatcgcacgcccc

SEQ ID NO: 12823 - DNA, 37 bp, Homo sapiens
gtgactctagataacctcgggccgatcgcacgccccc

SEQ ID NO: 12824 - DNA, 38 bp, Homo sapiens
gtgactctagataacctcgggccgatcgcacgcccccc

SEQ ID NO: 12825 - DNA, 39 bp, Homo sapiens
gtgactctagataacctcgggccgatcgcacgccccccg

SEQ ID NO: 12826 - DNA, 42 bp, Homo sapiens
gtgactctagataacctcgggccgatcgcacgccccccgtgg

SEQ ID NO: 12827 - DNA, 16 bp, Homo sapiens
tgactctagataacct

SEQ ID NO: 12828 - DNA, 17 bp, Homo sapiens
tgactctagataacctc

SEQ ID NO: 12829 - DNA, 22 bp, Homo sapiens
tgactctagataacctcgggcc

SEQ ID NO: 12830 - DNA, 30 bp, Homo sapiens; identical to SEQ ID NO: 2179

SEQ ID NO: 12831 - DNA, 31 bp, Homo sapiens; identical to SEQ ID NO: 2180

SEQ ID NO: 12832 - DNA, 32 bp, Homo sapiens; identical to SEQ ID NO: 2181

SEQ ID NO: 12833 - DNA, 33 bp, Homo sapiens
tgactctagataacctcgggccgatcgcacgcc

SEQ ID NO: 12834 - DNA, 29 bp, Homo sapiens
gactctagataacctcgggccgatcgcac

SEQ ID NO: 12835 - DNA, 30 bp, Homo sapiens
gactctagataacctcgggccgatcgcacg

SEQ ID NO: 12836 - DNA, 31 bp, Homo sapiens
gactctagataacctcgggccgatcgcacgc

SEQ ID NO: 12837 - DNA, 32 bp, Homo sapiens
gactctagataacctcgggccgatcgcacgcc

SEQ ID NO: 12838 - DNA, 20 bp, Homo sapiens
actctagataacctcgggcc

SEQ ID NO: 12839 - DNA, 22 bp, Homo sapiens
actctagataacctcgggccga

SEQ ID NO: 12840 - DNA, 25 bp, Homo sapiens
actctagataacctcgggccgatcg

SEQ ID NO: 12841 - DNA, 26 bp, Homo sapiens
actctagataacctcgggccgatcgc

SEQ ID NO: 12842 - DNA, 28 bp, Homo sapiens
actctagataacctcgggccgatcgcac

SEQ ID NO: 12843 - DNA, 29 bp, Homo sapiens
actctagataacctcgggccgatcgcacg

SEQ ID NO: 12844 - DNA, 31 bp, Homo sapiens
actctagataacctcgggccgatcgcacgcc

SEQ ID NO: 12845 - DNA, 19 bp, Homo sapiens
ctctagataacctcgggcc

SEQ ID NO: 12846 - DNA, 21 bp, Homo sapiens
ctctagataacctcgggccga

SEQ ID NO: 12847 - DNA, 26 bp, Homo sapiens
ctctagataacctcgggccgatcgca

SEQ ID NO: 12848 - DNA, 27 bp, Homo sapiens
ctctagataacctcgggccgatcgcac

SEQ ID NO: 12849 - DNA, 18 bp, Homo sapiens
tctagataacctcgggcc

SEQ ID NO: 12850 - DNA, 26 bp, Homo sapiens
tctagataacctcgggccgatcgcac

SEQ ID NO: 12851 - DNA, 17 bp, Homo sapiens
ctagataacctcgggcc

SEQ ID NO: 12852 - DNA, 25 bp, Homo sapiens
ctagataacctcgggccgatcgcac

SEQ ID NO: 12853 - DNA, 26 bp, Homo sapiens
ctagataacctcgggccgatcgcacg

SEQ ID NO: 12854 - DNA, 33 bp, Homo sapiens
ctagataacctcgggccgatcgcacgccccccg

SEQ ID NO: 12855 - DNA, 16 bp, Homo sapiens
tagataacctcgggcc

SEQ ID NO: 12856 - DNA, 25 bp, Homo sapiens
tagataacctcgggccgatcgcacg

SEQ ID NO: 12857 - DNA, 16 bp, Homo sapiens
gataacctcgggccga

SEQ ID NO: 12858 - DNA, 18 bp, Homo sapiens
gataacctcgggccgatc

SEQ ID NO: 12859 - DNA, 21 bp, Homo sapiens
gataacctcgggccgatcgca

SEQ ID NO: 12860 - DNA, 22 bp, Homo sapiens
gataacctcgggccgatcgcac

SEQ ID NO: 12861 - DNA, 23 bp, Homo sapiens
gataacctcgggccgatcgcacg

SEQ ID NO: 12862 - DNA, 17 bp, Homo sapiens
ataacctcgggccgatc

SEQ ID NO: 12863 - DNA, 21 bp, Homo sapiens
ataacctcgggccgatcgcac

SEQ ID NO: 12864 - DNA, 22 bp, Homo sapiens
ataacctcgggccgatcgcacg

SEQ ID NO: 12865 - DNA, 24 bp, Homo sapiens
ataacctcgggccgatcgcacgcc

SEQ ID NO: 12866 - DNA, 17 bp, Homo sapiens
taacctcgggccgatcg

SEQ ID NO: 12867 - DNA, 18 bp, Homo sapiens
taacctcgggccgatcgc

SEQ ID NO: 12868 - DNA, 19 bp, Homo sapiens
taacctcgggccgatcgca

SEQ ID NO: 12869 - DNA, 20 bp, Homo sapiens
taacctcgggccgatcgcac

SEQ ID NO: 12870 - DNA, 21 bp, Homo sapiens
taacctcgggccgatcgcacg

SEQ ID NO: 12871 - DNA, 23 bp, Homo sapiens
taacctcgggccgatcgcacgcc

SEQ ID NO: 12872 - DNA, 16 bp, Homo sapiens
aacctcgggccgatcg

SEQ ID NO: 12873 - DNA, 17 bp, Homo sapiens
aacctcgggccgatcgc

SEQ ID NO: 12874 - DNA, 18 bp, Homo sapiens
aacctcgggccgatcgca

SEQ ID NO: 12875 - DNA, 19 bp, Homo sapiens
aacctcgggccgatcgcac

SEQ ID NO: 12876 - DNA, 20 bp, Homo sapiens
aacctcgggccgatcgcacg

SEQ ID NO: 12877 - DNA, 21 bp, Homo sapiens
aacctcgggccgatcgcacgc

SEQ ID NO: 12878 - DNA, 22 bp, Homo sapiens
aacctcgggccgatcgcacgcc

SEQ ID NO: 12879 - DNA, 27 bp, Homo sapiens
aacctcgggccgatcgcacgccccccg

SEQ ID NO: 12880 - DNA, 40 bp, Homo sapiens
aacctcgggccgatcgcacgccccccgtggcggcgacgac

SEQ ID NO: 12881 - DNA, 16 bp, Homo sapiens
acctcgggccgatcgc

SEQ ID NO: 12882 - DNA, 17 bp, Homo sapiens
acctcgggccgatcgca

SEQ ID NO: 12883 - DNA, 18 bp, Homo sapiens
acctcgggccgatcgcac

SEQ ID NO: 12884 - DNA, 19 bp, Homo sapiens
acctcgggccgatcgcacg

SEQ ID NO: 12885 - DNA, 21 bp, Homo sapiens
acctcgggccgatcgcacgcc

SEQ ID NO: 12886 - DNA, 33 bp, Homo sapiens
acctcgggccgatcgcacgccccccgtggcggc

SEQ ID NO: 12887 - DNA, 16 bp, Homo sapiens
cctcgggccgatcgca

SEQ ID NO: 12888 - DNA, 17 bp, Homo sapiens
cctcgggccgatcgcac

SEQ ID NO: 12889 - DNA, 18 bp, Homo sapiens
cctcgggccgatcgcacg

SEQ ID NO: 12890 - DNA, 20 bp, Homo sapiens
cctcgggccgatcgcacgcc

SEQ ID NO: 12891 - DNA, 30 bp, Homo sapiens
cctcgggccgatcgcacgccccccgtggcg

SEQ ID NO: 12892 - DNA, 33 bp, Homo sapiens
cctcgggccgatcgcacgccccccgtggcggcg

SEQ ID NO: 12893 - DNA, 35 bp, Homo sapiens
cctcgggccgatcgcacgccccccgtggcggcgac

SEQ ID NO: 12894 - DNA, 16 bp, Homo sapiens
ctcgggccgatcgcac

SEQ ID NO: 12895 - DNA, 17 bp, Homo sapiens
ctcgggccgatcgcacg

SEQ ID NO: 12896 - DNA, 19 bp, Homo sapiens
ctcgggccgatcgcacgcc

SEQ ID NO: 12897 - DNA, 20 bp, Homo sapiens
ctcgggccgatcgcacgccc

SEQ ID NO: 12898 - DNA, 21 bp, Homo sapiens
ctcgggccgatcgcacgcccc

SEQ ID NO: 12899 - DNA, 29 bp, Homo sapiens
ctcgggccgatcgcacgccccccgtggcg

SEQ ID NO: 12900 - DNA, 31 bp, Homo sapiens
ctcgggccgatcgcacgccccccgtggcggc

SEQ ID NO: 12901 - DNA, 33 bp, Homo sapiens
ctcgggccgatcgcacgccccccgtggcggcga

SEQ ID NO: 12902 - DNA, 34 bp, Homo sapiens
ctcgggccgatcgcacgccccccgtggcggcgac

SEQ ID NO: 12903 - DNA, 35 bp, Homo sapiens
ctcgggccgatcgcacgccccccgtggcggcgacg

SEQ ID NO: 12904 - DNA, 37 bp, Homo sapiens
ctcgggccgatcgcacgccccccgtggcggcgacgac

SEQ ID NO: 12905 - DNA, 16 bp, Homo sapiens
tcgggccgatcgcacg

SEQ ID NO: 12906 - DNA, 18 bp, Homo sapiens
tcgggccgatcgcacgcc

SEQ ID NO: 12907 - DNA, 23 bp, Homo sapiens
tcgggccgatcgcacgccccccg

SEQ ID NO: 12908 - DNA, 28 bp, Homo sapiens
tcgggccgatcgcacgccccccgtggcg

SEQ ID NO: 12909 - DNA, 33 bp, Homo sapiens; identical to SEQ ID NO: 2206

SEQ ID NO: 12910 - DNA, 34 bp, Homo sapiens
tcgggccgatcgcacgccccccgtggcggcgacg

SEQ ID NO: 12911 - DNA, 36 bp, Homo sapiens
tcgggccgatcgcacgccccccgtggcggcgacgac

SEQ ID NO: 12912 - DNA, 17 bp, Homo sapiens
cgggccgatcgcacgcc

SEQ ID NO: 12913 - DNA, 33 bp, Homo sapiens
cgggccgatcgcacgccccccgtggcggcgacg

SEQ ID NO: 12914 - DNA, 16 bp, Homo sapiens
gggccgatcgcacgcc

SEQ ID NO: 12915 - DNA, 19 bp, Homo sapiens
gccgatcgcacgccccccg

SEQ ID NO: 12916 - DNA, 25 bp, Homo sapiens
gcacgccccccgtggcggcgacgac

SEQ ID NO: 12917 - DNA, 26 bp, Homo sapiens
gcacgccccccgtggcggcgacgacc

SEQ ID NO: 12918 - DNA, 25 bp, Homo sapiens
cacgccccccgtggcggcgacgacc

SEQ ID NO: 12919 - DNA, 19 bp, Homo sapiens
cgccccccgtggcggcgac

SEQ ID NO: 12920 - DNA, 18 bp, Homo sapiens
gccccccgtggcggcgac

SEQ ID NO: 12921 - DNA, 21 bp, Homo sapiens
gccccccgtggcggcgacgac

SEQ ID NO: 12922 - DNA, 26 bp, Homo sapiens
gccccccgtggcggcgacgacccatt

SEQ ID NO: 12923 - DNA, 27 bp, Homo sapiens
gccccccgtggcggcgacgacccattc

SEQ ID NO: 12924 - DNA, 28 bp, Homo sapiens
gccccccgtggcggcgacgacccattcg

SEQ ID NO: 12925 - DNA, 31 bp, Homo sapiens; identical to SEQ ID NO: 2209

SEQ ID NO: 12926 - DNA, 32 bp, Homo sapiens
gccccccgtggcggcgacgacccattcgaacg

SEQ ID NO: 12927 - DNA, 20 bp, Homo sapiens
ccccccgtggcggcgacgac

SEQ ID NO: 12928 - DNA, 32 bp, Homo sapiens
ccccgtggcggcgacgacccattcgaacgtct

SEQ ID NO: 12929 - DNA, 31 bp, Homo sapiens
cccgtggcggcgacgacccattcgaacgtct

SEQ ID NO: 12930 - DNA, 25 bp, Homo sapiens
cgacgacccattcgaacgtctgccc

SEQ ID NO: 12931 - DNA, 26 bp, Homo sapiens
cgacgacccattcgaacgtctgccct

SEQ ID NO: 12932 - DNA, 23 bp, Homo sapiens
gacgacccattcgaacgtctgcc

SEQ ID NO: 12933 - DNA, 24 bp, Homo sapiens
gacgacccattcgaacgtctgccc

SEQ ID NO: 12934 - DNA, 25 bp, Homo sapiens
gacgacccattcgaacgtctgccct

SEQ ID NO: 12935 - DNA, 22 bp, Homo sapiens
acgacccattcgaacgtctgcc

SEQ ID NO: 12936 - DNA, 23 bp, Homo sapiens
acgacccattcgaacgtctgccc

SEQ ID NO: 12937 - DNA, 24 bp, Homo sapiens
acgacccattcgaacgtctgccct

SEQ ID NO: 12938 - DNA, 27 bp, Homo sapiens
acgacccattcgaacgtctgccctatc

SEQ ID NO: 12939 - DNA, 21 bp, Homo sapiens
cgacccattcgaacgtctgcc

SEQ ID NO: 12940 - DNA, 22 bp, Homo sapiens
cgacccattcgaacgtctgccc

SEQ ID NO: 12941 - DNA, 23 bp, Homo sapiens
cgacccattcgaacgtctgccct

SEQ ID NO: 12942 - DNA, 24 bp, Homo sapiens
cgacccattcgaacgtctgcccta

SEQ ID NO: 12943 - DNA, 27 bp, Homo sapiens
cgacccattcgaacgtctgccctatca

SEQ ID NO: 12944 - DNA, 28 bp, Homo sapiens
cgacccattcgaacgtctgccctatcaa

SEQ ID NO: 12945 - DNA, 33 bp, Homo sapiens
cgacccattcgaacgtctgccctatcaactttc

SEQ ID NO: 12946 - DNA, 20 bp, Homo sapiens
gacccattcgaacgtctgcc

SEQ ID NO: 12947 - DNA, 21 bp, Homo sapiens
gacccattcgaacgtctgccc

SEQ ID NO: 12948 - DNA, 22 bp, Homo sapiens
gacccattcgaacgtctgccct

SEQ ID NO: 12949 - DNA, 25 bp, Homo sapiens
gacccattcgaacgtctgccctatc

SEQ ID NO: 12950 - DNA, 31 bp, Homo sapiens
gacccattcgaacgtctgccctatcaacttt

SEQ ID NO: 12951 - DNA, 32 bp, Homo sapiens
gacccattcgaacgtctgccctatcaactttc

SEQ ID NO: 12952 - DNA, 19 bp, Homo sapiens
acccattcgaacgtctgcc

SEQ ID NO: 12953 - DNA, 20 bp, Homo sapiens
acccattcgaacgtctgccc

SEQ ID NO: 12954 - DNA, 21 bp, Homo sapiens
acccattcgaacgtctgccct

SEQ ID NO: 12955 - DNA, 22 bp, Homo sapiens
acccattcgaacgtctgcccta

SEQ ID NO: 12956 - DNA, 23 bp, Homo sapiens
acccattcgaacgtctgccctat

SEQ ID NO: 12957 - DNA, 24 bp, Homo sapiens
acccattcgaacgtctgccctatc

SEQ ID NO: 12958 - DNA, 25 bp, Homo sapiens
acccattcgaacgtctgccctatca

SEQ ID NO: 12959 - DNA, 28 bp, Homo sapiens
acccattcgaacgtctgccctatcaact

SEQ ID NO: 12960 - DNA, 29 bp, Homo sapiens
acccattcgaacgtctgccctatcaactt

SEQ ID NO: 12961 - DNA, 30 bp, Homo sapiens
acccattcgaacgtctgccctatcaacttt

SEQ ID NO: 12962 - DNA, 31 bp, Homo sapiens
acccattcgaacgtctgccctatcaactttc

SEQ ID NO: 12963 - DNA, 18 bp, Homo sapiens
cccattcgaacgtctgcc

SEQ ID NO: 12964 - DNA, 19 bp, Homo sapiens
cccattcgaacgtctgccc

SEQ ID NO: 12965 - DNA, 20 bp, Homo sapiens
cccattcgaacgtctgccct

SEQ ID NO: 12966 - DNA, 21 bp, Homo sapiens
cccattcgaacgtctgcccta

SEQ ID NO: 12967 - DNA, 24 bp, Homo sapiens
cccattcgaacgtctgccctatca

SEQ ID NO: 12968 - DNA, 25 bp, Homo sapiens
cccattcgaacgtctgccctatcaa

SEQ ID NO: 12969 - DNA, 30 bp, Homo sapiens
cccattcgaacgtctgccctatcaactttc

SEQ ID NO: 12970 - DNA, 17 bp, Homo sapiens
ccattcgaacgtctgcc

SEQ ID NO: 12971 - DNA, 18 bp, Homo sapiens
ccattcgaacgtctgccc

SEQ ID NO: 12972 - DNA, 19 bp, Homo sapiens
ccattcgaacgtctgccct

SEQ ID NO: 12973 - DNA, 20 bp, Homo sapiens
ccattcgaacgtctgcccta

SEQ ID NO: 12974 - DNA, 21 bp, Homo sapiens
ccattcgaacgtctgccctat

SEQ ID NO: 12975 - DNA, 22 bp, Homo sapiens
ccattcgaacgtctgccctatc

SEQ ID NO: 12976 - DNA, 23 bp, Homo sapiens
ccattcgaacgtctgccctatca

SEQ ID NO: 12977 - DNA, 24 bp, Homo sapiens
ccattcgaacgtctgccctatcaa

SEQ ID NO: 12978 - DNA, 26 bp, Homo sapiens
ccattcgaacgtctgccctatcaact

SEQ ID NO: 12979 - DNA, 29 bp, Homo sapiens
ccattcgaacgtctgccctatcaactttc

SEQ ID NO: 12980 - DNA, 30 bp, Homo sapiens; identical to SEQ ID NO: 2227

SEQ ID NO: 12981 - DNA, 16 bp, Homo sapiens
cattcgaacgtctgcc

SEQ ID NO: 12982 - DNA, 17 bp, Homo sapiens
cattcgaacgtctgccc

SEQ ID NO: 12983 - DNA, 18 bp, Homo sapiens
cattcgaacgtctgccct

SEQ ID NO: 12984 - DNA, 19 bp, Homo sapiens
cattcgaacgtctgcccta

SEQ ID NO: 12985 - DNA, 20 bp, Homo sapiens
cattcgaacgtctgccctat

SEQ ID NO: 12986 - DNA, 21 bp, Homo sapiens
cattcgaacgtctgccctatc

SEQ ID NO: 12987 - DNA, 22 bp, Homo sapiens
cattcgaacgtctgccctatca

SEQ ID NO: 12988 - DNA, 23 bp, Homo sapiens
cattcgaacgtctgccctatcaa

SEQ ID NO: 12989 - DNA, 25 bp, Homo sapiens
cattcgaacgtctgccctatcaact

SEQ ID NO: 12990 - DNA, 27 bp, Homo sapiens
cattcgaacgtctgccctatcaacttt

SEQ ID NO: 12991 - DNA, 28 bp, Homo sapiens
cattcgaacgtctgccctatcaactttc

SEQ ID NO: 12992 - DNA, 29 bp, Homo sapiens
cattcgaacgtctgccctatcaactttcg

SEQ ID NO: 12993 - DNA, 16 bp, Homo sapiens
attcgaacgtctgccc

SEQ ID NO: 12994 - DNA, 17 bp, Homo sapiens
attcgaacgtctgccct

SEQ ID NO: 12995 - DNA, 18 bp, Homo sapiens
attcgaacgtctgcccta

SEQ ID NO: 12996 - DNA, 19 bp, Homo sapiens
attcgaacgtctgccctat

SEQ ID NO: 12997 - DNA, 20 bp, Homo sapiens
attcgaacgtctgccctatc

SEQ ID NO: 12998 - DNA, 21 bp, Homo sapiens
attcgaacgtctgccctatca

SEQ ID NO: 12999 - DNA, 23 bp, Homo sapiens
attcgaacgtctgccctatcaac

SEQ ID NO: 13000 - DNA, 24 bp, Homo sapiens
attcgaacgtctgccctatcaact

SEQ ID NO: 13001 - DNA, 26 bp, Homo sapiens
attcgaacgtctgccctatcaacttt

SEQ ID NO: 13002 - DNA, 27 bp, Homo sapiens
attcgaacgtctgccctatcaactttc

SEQ ID NO: 13003 - DNA, 28 bp, Homo sapiens
attcgaacgtctgccctatcaactttcg

SEQ ID NO: 13004 - DNA, 16 bp, Homo sapiens
ttcgaacgtctgccct

SEQ ID NO: 13005 - DNA, 17 bp, Homo sapiens
ttcgaacgtctgcccta

SEQ ID NO: 13006 - DNA, 18 bp, Homo sapiens
ttcgaacgtctgccctat

SEQ ID NO: 13007 - DNA, 19 bp, Homo sapiens
ttcgaacgtctgccctatc

SEQ ID NO: 13008 - DNA, 20 bp, Homo sapiens
ttcgaacgtctgccctatca

SEQ ID NO: 13009 - DNA, 21 bp, Homo sapiens
ttcgaacgtctgccctatcaa

SEQ ID NO: 13010 - DNA, 23 bp, Homo sapiens
ttcgaacgtctgccctatcaact

SEQ ID NO: 13011 - DNA, 28 bp, Homo sapiens
ttcgaacgtctgccctatcaactttcga

SEQ ID NO: 13012 - DNA, 16 bp, Homo sapiens
tcgaacgtctgcccta

SEQ ID NO: 13013 - DNA, 18 bp, Homo sapiens
tcgaacgtctgccctatc

SEQ ID NO: 13014 - DNA, 19 bp, Homo sapiens
tcgaacgtctgccctatca

SEQ ID NO: 13015 - DNA, 16 bp, Homo sapiens
cgaacgtctgccctat

SEQ ID NO: 13016 - DNA, 17 bp, Homo sapiens
cgaacgtctgccctatc

SEQ ID NO: 13017 - DNA, 18 bp, Homo sapiens
cgaacgtctgccctatca

SEQ ID NO: 13018 - DNA, 21 bp, Homo sapiens
cgaacgtctgccctatcaact

SEQ ID NO: 13019 - DNA, 24 bp, Homo sapiens
cgaacgtctgccctatcaactttc

SEQ ID NO: 13020 - DNA, 16 bp, Homo sapiens
gaacgtctgccctatc

SEQ ID NO: 13021 - DNA, 17 bp, Homo sapiens
gaacgtctgccctatca

SEQ ID NO: 13022 - DNA, 20 bp, Homo sapiens
gaacgtctgccctatcaact

SEQ ID NO: 13023 - DNA, 28 bp, Homo sapiens
acgtctgccctatcaactttcgatggta

SEQ ID NO: 13024 - DNA, 27 bp, Homo sapiens
cgtctgccctatcaactttcgatggta

SEQ ID NO: 13025 - DNA, 31 bp, Homo sapiens
cctatcaactttcgatggtagtcgccgtgcc

SEQ ID NO: 13026 - DNA, 30 bp, Homo sapiens
ctatcaactttcgatggtagtcgccgtgcc

SEQ ID NO: 13027 - DNA, 31 bp, Homo sapiens
ctatcaactttcgatggtagtcgccgtgcct

SEQ ID NO: 13028 - DNA, 24 bp, Homo sapiens
tatcaactttcgatggtagtcgcc

SEQ ID NO: 13029 - DNA, 29 bp, Homo sapiens
tatcaactttcgatggtagtcgccgtgcc

SEQ ID NO: 13030 - DNA, 30 bp, Homo sapiens
tatcaactttcgatggtagtcgccgtgcct

SEQ ID NO: 13031 - DNA, 29 bp, Homo sapiens
atcaactttcgatggtagtcgccgtgcct

SEQ ID NO: 13032 - DNA, 22 bp, Homo sapiens
tcaactttcgatggtagtcgcc

SEQ ID NO: 13033 - DNA, 24 bp, Homo sapiens
tcaactttcgatggtagtcgccgt

SEQ ID NO: 13034 - DNA, 21 bp, Homo sapiens
caactttcgatggtagtcgcc

SEQ ID NO: 13035 - DNA, 20 bp, Homo sapiens
aactttcgatggtagtcgcc

SEQ ID NO: 13036 - DNA, 22 bp, Homo sapiens
aactttcgatggtagtcgccgt

SEQ ID NO: 13037 - DNA, 24 bp, Homo sapiens
aactttcgatggtagtcgccgtgc

SEQ ID NO: 13038 - DNA, 25 bp, Homo sapiens
aactttcgatggtagtcgccgtgcc

SEQ ID NO: 13039 - DNA, 26 bp, Homo sapiens
aactttcgatggtagtcgccgtgcct

SEQ ID NO: 13040 - DNA, 19 bp, Homo sapiens
actttcgatggtagtcgcc

SEQ ID NO: 13041 - DNA, 21 bp, Homo sapiens
actttcgatggtagtcgccgt

SEQ ID NO: 13042 - DNA, 24 bp, Homo sapiens
actttcgatggtagtcgccgtgcc

SEQ ID NO: 13043 - DNA, 26 bp, Homo sapiens
actttcgatggtagtcgccgtgccta

SEQ ID NO: 13044 - DNA, 27 bp, Homo sapiens
actttcgatggtagtcgccgtgcctac

SEQ ID NO: 13045 - DNA, 36 bp, Homo sapiens
actttcgatggtagtcgccgtgcctaccatggtgac

SEQ ID NO: 13046 - DNA, 18 bp, Homo sapiens
ctttcgatggtagtcgcc

SEQ ID NO: 13047 - DNA, 20 bp, Homo sapiens
ctttcgatggtagtcgccgt

SEQ ID NO: 13048 - DNA, 23 bp, Homo sapiens
ctttcgatggtagtcgccgtgcc

SEQ ID NO: 13049 - DNA, 33 bp, Homo sapiens; identical to SEQ ID NO: 2250

SEQ ID NO: 13050 - DNA, 35 bp, Homo sapiens
ctttcgatggtagtcgccgtgcctaccatggtgac

SEQ ID NO: 13051 - DNA, 36 bp, Homo sapiens
ctttcgatggtagtcgccgtgcctaccatggtgacc

SEQ ID NO: 13052 - DNA, 17 bp, Homo sapiens
tttcgatggtagtcgcc

SEQ ID NO: 13053 - DNA, 19 bp, Homo sapiens
tttcgatggtagtcgccgt

SEQ ID NO: 13054 - DNA, 22 bp, Homo sapiens
tttcgatggtagtcgccgtgcc

SEQ ID NO: 13055 - DNA, 32 bp, Homo sapiens
tttcgatggtagtcgccgtgcctaccatggtg

SEQ ID NO: 13056 - DNA, 34 bp, Homo sapiens
tttcgatggtagtcgccgtgcctaccatggtgac

SEQ ID NO: 13057 - DNA, 35 bp, Homo sapiens
tttcgatggtagtcgccgtgcctaccatggtgacc

SEQ ID NO: 13058 - DNA, 16 bp, Homo sapiens
ttcgatggtagtcgcc

SEQ ID NO: 13059 - DNA, 18 bp, Homo sapiens
ttcgatggtagtcgccgt

SEQ ID NO: 13060 - DNA, 21 bp, Homo sapiens
ttcgatggtagtcgccgtgcc

SEQ ID NO: 13061 - DNA, 22 bp, Homo sapiens
ttcgatggtagtcgccgtgcct

SEQ ID NO: 13062 - DNA, 31 bp, Homo sapiens; identical to SEQ ID NO: 2252

SEQ ID NO: 13063 - DNA, 33 bp, Homo sapiens; identical to SEQ ID NO: 2253

SEQ ID NO: 13064 - DNA, 34 bp, Homo sapiens
ttcgatggtagtcgccgtgcctaccatggtgacc

SEQ ID NO: 13065 - DNA, 37 bp, Homo sapiens
ttcgatggtagtcgccgtgcctaccatggtgaccacg

SEQ ID NO: 13066 - DNA, 30 bp, Homo sapiens
tcgatggtagtcgccgtgcctaccatggtg

SEQ ID NO: 13067 - DNA, 32 bp, Homo sapiens; identical to SEQ ID NO: 2254

SEQ ID NO: 13068 - DNA, 33 bp, Homo sapiens
tcgatggtagtcgccgtgcctaccatggtgacc

SEQ ID NO: 13069 - DNA, 31 bp, Homo sapiens; identical to SEQ ID NO: 2255

SEQ ID NO: 13070 - DNA, 32 bp, Homo sapiens; identical to SEQ ID NO: 2256

SEQ ID NO: 13071 - DNA, 17 bp, Homo sapiens
gatggtagtcgccgtgc

SEQ ID NO: 13072 - DNA, 18 bp, Homo sapiens
gatggtagtcgccgtgcc

SEQ ID NO: 13073 - DNA, 20 bp, Homo sapiens
gatggtagtcgccgtgccta

SEQ ID NO: 13074 - DNA, 21 bp, Homo sapiens
gatggtagtcgccgtgcctac

SEQ ID NO: 13075 - DNA, 30 bp, Homo sapiens; identical to SEQ ID NO: 2258

SEQ ID NO: 13076 - DNA, 31 bp, Homo sapiens
gatggtagtcgccgtgcctaccatggtgacc

SEQ ID NO: 13077 - DNA, 17 bp, Homo sapiens
atggtagtcgccgtgcc

SEQ ID NO: 13078 - DNA, 19 bp, Homo sapiens
atggtagtcgccgtgccta

SEQ ID NO: 13079 - DNA, 20 bp, Homo sapiens
atggtagtcgccgtgcctac

SEQ ID NO: 13080 - DNA, 26 bp, Homo sapiens
atggtagtcgccgtgcctaccatggt

SEQ ID NO: 13081 - DNA, 29 bp, Homo sapiens
atggtagtcgccgtgcctaccatggtgac

SEQ ID NO: 13082 - DNA, 30 bp, Homo sapiens
atggtagtcgccgtgcctaccatggtgacc

SEQ ID NO: 13083 - DNA, 33 bp, Homo sapiens
atggtagtcgccgtgcctaccatggtgaccacg

SEQ ID NO: 13084 - DNA, 16 bp, Homo sapiens
tggtagtcgccgtgcc

SEQ ID NO: 13085 - DNA, 17 bp, Homo sapiens
tggtagtcgccgtgcct

SEQ ID NO: 13086 - DNA, 18 bp, Homo sapiens
tggtagtcgccgtgccta

SEQ ID NO: 13087 - DNA, 19 bp, Homo sapiens
tggtagtcgccgtgcctac

SEQ ID NO: 13088 - DNA, 16 bp, Homo sapiens
ggtagtcgccgtgcct

SEQ ID NO: 13089 - DNA, 17 bp, Homo sapiens
tagtcgccgtgcctacc

SEQ ID NO: 13090 - DNA, 26 bp, Homo sapiens
accacgggtgacggggaatcagggtt

SEQ ID NO: 13091 - DNA, 24 bp, Homo sapiens
cacgggtgacggggaatcagggtt

SEQ ID NO: 13092 - DNA, 26 bp, Homo sapiens
cacgggtgacggggaatcagggttcg

SEQ ID NO: 13093 - DNA, 17 bp, Homo sapiens
acgggtgacggggaatc

SEQ ID NO: 13094 - DNA, 22 bp, Homo sapiens
acgggtgacggggaatcagggt

SEQ ID NO: 13095 - DNA, 23 bp, Homo sapiens
acgggtgacggggaatcagggtt

SEQ ID NO: 13096 - DNA, 24 bp, Homo sapiens
acgggtgacggggaatcagggttc

SEQ ID NO: 13097 - DNA, 25 bp, Homo sapiens
acgggtgacggggaatcagggttcg

SEQ ID NO: 13098 - DNA, 29 bp, Homo sapiens
acgggtgacggggaatcagggttcgattc

SEQ ID NO: 13099 - DNA, 22 bp, Homo sapiens
cgggtgacggggaatcagggtt

SEQ ID NO: 13100 - DNA, 24 bp, Homo sapiens
cgggtgacggggaatcagggttcg

SEQ ID NO: 13101 - DNA, 25 bp, Homo sapiens
cgggtgacggggaatcagggttcga

SEQ ID NO: 13102 - DNA, 32 bp, Homo sapiens
cgggtgacggggaatcagggttcgattccgga

SEQ ID NO: 13103 - DNA, 19 bp, Homo sapiens
atcagggttcgattccgga

SEQ ID NO: 13104 - DNA, 20 bp, Homo sapiens
tcagggttcgattccggaga

SEQ ID NO: 13105 - DNA, 27 bp, Homo sapiens
tcagggttcgattccggagagggagcc

SEQ ID NO: 13106 - DNA, 17 bp, Homo sapiens
gggttcgattccggaga

SEQ ID NO: 13107 - DNA, 30 bp, Homo sapiens
gggttcgattccggagagggagcctgagaa

SEQ ID NO: 13108 - DNA, 27 bp, Homo sapiens
gttcgattccggagagggagcctgaga

SEQ ID NO: 13109 - DNA, 28 bp, Homo sapiens
gttcgattccggagagggagcctgagaa

SEQ ID NO: 13110 - DNA, 26 bp, Homo sapiens
ttcgattccggagagggagcctgaga

SEQ ID NO: 13111 - DNA, 25 bp, Homo sapiens
tcgattccggagagggagcctgaga

SEQ ID NO: 13112 - DNA, 32 bp, Homo sapiens
tcgattccggagagggagcctgagaaacggct

SEQ ID NO: 13113 - DNA, 24 bp, Homo sapiens
cgattccggagagggagcctgaga

SEQ ID NO: 13114 - DNA, 25 bp, Homo sapiens
cgattccggagagggagcctgagaa

SEQ ID NO: 13115 - DNA, 27 bp, Homo sapiens
cgattccggagagggagcctgagaaac

SEQ ID NO: 13116 - DNA, 28 bp, Homo sapiens
cgattccggagagggagcctgagaaacg

SEQ ID NO: 13117 - DNA, 31 bp, Homo sapiens; identical to SEQ ID NO: 2267

SEQ ID NO: 13118 - DNA, 33 bp, Homo sapiens
cgattccggagagggagcctgagaaacggctac

SEQ ID NO: 13119 - DNA, 19 bp, Homo sapiens
gattccggagagggagcct

SEQ ID NO: 13120 - DNA, 23 bp, Homo sapiens
gattccggagagggagcctgaga

SEQ ID NO: 13121 - DNA, 24 bp, Homo sapiens
gattccggagagggagcctgagaa

SEQ ID NO: 13122 - DNA, 25 bp, Homo sapiens
gattccggagagggagcctgagaaa

SEQ ID NO: 13123 - DNA, 26 bp, Homo sapiens
gattccggagagggagcctgagaaac

SEQ ID NO: 13124 - DNA, 27 bp, Homo sapiens
gattccggagagggagcctgagaaacg

SEQ ID NO: 13125 - DNA, 28 bp, Homo sapiens
gattccggagagggagcctgagaaacgg

SEQ ID NO: 13126 - DNA, 29 bp, Homo sapiens
gattccggagagggagcctgagaaacggc

SEQ ID NO: 13127 - DNA, 30 bp, Homo sapiens; identical to SEQ ID NO: 2272

SEQ ID NO: 13128 - DNA, 32 bp, Homo sapiens; identical to SEQ ID NO: 2273

SEQ ID NO: 13129 - DNA, 33 bp, Homo sapiens
gattccggagagggagcctgagaaacggctacc

SEQ ID NO: 13130 - DNA, 17 bp, Homo sapiens
attccggagagggagcc

SEQ ID NO: 13131 - DNA, 18 bp, Homo sapiens
attccggagagggagcct

SEQ ID NO: 13132 - DNA, 22 bp, Homo sapiens
attccggagagggagcctgaga

SEQ ID NO: 13133 - DNA, 23 bp, Homo sapiens
attccggagagggagcctgagaa

SEQ ID NO: 13134 - DNA, 24 bp, Homo sapiens
attccggagagggagcctgagaaa

SEQ ID NO: 13135 - DNA, 25 bp, Homo sapiens
attccggagagggagcctgagaaac

SEQ ID NO: 13136 - DNA, 26 bp, Homo sapiens
attccggagagggagcctgagaaacg

SEQ ID NO: 13137 - DNA, 27 bp, Homo sapiens
attccggagagggagcctgagaaacgg

SEQ ID NO: 13138 - DNA, 28 bp, Homo sapiens
attccggagagggagcctgagaaacggc

SEQ ID NO: 13139 - DNA, 29 bp, Homo sapiens
attccggagagggagcctgagaaacggct

SEQ ID NO: 13140 - DNA, 30 bp, Homo sapiens
attccggagagggagcctgagaaacggcta

SEQ ID NO: 13141 - DNA, 31 bp, Homo sapiens; identical to SEQ ID NO: 2283

SEQ ID NO: 13142 - DNA, 32 bp, Homo sapiens; identical to SEQ ID NO: 2284

SEQ ID NO: 13143 - DNA, 33 bp, Homo sapiens
attccggagagggagcctgagaaacggctacca

SEQ ID NO: 13144 - DNA, 35 bp, Homo sapiens
attccggagagggagcctgagaaacggctaccaca

SEQ ID NO: 13145 - DNA, 19 bp, Homo sapiens
ttccggagagggagcctga

SEQ ID NO: 13146 - DNA, 21 bp, Homo sapiens
ttccggagagggagcctgaga

SEQ ID NO: 13147 - DNA, 22 bp, Homo sapiens
ttccggagagggagcctgagaa

SEQ ID NO: 13148 - DNA, 23 bp, Homo sapiens
ttccggagagggagcctgagaaa

SEQ ID NO: 13149 - DNA, 24 bp, Homo sapiens
ttccggagagggagcctgagaaac

SEQ ID NO: 13150 - DNA, 25 bp, Homo sapiens
ttccggagagggagcctgagaaacg

SEQ ID NO: 13151 - DNA, 28 bp, Homo sapiens
ttccggagagggagcctgagaaacggct

SEQ ID NO: 13152 - DNA, 29 bp, Homo sapiens
ttccggagagggagcctgagaaacggcta

SEQ ID NO: 13153 - DNA, 30 bp, Homo sapiens
ttccggagagggagcctgagaaacggctac

SEQ ID NO: 13154 - DNA, 31 bp, Homo sapiens
ttccggagagggagcctgagaaacggctacc

SEQ ID NO: 13155 - DNA, 32 bp, Homo sapiens
ttccggagagggagcctgagaaacggctacca

SEQ ID NO: 13156 - DNA, 16 bp, Homo sapiens
tccggagagggagcct

SEQ ID NO: 13157 - DNA, 20 bp, Homo sapiens
tccggagagggagcctgaga

SEQ ID NO: 13158 - DNA, 21 bp, Homo sapiens
tccggagagggagcctgagaa

SEQ ID NO: 13159 - DNA, 23 bp, Homo sapiens
tccggagagggagcctgagaaac

SEQ ID NO: 13160 - DNA, 24 bp, Homo sapiens
tccggagagggagcctgagaaacg

SEQ ID NO: 13161 - DNA, 25 bp, Homo sapiens
tccggagagggagcctgagaaacgg

SEQ ID NO: 13162 - DNA, 29 bp, Homo sapiens
tccggagagggagcctgagaaacggctac

SEQ ID NO: 13163 - DNA, 30 bp, Homo sapiens
tccggagagggagcctgagaaacggctacc

SEQ ID NO: 13164 - DNA, 20 bp, Homo sapiens
ccggagagggagcctgagaa

SEQ ID NO: 13165 - DNA, 23 bp, Homo sapiens
ccggagagggagcctgagaaacg

SEQ ID NO: 13166 - DNA, 24 bp, Homo sapiens
ccggagagggagcctgagaaacgg

SEQ ID NO: 13167 - DNA, 24 bp, Homo sapiens
cggagagggagcctgagaaacggc

SEQ ID NO: 13168 - DNA, 25 bp, Homo sapiens
cggagagggagcctgagaaacggct

SEQ ID NO: 13169 - DNA, 16 bp, Homo sapiens
agggagcctgagaaac

SEQ ID NO: 13170 - DNA, 17 bp, Homo sapiens
agggagcctgagaaacg

SEQ ID NO: 13171 - DNA, 16 bp, Homo sapiens
ctgagaaacggctacc

SEQ ID NO: 13172 - DNA, 17 bp, Homo sapiens
tgagaaacggctaccac

SEQ ID NO: 13173 - DNA, 24 bp, Homo sapiens
gaaacggctaccacatccaaggaa

SEQ ID NO: 13174 - DNA, 28 bp, Homo sapiens
gaaacggctaccacatccaaggaaggca

SEQ ID NO: 13175 - DNA, 22 bp, Homo sapiens
aacggctaccacatccaaggaa

SEQ ID NO: 13176 - DNA, 23 bp, Homo sapiens
aacggctaccacatccaaggaag

SEQ ID NO: 13177 - DNA, 21 bp, Homo sapiens
acggctaccacatccaaggaa

SEQ ID NO: 13178 - DNA, 22 bp, Homo sapiens
acggctaccacatccaaggaag

SEQ ID NO: 13179 - DNA, 20 bp, Homo sapiens
cggctaccacatccaaggaa

SEQ ID NO: 13180 - DNA, 21 bp, Homo sapiens
cggctaccacatccaaggaag

SEQ ID NO: 13181 - DNA, 18 bp, Homo sapiens
ctaccacatccaaggaag

SEQ ID NO: 13182 - DNA, 16 bp, Homo sapiens
accacatccaaggaag

SEQ ID NO: 13183 - DNA, 18 bp, Homo sapiens
ccacatccaaggaaggca

SEQ ID NO: 13184 - DNA, 21 bp, Homo sapiens
ccacatccaaggaaggcagca

SEQ ID NO: 13185 - DNA, 26 bp, Homo sapiens
cacatccaaggaaggcagcaggcgcg

SEQ ID NO: 13186 - DNA, 25 bp, Homo sapiens
acatccaaggaaggcagcaggcgcg

SEQ ID NO: 13187 - DNA, 18 bp, Homo sapiens
catccaaggaaggcagca

SEQ ID NO: 13188 - DNA, 24 bp, Homo sapiens
catccaaggaaggcagcaggcgcg

SEQ ID NO: 13189 - DNA, 33 bp, Homo sapiens
catccaaggaaggcagcaggcgcgcaaattacc

SEQ ID NO: 13190 - DNA, 31 bp, Homo sapiens
tccaaggaaggcagcaggcgcgcaaattacc

SEQ ID NO: 13191 - DNA, 21 bp, Homo sapiens
ccaaggaaggcagcaggcgcg

SEQ ID NO: 13192 - DNA, 30 bp, Homo sapiens; identical to SEQ ID NO: 2288

SEQ ID NO: 13193 - DNA, 31 bp, Homo sapiens
ccaaggaaggcagcaggcgcgcaaattaccc

SEQ ID NO: 13194 - DNA, 34 bp, Homo sapiens
ccaaggaaggcagcaggcgcgcaaattacccact

SEQ ID NO: 13195 - DNA, 41 bp, Homo sapiens
ccaaggaaggcagcaggcgcgcaaattacccactcccgacc

SEQ ID NO: 13196 - DNA, 27 bp, Homo sapiens
aggaaggcagcaggcgcgcaaattacc

SEQ ID NO: 13197 - DNA, 31 bp, Homo sapiens
aggaaggcagcaggcgcgcaaattacccact

SEQ ID NO: 13198 - DNA, 38 bp, Homo sapiens
aggaaggcagcaggcgcgcaaattacccactcccgacc

SEQ ID NO: 13199 - DNA, 26 bp, Homo sapiens
ggcgcgcaaattacccactcccgacc

SEQ ID NO: 13200 - DNA, 27 bp, Homo sapiens
ggcgcgcaaattacccactcccgaccc

SEQ ID NO: 13201 - DNA, 32 bp, Homo sapiens
ggcgcgcaaattacccactcccgacccgggga

SEQ ID NO: 13202 - DNA, 22 bp, Homo sapiens
cgcaaattacccactcccgacc

SEQ ID NO: 13203 - DNA, 23 bp, Homo sapiens
cgcaaattacccactcccgaccc

SEQ ID NO: 13204 - DNA, 19 bp, Homo sapiens
caaattacccactcccgac

SEQ ID NO: 13205 - DNA, 20 bp, Homo sapiens
caaattacccactcccgacc

SEQ ID NO: 13206 - DNA, 21 bp, Homo sapiens
caaattacccactcccgaccc

SEQ ID NO: 13207 - DNA, 22 bp, Homo sapiens
caaattacccactcccgacccg

SEQ ID NO: 13208 - DNA, 20 bp, Homo sapiens
aaattacccactcccgaccc

SEQ ID NO: 13209 - DNA, 17 bp, Homo sapiens
aattacccactcccgac

SEQ ID NO: 13210 - DNA, 18 bp, Homo sapiens
aattacccactcccgacc

SEQ ID NO: 13211 - DNA, 19 bp, Homo sapiens
aattacccactcccgaccc

SEQ ID NO: 13212 - DNA, 20 bp, Homo sapiens
aattacccactcccgacccg

SEQ ID NO: 13213 - DNA, 19 bp, Homo sapiens
attacccactcccgacccg

SEQ ID NO: 13214 - DNA, 23 bp, Homo sapiens
attacccactcccgacccgggga

SEQ ID NO: 13215 - DNA, 16 bp, Homo sapiens
ttacccactcccgacc

SEQ ID NO: 13216 - DNA, 22 bp, Homo sapiens
ttacccactcccgacccgggga

SEQ ID NO: 13217 - DNA, 33 bp, Homo sapiens
ttacccactcccgacccggggaggtagtgacga

SEQ ID NO: 13218 - DNA, 31 bp, Homo sapiens
tacccactcccgacccggggaggtagtgacg

SEQ ID NO: 13219 - DNA, 32 bp, Homo sapiens
tacccactcccgacccggggaggtagtgacga

SEQ ID NO: 13220 - DNA, 30 bp, Homo sapiens
acccactcccgacccggggaggtagtgacg

SEQ ID NO: 13221 - DNA, 19 bp, Homo sapiens
cccactcccgacccgggga

SEQ ID NO: 13222 - DNA, 30 bp, Homo sapiens
cccactcccgacccggggaggtagtgacga

SEQ ID NO: 13223 - DNA, 28 bp, Homo sapiens
ccactcccgacccggggaggtagtgacg

SEQ ID NO: 13224 - DNA, 29 bp, Homo sapiens
ccactcccgacccggggaggtagtgacga

SEQ ID NO: 13225 - DNA, 27 bp, Homo sapiens
cactcccgacccggggaggtagtgacg

SEQ ID NO: 13226 - DNA, 28 bp, Homo sapiens
cactcccgacccggggaggtagtgacga

SEQ ID NO: 13227 - DNA, 29 bp, Homo sapiens
cactcccgacccggggaggtagtgacgaa

SEQ ID NO: 13228 - DNA, 30 bp, Homo sapiens
cactcccgacccggggaggtagtgacgaaa

SEQ ID NO: 13229 - DNA, 47 bp, Homo sapiens
cactcccgacccggggaggtagtgacgaaaaataacaatacaggact

SEQ ID NO: 13230 - DNA, 26 bp, Homo sapiens
actcccgacccggggaggtagtgacg

SEQ ID NO: 13231 - DNA, 27 bp, Homo sapiens
actcccgacccggggaggtagtgacga

SEQ ID NO: 13232 - DNA, 28 bp, Homo sapiens
actcccgacccggggaggtagtgacgaa

SEQ ID NO: 13233 - DNA, 29 bp, Homo sapiens
actcccgacccggggaggtagtgacgaaa

SEQ ID NO: 13234 - DNA, 30 bp, Homo sapiens
actcccgacccggggaggtagtgacgaaaa

SEQ ID NO: 13235 - DNA, 31 bp, Homo sapiens
actcccgacccggggaggtagtgacgaaaaa

SEQ ID NO: 13236 - DNA, 32 bp, Homo sapiens
actcccgacccggggaggtagtgacgaaaaat

SEQ ID NO: 13237 - DNA, 25 bp, Homo sapiens
ctcccgacccggggaggtagtgacg

SEQ ID NO: 13238 - DNA, 26 bp, Homo sapiens
ctcccgacccggggaggtagtgacga

SEQ ID NO: 13239 - DNA, 27 bp, Homo sapiens
ctcccgacccggggaggtagtgacgaa

SEQ ID NO: 13240 - DNA, 28 bp, Homo sapiens
ctcccgacccggggaggtagtgacgaaa

SEQ ID NO: 13241 - DNA, 29 bp, Homo sapiens
ctcccgacccggggaggtagtgacgaaaa

SEQ ID NO: 13242 - DNA, 30 bp, Homo sapiens
ctcccgacccggggaggtagtgacgaaaaa

SEQ ID NO: 13243 - DNA, 32 bp, Homo sapiens
ctcccgacccggggaggtagtgacgaaaaata

SEQ ID NO: 13244 - DNA, 20 bp, Homo sapiens
tcccgacccggggaggtagt

SEQ ID NO: 13245 - DNA, 24 bp, Homo sapiens
tcccgacccggggaggtagtgacg

SEQ ID NO: 13246 - DNA, 25 bp, Homo sapiens
tcccgacccggggaggtagtgacga

SEQ ID NO: 13247 - DNA, 26 bp, Homo sapiens
tcccgacccggggaggtagtgacgaa

SEQ ID NO: 13248 - DNA, 27 bp, Homo sapiens
tcccgacccggggaggtagtgacgaaa

SEQ ID NO: 13249 - DNA, 28 bp, Homo sapiens
tcccgacccggggaggtagtgacgaaaa

SEQ ID NO: 13250 - DNA, 29 bp, Homo sapiens
tcccgacccggggaggtagtgacgaaaaa

SEQ ID NO: 13251 - DNA, 31 bp, Homo sapiens
tcccgacccggggaggtagtgacgaaaaata

SEQ ID NO: 13252 - DNA, 33 bp, Homo sapiens; identical to SEQ ID NO: 2299

SEQ ID NO: 13253 - DNA, 23 bp, Homo sapiens
cccgacccggggaggtagtgacg

SEQ ID NO: 13254 - DNA, 24 bp, Homo sapiens
cccgacccggggaggtagtgacga

SEQ ID NO: 13255 - DNA, 25 bp, Homo sapiens
cccgacccggggaggtagtgacgaa

SEQ ID NO: 13256 - DNA, 26 bp, Homo sapiens
cccgacccggggaggtagtgacgaaa

SEQ ID NO: 13257 - DNA, 27 bp, Homo sapiens
cccgacccggggaggtagtgacgaaaa

SEQ ID NO: 13258 - DNA, 28 bp, Homo sapiens
cccgacccggggaggtagtgacgaaaaa

SEQ ID NO: 13259 - DNA, 29 bp, Homo sapiens
cccgacccggggaggtagtgacgaaaaat

SEQ ID NO: 13260 - DNA, 32 bp, Homo sapiens
cccgacccggggaggtagtgacgaaaaataac

SEQ ID NO: 13261 - DNA, 33 bp, Homo sapiens
cccgacccggggaggtagtgacgaaaaataaca

SEQ ID NO: 13262 - DNA, 43 bp, Homo sapiens
cccgacccggggaggtagtgacgaaaaataacaatacaggact

SEQ ID NO: 13263 - DNA, 24 bp, Homo sapiens
ccgacccggggaggtagtgacgaa

SEQ ID NO: 13264 - DNA, 41 bp, Homo sapiens
ccgacccggggaggtagtgacgaaaaataacaatacaggac

SEQ ID NO: 13265 - DNA, 42 bp, Homo sapiens
ccgacccggggaggtagtgacgaaaaataacaatacaggact

SEQ ID NO: 13266 - DNA, 43 bp, Homo sapiens
ccgacccggggaggtagtgacgaaaaataacaatacaggactc

SEQ ID NO: 13267 - DNA, 22 bp, Homo sapiens
cgacccggggaggtagtgacga

SEQ ID NO: 13268 - DNA, 23 bp, Homo sapiens
cgacccggggaggtagtgacgaa

SEQ ID NO: 13269 - DNA, 24 bp, Homo sapiens
cgacccggggaggtagtgacgaaa

SEQ ID NO: 13270 - DNA, 25 bp, Homo sapiens
cgacccggggaggtagtgacgaaaa

SEQ ID NO: 13271 - DNA, 26 bp, Homo sapiens
cgacccggggaggtagtgacgaaaaa

SEQ ID NO: 13272 - DNA, 27 bp, Homo sapiens
cgacccggggaggtagtgacgaaaaat

SEQ ID NO: 13273 - DNA, 28 bp, Homo sapiens
cgacccggggaggtagtgacgaaaaata

SEQ ID NO: 13274 - DNA, 31 bp, Homo sapiens
cgacccggggaggtagtgacgaaaaataaca

SEQ ID NO: 13275 - DNA, 40 bp, Homo sapiens
cgacccggggaggtagtgacgaaaaataacaatacaggac

SEQ ID NO: 13276 - DNA, 41 bp, Homo sapiens
cgacccggggaggtagtgacgaaaaataacaatacaggact

SEQ ID NO: 13277 - DNA, 42 bp, Homo sapiens
cgacccggggaggtagtgacgaaaaataacaatacaggactc

SEQ ID NO: 13278 - DNA, 43 bp, Homo sapiens
cgacccggggaggtagtgacgaaaaataacaatacaggactct

SEQ ID NO: 13279 - DNA, 45 bp, Homo sapiens
cgacccggggaggtagtgacgaaaaataacaatacaggactcttt

SEQ ID NO: 13280 - DNA, 21 bp, Homo sapiens
gacccggggaggtagtgacga

SEQ ID NO: 13281 - DNA, 22 bp, Homo sapiens
gacccggggaggtagtgacgaa

SEQ ID NO: 13282 - DNA, 23 bp, Homo sapiens
gacccggggaggtagtgacgaaa

SEQ ID NO: 13283 - DNA, 24 bp, Homo sapiens
gacccggggaggtagtgacgaaaa

SEQ ID NO: 13284 - DNA, 25 bp, Homo sapiens
gacccggggaggtagtgacgaaaaa

SEQ ID NO: 13285 - DNA, 26 bp, Homo sapiens
gacccggggaggtagtgacgaaaaat

SEQ ID NO: 13286 - DNA, 27 bp, Homo sapiens
gacccggggaggtagtgacgaaaaata

SEQ ID NO: 13287 - DNA, 30 bp, Homo sapiens
gacccggggaggtagtgacgaaaaataaca

SEQ ID NO: 13288 - DNA, 39 bp, Homo sapiens
gacccggggaggtagtgacgaaaaataacaatacaggac

SEQ ID NO: 13289 - DNA, 40 bp, Homo sapiens
gacccggggaggtagtgacgaaaaataacaatacaggact

SEQ ID NO: 13290 - DNA, 41 bp, Homo sapiens
gacccggggaggtagtgacgaaaaataacaatacaggactc

SEQ ID NO: 13291 - DNA, 19 bp, Homo sapiens
cccggggaggtagtgacga

SEQ ID NO: 13292 - DNA, 20 bp, Homo sapiens
cccggggaggtagtgacgaa

SEQ ID NO: 13293 - DNA, 21 bp, Homo sapiens
cccggggaggtagtgacgaaa

SEQ ID NO: 13294 - DNA, 22 bp, Homo sapiens
cccggggaggtagtgacgaaaa

SEQ ID NO: 13295 - DNA, 23 bp, Homo sapiens
cccggggaggtagtgacgaaaaa

SEQ ID NO: 13296 - DNA, 24 bp, Homo sapiens
cccggggaggtagtgacgaaaaat

SEQ ID NO: 13297 - DNA, 25 bp, Homo sapiens
cccggggaggtagtgacgaaaaata

SEQ ID NO: 13298 - DNA, 26 bp, Homo sapiens
cccggggaggtagtgacgaaaaataa

SEQ ID NO: 13299 - DNA, 28 bp, Homo sapiens
cccggggaggtagtgacgaaaaataaca

SEQ ID NO: 13300 - DNA, 29 bp, Homo sapiens
cccggggaggtagtgacgaaaaataacaa

SEQ ID NO: 13301 - DNA, 30 bp, Homo sapiens
cccggggaggtagtgacgaaaaataacaat

SEQ ID NO: 13302 - DNA, 31 bp, Homo sapiens
cccggggaggtagtgacgaaaaataacaata

SEQ ID NO: 13303 - DNA, 33 bp, Homo sapiens
cccggggaggtagtgacgaaaaataacaataca

SEQ ID NO: 13304 - DNA, 16 bp, Homo sapiens
cggggaggtagtgacg

SEQ ID NO: 13305 - DNA, 17 bp, Homo sapiens
cggggaggtagtgacga

SEQ ID NO: 13306 - DNA, 18 bp, Homo sapiens
cggggaggtagtgacgaa

SEQ ID NO: 13307 - DNA, 19 bp, Homo sapiens
cggggaggtagtgacgaaa

SEQ ID NO: 13308 - DNA, 20 bp, Homo sapiens
cggggaggtagtgacgaaaa

SEQ ID NO: 13309 - DNA, 21 bp, Homo sapiens
cggggaggtagtgacgaaaaa

SEQ ID NO: 13310 - DNA, 22 bp, Homo sapiens
cggggaggtagtgacgaaaaat

SEQ ID NO: 13311 - DNA, 23 bp, Homo sapiens
cggggaggtagtgacgaaaaata

SEQ ID NO: 13312 - DNA, 25 bp, Homo sapiens
cggggaggtagtgacgaaaaataac

SEQ ID NO: 13313 - DNA, 26 bp, Homo sapiens
cggggaggtagtgacgaaaaataaca

SEQ ID NO: 13314 - DNA, 33 bp, Homo sapiens
cggggaggtagtgacgaaaaataacaatacagg

SEQ ID NO: 13315 - DNA, 35 bp, Homo sapiens
cggggaggtagtgacgaaaaataacaatacaggac

SEQ ID NO: 13316 - DNA, 36 bp, Homo sapiens
cggggaggtagtgacgaaaaataacaatacaggact

SEQ ID NO: 13317 - DNA, 41 bp, Homo sapiens
cggggaggtagtgacgaaaaataacaatacaggactctttc

SEQ ID NO: 13318 - DNA, 16 bp, Homo sapiens
ggggaggtagtgacga

SEQ ID NO: 13319 - DNA, 17 bp, Homo sapiens
ggggaggtagtgacgaa

SEQ ID NO: 13320 - DNA, 18 bp, Homo sapiens
ggggaggtagtgacgaaa

SEQ ID NO: 13321 - DNA, 19 bp, Homo sapiens
ggggaggtagtgacgaaaa

SEQ ID NO: 13322 - DNA, 20 bp, Homo sapiens
ggggaggtagtgacgaaaaa

SEQ ID NO: 13323 - DNA, 21 bp, Homo sapiens
ggggaggtagtgacgaaaaat

SEQ ID NO: 13324 - DNA, 22 bp, Homo sapiens
ggggaggtagtgacgaaaaata

SEQ ID NO: 13325 - DNA, 24 bp, Homo sapiens
ggggaggtagtgacgaaaaataac

SEQ ID NO: 13326 - DNA, 25 bp, Homo sapiens
ggggaggtagtgacgaaaaataaca

SEQ ID NO: 13327 - DNA, 33 bp, Homo sapiens
gggaggtagtgacgaaaaataacaatacaggac

SEQ ID NO: 13328 - DNA, 31 bp, Homo sapiens
gaggtagtgacgaaaaataacaatacaggac

SEQ ID NO: 13329 - DNA, 32 bp, Homo sapiens; identical to SEQ ID NO: 2311

SEQ ID NO: 13330 - DNA, 33 bp, Homo sapiens
gaggtagtgacgaaaaataacaatacaggactc

SEQ ID NO: 13331 - DNA, 38 bp, Homo sapiens
gaggtagtgacgaaaaataacaatacaggactctttcg

SEQ ID NO: 13332 - DNA, 30 bp, Homo sapiens
aggtagtgacgaaaaataacaatacaggac

SEQ ID NO: 13333 - DNA, 31 bp, Homo sapiens; identical to SEQ ID NO: 2312

SEQ ID NO: 13334 - DNA, 30 bp, Homo sapiens; identical to SEQ ID NO: 2313

SEQ ID NO: 13335 - DNA, 28 bp, Homo sapiens
tagtgacgaaaaataacaatacaggact

SEQ ID NO: 13336 - DNA, 30 bp, Homo sapiens
tagtgacgaaaaataacaatacaggactct

SEQ ID NO: 13337 - DNA, 27 bp, Homo sapiens
agtgacgaaaaataacaatacaggact

SEQ ID NO: 13338 - DNA, 32 bp, Homo sapiens
agtgacgaaaaataacaatacaggactctttc

SEQ ID NO: 13339 - DNA, 33 bp, Homo sapiens
agtgacgaaaaataacaatacaggactctttcg

SEQ ID NO: 13340 - DNA, 26 bp, Homo sapiens
gtgacgaaaaataacaatacaggact

SEQ ID NO: 13341 - DNA, 30 bp, Homo sapiens
gtgacgaaaaataacaatacaggactcttt

SEQ ID NO: 13342 - DNA, 31 bp, Homo sapiens
gtgacgaaaaataacaatacaggactctttc

SEQ ID NO: 13343 - DNA, 32 bp, Homo sapiens
gtgacgaaaaataacaatacaggactctttcg

SEQ ID NO: 13344 - DNA, 23 bp, Homo sapiens
gacgaaaaataacaatacaggac

SEQ ID NO: 13345 - DNA, 24 bp, Homo sapiens
gacgaaaaataacaatacaggact

SEQ ID NO: 13346 - DNA, 26 bp, Homo sapiens
gacgaaaaataacaatacaggactct

SEQ ID NO: 13347 - DNA, 27 bp, Homo sapiens
gacgaaaaataacaatacaggactctt

SEQ ID NO: 13348 - DNA, 28 bp, Homo sapiens
gacgaaaaataacaatacaggactcttt

SEQ ID NO: 13349 - DNA, 29 bp, Homo sapiens
gacgaaaaataacaatacaggactctttc

SEQ ID NO: 13350 - DNA, 30 bp, Homo sapiens
gacgaaaaataacaatacaggactctttcg

SEQ ID NO: 13351 - DNA, 22 bp, Homo sapiens
acgaaaaataacaatacaggac

SEQ ID NO: 13352 - DNA, 23 bp, Homo sapiens
acgaaaaataacaatacaggact

SEQ ID NO: 13353 - DNA, 24 bp, Homo sapiens
acgaaaaataacaatacaggactc

SEQ ID NO: 13354 - DNA, 25 bp, Homo sapiens
acgaaaaataacaatacaggactct

SEQ ID NO: 13355 - DNA, 27 bp, Homo sapiens
acgaaaaataacaatacaggactcttt

SEQ ID NO: 13356 - DNA, 28 bp, Homo sapiens
acgaaaaataacaatacaggactctttc

SEQ ID NO: 13357 - DNA, 29 bp, Homo sapiens
acgaaaaataacaatacaggactctttcg

SEQ ID NO: 13358 - DNA, 22 bp, Homo sapiens
cgaaaaataacaatacaggact

SEQ ID NO: 13359 - DNA, 27 bp, Homo sapiens
cgaaaaataacaatacaggactctttc

SEQ ID NO: 13360 - DNA, 28 bp, Homo sapiens
cgaaaaataacaatacaggactctttcg

SEQ ID NO: 13361 - DNA, 40 bp, Homo sapiens
cgaaaaataacaatacaggactctttcgaggccctgtaat

SEQ ID NO: 13362 - DNA, 21 bp, Homo sapiens
gaaaaataacaatacaggact

SEQ ID NO: 13363 - DNA, 19 bp, Homo sapiens
aaaaataacaatacaggac

SEQ ID NO: 13364 - DNA, 20 bp, Homo sapiens
aaaaataacaatacaggact

SEQ ID NO: 13365 - DNA, 21 bp, Homo sapiens
aaaaataacaatacaggactc

SEQ ID NO: 13366 - DNA, 22 bp, Homo sapiens
aaaaataacaatacaggactct

SEQ ID NO: 13367 - DNA, 23 bp, Homo sapiens
aaaaataacaatacaggactctt

SEQ ID NO: 13368 - DNA, 24 bp, Homo sapiens
aaaaataacaatacaggactcttt

SEQ ID NO: 13369 - DNA, 25 bp, Homo sapiens
aaaaataacaatacaggactctttc

SEQ ID NO: 13370 - DNA, 26 bp, Homo sapiens
aaaaataacaatacaggactctttcg

SEQ ID NO: 13371 - DNA, 30 bp, Homo sapiens
aaaaataacaatacaggactctttcgaggc

SEQ ID NO: 13372 - DNA, 19 bp, Homo sapiens
aaaataacaatacaggact

SEQ ID NO: 13373 - DNA, 24 bp, Homo sapiens
aaaataacaatacaggactctttc

SEQ ID NO: 13374 - DNA, 25 bp, Homo sapiens
aaaataacaatacaggactctttcg

SEQ ID NO: 13375 - DNA, 26 bp, Homo sapiens
aaaataacaatacaggactctttcga

SEQ ID NO: 13376 - DNA, 17 bp, Homo sapiens
aaataacaatacaggac

SEQ ID NO: 13377 - DNA, 18 bp, Homo sapiens
aaataacaatacaggact

SEQ ID NO: 13378 - DNA, 19 bp, Homo sapiens
aaataacaatacaggactc

SEQ ID NO: 13379 - DNA, 20 bp, Homo sapiens
aaataacaatacaggactct

SEQ ID NO: 13380 - DNA, 22 bp, Homo sapiens
aaataacaatacaggactcttt

SEQ ID NO: 13381 - DNA, 23 bp, Homo sapiens
aaataacaatacaggactctttc

SEQ ID NO: 13382 - DNA, 24 bp, Homo sapiens
aaataacaatacaggactctttcg

SEQ ID NO: 13383 - DNA, 25 bp, Homo sapiens
aaataacaatacaggactctttcga

SEQ ID NO: 13384 - DNA, 28 bp, Homo sapiens
aaataacaatacaggactctttcgaggc

SEQ ID NO: 13385 - DNA, 16 bp, Homo sapiens
aataacaatacaggac

SEQ ID NO: 13386 - DNA, 17 bp, Homo sapiens
aataacaatacaggact

SEQ ID NO: 13387 - DNA, 18 bp, Homo sapiens
aataacaatacaggactc

SEQ ID NO: 13388 - DNA, 19 bp, Homo sapiens
aataacaatacaggactct

SEQ ID NO: 13389 - DNA, 21 bp, Homo sapiens
aataacaatacaggactcttt

SEQ ID NO: 13390 - DNA, 22 bp, Homo sapiens
aataacaatacaggactctttc

SEQ ID NO: 13391 - DNA, 23 bp, Homo sapiens
aataacaatacaggactctttcg

SEQ ID NO: 13392 - DNA, 24 bp, Homo sapiens
aataacaatacaggactctttcga

SEQ ID NO: 13393 - DNA, 27 bp, Homo sapiens
aataacaatacaggactctttcgaggc

SEQ ID NO: 13394 - DNA, 35 bp, Homo sapiens
aataacaatacaggactctttcgaggccctgtaat

SEQ ID NO: 13395 - DNA, 16 bp, Homo sapiens
ataacaatacaggact

SEQ ID NO: 13396 - DNA, 18 bp, Homo sapiens
ataacaatacaggactct

SEQ ID NO: 13397 - DNA, 20 bp, Homo sapiens
ataacaatacaggactcttt

SEQ ID NO: 13398 - DNA, 21 bp, Homo sapiens
ataacaatacaggactctttc

SEQ ID NO: 13399 - DNA, 22 bp, Homo sapiens
ataacaatacaggactctttcg

SEQ ID NO: 13400 - DNA, 23 bp, Homo sapiens
ataacaatacaggactctttcga

SEQ ID NO: 13401 - DNA, 26 bp, Homo sapiens
ataacaatacaggactctttcgaggc

SEQ ID NO: 13402 - DNA, 20 bp, Homo sapiens
taacaatacaggactctttc

SEQ ID NO: 13403 - DNA, 22 bp, Homo sapiens
taacaatacaggactctttcga

SEQ ID NO: 13404 - DNA, 25 bp, Homo sapiens
taacaatacaggactctttcgaggc

SEQ ID NO: 13405 - DNA, 33 bp, Homo sapiens
taacaatacaggactctttcgaggccctgtaat

SEQ ID NO: 13406 - DNA, 16 bp, Homo sapiens
aacaatacaggactct

SEQ ID NO: 13407 - DNA, 19 bp, Homo sapiens
aacaatacaggactctttc

SEQ ID NO: 13408 - DNA, 24 bp, Homo sapiens
aacaatacaggactctttcgaggc

SEQ ID NO: 13409 - DNA, 32 bp, Homo sapiens
aacaatacaggactctttcgaggccctgtaat

SEQ ID NO: 13410 - DNA, 18 bp, Homo sapiens
acaatacaggactctttc

SEQ ID NO: 13411 - DNA, 20 bp, Homo sapiens
acaatacaggactctttcga

SEQ ID NO: 13412 - DNA, 23 bp, Homo sapiens
acaatacaggactctttcgaggc

SEQ ID NO: 13413 - DNA, 31 bp, Homo sapiens
acaatacaggactctttcgaggccctgtaat

SEQ ID NO: 13414 - DNA, 17 bp, Homo sapiens
caatacaggactctttc

SEQ ID NO: 13415 - DNA, 19 bp, Homo sapiens
caatacaggactctttcga

SEQ ID NO: 13416 - DNA, 22 bp, Homo sapiens
caatacaggactctttcgaggc

SEQ ID NO: 13417 - DNA, 30 bp, Homo sapiens
caatacaggactctttcgaggccctgtaat

SEQ ID NO: 13418 - DNA, 16 bp, Homo sapiens
aatacaggactctttc

SEQ ID NO: 13419 - DNA, 17 bp, Homo sapiens
aatacaggactctttcg

SEQ ID NO: 13420 - DNA, 18 bp, Homo sapiens
aatacaggactctttcga

SEQ ID NO: 13421 - DNA, 21 bp, Homo sapiens
aatacaggactctttcgaggc

SEQ ID NO: 13422 - DNA, 24 bp, Homo sapiens
aatacaggactctttcgaggccct

SEQ ID NO: 13423 - DNA, 29 bp, Homo sapiens
aatacaggactctttcgaggccctgtaat

SEQ ID NO: 13424 - DNA, 16 bp, Homo sapiens
atacaggactctttcg

SEQ ID NO: 13425 - DNA, 17 bp, Homo sapiens
atacaggactctttcga

SEQ ID NO: 13426 - DNA, 20 bp, Homo sapiens
atacaggactctttcgaggc

SEQ ID NO: 13427 - DNA, 28 bp, Homo sapiens
atacaggactctttcgaggccctgtaat

SEQ ID NO: 13428 - DNA, 16 bp, Homo sapiens
tacaggactctttcga

SEQ ID NO: 13429 - DNA, 19 bp, Homo sapiens
tacaggactctttcgaggc

SEQ ID NO: 13430 - DNA, 27 bp, Homo sapiens
tacaggactctttcgaggccctgtaat

SEQ ID NO: 13431 - DNA, 18 bp, Homo sapiens
acaggactctttcgaggc

SEQ ID NO: 13432 - DNA, 20 bp, Homo sapiens
acaggactctttcgaggccc

SEQ ID NO: 13433 - DNA, 21 bp, Homo sapiens
acaggactctttcgaggccct

SEQ ID NO: 13434 - DNA, 17 bp, Homo sapiens
caggactctttcgaggc

SEQ ID NO: 13435 - DNA, 19 bp, Homo sapiens
caggactctttcgaggccc

SEQ ID NO: 13436 - DNA, 25 bp, Homo sapiens
caggactctttcgaggccctgtaat

SEQ ID NO: 13437 - DNA, 16 bp, Homo sapiens
aggactctttcgaggc

SEQ ID NO: 13438 - DNA, 17 bp, Homo sapiens
aggactctttcgaggcc

SEQ ID NO: 13439 - DNA, 18 bp, Homo sapiens
aggactctttcgaggccc

SEQ ID NO: 13440 - DNA, 19 bp, Homo sapiens
aggactctttcgaggccct

SEQ ID NO: 13441 - DNA, 21 bp, Homo sapiens
actctttcgaggccctgtaat

SEQ ID NO: 13442 - DNA, 16 bp, Homo sapiens
ctctttcgaggccctg

SEQ ID NO: 13443 - DNA, 17 bp, Homo sapiens
ctctttcgaggccctgt

SEQ ID NO: 13444 - DNA, 18 bp, Homo sapiens
ctctttcgaggccctgta

SEQ ID NO: 13445 - DNA, 19 bp, Homo sapiens
ctctttcgaggccctgtaa

SEQ ID NO: 13446 - DNA, 20 bp, Homo sapiens
ctctttcgaggccctgtaat

SEQ ID NO: 13447 - DNA, 16 bp, Homo sapiens
tctttcgaggccctgt

SEQ ID NO: 13448 - DNA, 17 bp, Homo sapiens
tctttcgaggccctgta

SEQ ID NO: 13449 - DNA, 18 bp, Homo sapiens
tctttcgaggccctgtaa

SEQ ID NO: 13450 - DNA, 19 bp, Homo sapiens
tctttcgaggccctgtaat

SEQ ID NO: 13451 - DNA, 20 bp, Homo sapiens
tctttcgaggccctgtaatt

SEQ ID NO: 13452 - DNA, 21 bp, Homo sapiens
tctttcgaggccctgtaattg

SEQ ID NO: 13453 - DNA, 26 bp, Homo sapiens
tctttcgaggccctgtaattggaatg

SEQ ID NO: 13454 - DNA, 30 bp, Homo sapiens
tctttcgaggccctgtaattggaatgagtc

SEQ ID NO: 13455 - DNA, 31 bp, Homo sapiens; identical to SEQ ID NO: 2359

SEQ ID NO: 13456 - DNA, 32 bp, Homo sapiens; identical to SEQ ID NO: 2360

SEQ ID NO: 13457 - DNA, 33 bp, Homo sapiens
tctttcgaggccctgtaattggaatgagtccac

SEQ ID NO: 13458 - DNA, 34 bp, Homo sapiens
tctttcgaggccctgtaattggaatgagtccact

SEQ ID NO: 13459 - DNA, 36 bp, Homo sapiens
tctttcgaggccctgtaattggaatgagtccacttt

SEQ ID NO: 13460 - DNA, 16 bp, Homo sapiens
ctttcgaggccctgta

SEQ ID NO: 13461 - DNA, 17 bp, Homo sapiens
ctttcgaggccctgtaa

SEQ ID NO: 13462 - DNA, 18 bp, Homo sapiens
ctttcgaggccctgtaat

SEQ ID NO: 13463 - DNA, 19 bp, Homo sapiens
ctttcgaggccctgtaatt

SEQ ID NO: 13464 - DNA, 20 bp, Homo sapiens
ctttcgaggccctgtaattg

SEQ ID NO: 13465 - DNA, 21 bp, Homo sapiens
ctttcgaggccctgtaattgg

SEQ ID NO: 13466 - DNA, 24 bp, Homo sapiens
ctttcgaggccctgtaattggaat

SEQ ID NO: 13467 - DNA, 25 bp, Homo sapiens
ctttcgaggccctgtaattggaatg

SEQ ID NO: 13468 - DNA, 27 bp, Homo sapiens
ctttcgaggccctgtaattggaatgag

SEQ ID NO: 13469 - DNA, 29 bp, Homo sapiens
ctttcgaggccctgtaattggaatgagtc

SEQ ID NO: 13470 - DNA, 30 bp, Homo sapiens; identical to SEQ ID NO: 2369

SEQ ID NO: 13471 - DNA, 31 bp, Homo sapiens; identical to SEQ ID NO: 2370

SEQ ID NO: 13472 - DNA, 32 bp, Homo sapiens
ctttcgaggccctgtaattggaatgagtccac

SEQ ID NO: 13473 - DNA, 33 bp, Homo sapiens; identical to SEQ ID NO: 2371

SEQ ID NO: 13474 - DNA, 35 bp, Homo sapiens
ctttcgaggccctgtaattggaatgagtccacttt

SEQ ID NO: 13475 - DNA, 41 bp, Homo sapiens
ctttcgaggccctgtaattggaatgagtccactttaaatcc

SEQ ID NO: 13476 - DNA, 16 bp, Homo sapiens
tttcgaggccctgtaa

SEQ ID NO: 13477 - DNA, 17 bp, Homo sapiens
tttcgaggccctgtaat

SEQ ID NO: 13478 - DNA, 18 bp, Homo sapiens
tttcgaggccctgtaatt

SEQ ID NO: 13479 - DNA, 19 bp, Homo sapiens
tttcgaggccctgtaattg

SEQ ID NO: 13480 - DNA, 20 bp, Homo sapiens
tttcgaggccctgtaattgg

SEQ ID NO: 13481 - DNA, 24 bp, Homo sapiens
tttcgaggccctgtaattggaatg

SEQ ID NO: 13482 - DNA, 26 bp, Homo sapiens
tttcgaggccctgtaattggaatgag

SEQ ID NO: 13483 - DNA, 27 bp, Homo sapiens
tttcgaggccctgtaattggaatgagt

SEQ ID NO: 13484 - DNA, 28 bp, Homo sapiens
tttcgaggccctgtaattggaatgagtc

SEQ ID NO: 13485 - DNA, 29 bp, Homo sapiens
tttcgaggccctgtaattggaatgagtcc

SEQ ID NO: 13486 - DNA, 30 bp, Homo sapiens; identical to SEQ ID NO: 2381

SEQ ID NO: 13487 - DNA, 32 bp, Homo sapiens; identical to SEQ ID NO: 2382

SEQ ID NO: 13488 - DNA, 33 bp, Homo sapiens
tttcgaggccctgtaattggaatgagtccactt

SEQ ID NO: 13489 - DNA, 34 bp, Homo sapiens
tttcgaggccctgtaattggaatgagtccacttt

SEQ ID NO: 13490 - DNA, 40 bp, Homo sapiens
tttcgaggccctgtaattggaatgagtccactttaaatcc

SEQ ID NO: 13491 - DNA, 41 bp, Homo sapiens
tttcgaggccctgtaattggaatgagtccactttaaatcct

SEQ ID NO: 13492 - DNA, 16 bp, Homo sapiens
ttcgaggccctgtaat

SEQ ID NO: 13493 - DNA, 17 bp, Homo sapiens
ttcgaggccctgtaatt

SEQ ID NO: 13494 - DNA, 18 bp, Homo sapiens
ttcgaggccctgtaattg

SEQ ID NO: 13495 - DNA, 23 bp, Homo sapiens
ttcgaggccctgtaattggaatg

SEQ ID NO: 13496 - DNA, 25 bp, Homo sapiens
ttcgaggccctgtaattggaatgag

SEQ ID NO: 13497 - DNA, 27 bp, Homo sapiens
ttcgaggccctgtaattggaatgagtc

SEQ ID NO: 13498 - DNA, 28 bp, Homo sapiens
ttcgaggccctgtaattggaatgagtcc

SEQ ID NO: 13499 - DNA, 31 bp, Homo sapiens; identical to SEQ ID NO: 2386

SEQ ID NO: 13500 - DNA, 33 bp, Homo sapiens
ttcgaggccctgtaattggaatgagtccacttt

SEQ ID NO: 13501 - DNA, 16 bp, Homo sapiens
tcgaggccctgtaatt

SEQ ID NO: 13502 - DNA, 22 bp, Homo sapiens
tcgaggccctgtaattggaatg

SEQ ID NO: 13503 - DNA, 24 bp, Homo sapiens
tcgaggccctgtaattggaatgag

SEQ ID NO: 13504 - DNA, 26 bp, Homo sapiens
tcgaggccctgtaattggaatgagtc

SEQ ID NO: 13505 - DNA, 27 bp, Homo sapiens
tcgaggccctgtaattggaatgagtcc

SEQ ID NO: 13506 - DNA, 30 bp, Homo sapiens; identical to SEQ ID NO: 2388

SEQ ID NO: 13507 - DNA, 32 bp, Homo sapiens
tcgaggccctgtaattggaatgagtccacttt

SEQ ID NO: 13508 - DNA, 21 bp, Homo sapiens
cgaggccctgtaattggaatg

SEQ ID NO: 13509 - DNA, 23 bp, Homo sapiens
cgaggccctgtaattggaatgag

SEQ ID NO: 13510 - DNA, 25 bp, Homo sapiens
cgaggccctgtaattggaatgagtc

SEQ ID NO: 13511 - DNA, 26 bp, Homo sapiens
cgaggccctgtaattggaatgagtcc

SEQ ID NO: 13512 - DNA, 29 bp, Homo sapiens
cgaggccctgtaattggaatgagtccact

SEQ ID NO: 13513 - DNA, 31 bp, Homo sapiens
cgaggccctgtaattggaatgagtccacttt

SEQ ID NO: 13514 - DNA, 16 bp, Homo sapiens
gaggccctgtaattgg

SEQ ID NO: 13515 - DNA, 20 bp, Homo sapiens
gaggccctgtaattggaatg

SEQ ID NO: 13516 - DNA, 22 bp, Homo sapiens
gaggccctgtaattggaatgag

SEQ ID NO: 13517 - DNA, 23 bp, Homo sapiens
gaggccctgtaattggaatgagt

SEQ ID NO: 13518 - DNA, 24 bp, Homo sapiens
gaggccctgtaattggaatgagtc

SEQ ID NO: 13519 - DNA, 25 bp, Homo sapiens
gaggccctgtaattggaatgagtcc

SEQ ID NO: 13520 - DNA, 26 bp, Homo sapiens
gaggccctgtaattggaatgagtcca

SEQ ID NO: 13521 - DNA, 28 bp, Homo sapiens
gaggccctgtaattggaatgagtccact

SEQ ID NO: 13522 - DNA, 30 bp, Homo sapiens; identical to SEQ ID NO: 2397

SEQ ID NO: 13523 - DNA, 31 bp, Homo sapiens
gaggccctgtaattggaatgagtccacttta

SEQ ID NO: 13524 - DNA, 36 bp, Homo sapiens
gaggccctgtaattggaatgagtccactttaaatcc

SEQ ID NO: 13525 - DNA, 37 bp, Homo sapiens
gaggccctgtaattggaatgagtccactttaaatcct

SEQ ID NO: 13526 - DNA, 19 bp, Homo sapiens
aggccctgtaattggaatg

SEQ ID NO: 13527 - DNA, 23 bp, Homo sapiens
aggccctgtaattggaatgagtc

SEQ ID NO: 13528 - DNA, 24 bp, Homo sapiens
aggccctgtaattggaatgagtcc

SEQ ID NO: 13529 - DNA, 27 bp, Homo sapiens
aggccctgtaattggaatgagtccact

SEQ ID NO: 13530 - DNA, 29 bp, Homo sapiens
aggccctgtaattggaatgagtccacttt

SEQ ID NO: 13531 - DNA, 30 bp, Homo sapiens
aggccctgtaattggaatgagtccacttta

SEQ ID NO: 13532 - DNA, 36 bp, Homo sapiens
aggccctgtaattggaatgagtccactttaaatcct

SEQ ID NO: 13533 - DNA, 18 bp, Homo sapiens
ggccctgtaattggaatg

SEQ ID NO: 13534 - DNA, 25 bp, Homo sapiens
gccctgtaattggaatgagtccact

SEQ ID NO: 13535 - DNA, 32 bp, Homo sapiens
cctgtaattggaatgagtccactttaaatcct

SEQ ID NO: 13536 - DNA, 30 bp, Homo sapiens
tgtaattggaatgagtccactttaaatcct

SEQ ID NO: 13537 - DNA, 27 bp, Homo sapiens
aattggaatgagtccactttaaatcct

SEQ ID NO: 13538 - DNA, 25 bp, Homo sapiens
attggaatgagtccactttaaatcc

SEQ ID NO: 13539 - DNA, 26 bp, Homo sapiens
attggaatgagtccactttaaatcct

SEQ ID NO: 13540 - DNA, 33 bp, Homo sapiens
attggaatgagtccactttaaatcctttaacga

SEQ ID NO: 13541 - DNA, 16 bp, Homo sapiens
ttggaatgagtccact

SEQ ID NO: 13542 - DNA, 24 bp, Homo sapiens
ttggaatgagtccactttaaatcc

SEQ ID NO: 13543 - DNA, 25 bp, Homo sapiens
ttggaatgagtccactttaaatcct

SEQ ID NO: 13544 - DNA, 32 bp, Homo sapiens
ttggaatgagtccactttaaatcctttaacga

SEQ ID NO: 13545 - DNA, 21 bp, Homo sapiens
aatgagtccactttaaatcct

SEQ ID NO: 13546 - DNA, 20 bp, Homo sapiens
atgagtccactttaaatcct

SEQ ID NO: 13547 - DNA, 27 bp, Homo sapiens
atgagtccactttaaatcctttaacga

SEQ ID NO: 13548 - DNA, 19 bp, Homo sapiens
tgagtccactttaaatcct

SEQ ID NO: 13549 - DNA, 26 bp, Homo sapiens
tgagtccactttaaatcctttaacga

SEQ ID NO: 13550 - DNA, 33 bp, Homo sapiens; identical to SEQ ID NO: 2403

SEQ ID NO: 13551 - DNA, 32 bp, Homo sapiens; identical to SEQ ID NO: 2404

SEQ ID NO: 13552 - DNA, 24 bp, Homo sapiens
ttaaatcctttaacgaggatccat

SEQ ID NO: 13553 - DNA, 30 bp, Homo sapiens
aatcctttaacgaggatccattggagggca

SEQ ID NO: 13554 - DNA, 18 bp, Homo sapiens
cctttaacgaggatccat

SEQ ID NO: 13555 - DNA, 26 bp, Homo sapiens
cctttaacgaggatccattggagggc

SEQ ID NO: 13556 - DNA, 25 bp, Homo sapiens
ctttaacgaggatccattggagggc

SEQ ID NO: 13557 - DNA, 30 bp, Homo sapiens
ctttaacgaggatccattggagggcaagtc

SEQ ID NO: 13558 - DNA, 37 bp, Homo sapiens
ctttaacgaggatccattggagggcaagtctggtgcc

SEQ ID NO: 13559 - DNA, 16 bp, Homo sapiens
tttaacgaggatccat

SEQ ID NO: 13560 - DNA, 24 bp, Homo sapiens
tttaacgaggatccattggagggc

SEQ ID NO: 13561 - DNA, 29 bp, Homo sapiens
tttaacgaggatccattggagggcaagtc

SEQ ID NO: 13562 - DNA, 36 bp, Homo sapiens
tttaacgaggatccattggagggcaagtctggtgcc

SEQ ID NO: 13563 - DNA, 23 bp, Homo sapiens
ttaacgaggatccattggagggc

SEQ ID NO: 13564 - DNA, 35 bp, Homo sapiens
ttaacgaggatccattggagggcaagtctggtgcc

SEQ ID NO: 13565 - DNA, 20 bp, Homo sapiens
acgaggatccattggagggc

SEQ ID NO: 13566 - DNA, 32 bp, Homo sapiens
acgaggatccattggagggcaagtctggtgcc

SEQ ID NO: 13567 - DNA, 19 bp, Homo sapiens
cgaggatccattggagggc

SEQ ID NO: 13568 - DNA, 20 bp, Homo sapiens
cgaggatccattggagggca

SEQ ID NO: 13569 - DNA, 31 bp, Homo sapiens
cgaggatccattggagggcaagtctggtgcc

SEQ ID NO: 13570 - DNA, 32 bp, Homo sapiens
cgaggatccattggagggcaagtctggtgcca

SEQ ID NO: 13571 - DNA, 18 bp, Homo sapiens
gaggatccattggagggc

SEQ ID NO: 13572 - DNA, 30 bp, Homo sapiens
gaggatccattggagggcaagtctggtgcc

SEQ ID NO: 13573 - DNA, 17 bp, Homo sapiens
aggatccattggagggc

SEQ ID NO: 13574 - DNA, 24 bp, Homo sapiens
aggatccattggagggcaagtctg

SEQ ID NO: 13575 - DNA, 29 bp, Homo sapiens
aggatccattggagggcaagtctggtgcc

SEQ ID NO: 13576 - DNA, 37 bp, Homo sapiens
aggatccattggagggcaagtctggtgccagcagccg

SEQ ID NO: 13577 - DNA, 16 bp, Homo sapiens
ggatccattggagggc

SEQ ID NO: 13578 - DNA, 17 bp, Homo sapiens
ggatccattggagggca

SEQ ID NO: 13579 - DNA, 18 bp, Homo sapiens
ggatccattggagggcaa

SEQ ID NO: 13580 - DNA, 28 bp, Homo sapiens
ggatccattggagggcaagtctggtgcc

SEQ ID NO: 13581 - DNA, 16 bp, Homo sapiens
gatccattggagggca

SEQ ID NO: 13582 - DNA, 17 bp, Homo sapiens
gatccattggagggcaa

SEQ ID NO: 13583 - DNA, 22 bp, Homo sapiens
gatccattggagggcaagtctg

SEQ ID NO: 13584 - DNA, 27 bp, Homo sapiens
gatccattggagggcaagtctggtgcc

SEQ ID NO: 13585 - DNA, 31 bp, Homo sapiens
gatccattggagggcaagtctggtgccagca

SEQ ID NO: 13586 - DNA, 33 bp, Homo sapiens
gatccattggagggcaagtctggtgccagcagc

SEQ ID NO: 13587 - DNA, 35 bp, Homo sapiens
gatccattggagggcaagtctggtgccagcagccg

SEQ ID NO: 13588 - DNA, 16 bp, Homo sapiens
atccattggagggcaa

SEQ ID NO: 13589 - DNA, 21 bp, Homo sapiens
atccattggagggcaagtctg

SEQ ID NO: 13590 - DNA, 32 bp, Homo sapiens
ccattggagggcaagtctggtgccagcagccg

SEQ ID NO: 13591 - DNA, 23 bp, Homo sapiens
cattggagggcaagtctggtgcc

SEQ ID NO: 13592 - DNA, 31 bp, Homo sapiens; identical to SEQ ID NO: 2411

SEQ ID NO: 13593 - DNA, 33 bp, Homo sapiens
cattggagggcaagtctggtgccagcagccgcg

SEQ ID NO: 13594 - DNA, 22 bp, Homo sapiens
attggagggcaagtctggtgcc

SEQ ID NO: 13595 - DNA, 23 bp, Homo sapiens
attggagggcaagtctggtgcca

SEQ ID NO: 13596 - DNA, 25 bp, Homo sapiens
attggagggcaagtctggtgccagc

SEQ ID NO: 13597 - DNA, 29 bp, Homo sapiens
attggagggcaagtctggtgccagcagcc

SEQ ID NO: 13598 - DNA, 30 bp, Homo sapiens; identical to SEQ ID NO: 2415

SEQ ID NO: 13599 - DNA, 31 bp, Homo sapiens
attggagggcaagtctggtgccagcagccgc

SEQ ID NO: 13600 - DNA, 32 bp, Homo sapiens
attggagggcaagtctggtgccagcagccgcg

SEQ ID NO: 13601 - DNA, 44 bp, Homo sapiens
attggagggcaagtctggtgccagcagccgcggtaattccagct

SEQ ID NO: 13602 - DNA, 16 bp, Homo sapiens
ttggagggcaagtctg

SEQ ID NO: 13603 - DNA, 21 bp, Homo sapiens
ttggagggcaagtctggtgcc

SEQ ID NO: 13604 - DNA, 22 bp, Homo sapiens
ttggagggcaagtctggtgcca

SEQ ID NO: 13605 - DNA, 23 bp, Homo sapiens
ttggagggcaagtctggtgccag

SEQ ID NO: 13606 - DNA, 24 bp, Homo sapiens
ttggagggcaagtctggtgccagc

SEQ ID NO: 13607 - DNA, 25 bp, Homo sapiens
ttggagggcaagtctggtgccagca

SEQ ID NO: 13608 - DNA, 28 bp, Homo sapiens
ttggagggcaagtctggtgccagcagcc

SEQ ID NO: 13609 - DNA, 29 bp, Homo sapiens
ttggagggcaagtctggtgccagcagccg

SEQ ID NO: 13610 - DNA, 30 bp, Homo sapiens
ttggagggcaagtctggtgccagcagccgc

SEQ ID NO: 13611 - DNA, 31 bp, Homo sapiens
ttggagggcaagtctggtgccagcagccgcg

SEQ ID NO: 13612 - DNA, 43 bp, Homo sapiens
ttggagggcaagtctggtgccagcagccgcggtaattccagct

SEQ ID NO: 13613 - DNA, 19 bp, Homo sapiens
ggagggcaagtctggtgcc

SEQ ID NO: 13614 - DNA, 18 bp, Homo sapiens
gagggcaagtctggtgcc

SEQ ID NO: 13615 - DNA, 26 bp, Homo sapiens
gagggcaagtctggtgccagcagccg

SEQ ID NO: 13616 - DNA, 16 bp, Homo sapiens
agggcaagtctggtgc

SEQ ID NO: 13617 - DNA, 17 bp, Homo sapiens
agggcaagtctggtgcc

SEQ ID NO: 13618 - DNA, 25 bp, Homo sapiens
agggcaagtctggtgccagcagccg

SEQ ID NO: 13619 - DNA, 24 bp, Homo sapiens
agtctggtgccagcagccgcggta

SEQ ID NO: 13620 - DNA, 31 bp, Homo sapiens
tctggtgccagcagccgcggtaattccagct

SEQ ID NO: 13621 - DNA, 16 bp, Homo sapiens
cagccgcggtaattcc

SEQ ID NO: 13622 - DNA, 21 bp, Homo sapiens
cagccgcggtaattccagctc

SEQ ID NO: 13623 - DNA, 29 bp, Homo sapiens
cagccgcggtaattccagctccaatagcg

SEQ ID NO: 13624 - DNA, 18 bp, Homo sapiens
ccgcggtaattccagctc

SEQ ID NO: 13625 - DNA, 42 bp, Homo sapiens
ccgcggtaattccagctccaatagcgtatattaaagttgctg

SEQ ID NO: 13626 - DNA, 39 bp, Homo sapiens
cggtaattccagctccaatagcgtatattaaagttgctg

SEQ ID NO: 13627 - DNA, 28 bp, Homo sapiens
gctccaatagcgtatattaaagttgctg

SEQ ID NO: 13628 - DNA, 16 bp, Homo sapiens
tattaaagttgctgca

SEQ ID NO: 13629 - DNA, 21 bp, Homo sapiens
tattaaagttgctgcagttaa

SEQ ID NO: 13630 - DNA, 33 bp, Homo sapiens; identical to SEQ ID NO: 2422

SEQ ID NO: 13631 - DNA, 32 bp, Homo sapiens; identical to SEQ ID NO: 2423

SEQ ID NO: 13632 - DNA, 21 bp, Homo sapiens
ttaaagttgctgcagttaaaa

SEQ ID NO: 13633 - DNA, 31 bp, Homo sapiens; identical to SEQ ID NO: 2424

SEQ ID NO: 13634 - DNA, 30 bp, Homo sapiens; identical to SEQ ID NO: 2425

SEQ ID NO: 13635 - DNA, 29 bp, Homo sapiens
aaagttgctgcagttaaaaagctcgtagt

SEQ ID NO: 13636 - DNA, 28 bp, Homo sapiens
aagttgctgcagttaaaaagctcgtagt

SEQ ID NO: 13637 - DNA, 30 bp, Homo sapiens
gttgctgcagttaaaaagctcgtagttgga

SEQ ID NO: 13638 - DNA, 32 bp, Homo sapiens
gttgctgcagttaaaaagctcgtagttggatc

SEQ ID NO: 13639 - DNA, 33 bp, Homo sapiens; identical to SEQ ID NO: 2427

SEQ ID NO: 13640 - DNA, 32 bp, Homo sapiens
ttgctgcagttaaaaagctcgtagttggatct

SEQ ID NO: 13641 - DNA, 29 bp, Homo sapiens
gctgcagttaaaaagctcgtagttggatc

SEQ ID NO: 13642 - DNA, 30 bp, Homo sapiens; identical to SEQ ID NO: 2429

SEQ ID NO: 13643 - DNA, 28 bp, Homo sapiens
ctgcagttaaaaagctcgtagttggatc

SEQ ID NO: 13644 - DNA, 30 bp, Homo sapiens
agttaaaaagctcgtagttggatcttggga

SEQ ID NO: 13645 - DNA, 23 bp, Homo sapiens
gttaaaaagctcgtagttggatc

SEQ ID NO: 13646 - DNA, 24 bp, Homo sapiens
gttaaaaagctcgtagttggatct

SEQ ID NO: 13647 - DNA, 29 bp, Homo sapiens
gttaaaaagctcgtagttggatcttggga

SEQ ID NO: 13648 - DNA, 31 bp, Homo sapiens
gttaaaaagctcgtagttggatcttgggagc

SEQ ID NO: 13649 - DNA, 26 bp, Homo sapiens
aaaaagctcgtagttggatcttggga

SEQ ID NO: 13650 - DNA, 16 bp, Homo sapiens
aaagctcgtagttgga

SEQ ID NO: 13651 - DNA, 19 bp, Homo sapiens
aaagctcgtagttggatct

SEQ ID NO: 13652 - DNA, 24 bp, Homo sapiens
aaagctcgtagttggatcttggga

SEQ ID NO: 13653 - DNA, 26 bp, Homo sapiens
aaagctcgtagttggatcttgggagc

SEQ ID NO: 13654 - DNA, 18 bp, Homo sapiens
aagctcgtagttggatct

SEQ ID NO: 13655 - DNA, 23 bp, Homo sapiens
aagctcgtagttggatcttggga

SEQ ID NO: 13656 - DNA, 24 bp, Homo sapiens
aagctcgtagttggatcttgggag

SEQ ID NO: 13657 - DNA, 25 bp, Homo sapiens
aagctcgtagttggatcttgggagc

SEQ ID NO: 13658 - DNA, 33 bp, Homo sapiens
aagctcgtagttggatcttgggagcgggcgggc

SEQ ID NO: 13659 - DNA, 17 bp, Homo sapiens
agctcgtagttggatct

SEQ ID NO: 13660 - DNA, 22 bp, Homo sapiens
agctcgtagttggatcttggga

SEQ ID NO: 13661 - DNA, 23 bp, Homo sapiens
agctcgtagttggatcttgggag

SEQ ID NO: 13662 - DNA, 24 bp, Homo sapiens
agctcgtagttggatcttgggagc

SEQ ID NO: 13663 - DNA, 28 bp, Homo sapiens
agctcgtagttggatcttgggagcgggc

SEQ ID NO: 13664 - DNA, 32 bp, Homo sapiens
agctcgtagttggatcttgggagcgggcgggc

SEQ ID NO: 13665 - DNA, 16 bp, Homo sapiens
gctcgtagttggatct

SEQ ID NO: 13666 - DNA, 20 bp, Homo sapiens
gctcgtagttggatcttggg

SEQ ID NO: 13667 - DNA, 21 bp, Homo sapiens
gctcgtagttggatcttggga

SEQ ID NO: 13668 - DNA, 23 bp, Homo sapiens
gctcgtagttggatcttgggagc

SEQ ID NO: 13669 - DNA, 20 bp, Homo sapiens
ctcgtagttggatcttggga

SEQ ID NO: 13670 - DNA, 19 bp, Homo sapiens
tcgtagttggatcttggga

SEQ ID NO: 13671 - DNA, 18 bp, Homo sapiens
cgtagttggatcttggga

SEQ ID NO: 13672 - DNA, 20 bp, Homo sapiens
cgtagttggatcttgggagc

SEQ ID NO: 13673 - DNA, 21 bp, Homo sapiens
cgtagttggatcttgggagcg

SEQ ID NO: 13674 - DNA, 26 bp, Homo sapiens
cgtagttggatcttgggagcgggcgg

SEQ ID NO: 13675 - DNA, 27 bp, Homo sapiens
cgtagttggatcttgggagcgggcggg

SEQ ID NO: 13676 - DNA, 28 bp, Homo sapiens
cgtagttggatcttgggagcgggcgggc

SEQ ID NO: 13677 - DNA, 30 bp, Homo sapiens
cgtagttggatcttgggagcgggcgggcgg

SEQ ID NO: 13678 - DNA, 31 bp, Homo sapiens
cgtagttggatcttgggagcgggcgggcggt

SEQ ID NO: 13679 - DNA, 32 bp, Homo sapiens; identical to SEQ ID NO: 2430

SEQ ID NO: 13680 - DNA, 33 bp, Homo sapiens; identical to SEQ ID NO: 2431

SEQ ID NO: 13681 - DNA, 17 bp, Homo sapiens
gtagttggatcttggga

SEQ ID NO: 13682 - DNA, 31 bp, Homo sapiens
gtagttggatcttgggagcgggcgggcggtc

SEQ ID NO: 13683 - DNA, 32 bp, Homo sapiens
gtagttggatcttgggagcgggcgggcggtcc

SEQ ID NO: 13684 - DNA, 16 bp, Homo sapiens
tagttggatcttggga

SEQ ID NO: 13685 - DNA, 30 bp, Homo sapiens
tagttggatcttgggagcgggcgggcggtc

SEQ ID NO: 13686 - DNA, 31 bp, Homo sapiens
tagttggatcttgggagcgggcgggcggtcc

SEQ ID NO: 13687 - DNA, 32 bp, Homo sapiens
tagttggatcttgggagcgggcgggcggtccg

SEQ ID NO: 13688 - DNA, 16 bp, Homo sapiens
ttgggagcgggcgggc

SEQ ID NO: 13689 - DNA, 16 bp, Homo sapiens
cgggcgggcggtccgc

SEQ ID NO: 13690 - DNA, 30 bp, Homo sapiens
cgccgcgaggcgagccaccgcccgtccccg

SEQ ID NO: 13691 - DNA, 29 bp, Homo sapiens
gccgcgaggcgagccaccgcccgtccccg

SEQ ID NO: 13692 - DNA, 30 bp, Homo sapiens
gccgcgaggcgagccaccgcccgtccccgc

SEQ ID NO: 13693 - DNA, 25 bp, Homo sapiens
gcgagccaccgcccgtccccgcccc

SEQ ID NO: 13694 - DNA, 22 bp, Homo sapiens
cgagccaccgcccgtccccgcc

SEQ ID NO: 13695 - DNA, 24 bp, Homo sapiens
cgagccaccgcccgtccccgcccc

SEQ ID NO: 13696 - DNA, 16 bp, Homo sapiens
accgcccgtccccgcc

SEQ ID NO: 13697 - DNA, 18 bp, Homo sapiens
accgcccgtccccgcccc

SEQ ID NO: 13698 - DNA, 23 bp, Homo sapiens
accgcccgtccccgccccttgcc

SEQ ID NO: 13699 - DNA, 33 bp, Homo sapiens
accgcccgtccccgccccttgcctctcggcgcc

SEQ ID NO: 13700 - DNA, 16 bp, Homo sapiens
ccgcccgtccccgccc

SEQ ID NO: 13701 - DNA, 17 bp, Homo sapiens
ccgcccgtccccgcccc

SEQ ID NO: 13702 - DNA, 22 bp, Homo sapiens
ccgcccgtccccgccccttgcc

SEQ ID NO: 13703 - DNA, 27 bp, Homo sapiens
ccgcccgtccccgccccttgcctctcg

SEQ ID NO: 13704 - DNA, 16 bp, Homo sapiens
cgcccgtccccgcccc

SEQ ID NO: 13705 - DNA, 31 bp, Homo sapiens
cgcccgtccccgccccttgcctctcggcgcc

SEQ ID NO: 13706 - DNA, 24 bp, Homo sapiens
cgtccccgccccttgcctctcggc

SEQ ID NO: 13707 - DNA, 27 bp, Homo sapiens
cgtccccgccccttgcctctcggcgcc

SEQ ID NO: 13708 - DNA, 17 bp, Homo sapiens
ccccttgcctctcggcg

SEQ ID NO: 13709 - DNA, 35 bp, Homo sapiens
ccttgcctctcggcgccccctcgatgctcttagct

SEQ ID NO: 13710 - DNA, 36 bp, Homo sapiens
ccttgcctctcggcgccccctcgatgctcttagctg

SEQ ID NO: 13711 - DNA, 23 bp, Homo sapiens
ttgcctctcggcgccccctcgat

SEQ ID NO: 13712 - DNA, 25 bp, Homo sapiens
cctctcggcgccccctcgatgctct

SEQ ID NO: 13713 - DNA, 30 bp, Homo sapiens
cctctcggcgccccctcgatgctcttagct

SEQ ID NO: 13714 - DNA, 31 bp, Homo sapiens
cctctcggcgccccctcgatgctcttagctg

SEQ ID NO: 13715 - DNA, 24 bp, Homo sapiens
ctctcggcgccccctcgatgctct

SEQ ID NO: 13716 - DNA, 25 bp, Homo sapiens
ctctcggcgccccctcgatgctctt

SEQ ID NO: 13717 - DNA, 26 bp, Homo sapiens
ctctcggcgccccctcgatgctctta

SEQ ID NO: 13718 - DNA, 29 bp, Homo sapiens
ctctcggcgccccctcgatgctcttagct

SEQ ID NO: 13719 - DNA, 30 bp, Homo sapiens
ctctcggcgccccctcgatgctcttagctg

SEQ ID NO: 13720 - DNA, 23 bp, Homo sapiens
tctcggcgccccctcgatgctct

SEQ ID NO: 13721 - DNA, 28 bp, Homo sapiens
tctcggcgccccctcgatgctcttagct

SEQ ID NO: 13722 - DNA, 29 bp, Homo sapiens
tctcggcgccccctcgatgctcttagctg

SEQ ID NO: 13723 - DNA, 22 bp, Homo sapiens
ctcggcgccccctcgatgctct

SEQ ID NO: 13724 - DNA, 23 bp, Homo sapiens
ctcggcgccccctcgatgctctt

SEQ ID NO: 13725 - DNA, 27 bp, Homo sapiens
ctcggcgccccctcgatgctcttagct

SEQ ID NO: 13726 - DNA, 28 bp, Homo sapiens
ctcggcgccccctcgatgctcttagctg

SEQ ID NO: 13727 - DNA, 21 bp, Homo sapiens
tcggcgccccctcgatgctct

SEQ ID NO: 13728 - DNA, 27 bp, Homo sapiens
tcggcgccccctcgatgctcttagctg

SEQ ID NO: 13729 - DNA, 26 bp, Homo sapiens
cggcgccccctcgatgctcttagctg

SEQ ID NO: 13730 - DNA, 24 bp, Homo sapiens
gcgccccctcgatgctcttagctg

SEQ ID NO: 13731 - DNA, 23 bp, Homo sapiens
cgccccctcgatgctcttagctg

SEQ ID NO: 13732 - DNA, 21 bp, Homo sapiens
ccccctcgatgctcttagctg

SEQ ID NO: 13733 - DNA, 19 bp, Homo sapiens
ccctcgatgctcttagctg

SEQ ID NO: 13734 - DNA, 18 bp, Homo sapiens
cctcgatgctcttagctg

SEQ ID NO: 13735 - DNA, 16 bp, Homo sapiens
tcgatgctcttagctg

SEQ ID NO: 13736 - DNA, 26 bp, Homo sapiens
agctgagtgtcccgcggggcccgaag

SEQ ID NO: 13737 - DNA, 23 bp, Homo sapiens
gctgagtgtcccgcggggcccga

SEQ ID NO: 13738 - DNA, 25 bp, Homo sapiens
gctgagtgtcccgcggggcccgaag

SEQ ID NO: 13739 - DNA, 16 bp, Homo sapiens
gagtgtcccgcggggc

SEQ ID NO: 13740 - DNA, 28 bp, Homo sapiens
gagtgtcccgcggggcccgaagcgttta

SEQ ID NO: 13741 - DNA, 29 bp, Homo sapiens
gagtgtcccgcggggcccgaagcgtttac

SEQ ID NO: 13742 - DNA, 30 bp, Homo sapiens; identical to SEQ ID NO: 2436

SEQ ID NO: 13743 - DNA, 31 bp, Homo sapiens
gagtgtcccgcggggcccgaagcgtttactt

SEQ ID NO: 13744 - DNA, 32 bp, Homo sapiens
gagtgtcccgcggggcccgaagcgtttacttt

SEQ ID NO: 13745 - DNA, 33 bp, Homo sapiens
gagtgtcccgcggggcccgaagcgtttactttg

SEQ ID NO: 13746 - DNA, 27 bp, Homo sapiens
agtgtcccgcggggcccgaagcgttta

SEQ ID NO: 13747 - DNA, 28 bp, Homo sapiens
agtgtcccgcggggcccgaagcgtttac

SEQ ID NO: 13748 - DNA, 29 bp, Homo sapiens
agtgtcccgcggggcccgaagcgtttact

SEQ ID NO: 13749 - DNA, 30 bp, Homo sapiens
agtgtcccgcggggcccgaagcgtttactt

SEQ ID NO: 13750 - DNA, 33 bp, Homo sapiens
agtgtcccgcggggcccgaagcgtttactttga

SEQ ID NO: 13751 - DNA, 36 bp, Homo sapiens
agtgtcccgcggggcccgaagcgtttactttgaaaa

SEQ ID NO: 13752 - DNA, 27 bp, Homo sapiens
gtgtcccgcggggcccgaagcgtttac

SEQ ID NO: 13753 - DNA, 28 bp, Homo sapiens
gtgtcccgcggggcccgaagcgtttact

SEQ ID NO: 13754 - DNA, 29 bp, Homo sapiens
gtgtcccgcggggcccgaagcgtttactt

SEQ ID NO: 13755 - DNA, 33 bp, Homo sapiens
gtgtcccgcggggcccgaagcgtttactttgaa

SEQ ID NO: 13756 - DNA, 33 bp, Homo sapiens
gtcccgcggggcccgaagcgtttactttgaaaa

SEQ ID NO: 13757 - DNA, 16 bp, Homo sapiens
cccgcggggcccgaag

SEQ ID NO: 13758 - DNA, 18 bp, Homo sapiens
cccgcggggcccgaagcg

SEQ ID NO: 13759 - DNA, 20 bp, Homo sapiens
cccgcggggcccgaagcgtt

SEQ ID NO: 13760 - DNA, 21 bp, Homo sapiens
cccgcggggcccgaagcgttt

SEQ ID NO: 13761 - DNA, 20 bp, Homo sapiens
cccgaagcgtttactttgaa

SEQ ID NO: 13762 - DNA, 19 bp, Homo sapiens
ccgaagcgtttactttgaa

SEQ ID NO: 13763 - DNA, 20 bp, Homo sapiens
ccgaagcgtttactttgaaa

SEQ ID NO: 13764 - DNA, 21 bp, Homo sapiens
ccgaagcgtttactttgaaaa

SEQ ID NO: 13765 - DNA, 18 bp, Homo sapiens
cgaagcgtttactttgaa

SEQ ID NO: 13766 - DNA, 19 bp, Homo sapiens
cgaagcgtttactttgaaa

SEQ ID NO: 13767 - DNA, 19 bp, Homo sapiens
gaagcgtttactttgaaaa

SEQ ID NO: 13768 - DNA, 23 bp, Homo sapiens
gaagcgtttactttgaaaaaatt

SEQ ID NO: 13769 - DNA, 31 bp, Homo sapiens
gaagcgtttactttgaaaaaattagagtgtt

SEQ ID NO: 13770 - DNA, 16 bp, Homo sapiens
aagcgtttactttgaa

SEQ ID NO: 13771 - DNA, 17 bp, Homo sapiens
aagcgtttactttgaaa

SEQ ID NO: 13772 - DNA, 18 bp, Homo sapiens
aagcgtttactttgaaaa

SEQ ID NO: 13773 - DNA, 20 bp, Homo sapiens
aagcgtttactttgaaaaaa

SEQ ID NO: 13774 - DNA, 16 bp, Homo sapiens
agcgtttactttgaaa

SEQ ID NO: 13775 - DNA, 17 bp, Homo sapiens
agcgtttactttgaaaa

SEQ ID NO: 13776 - DNA, 18 bp, Homo sapiens
agcgtttactttgaaaaa

SEQ ID NO: 13777 - DNA, 19 bp, Homo sapiens
agcgtttactttgaaaaaa

SEQ ID NO: 13778 - DNA, 22 bp, Homo sapiens
agcgtttactttgaaaaaatta

SEQ ID NO: 13779 - DNA, 24 bp, Homo sapiens
agcgtttactttgaaaaaattaga

SEQ ID NO: 13780 - DNA, 16 bp, Homo sapiens
gcgtttactttgaaaa

SEQ ID NO: 13781 - DNA, 17 bp, Homo sapiens
gcgtttactttgaaaaa

SEQ ID NO: 13782 - DNA, 18 bp, Homo sapiens
gcgtttactttgaaaaaa

SEQ ID NO: 13783 - DNA, 21 bp, Homo sapiens
gcgtttactttgaaaaaatta

SEQ ID NO: 13784 - DNA, 23 bp, Homo sapiens
gcgtttactttgaaaaaattaga

SEQ ID NO: 13785 - DNA, 16 bp, Homo sapiens
cgtttactttgaaaaa

SEQ ID NO: 13786 - DNA, 17 bp, Homo sapiens
cgtttactttgaaaaaa

SEQ ID NO: 13787 - DNA, 32 bp, Homo sapiens
ttgaaaaaattagagtgttcaaagcaggcccg

SEQ ID NO: 13788 - DNA, 32 bp, Homo sapiens
aaaaaattagagtgttcaaagcaggcccgagc

SEQ ID NO: 13789 - DNA, 33 bp, Homo sapiens
aaaaaattagagtgttcaaagcaggcccgagcc

SEQ ID NO: 13790 - DNA, 27 bp, Homo sapiens
aaaaattagagtgttcaaagcaggccc

SEQ ID NO: 13791 - DNA, 28 bp, Homo sapiens
aaaaattagagtgttcaaagcaggcccg

SEQ ID NO: 13792 - DNA, 31 bp, Homo sapiens
aaaaattagagtgttcaaagcaggcccgagc

SEQ ID NO: 13793 - DNA, 26 bp, Homo sapiens
aaaattagagtgttcaaagcaggccc

SEQ ID NO: 13794 - DNA, 25 bp, Homo sapiens
aaattagagtgttcaaagcaggccc

SEQ ID NO: 13795 - DNA, 27 bp, Homo sapiens
aaattagagtgttcaaagcaggcccga

SEQ ID NO: 13796 - DNA, 28 bp, Homo sapiens
aaattagagtgttcaaagcaggcccgag

SEQ ID NO: 13797 - DNA, 29 bp, Homo sapiens
aaattagagtgttcaaagcaggcccgagc

SEQ ID NO: 13798 - DNA, 30 bp, Homo sapiens
aaattagagtgttcaaagcaggcccgagcc

SEQ ID NO: 13799 - DNA, 33 bp, Homo sapiens
aaattagagtgttcaaagcaggcccgagccgcc

SEQ ID NO: 13800 - DNA, 24 bp, Homo sapiens
aattagagtgttcaaagcaggccc

SEQ ID NO: 13801 - DNA, 26 bp, Homo sapiens
aattagagtgttcaaagcaggcccga

SEQ ID NO: 13802 - DNA, 27 bp, Homo sapiens
aattagagtgttcaaagcaggcccgag

SEQ ID NO: 13803 - DNA, 28 bp, Homo sapiens
aattagagtgttcaaagcaggcccgagc

SEQ ID NO: 13804 - DNA, 29 bp, Homo sapiens
aattagagtgttcaaagcaggcccgagcc

SEQ ID NO: 13805 - DNA, 32 bp, Homo sapiens
aattagagtgttcaaagcaggcccgagccgcc

SEQ ID NO: 13806 - DNA, 33 bp, Homo sapiens
aattagagtgttcaaagcaggcccgagccgcct

SEQ ID NO: 13807 - DNA, 21 bp, Homo sapiens
attagagtgttcaaagcaggc

SEQ ID NO: 13808 - DNA, 25 bp, Homo sapiens
attagagtgttcaaagcaggcccga

SEQ ID NO: 13809 - DNA, 27 bp, Homo sapiens
attagagtgttcaaagcaggcccgagc

SEQ ID NO: 13810 - DNA, 24 bp, Homo sapiens
ttagagtgttcaaagcaggcccga

SEQ ID NO: 13811 - DNA, 27 bp, Homo sapiens
ttagagtgttcaaagcaggcccgagcc

SEQ ID NO: 13812 - DNA, 24 bp, Homo sapiens
agagtgttcaaagcaggcccgagc

SEQ ID NO: 13813 - DNA, 25 bp, Homo sapiens
agagtgttcaaagcaggcccgagcc

SEQ ID NO: 13814 - DNA, 29 bp, Homo sapiens
agagtgttcaaagcaggcccgagccgcct

SEQ ID NO: 13815 - DNA, 19 bp, Homo sapiens
gagtgttcaaagcaggccc

SEQ ID NO: 13816 - DNA, 20 bp, Homo sapiens
gagtgttcaaagcaggcccg

SEQ ID NO: 13817 - DNA, 21 bp, Homo sapiens
gagtgttcaaagcaggcccga

SEQ ID NO: 13818 - DNA, 22 bp, Homo sapiens
gagtgttcaaagcaggcccgag

SEQ ID NO: 13819 - DNA, 23 bp, Homo sapiens
gagtgttcaaagcaggcccgagc

SEQ ID NO: 13820 - DNA, 24 bp, Homo sapiens
gagtgttcaaagcaggcccgagcc

SEQ ID NO: 13821 - DNA, 27 bp, Homo sapiens
gagtgttcaaagcaggcccgagccgcc

SEQ ID NO: 13822 - DNA, 28 bp, Homo sapiens
gagtgttcaaagcaggcccgagccgcct

SEQ ID NO: 13823 - DNA, 22 bp, Homo sapiens
agtgttcaaagcaggcccgagc

SEQ ID NO: 13824 - DNA, 23 bp, Homo sapiens
agtgttcaaagcaggcccgagcc

SEQ ID NO: 13825 - DNA, 27 bp, Homo sapiens
agtgttcaaagcaggcccgagccgcct

SEQ ID NO: 13826 - DNA, 16 bp, Homo sapiens
gttcaaagcaggcccg

SEQ ID NO: 13827 - DNA, 20 bp, Homo sapiens
gttcaaagcaggcccgagcc

SEQ ID NO: 13828 - DNA, 31 bp, Homo sapiens
gttcaaagcaggcccgagccgcctggatacc

SEQ ID NO: 13829 - DNA, 44 bp, Homo sapiens
ttcaaagcaggcccgagccgcctggataccgcagctaggaataa

SEQ ID NO: 13830 - DNA, 41 bp, Homo sapiens
aaagcaggcccgagccgcctggataccgcagctaggaataa

SEQ ID NO: 13831 - DNA, 26 bp, Homo sapiens
aagcaggcccgagccgcctggatacc

SEQ ID NO: 13832 - DNA, 40 bp, Homo sapiens
aagcaggcccgagccgcctggataccgcagctaggaataa

SEQ ID NO: 13833 - DNA, 39 bp, Homo sapiens
agcaggcccgagccgcctggataccgcagctaggaataa

SEQ ID NO: 13834 - DNA, 23 bp, Homo sapiens
caggcccgagccgcctggatacc

SEQ ID NO: 13835 - DNA, 24 bp, Homo sapiens
caggcccgagccgcctggataccg

SEQ ID NO: 13836 - DNA, 29 bp, Homo sapiens
caggcccgagccgcctggataccgcagct

SEQ ID NO: 13837 - DNA, 31 bp, Homo sapiens
caggcccgagccgcctggataccgcagctag

SEQ ID NO: 13838 - DNA, 37 bp, Homo sapiens
caggcccgagccgcctggataccgcagctaggaataa

SEQ ID NO: 13839 - DNA, 19 bp, Homo sapiens
aggcccgagccgcctggat

SEQ ID NO: 13840 - DNA, 36 bp, Homo sapiens
aggcccgagccgcctggataccgcagctaggaataa

SEQ ID NO: 13841 - DNA, 18 bp, Homo sapiens
ggcccgagccgcctggat

SEQ ID NO: 13842 - DNA, 35 bp, Homo sapiens
ggcccgagccgcctggataccgcagctaggaataa

SEQ ID NO: 13843 - DNA, 17 bp, Homo sapiens
gcccgagccgcctggat

SEQ ID NO: 13844 - DNA, 34 bp, Homo sapiens
gcccgagccgcctggataccgcagctaggaataa

SEQ ID NO: 13845 - DNA, 16 bp, Homo sapiens
cccgagccgcctggat

SEQ ID NO: 13846 - DNA, 20 bp, Homo sapiens
cccgagccgcctggataccg

SEQ ID NO: 13847 - DNA, 33 bp, Homo sapiens
cccgagccgcctggataccgcagctaggaataa

SEQ ID NO: 13848 - DNA, 17 bp, Homo sapiens
ccgagccgcctggatac

SEQ ID NO: 13849 - DNA, 18 bp, Homo sapiens
ccgagccgcctggatacc

SEQ ID NO: 13850 - DNA, 19 bp, Homo sapiens
ccgagccgcctggataccg

SEQ ID NO: 13851 - DNA, 17 bp, Homo sapiens
cgagccgcctggatacc

SEQ ID NO: 13852 - DNA, 18 bp, Homo sapiens
cgagccgcctggataccg

SEQ ID NO: 13853 - DNA, 22 bp, Homo sapiens
cgagccgcctggataccgcagc

SEQ ID NO: 13854 - DNA, 31 bp, Homo sapiens
cgagccgcctggataccgcagctaggaataa

SEQ ID NO: 13855 - DNA, 30 bp, Homo sapiens
gagccgcctggataccgcagctaggaataa

SEQ ID NO: 13856 - DNA, 16 bp, Homo sapiens
agccgcctggataccg

SEQ ID NO: 13857 - DNA, 29 bp, Homo sapiens
agccgcctggataccgcagctaggaataa

SEQ ID NO: 13858 - DNA, 28 bp, Homo sapiens
gccgcctggataccgcagctaggaataa

SEQ ID NO: 13859 - DNA, 27 bp, Homo sapiens
ccgcctggataccgcagctaggaataa

SEQ ID NO: 13860 - DNA, 25 bp, Homo sapiens
gcctggataccgcagctaggaataa

SEQ ID NO: 13861 - DNA, 24 bp, Homo sapiens
cctggataccgcagctaggaataa

SEQ ID NO: 13862 - DNA, 23 bp, Homo sapiens
ctggataccgcagctaggaataa

SEQ ID NO: 13863 - DNA, 22 bp, Homo sapiens
tggataccgcagctaggaataa

SEQ ID NO: 13864 - DNA, 21 bp, Homo sapiens
ggataccgcagctaggaataa

SEQ ID NO: 13865 - DNA, 20 bp, Homo sapiens
gataccgcagctaggaataa

SEQ ID NO: 13866 - DNA, 19 bp, Homo sapiens
ataccgcagctaggaataa

SEQ ID NO: 13867 - DNA, 18 bp, Homo sapiens
taccgcagctaggaataa

SEQ ID NO: 13868 - DNA, 17 bp, Homo sapiens
accgcagctaggaataa

SEQ ID NO: 13869 - DNA, 29 bp, Homo sapiens
accgcagctaggaataatggaataggacc

SEQ ID NO: 13870 - DNA, 16 bp, Homo sapiens
ccgcagctaggaataa

SEQ ID NO: 13871 - DNA, 27 bp, Homo sapiens
cgcagctaggaataatggaataggacc

SEQ ID NO: 13872 - DNA, 16 bp, Homo sapiens
gcagctaggaataatg

SEQ ID NO: 13873 - DNA, 26 bp, Homo sapiens
gcagctaggaataatggaataggacc

SEQ ID NO: 13874 - DNA, 27 bp, Homo sapiens
gcagctaggaataatggaataggaccg

SEQ ID NO: 13875 - DNA, 25 bp, Homo sapiens
cagctaggaataatggaataggacc

SEQ ID NO: 13876 - DNA, 33 bp, Homo sapiens; identical to SEQ ID NO: 2449

SEQ ID NO: 13877 - DNA, 17 bp, Homo sapiens
aataatggaataggacc

SEQ ID NO: 13878 - DNA, 16 bp, Homo sapiens
ataatggaataggacc

SEQ ID NO: 13879 - DNA, 25 bp, Homo sapiens
ataatggaataggaccgcggttcta

SEQ ID NO: 13880 - DNA, 24 bp, Homo sapiens
taatggaataggaccgcggttcta

SEQ ID NO: 13881 - DNA, 21 bp, Homo sapiens
aatggaataggaccgcggttc

SEQ ID NO: 13882 - DNA, 22 bp, Homo sapiens
aatggaataggaccgcggttct

SEQ ID NO: 13883 - DNA, 20 bp, Homo sapiens
atggaataggaccgcggttc

SEQ ID NO: 13884 - DNA, 22 bp, Homo sapiens
atggaataggaccgcggttcta

SEQ ID NO: 13885 - DNA, 18 bp, Homo sapiens
ggaataggaccgcggttc

SEQ ID NO: 13886 - DNA, 17 bp, Homo sapiens
ataggaccgcggttcta

SEQ ID NO: 13887 - DNA, 16 bp, Homo sapiens
taggaccgcggttcta

SEQ ID NO: 13888 - DNA, 33 bp, Homo sapiens
taggaccgcggttctattttgttggttttcgga

SEQ ID NO: 13889 - DNA, 36 bp, Homo sapiens
taggaccgcggttctattttgttggttttcggaact

SEQ ID NO: 13890 - DNA, 32 bp, Homo sapiens
gaccgcggttctattttgttggttttcggaac

SEQ ID NO: 13891 - DNA, 33 bp, Homo sapiens; identical to SEQ ID NO: 2452

SEQ ID NO: 13892 - DNA, 32 bp, Homo sapiens
accgcggttctattttgttggttttcggaact

SEQ ID NO: 13893 - DNA, 33 bp, Homo sapiens
accgcggttctattttgttggttttcggaactg

SEQ ID NO: 13894 - DNA, 16 bp, Homo sapiens
ccgcggttctattttg

SEQ ID NO: 13895 - DNA, 17 bp, Homo sapiens
ccgcggttctattttgt

SEQ ID NO: 13896 - DNA, 18 bp, Homo sapiens
ccgcggttctattttgtt

SEQ ID NO: 13897 - DNA, 26 bp, Homo sapiens
ccgcggttctattttgttggttttcg

SEQ ID NO: 13898 - DNA, 31 bp, Homo sapiens
ccgcggttctattttgttggttttcggaact

SEQ ID NO: 13899 - DNA, 32 bp, Homo sapiens; identical to SEQ ID NO: 2453

SEQ ID NO: 13900 - DNA, 33 bp, Homo sapiens
ccgcggttctattttgttggttttcggaactga

SEQ ID NO: 13901 - DNA, 29 bp, Homo sapiens
cgcggttctattttgttggttttcggaac

SEQ ID NO: 13902 - DNA, 30 bp, Homo sapiens; identical to SEQ ID NO: 2454

SEQ ID NO: 13903 - DNA, 31 bp, Homo sapiens; identical to SEQ ID NO: 2455

SEQ ID NO: 13904 - DNA, 32 bp, Homo sapiens
cgcggttctattttgttggttttcggaactga

SEQ ID NO: 13905 - DNA, 28 bp, Homo sapiens
gcggttctattttgttggttttcggaac

SEQ ID NO: 13906 - DNA, 29 bp, Homo sapiens
gcggttctattttgttggttttcggaact

SEQ ID NO: 13907 - DNA, 30 bp, Homo sapiens
gcggttctattttgttggttttcggaactg

SEQ ID NO: 13908 - DNA, 31 bp, Homo sapiens
gcggttctattttgttggttttcggaactga

SEQ ID NO: 13909 - DNA, 25 bp, Homo sapiens
cggttctattttgttggttttcgga

SEQ ID NO: 13910 - DNA, 27 bp, Homo sapiens
cggttctattttgttggttttcggaac

SEQ ID NO: 13911 - DNA, 28 bp, Homo sapiens
cggttctattttgttggttttcggaact

SEQ ID NO: 13912 - DNA, 24 bp, Homo sapiens
ggttctattttgttggttttcgga

SEQ ID NO: 13913 - DNA, 25 bp, Homo sapiens
ggttctattttgttggttttcggaa

SEQ ID NO: 13914 - DNA, 26 bp, Homo sapiens
ggttctattttgttggttttcggaac

SEQ ID NO: 13915 - DNA, 33 bp, Homo sapiens; identical to SEQ ID NO: 2460

SEQ ID NO: 13916 - DNA, 23 bp, Homo sapiens
gttctattttgttggttttcgga

SEQ ID NO: 13917 - DNA, 24 bp, Homo sapiens
gttctattttgttggttttcggaa

SEQ ID NO: 13918 - DNA, 26 bp, Homo sapiens
gttctattttgttggttttcggaact

SEQ ID NO: 13919 - DNA, 28 bp, Homo sapiens
gttctattttgttggttttcggaactga

SEQ ID NO: 13920 - DNA, 31 bp, Homo sapiens
gttctattttgttggttttcggaactgaggc

SEQ ID NO: 13921 - DNA, 32 bp, Homo sapiens; identical to SEQ ID NO: 2463

SEQ ID NO: 13922 - DNA, 35 bp, Homo sapiens
gttctattttgttggttttcggaactgaggccatg

SEQ ID NO: 13923 - DNA, 37 bp, Homo sapiens
gttctattttgttggttttcggaactgaggccatgat

SEQ ID NO: 13924 - DNA, 38 bp, Homo sapiens
gttctattttgttggttttcggaactgaggccatgatt

SEQ ID NO: 13925 - DNA, 39 bp, Homo sapiens
gttctattttgttggttttcggaactgaggccatgatta

SEQ ID NO: 13926 - DNA, 22 bp, Homo sapiens
ttctattttgttggttttcgga

SEQ ID NO: 13927 - DNA, 23 bp, Homo sapiens
ttctattttgttggttttcggaa

SEQ ID NO: 13928 - DNA, 25 bp, Homo sapiens
ttctattttgttggttttcggaact

SEQ ID NO: 13929 - DNA, 21 bp, Homo sapiens
tctattttgttggttttcgga

SEQ ID NO: 13930 - DNA, 22 bp, Homo sapiens
tctattttgttggttttcggaa

SEQ ID NO: 13931 - DNA, 19 bp, Homo sapiens
tattttgttggttttcgga

SEQ ID NO: 13932 - DNA, 18 bp, Homo sapiens
attttgttggttttcgga

SEQ ID NO: 13933 - DNA, 23 bp, Homo sapiens
attttgttggttttcggaactga

SEQ ID NO: 13934 - DNA, 16 bp, Homo sapiens
ttttgttggttttcgg

SEQ ID NO: 13935 - DNA, 17 bp, Homo sapiens
ttttgttggttttcgga

SEQ ID NO: 13936 - DNA, 18 bp, Homo sapiens
ttttgttggttttcggaa

SEQ ID NO: 13937 - DNA, 19 bp, Homo sapiens
ttttgttggttttcggaac

SEQ ID NO: 13938 - DNA, 20 bp, Homo sapiens
ttttgttggttttcggaact

SEQ ID NO: 13939 - DNA, 22 bp, Homo sapiens
ttttgttggttttcggaactga

SEQ ID NO: 13940 - DNA, 26 bp, Homo sapiens
ttttgttggttttcggaactgaggcc

SEQ ID NO: 13941 - DNA, 27 bp, Homo sapiens
ttttgttggttttcggaactgaggcca

SEQ ID NO: 13942 - DNA, 30 bp, Homo sapiens
ttttgttggttttcggaactgaggccatga

SEQ ID NO: 13943 - DNA, 16 bp, Homo sapiens
tttgttggttttcgga

SEQ ID NO: 13944 - DNA, 17 bp, Homo sapiens
tttgttggttttcggaa

SEQ ID NO: 13945 - DNA, 33 bp, Homo sapiens
ttgttggttttcggaactgaggccatgattaag

SEQ ID NO: 13946 - DNA, 19 bp, Homo sapiens
tgttggttttcggaactga

SEQ ID NO: 13947 - DNA, 23 bp, Homo sapiens
tgttggttttcggaactgaggcc

SEQ ID NO: 13948 - DNA, 16 bp, Homo sapiens
gttggttttcggaact

SEQ ID NO: 13949 - DNA, 18 bp, Homo sapiens
gttggttttcggaactga

SEQ ID NO: 13950 - DNA, 22 bp, Homo sapiens
gttggttttcggaactgaggcc

SEQ ID NO: 13951 - DNA, 31 bp, Homo sapiens
gttggttttcggaactgaggccatgattaag

SEQ ID NO: 13952 - DNA, 21 bp, Homo sapiens
ttggttttcggaactgaggcc

SEQ ID NO: 13953 - DNA, 19 bp, Homo sapiens
ggttttcggaactgaggcc

SEQ ID NO: 13954 - DNA, 18 bp, Homo sapiens
gttttcggaactgaggcc

SEQ ID NO: 13955 - DNA, 19 bp, Homo sapiens
gttttcggaactgaggcca

SEQ ID NO: 13956 - DNA, 22 bp, Homo sapiens
gttttcggaactgaggccatga

SEQ ID NO: 13957 - DNA, 25 bp, Homo sapiens
gttttcggaactgaggccatgatta

SEQ ID NO: 13958 - DNA, 26 bp, Homo sapiens
gttttcggaactgaggccatgattaa

SEQ ID NO: 13959 - DNA, 28 bp, Homo sapiens
gttttcggaactgaggccatgattaaga

SEQ ID NO: 13960 - DNA, 32 bp, Homo sapiens
gttttcggaactgaggccatgattaagaggga

SEQ ID NO: 13961 - DNA, 17 bp, Homo sapiens
ttttcggaactgaggcc

SEQ ID NO: 13962 - DNA, 18 bp, Homo sapiens
ttttcggaactgaggcca

SEQ ID NO: 13963 - DNA, 22 bp, Homo sapiens
ttttcggaactgaggccatgat

SEQ ID NO: 13964 - DNA, 24 bp, Homo sapiens
ttttcggaactgaggccatgatta

SEQ ID NO: 13965 - DNA, 25 bp, Homo sapiens
ttttcggaactgaggccatgattaa

SEQ ID NO: 13966 - DNA, 26 bp, Homo sapiens
ttttcggaactgaggccatgattaag

SEQ ID NO: 13967 - DNA, 27 bp, Homo sapiens
ttttcggaactgaggccatgattaaga

SEQ ID NO: 13968 - DNA, 28 bp, Homo sapiens
ttttcggaactgaggccatgattaagag

SEQ ID NO: 13969 - DNA, 31 bp, Homo sapiens
ttttcggaactgaggccatgattaagaggga

SEQ ID NO: 13970 - DNA, 16 bp, Homo sapiens
tttcggaactgaggcc

SEQ ID NO: 13971 - DNA, 17 bp, Homo sapiens
tttcggaactgaggcca

SEQ ID NO: 13972 - DNA, 20 bp, Homo sapiens
tttcggaactgaggccatga

SEQ ID NO: 13973 - DNA, 21 bp, Homo sapiens
tttcggaactgaggccatgat

SEQ ID NO: 13974 - DNA, 23 bp, Homo sapiens
tttcggaactgaggccatgatta

SEQ ID NO: 13975 - DNA, 24 bp, Homo sapiens
tttcggaactgaggccatgattaa

SEQ ID NO: 13976 - DNA, 25 bp, Homo sapiens
tttcggaactgaggccatgattaag

SEQ ID NO: 13977 - DNA, 26 bp, Homo sapiens
tttcggaactgaggccatgattaaga

SEQ ID NO: 13978 - DNA, 27 bp, Homo sapiens
tttcggaactgaggccatgattaagag

SEQ ID NO: 13979 - DNA, 30 bp, Homo sapiens
tttcggaactgaggccatgattaagaggga

SEQ ID NO: 13980 - DNA, 16 bp, Homo sapiens
ttcggaactgaggcca

SEQ ID NO: 13981 - DNA, 20 bp, Homo sapiens
ttcggaactgaggccatgat

SEQ ID NO: 13982 - DNA, 22 bp, Homo sapiens
ttcggaactgaggccatgatta

SEQ ID NO: 13983 - DNA, 23 bp, Homo sapiens
ttcggaactgaggccatgattaa

SEQ ID NO: 13984 - DNA, 24 bp, Homo sapiens
ttcggaactgaggccatgattaag

SEQ ID NO: 13985 - DNA, 25 bp, Homo sapiens
ttcggaactgaggccatgattaaga

SEQ ID NO: 13986 - DNA, 26 bp, Homo sapiens
ttcggaactgaggccatgattaagag

SEQ ID NO: 13987 - DNA, 29 bp, Homo sapiens
ttcggaactgaggccatgattaagaggga

SEQ ID NO: 13988 - DNA, 31 bp, Homo sapiens
ttcggaactgaggccatgattaagagggacg

SEQ ID NO: 13989 - DNA, 19 bp, Homo sapiens
tcggaactgaggccatgat

SEQ ID NO: 13990 - DNA, 21 bp, Homo sapiens
tcggaactgaggccatgatta

SEQ ID NO: 13991 - DNA, 22 bp, Homo sapiens
tcggaactgaggccatgattaa

SEQ ID NO: 13992 - DNA, 23 bp, Homo sapiens
tcggaactgaggccatgattaag

SEQ ID NO: 13993 - DNA, 24 bp, Homo sapiens
tcggaactgaggccatgattaaga

SEQ ID NO: 13994 - DNA, 25 bp, Homo sapiens
tcggaactgaggccatgattaagag

SEQ ID NO: 13995 - DNA, 28 bp, Homo sapiens
tcggaactgaggccatgattaagaggga

SEQ ID NO: 13996 - DNA, 19 bp, Homo sapiens
cggaactgaggccatgatt

SEQ ID NO: 13997 - DNA, 20 bp, Homo sapiens
cggaactgaggccatgatta

SEQ ID NO: 13998 - DNA, 21 bp, Homo sapiens
cggaactgaggccatgattaa

SEQ ID NO: 13999 - DNA, 22 bp, Homo sapiens
cggaactgaggccatgattaag

SEQ ID NO: 14000 - DNA, 23 bp, Homo sapiens
cggaactgaggccatgattaaga

SEQ ID NO: 14001 - DNA, 24 bp, Homo sapiens
cggaactgaggccatgattaagag

SEQ ID NO: 14002 - DNA, 27 bp, Homo sapiens
cggaactgaggccatgattaagaggga

SEQ ID NO: 14003 - DNA, 23 bp, Homo sapiens
actgaggccatgattaagaggga

SEQ ID NO: 14004 - DNA, 24 bp, Homo sapiens
actgaggccatgattaagagggac

SEQ ID NO: 14005 - DNA, 25 bp, Homo sapiens
actgaggccatgattaagagggacg

SEQ ID NO: 14006 - DNA, 18 bp, Homo sapiens
ctgaggccatgattaaga

SEQ ID NO: 14007 - DNA, 22 bp, Homo sapiens
ctgaggccatgattaagaggga

SEQ ID NO: 14008 - DNA, 18 bp, Homo sapiens
ggccatgattaagaggga

SEQ ID NO: 14009 - DNA, 29 bp, Homo sapiens
catgattaagagggacggccgggggcatt

SEQ ID NO: 14010 - DNA, 25 bp, Homo sapiens
tgattaagagggacggccgggggca

SEQ ID NO: 14011 - DNA, 16 bp, Homo sapiens
attaagagggacggcc

SEQ ID NO: 14012 - DNA, 20 bp, Homo sapiens
attaagagggacggccgggg

SEQ ID NO: 14013 - DNA, 21 bp, Homo sapiens
attaagagggacggccggggg

SEQ ID NO: 14014 - DNA, 22 bp, Homo sapiens
attaagagggacggccgggggc

SEQ ID NO: 14015 - DNA, 23 bp, Homo sapiens
attaagagggacggccgggggca

SEQ ID NO: 14016 - DNA, 22 bp, Homo sapiens
ttaagagggacggccgggggca

SEQ ID NO: 14017 - DNA, 19 bp, Homo sapiens
aagagggacggccgggggc

SEQ ID NO: 14018 - DNA, 18 bp, Homo sapiens
agagggacggccgggggc

SEQ ID NO: 14019 - DNA, 19 bp, Homo sapiens
agagggacggccgggggca

SEQ ID NO: 14020 - DNA, 17 bp, Homo sapiens
gagggacggccgggggc

SEQ ID NO: 14021 - DNA, 18 bp, Homo sapiens
gagggacggccgggggca

SEQ ID NO: 14022 - DNA, 16 bp, Homo sapiens
agggacggccgggggc

SEQ ID NO: 14023 - DNA, 18 bp, Homo sapiens
cggccgggggcattcgta

SEQ ID NO: 14024 - DNA, 26 bp, Homo sapiens
gccgggggcattcgtattgcgccgct

SEQ ID NO: 14025 - DNA, 27 bp, Homo sapiens
ggggcattcgtattgcgccgctagagg

SEQ ID NO: 14026 - DNA, 22 bp, Homo sapiens
cattcgtattgcgccgctagag

SEQ ID NO: 14027 - DNA, 32 bp, Homo sapiens; identical to SEQ ID NO: 2465

SEQ ID NO: 14028 - DNA, 38 bp, Homo sapiens
cattcgtattgcgccgctagaggtgaaattcttggacc

SEQ ID NO: 14029 - DNA, 17 bp, Homo sapiens
attcgtattgcgccgct

SEQ ID NO: 14030 - DNA, 16 bp, Homo sapiens
ttcgtattgcgccgct

SEQ ID NO: 14031 - DNA, 17 bp, Homo sapiens
ttcgtattgcgccgcta

SEQ ID NO: 14032 - DNA, 19 bp, Homo sapiens
ttcgtattgcgccgctaga

SEQ ID NO: 14033 - DNA, 35 bp, Homo sapiens
ttcgtattgcgccgctagaggtgaaattcttggac

SEQ ID NO: 14034 - DNA, 36 bp, Homo sapiens
ttcgtattgcgccgctagaggtgaaattcttggacc

SEQ ID NO: 14035 - DNA, 37 bp, Homo sapiens
ttcgtattgcgccgctagaggtgaaattcttggaccg

SEQ ID NO: 14036 - DNA, 34 bp, Homo sapiens
tcgtattgcgccgctagaggtgaaattcttggac

SEQ ID NO: 14037 - DNA, 35 bp, Homo sapiens
tcgtattgcgccgctagaggtgaaattcttggacc

SEQ ID NO: 14038 - DNA, 33 bp, Homo sapiens; identical to SEQ ID NO: 2466

SEQ ID NO: 14039 - DNA, 34 bp, Homo sapiens
cgtattgcgccgctagaggtgaaattcttggacc

SEQ ID NO: 14040 - DNA, 32 bp, Homo sapiens; identical to SEQ ID NO: 2467

SEQ ID NO: 14041 - DNA, 31 bp, Homo sapiens; identical to SEQ ID NO: 2468

SEQ ID NO: 14042 - DNA, 30 bp, Homo sapiens; identical to SEQ ID NO: 2469

SEQ ID NO: 14043 - DNA, 46 bp, Homo sapiens
attgcgccgctagaggtgaaattcttggaccggcgcaagacggacc

SEQ ID NO: 14044 - DNA, 28 bp, Homo sapiens
ttgcgccgctagaggtgaaattcttgga

SEQ ID NO: 14045 - DNA, 29 bp, Homo sapiens
ttgcgccgctagaggtgaaattcttggac

SEQ ID NO: 14046 - DNA, 31 bp, Homo sapiens
ttgcgccgctagaggtgaaattcttggaccg

SEQ ID NO: 14047 - DNA, 45 bp, Homo sapiens
ttgcgccgctagaggtgaaattcttggaccggcgcaagacggacc

SEQ ID NO: 14048 - DNA, 28 bp, Homo sapiens
tgcgccgctagaggtgaaattcttggac

SEQ ID NO: 14049 - DNA, 44 bp, Homo sapiens
tgcgccgctagaggtgaaattcttggaccggcgcaagacggacc

SEQ ID NO: 14050 - DNA, 27 bp, Homo sapiens
gcgccgctagaggtgaaattcttggac

SEQ ID NO: 14051 - DNA, 28 bp, Homo sapiens
gcgccgctagaggtgaaattcttggacc

SEQ ID NO: 14052 - DNA, 29 bp, Homo sapiens
gcgccgctagaggtgaaattcttggaccg

SEQ ID NO: 14053 - DNA, 30 bp, Homo sapiens
gcgccgctagaggtgaaattcttggaccgg

SEQ ID NO: 14054 - DNA, 26 bp, Homo sapiens
cgccgctagaggtgaaattcttggac

SEQ ID NO: 14055 - DNA, 27 bp, Homo sapiens
cgccgctagaggtgaaattcttggacc

SEQ ID NO: 14056 - DNA, 28 bp, Homo sapiens
cgccgctagaggtgaaattcttggaccg

SEQ ID NO: 14057 - DNA, 29 bp, Homo sapiens
cgccgctagaggtgaaattcttggaccgg

SEQ ID NO: 14058 - DNA, 42 bp, Homo sapiens
cgccgctagaggtgaaattcttggaccggcgcaagacggacc

SEQ ID NO: 14059 - DNA, 22 bp, Homo sapiens
gccgctagaggtgaaattcttg

SEQ ID NO: 14060 - DNA, 24 bp, Homo sapiens
gccgctagaggtgaaattcttgga

SEQ ID NO: 14061 - DNA, 25 bp, Homo sapiens
gccgctagaggtgaaattcttggac

SEQ ID NO: 14062 - DNA, 26 bp, Homo sapiens
gccgctagaggtgaaattcttggacc

SEQ ID NO: 14063 - DNA, 27 bp, Homo sapiens
gccgctagaggtgaaattcttggaccg

SEQ ID NO: 14064 - DNA, 28 bp, Homo sapiens
gccgctagaggtgaaattcttggaccgg

SEQ ID NO: 14065 - DNA, 41 bp, Homo sapiens
gccgctagaggtgaaattcttggaccggcgcaagacggacc

SEQ ID NO: 14066 - DNA, 25 bp, Homo sapiens
ccgctagaggtgaaattcttggacc

SEQ ID NO: 14067 - DNA, 24 bp, Homo sapiens
cgctagaggtgaaattcttggacc

SEQ ID NO: 14068 - DNA, 22 bp, Homo sapiens
gctagaggtgaaattcttggac

SEQ ID NO: 14069 - DNA, 23 bp, Homo sapiens
gctagaggtgaaattcttggacc

SEQ ID NO: 14070 - DNA, 22 bp, Homo sapiens
ctagaggtgaaattcttggacc

SEQ ID NO: 14071 - DNA, 20 bp, Homo sapiens
tagaggtgaaattcttggac

SEQ ID NO: 14072 - DNA, 21 bp, Homo sapiens
tagaggtgaaattcttggacc

SEQ ID NO: 14073 - DNA, 19 bp, Homo sapiens
agaggtgaaattcttggac

SEQ ID NO: 14074 - DNA, 20 bp, Homo sapiens
agaggtgaaattcttggacc

SEQ ID NO: 14075 - DNA, 21 bp, Homo sapiens
agaggtgaaattcttggaccg

SEQ ID NO: 14076 - DNA, 29 bp, Homo sapiens
agaggtgaaattcttggaccggcgcaaga

SEQ ID NO: 14077 - DNA, 30 bp, Homo sapiens; identical to SEQ ID NO: 2482

SEQ ID NO: 14078 - DNA, 31 bp, Homo sapiens
agaggtgaaattcttggaccggcgcaagacg

SEQ ID NO: 14079 - DNA, 32 bp, Homo sapiens
agaggtgaaattcttggaccggcgcaagacgg

SEQ ID NO: 14080 - DNA, 34 bp, Homo sapiens
agaggtgaaattcttggaccggcgcaagacggac

SEQ ID NO: 14081 - DNA, 18 bp, Homo sapiens
gaggtgaaattcttggac

SEQ ID NO: 14082 - DNA, 19 bp, Homo sapiens
gaggtgaaattcttggacc

SEQ ID NO: 14083 - DNA, 25 bp, Homo sapiens
gaggtgaaattcttggaccggcgca

SEQ ID NO: 14084 - DNA, 28 bp, Homo sapiens
gaggtgaaattcttggaccggcgcaaga

SEQ ID NO: 14085 - DNA, 29 bp, Homo sapiens
gaggtgaaattcttggaccggcgcaagac

SEQ ID NO: 14086 - DNA, 32 bp, Homo sapiens
gaggtgaaattcttggaccggcgcaagacgga

SEQ ID NO: 14087 - DNA, 33 bp, Homo sapiens
gaggtgaaattcttggaccggcgcaagacggac

SEQ ID NO: 14088 - DNA, 17 bp, Homo sapiens
aggtgaaattcttggac

SEQ ID NO: 14089 - DNA, 18 bp, Homo sapiens
aggtgaaattcttggacc

SEQ ID NO: 14090 - DNA, 30 bp, Homo sapiens
aggtgaaattcttggaccggcgcaagacgg

SEQ ID NO: 14091 - DNA, 31 bp, Homo sapiens
aggtgaaattcttggaccggcgcaagacgga

SEQ ID NO: 14092 - DNA, 32 bp, Homo sapiens
aggtgaaattcttggaccggcgcaagacggac

SEQ ID NO: 14093 - DNA, 16 bp, Homo sapiens
ggtgaaattcttggac

SEQ ID NO: 14094 - DNA, 30 bp, Homo sapiens
ggtgaaattcttggaccggcgcaagacgga

SEQ ID NO: 14095 - DNA, 31 bp, Homo sapiens; identical to SEQ ID NO: 2487

SEQ ID NO: 14096 - DNA, 16 bp, Homo sapiens
gtgaaattcttggacc

SEQ ID NO: 14097 - DNA, 29 bp, Homo sapiens
gtgaaattcttggaccggcgcaagacgga

SEQ ID NO: 14098 - DNA, 30 bp, Homo sapiens; identical to SEQ ID NO: 2488

SEQ ID NO: 14099 - DNA, 29 bp, Homo sapiens
tgaaattcttggaccggcgcaagacggac

SEQ ID NO: 14100 - DNA, 27 bp, Homo sapiens
aaattcttggaccggcgcaagacggac

SEQ ID NO: 14101 - DNA, 18 bp, Homo sapiens
aattcttggaccggcgca

SEQ ID NO: 14102 - DNA, 19 bp, Homo sapiens
aattcttggaccggcgcaa

SEQ ID NO: 14103 - DNA, 21 bp, Homo sapiens
aattcttggaccggcgcaaga

SEQ ID NO: 14104 - DNA, 25 bp, Homo sapiens
aattcttggaccggcgcaagacgga

SEQ ID NO: 14105 - DNA, 26 bp, Homo sapiens
aattcttggaccggcgcaagacggac

SEQ ID NO: 14106 - DNA, 17 bp, Homo sapiens
attcttggaccggcgca

SEQ ID NO: 14107 - DNA, 18 bp, Homo sapiens
attcttggaccggcgcaa

SEQ ID NO: 14108 - DNA, 20 bp, Homo sapiens
attcttggaccggcgcaaga

SEQ ID NO: 14109 - DNA, 22 bp, Homo sapiens
attcttggaccggcgcaagacg

SEQ ID NO: 14110 - DNA, 24 bp, Homo sapiens
attcttggaccggcgcaagacgga

SEQ ID NO: 14111 - DNA, 25 bp, Homo sapiens
attcttggaccggcgcaagacggac

SEQ ID NO: 14112 - DNA, 26 bp, Homo sapiens
attcttggaccggcgcaagacggacc

SEQ ID NO: 14113 - DNA, 27 bp, Homo sapiens
attcttggaccggcgcaagacggacca

SEQ ID NO: 14114 - DNA, 21 bp, Homo sapiens
ttcttggaccggcgcaagacg

SEQ ID NO: 14115 - DNA, 24 bp, Homo sapiens
ttcttggaccggcgcaagacggac

SEQ ID NO: 14116 - DNA, 25 bp, Homo sapiens
ttcttggaccggcgcaagacggacc

SEQ ID NO: 14117 - DNA, 23 bp, Homo sapiens
tcttggaccggcgcaagacggac

SEQ ID NO: 14118 - DNA, 24 bp, Homo sapiens
tcttggaccggcgcaagacggacc

SEQ ID NO: 14119 - DNA, 18 bp, Homo sapiens
cttggaccggcgcaagac

SEQ ID NO: 14120 - DNA, 19 bp, Homo sapiens
cttggaccggcgcaagacg

SEQ ID NO: 14121 - DNA, 22 bp, Homo sapiens
cttggaccggcgcaagacggac

SEQ ID NO: 14122 - DNA, 23 bp, Homo sapiens
cttggaccggcgcaagacggacc

SEQ ID NO: 14123 - DNA, 17 bp, Homo sapiens
ttggaccggcgcaagac

SEQ ID NO: 14124 - DNA, 18 bp, Homo sapiens
ttggaccggcgcaagacg

SEQ ID NO: 14125 - DNA, 21 bp, Homo sapiens
ttggaccggcgcaagacggac

SEQ ID NO: 14126 - DNA, 22 bp, Homo sapiens
ttggaccggcgcaagacggacc

SEQ ID NO: 14127 - DNA, 16 bp, Homo sapiens
tggaccggcgcaagac

SEQ ID NO: 14128 - DNA, 17 bp, Homo sapiens
tggaccggcgcaagacg

SEQ ID NO: 14129 - DNA, 20 bp, Homo sapiens
tggaccggcgcaagacggac

SEQ ID NO: 14130 - DNA, 21 bp, Homo sapiens
tggaccggcgcaagacggacc

SEQ ID NO: 14131 - DNA, 19 bp, Homo sapiens
ggaccggcgcaagacggac

SEQ ID NO: 14132 - DNA, 18 bp, Homo sapiens
gaccggcgcaagacggac

SEQ ID NO: 14133 - DNA, 19 bp, Homo sapiens
gaccggcgcaagacggacc

SEQ ID NO: 14134 - DNA, 17 bp, Homo sapiens
accggcgcaagacggac

SEQ ID NO: 14135 - DNA, 18 bp, Homo sapiens
accggcgcaagacggacc

SEQ ID NO: 14136 - DNA, 16 bp, Homo sapiens
ccggcgcaagacggac

SEQ ID NO: 14137 - DNA, 16 bp, Homo sapiens
cggcgcaagacggacc

SEQ ID NO: 14138 - DNA, 17 bp, Homo sapiens
cggcgcaagacggacca

SEQ ID NO: 14139 - DNA, 18 bp, Homo sapiens
cggcgcaagacggaccag

SEQ ID NO: 14140 - DNA, 20 bp, Homo sapiens
cggcgcaagacggaccagag

SEQ ID NO: 14141 - DNA, 21 bp, Homo sapiens
cggcgcaagacggaccagagc

SEQ ID NO: 14142 - DNA, 27 bp, Homo sapiens
cggcgcaagacggaccagagcgaaagc

SEQ ID NO: 14143 - DNA, 28 bp, Homo sapiens
cggcgcaagacggaccagagcgaaagca

SEQ ID NO: 14144 - DNA, 29 bp, Homo sapiens
cggcgcaagacggaccagagcgaaagcat

SEQ ID NO: 14145 - DNA, 30 bp, Homo sapiens; identical to SEQ ID NO: 2507

SEQ ID NO: 14146 - DNA, 31 bp, Homo sapiens
cggcgcaagacggaccagagcgaaagcattt

SEQ ID NO: 14147 - DNA, 32 bp, Homo sapiens; identical to SEQ ID NO: 2508

SEQ ID NO: 14148 - DNA, 35 bp, Homo sapiens
cggcgcaagacggaccagagcgaaagcatttgcca

SEQ ID NO: 14149 - DNA, 43 bp, Homo sapiens
cggcgcaagacggaccagagcgaaagcatttgccaagaatgtt

SEQ ID NO: 14150 - DNA, 16 bp, Homo sapiens
ggcgcaagacggacca

SEQ ID NO: 14151 - DNA, 17 bp, Homo sapiens
ggcgcaagacggaccag

SEQ ID NO: 14152 - DNA, 18 bp, Homo sapiens
ggcgcaagacggaccaga

SEQ ID NO: 14153 - DNA, 19 bp, Homo sapiens
ggcgcaagacggaccagag

SEQ ID NO: 14154 - DNA, 20 bp, Homo sapiens
ggcgcaagacggaccagagc

SEQ ID NO: 14155 - DNA, 21 bp, Homo sapiens
ggcgcaagacggaccagagcg

SEQ ID NO: 14156 - DNA, 22 bp, Homo sapiens
ggcgcaagacggaccagagcga

SEQ ID NO: 14157 - DNA, 23 bp, Homo sapiens
ggcgcaagacggaccagagcgaa

SEQ ID NO: 14158 - DNA, 24 bp, Homo sapiens
ggcgcaagacggaccagagcgaaa

SEQ ID NO: 14159 - DNA, 25 bp, Homo sapiens
ggcgcaagacggaccagagcgaaag

SEQ ID NO: 14160 - DNA, 26 bp, Homo sapiens
ggcgcaagacggaccagagcgaaagc

SEQ ID NO: 14161 - DNA, 27 bp, Homo sapiens
ggcgcaagacggaccagagcgaaagca

SEQ ID NO: 14162 - DNA, 28 bp, Homo sapiens
ggcgcaagacggaccagagcgaaagcat

SEQ ID NO: 14163 - DNA, 29 bp, Homo sapiens
ggcgcaagacggaccagagcgaaagcatt

SEQ ID NO: 14164 - DNA, 30 bp, Homo sapiens
ggcgcaagacggaccagagcgaaagcattt

SEQ ID NO: 14165 - DNA, 31 bp, Homo sapiens; identical to SEQ ID NO: 2518

SEQ ID NO: 14166 - DNA, 32 bp, Homo sapiens
ggcgcaagacggaccagagcgaaagcatttgc

SEQ ID NO: 14167 - DNA, 33 bp, Homo sapiens
ggcgcaagacggaccagagcgaaagcatttgcc

SEQ ID NO: 14168 - DNA, 34 bp, Homo sapiens
ggcgcaagacggaccagagcgaaagcatttgcca

SEQ ID NO: 14169 - DNA, 36 bp, Homo sapiens
ggcgcaagacggaccagagcgaaagcatttgccaag

SEQ ID NO: 14170 - DNA, 40 bp, Homo sapiens
ggcgcaagacggaccagagcgaaagcatttgccaagaatg

SEQ ID NO: 14171 - DNA, 42 bp, Homo sapiens
ggcgcaagacggaccagagcgaaagcatttgccaagaatgtt

SEQ ID NO: 14172 - DNA, 19 bp, Homo sapiens
gcgcaagacggaccagagc

SEQ ID NO: 14173 - DNA, 25 bp, Homo sapiens
gcgcaagacggaccagagcgaaagc

SEQ ID NO: 14174 - DNA, 26 bp, Homo sapiens
gcgcaagacggaccagagcgaaagca

SEQ ID NO: 14175 - DNA, 27 bp, Homo sapiens
gcgcaagacggaccagagcgaaagcat

SEQ ID NO: 14176 - DNA, 28 bp, Homo sapiens
gcgcaagacggaccagagcgaaagcatt

SEQ ID NO: 14177 - DNA, 29 bp, Homo sapiens
gcgcaagacggaccagagcgaaagcattt

SEQ ID NO: 14178 - DNA, 30 bp, Homo sapiens
gcgcaagacggaccagagcgaaagcatttg

SEQ ID NO: 14179 - DNA, 32 bp, Homo sapiens
gcgcaagacggaccagagcgaaagcatttgcc

SEQ ID NO: 14180 - DNA, 33 bp, Homo sapiens; identical to SEQ ID NO: 2523

SEQ ID NO: 14181 - DNA, 16 bp, Homo sapiens
cgcaagacggaccaga

SEQ ID NO: 14182 - DNA, 18 bp, Homo sapiens
cgcaagacggaccagagc

SEQ ID NO: 14183 - DNA, 24 bp, Homo sapiens
cgcaagacggaccagagcgaaagc

SEQ ID NO: 14184 - DNA, 25 bp, Homo sapiens
cgcaagacggaccagagcgaaagca

SEQ ID NO: 14185 - DNA, 26 bp, Homo sapiens
cgcaagacggaccagagcgaaagcat

SEQ ID NO: 14186 - DNA, 27 bp, Homo sapiens
cgcaagacggaccagagcgaaagcatt

SEQ ID NO: 14187 - DNA, 28 bp, Homo sapiens
cgcaagacggaccagagcgaaagcattt

SEQ ID NO: 14188 - DNA, 29 bp, Homo sapiens
cgcaagacggaccagagcgaaagcatttg

SEQ ID NO: 14189 - DNA, 31 bp, Homo sapiens
cgcaagacggaccagagcgaaagcatttgcc

SEQ ID NO: 14190 - DNA, 32 bp, Homo sapiens; identical to SEQ ID NO: 2527

SEQ ID NO: 14191 - DNA, 17 bp, Homo sapiens
gcaagacggaccagagc

SEQ ID NO: 14192 - DNA, 23 bp, Homo sapiens
gcaagacggaccagagcgaaagc

SEQ ID NO: 14193 - DNA, 24 bp, Homo sapiens
gcaagacggaccagagcgaaagca

SEQ ID NO: 14194 - DNA, 25 bp, Homo sapiens
gcaagacggaccagagcgaaagcat

SEQ ID NO: 14195 - DNA, 26 bp, Homo sapiens
gcaagacggaccagagcgaaagcatt

SEQ ID NO: 14196 - DNA, 27 bp, Homo sapiens
gcaagacggaccagagcgaaagcattt

SEQ ID NO: 14197 - DNA, 28 bp, Homo sapiens
gcaagacggaccagagcgaaagcatttg

SEQ ID NO: 14198 - DNA, 29 bp, Homo sapiens
gcaagacggaccagagcgaaagcatttgc

SEQ ID NO: 14199 - DNA, 31 bp, Homo sapiens; identical to SEQ ID NO: 2531

SEQ ID NO: 14200 - DNA, 18 bp, Homo sapiens
caagacggaccagagcga

SEQ ID NO: 14201 - DNA, 19 bp, Homo sapiens
caagacggaccagagcgaa

SEQ ID NO: 14202 - DNA, 22 bp, Homo sapiens
caagacggaccagagcgaaagc

SEQ ID NO: 14203 - DNA, 23 bp, Homo sapiens
caagacggaccagagcgaaagca

SEQ ID NO: 14204 - DNA, 24 bp, Homo sapiens
caagacggaccagagcgaaagcat

SEQ ID NO: 14205 - DNA, 25 bp, Homo sapiens
caagacggaccagagcgaaagcatt

SEQ ID NO: 14206 - DNA, 26 bp, Homo sapiens
caagacggaccagagcgaaagcattt

SEQ ID NO: 14207 - DNA, 28 bp, Homo sapiens
caagacggaccagagcgaaagcatttgc

SEQ ID NO: 14208 - DNA, 29 bp, Homo sapiens
caagacggaccagagcgaaagcatttgcc

SEQ ID NO: 14209 - DNA, 30 bp, Homo sapiens
caagacggaccagagcgaaagcatttgcca

SEQ ID NO: 14210 - DNA, 32 bp, Homo sapiens
caagacggaccagagcgaaagcatttgccaag

SEQ ID NO: 14211 - DNA, 44 bp, Homo sapiens
caagacggaccagagcgaaagcatttgccaagaatgttttcatt

SEQ ID NO: 14212 - DNA, 18 bp, Homo sapiens
aagacggaccagagcgaa

SEQ ID NO: 14213 - DNA, 19 bp, Homo sapiens
aagacggaccagagcgaaa

SEQ ID NO: 14214 - DNA, 21 bp, Homo sapiens
aagacggaccagagcgaaagc

SEQ ID NO: 14215 - DNA, 22 bp, Homo sapiens
aagacggaccagagcgaaagca

SEQ ID NO: 14216 - DNA, 23 bp, Homo sapiens
aagacggaccagagcgaaagcat

SEQ ID NO: 14217 - DNA, 24 bp, Homo sapiens
aagacggaccagagcgaaagcatt

SEQ ID NO: 14218 - DNA, 25 bp, Homo sapiens
aagacggaccagagcgaaagcattt

SEQ ID NO: 14219 - DNA, 26 bp, Homo sapiens
aagacggaccagagcgaaagcatttg

SEQ ID NO: 14220 - DNA, 28 bp, Homo sapiens
aagacggaccagagcgaaagcatttgcc

SEQ ID NO: 14221 - DNA, 29 bp, Homo sapiens
aagacggaccagagcgaaagcatttgcca

SEQ ID NO: 14222 - DNA, 37 bp, Homo sapiens
aagacggaccagagcgaaagcatttgccaagaatgtt

SEQ ID NO: 14223 - DNA, 16 bp, Homo sapiens
agacggaccagagcga

SEQ ID NO: 14224 - DNA, 17 bp, Homo sapiens
agacggaccagagcgaa

SEQ ID NO: 14225 - DNA, 18 bp, Homo sapiens
agacggaccagagcgaaa

SEQ ID NO: 14226 - DNA, 20 bp, Homo sapiens
agacggaccagagcgaaagc

SEQ ID NO: 14227 - DNA, 21 bp, Homo sapiens
agacggaccagagcgaaagca

SEQ ID NO: 14228 - DNA, 22 bp, Homo sapiens
agacggaccagagcgaaagcat

SEQ ID NO: 14229 - DNA, 23 bp, Homo sapiens
agacggaccagagcgaaagcatt

SEQ ID NO: 14230 - DNA, 24 bp, Homo sapiens
agacggaccagagcgaaagcattt

SEQ ID NO: 14231 - DNA, 25 bp, Homo sapiens
agacggaccagagcgaaagcatttg

SEQ ID NO: 14232 - DNA, 27 bp, Homo sapiens
agacggaccagagcgaaagcatttgcc

SEQ ID NO: 14233 - DNA, 28 bp, Homo sapiens
agacggaccagagcgaaagcatttgcca

SEQ ID NO: 14234 - DNA, 29 bp, Homo sapiens
agacggaccagagcgaaagcatttgccaa

SEQ ID NO: 14235 - DNA, 31 bp, Homo sapiens
agacggaccagagcgaaagcatttgccaaga

SEQ ID NO: 14236 - DNA, 32 bp, Homo sapiens
agacggaccagagcgaaagcatttgccaagaa

SEQ ID NO: 14237 - DNA, 16 bp, Homo sapiens
gacggaccagagcgaa

SEQ ID NO: 14238 - DNA, 17 bp, Homo sapiens
gacggaccagagcgaaa

SEQ ID NO: 14239 - DNA, 19 bp, Homo sapiens
gacggaccagagcgaaagc

SEQ ID NO: 14240 - DNA, 20 bp, Homo sapiens
gacggaccagagcgaaagca

SEQ ID NO: 14241 - DNA, 21 bp, Homo sapiens
gacggaccagagcgaaagcat

SEQ ID NO: 14242 - DNA, 22 bp, Homo sapiens
gacggaccagagcgaaagcatt

SEQ ID NO: 14243 - DNA, 23 bp, Homo sapiens
gacggaccagagcgaaagcattt

SEQ ID NO: 14244 - DNA, 24 bp, Homo sapiens
gacggaccagagcgaaagcatttg

SEQ ID NO: 14245 - DNA, 25 bp, Homo sapiens
gacggaccagagcgaaagcatttgc

SEQ ID NO: 14246 - DNA, 26 bp, Homo sapiens
gacggaccagagcgaaagcatttgcc

SEQ ID NO: 14247 - DNA, 27 bp, Homo sapiens
gacggaccagagcgaaagcatttgcca

SEQ ID NO: 14248 - DNA, 28 bp, Homo sapiens
gacggaccagagcgaaagcatttgccaa

SEQ ID NO: 14249 - DNA, 30 bp, Homo sapiens
gacggaccagagcgaaagcatttgccaaga

SEQ ID NO: 14250 - DNA, 31 bp, Homo sapiens
gacggaccagagcgaaagcatttgccaagaa

SEQ ID NO: 14251 - DNA, 33 bp, Homo sapiens
gacggaccagagcgaaagcatttgccaagaatg

SEQ ID NO: 14252 - DNA, 35 bp, Homo sapiens
gacggaccagagcgaaagcatttgccaagaatgtt

SEQ ID NO: 14253 - DNA, 37 bp, Homo sapiens
gacggaccagagcgaaagcatttgccaagaatgtttt

SEQ ID NO: 14254 - DNA, 16 bp, Homo sapiens
acggaccagagcgaaa

SEQ ID NO: 14255 - DNA, 18 bp, Homo sapiens
acggaccagagcgaaagc

SEQ ID NO: 14256 - DNA, 19 bp, Homo sapiens
acggaccagagcgaaagca

SEQ ID NO: 14257 - DNA, 20 bp, Homo sapiens
acggaccagagcgaaagcat

SEQ ID NO: 14258 - DNA, 21 bp, Homo sapiens
acggaccagagcgaaagcatt

SEQ ID NO: 14259 - DNA, 22 bp, Homo sapiens
acggaccagagcgaaagcattt

SEQ ID NO: 14260 - DNA, 23 bp, Homo sapiens
acggaccagagcgaaagcatttg

SEQ ID NO: 14261 - DNA, 24 bp, Homo sapiens
acggaccagagcgaaagcatttgc

SEQ ID NO: 14262 - DNA, 25 bp, Homo sapiens
acggaccagagcgaaagcatttgcc

SEQ ID NO: 14263 - DNA, 26 bp, Homo sapiens
acggaccagagcgaaagcatttgcca

SEQ ID NO: 14264 - DNA, 32 bp, Homo sapiens; identical to SEQ ID NO: 2553

SEQ ID NO: 14265 - DNA, 33 bp, Homo sapiens; identical to SEQ ID NO: 2554

SEQ ID NO: 14266 - DNA, 34 bp, Homo sapiens
acggaccagagcgaaagcatttgccaagaatgtt

SEQ ID NO: 14267 - DNA, 35 bp, Homo sapiens
acggaccagagcgaaagcatttgccaagaatgttt

SEQ ID NO: 14268 - DNA, 36 bp, Homo sapiens
acggaccagagcgaaagcatttgccaagaatgtttt

SEQ ID NO: 14269 - DNA, 37 bp, Homo sapiens
acggaccagagcgaaagcatttgccaagaatgttttc

SEQ ID NO: 14270 - DNA, 40 bp, Homo sapiens
acggaccagagcgaaagcatttgccaagaatgttttcatt

SEQ ID NO: 14271 - DNA, 41 bp, Homo sapiens
acggaccagagcgaaagcatttgccaagaatgttttcatta

SEQ ID NO: 14272 - DNA, 17 bp, Homo sapiens
cggaccagagcgaaagc

SEQ ID NO: 14273 - DNA, 18 bp, Homo sapiens
cggaccagagcgaaagca

SEQ ID NO: 14274 - DNA, 19 bp, Homo sapiens
cggaccagagcgaaagcat

SEQ ID NO: 14275 - DNA, 20 bp, Homo sapiens
cggaccagagcgaaagcatt

SEQ ID NO: 14276 - DNA, 22 bp, Homo sapiens
cggaccagagcgaaagcatttg

SEQ ID NO: 14277 - DNA, 24 bp, Homo sapiens
cggaccagagcgaaagcatttgcc

SEQ ID NO: 14278 - DNA, 25 bp, Homo sapiens
cggaccagagcgaaagcatttgcca

SEQ ID NO: 14279 - DNA, 28 bp, Homo sapiens
cggaccagagcgaaagcatttgccaaga

SEQ ID NO: 14280 - DNA, 29 bp, Homo sapiens
cggaccagagcgaaagcatttgccaagaa

SEQ ID NO: 14281 - DNA, 33 bp, Homo sapiens
cggaccagagcgaaagcatttgccaagaatgtt

SEQ ID NO: 14282 - DNA, 18 bp, Homo sapiens
tttgccaagaatgttttc

SEQ ID NO: 14283 - DNA, 19 bp, Homo sapiens
tttgccaagaatgttttca

SEQ ID NO: 14284 - DNA, 43 bp, Homo sapiens
gccaagaatgttttcattaatcaagaacgaaagtcggaggttc

SEQ ID NO: 14285 - DNA, 44 bp, Homo sapiens
gccaagaatgttttcattaatcaagaacgaaagtcggaggttcg

SEQ ID NO: 14286 - DNA, 39 bp, Homo sapiens
agaatgttttcattaatcaagaacgaaagtcggaggttc

SEQ ID NO: 14287 - DNA, 33 bp, Homo sapiens
gaatgttttcattaatcaagaacgaaagtcgga

SEQ ID NO: 14288 - DNA, 31 bp, Homo sapiens
atgttttcattaatcaagaacgaaagtcgga

SEQ ID NO: 14289 - DNA, 30 bp, Homo sapiens
tgttttcattaatcaagaacgaaagtcgga

SEQ ID NO: 14290 - DNA, 32 bp, Homo sapiens
tgttttcattaatcaagaacgaaagtcggagg

SEQ ID NO: 14291 - DNA, 33 bp, Homo sapiens
tgttttcattaatcaagaacgaaagtcggaggt

SEQ ID NO: 14292 - DNA, 31 bp, Homo sapiens
gttttcattaatcaagaacgaaagtcggagg

SEQ ID NO: 14293 - DNA, 32 bp, Homo sapiens
gttttcattaatcaagaacgaaagtcggaggt

SEQ ID NO: 14294 - DNA, 33 bp, Homo sapiens
gttttcattaatcaagaacgaaagtcggaggtt

SEQ ID NO: 14295 - DNA, 33 bp, Homo sapiens
ttttcattaatcaagaacgaaagtcggaggttc

SEQ ID NO: 14296 - DNA, 28 bp, Homo sapiens
ttcattaatcaagaacgaaagtcggagg

SEQ ID NO: 14297 - DNA, 31 bp, Homo sapiens; identical to SEQ ID NO: 2556

SEQ ID NO: 14298 - DNA, 30 bp, Homo sapiens
tcattaatcaagaacgaaagtcggaggttc

SEQ ID NO: 14299 - DNA, 29 bp, Homo sapiens
cattaatcaagaacgaaagtcggaggttc

SEQ ID NO: 14300 - DNA, 30 bp, Homo sapiens
cattaatcaagaacgaaagtcggaggttcg

SEQ ID NO: 14301 - DNA, 28 bp, Homo sapiens
attaatcaagaacgaaagtcggaggttc

SEQ ID NO: 14302 - DNA, 33 bp, Homo sapiens
attaatcaagaacgaaagtcggaggttcgaaga

SEQ ID NO: 14303 - DNA, 22 bp, Homo sapiens
ttaatcaagaacgaaagtcgga

SEQ ID NO: 14304 - DNA, 27 bp, Homo sapiens
ttaatcaagaacgaaagtcggaggttc

SEQ ID NO: 14305 - DNA, 32 bp, Homo sapiens
ttaatcaagaacgaaagtcggaggttcgaaga

SEQ ID NO: 14306 - DNA, 33 bp, Homo sapiens
ttaatcaagaacgaaagtcggaggttcgaagac

SEQ ID NO: 14307 - DNA, 44 bp, Homo sapiens
ttaatcaagaacgaaagtcggaggttcgaagacgatcagatacc

SEQ ID NO: 14308 - DNA, 24 bp, Homo sapiens
aatcaagaacgaaagtcggaggtt

SEQ ID NO: 14309 - DNA, 25 bp, Homo sapiens
aatcaagaacgaaagtcggaggttc

SEQ ID NO: 14310 - DNA, 26 bp, Homo sapiens
aatcaagaacgaaagtcggaggttcg

SEQ ID NO: 14311 - DNA, 30 bp, Homo sapiens; identical to SEQ ID NO: 2562

SEQ ID NO: 14312 - DNA, 31 bp, Homo sapiens; identical to SEQ ID NO: 2563

SEQ ID NO: 14313 - DNA, 33 bp, Homo sapiens
aatcaagaacgaaagtcggaggttcgaagacga

SEQ ID NO: 14314 - DNA, 35 bp, Homo sapiens
aatcaagaacgaaagtcggaggttcgaagacgatc

SEQ ID NO: 14315 - DNA, 39 bp, Homo sapiens
aatcaagaacgaaagtcggaggttcgaagacgatcagat

SEQ ID NO: 14316 - DNA, 40 bp, Homo sapiens
aatcaagaacgaaagtcggaggttcgaagacgatcagata

SEQ ID NO: 14317 - DNA, 42 bp, Homo sapiens
aatcaagaacgaaagtcggaggttcgaagacgatcagatacc

SEQ ID NO: 14318 - DNA, 45 bp, Homo sapiens
aatcaagaacgaaagtcggaggttcgaagacgatcagataccgtc

SEQ ID NO: 14319 - DNA, 19 bp, Homo sapiens
atcaagaacgaaagtcgga

SEQ ID NO: 14320 - DNA, 23 bp, Homo sapiens
atcaagaacgaaagtcggaggtt

SEQ ID NO: 14321 - DNA, 24 bp, Homo sapiens
atcaagaacgaaagtcggaggttc

SEQ ID NO: 14322 - DNA, 25 bp, Homo sapiens
atcaagaacgaaagtcggaggttcg

SEQ ID NO: 14323 - DNA, 28 bp, Homo sapiens
atcaagaacgaaagtcggaggttcgaag

SEQ ID NO: 14324 - DNA, 29 bp, Homo sapiens
atcaagaacgaaagtcggaggttcgaaga

SEQ ID NO: 14325 - DNA, 30 bp, Homo sapiens; identical to SEQ ID NO: 2568

SEQ ID NO: 14326 - DNA, 31 bp, Homo sapiens; identical to SEQ ID NO: 2569

SEQ ID NO: 14327 - DNA, 33 bp, Homo sapiens
atcaagaacgaaagtcggaggttcgaagacgat

SEQ ID NO: 14328 - DNA, 34 bp, Homo sapiens
atcaagaacgaaagtcggaggttcgaagacgatc

SEQ ID NO: 14329 - DNA, 35 bp, Homo sapiens
atcaagaacgaaagtcggaggttcgaagacgatca

SEQ ID NO: 14330 - DNA, 39 bp, Homo sapiens
atcaagaacgaaagtcggaggttcgaagacgatcagata

SEQ ID NO: 14331 - DNA, 41 bp, Homo sapiens
atcaagaacgaaagtcggaggttcgaagacgatcagatacc

SEQ ID NO: 14332 - DNA, 44 bp, Homo sapiens
atcaagaacgaaagtcggaggttcgaagacgatcagataccgtc

SEQ ID NO: 14333 - DNA, 18 bp, Homo sapiens
tcaagaacgaaagtcgga

SEQ ID NO: 14334 - DNA, 23 bp, Homo sapiens
tcaagaacgaaagtcggaggttc

SEQ ID NO: 14335 - DNA, 28 bp, Homo sapiens
tcaagaacgaaagtcggaggttcgaaga

SEQ ID NO: 14336 - DNA, 29 bp, Homo sapiens
tcaagaacgaaagtcggaggttcgaagac

SEQ ID NO: 14337 - DNA, 21 bp, Homo sapiens
caagaacgaaagtcggaggtt

SEQ ID NO: 14338 - DNA, 22 bp, Homo sapiens
caagaacgaaagtcggaggttc

SEQ ID NO: 14339 - DNA, 23 bp, Homo sapiens
caagaacgaaagtcggaggttcg

SEQ ID NO: 14340 - DNA, 27 bp, Homo sapiens
caagaacgaaagtcggaggttcgaaga

SEQ ID NO: 14341 - DNA, 28 bp, Homo sapiens
caagaacgaaagtcggaggttcgaagac

SEQ ID NO: 14342 - DNA, 29 bp, Homo sapiens
caagaacgaaagtcggaggttcgaagacg

SEQ ID NO: 14343 - DNA, 32 bp, Homo sapiens; identical to SEQ ID NO: 2577

SEQ ID NO: 14344 - DNA, 33 bp, Homo sapiens; identical to SEQ ID NO: 2578

SEQ ID NO: 14345 - DNA, 37 bp, Homo sapiens
caagaacgaaagtcggaggttcgaagacgatcagata

SEQ ID NO: 14346 - DNA, 38 bp, Homo sapiens
caagaacgaaagtcggaggttcgaagacgatcagatac

SEQ ID NO: 14347 - DNA, 39 bp, Homo sapiens
caagaacgaaagtcggaggttcgaagacgatcagatacc

SEQ ID NO: 14348 - DNA, 42 bp, Homo sapiens
caagaacgaaagtcggaggttcgaagacgatcagataccgtc

SEQ ID NO: 14349 - DNA, 20 bp, Homo sapiens
aagaacgaaagtcggaggtt

SEQ ID NO: 14350 - DNA, 21 bp, Homo sapiens
aagaacgaaagtcggaggttc

SEQ ID NO: 14351 - DNA, 22 bp, Homo sapiens
aagaacgaaagtcggaggttcg

SEQ ID NO: 14352 - DNA, 25 bp, Homo sapiens
aagaacgaaagtcggaggttcgaag

SEQ ID NO: 14353 - DNA, 26 bp, Homo sapiens
aagaacgaaagtcggaggttcgaaga

SEQ ID NO: 14354 - DNA, 27 bp, Homo sapiens
aagaacgaaagtcggaggttcgaagac

SEQ ID NO: 14355 - DNA, 28 bp, Homo sapiens
aagaacgaaagtcggaggttcgaagacg

SEQ ID NO: 14356 - DNA, 29 bp, Homo sapiens
aagaacgaaagtcggaggttcgaagacga

SEQ ID NO: 14357 - DNA, 30 bp, Homo sapiens
aagaacgaaagtcggaggttcgaagacgat

SEQ ID NO: 14358 - DNA, 31 bp, Homo sapiens; identical to SEQ ID NO: 2585

SEQ ID NO: 14359 - DNA, 32 bp, Homo sapiens; identical to SEQ ID NO: 2586

SEQ ID NO: 14360 - DNA, 33 bp, Homo sapiens
aagaacgaaagtcggaggttcgaagacgatcag

SEQ ID NO: 14361 - DNA, 35 bp, Homo sapiens
aagaacgaaagtcggaggttcgaagacgatcagat

SEQ ID NO: 14362 - DNA, 36 bp, Homo sapiens
aagaacgaaagtcggaggttcgaagacgatcagata

SEQ ID NO: 14363 - DNA, 37 bp, Homo sapiens
aagaacgaaagtcggaggttcgaagacgatcagatac

SEQ ID NO: 14364 - DNA, 38 bp, Homo sapiens
aagaacgaaagtcggaggttcgaagacgatcagatacc

SEQ ID NO: 14365 - DNA, 41 bp, Homo sapiens
aagaacgaaagtcggaggttcgaagacgatcagataccgtc

SEQ ID NO: 14366 - DNA, 19 bp, Homo sapiens
agaacgaaagtcggaggtt

SEQ ID NO: 14367 - DNA, 20 bp, Homo sapiens
agaacgaaagtcggaggttc

SEQ ID NO: 14368 - DNA, 21 bp, Homo sapiens
agaacgaaagtcggaggttcg

SEQ ID NO: 14369 - DNA, 22 bp, Homo sapiens
agaacgaaagtcggaggttcga

SEQ ID NO: 14370 - DNA, 24 bp, Homo sapiens
agaacgaaagtcggaggttcgaag

SEQ ID NO: 14371 - DNA, 25 bp, Homo sapiens
agaacgaaagtcggaggttcgaaga

SEQ ID NO: 14372 - DNA, 26 bp, Homo sapiens
agaacgaaagtcggaggttcgaagac

SEQ ID NO: 14373 - DNA, 27 bp, Homo sapiens
agaacgaaagtcggaggttcgaagacg

SEQ ID NO: 14374 - DNA, 28 bp, Homo sapiens
agaacgaaagtcggaggttcgaagacga

SEQ ID NO: 14375 - DNA, 29 bp, Homo sapiens
agaacgaaagtcggaggttcgaagacgat

SEQ ID NO: 14376 - DNA, 30 bp, Homo sapiens; identical to SEQ ID NO: 2595

SEQ ID NO: 14377 - DNA, 31 bp, Homo sapiens; identical to SEQ ID NO: 2596

SEQ ID NO: 14378 - DNA, 32 bp, Homo sapiens
agaacgaaagtcggaggttcgaagacgatcag

SEQ ID NO: 14379 - DNA, 33 bp, Homo sapiens; identical to SEQ ID NO: 2597

SEQ ID NO: 14380 - DNA, 34 bp, Homo sapiens
agaacgaaagtcggaggttcgaagacgatcagat

SEQ ID NO: 14381 - DNA, 35 bp, Homo sapiens
agaacgaaagtcggaggttcgaagacgatcagata

SEQ ID NO: 14382 - DNA, 36 bp, Homo sapiens
agaacgaaagtcggaggttcgaagacgatcagatac

SEQ ID NO: 14383 - DNA, 37 bp, Homo sapiens
agaacgaaagtcggaggttcgaagacgatcagatacc

SEQ ID NO: 14384 - DNA, 40 bp, Homo sapiens
agaacgaaagtcggaggttcgaagacgatcagataccgtc

SEQ ID NO: 14385 - DNA, 18 bp, Homo sapiens
gaacgaaagtcggaggtt

SEQ ID NO: 14386 - DNA, 19 bp, Homo sapiens
gaacgaaagtcggaggttc

SEQ ID NO: 14387 - DNA, 20 bp, Homo sapiens
gaacgaaagtcggaggttcg

SEQ ID NO: 14388 - DNA, 21 bp, Homo sapiens
gaacgaaagtcggaggttcga

SEQ ID NO: 14389 - DNA, 22 bp, Homo sapiens
gaacgaaagtcggaggttcgaa

SEQ ID NO: 14390 - DNA, 23 bp, Homo sapiens
gaacgaaagtcggaggttcgaag

SEQ ID NO: 14391 - DNA, 24 bp, Homo sapiens
gaacgaaagtcggaggttcgaaga

SEQ ID NO: 14392 - DNA, 25 bp, Homo sapiens
gaacgaaagtcggaggttcgaagac

SEQ ID NO: 14393 - DNA, 26 bp, Homo sapiens
gaacgaaagtcggaggttcgaagacg

SEQ ID NO: 14394 - DNA, 27 bp, Homo sapiens
gaacgaaagtcggaggttcgaagacga

SEQ ID NO: 14395 - DNA, 28 bp, Homo sapiens
gaacgaaagtcggaggttcgaagacgat

SEQ ID NO: 14396 - DNA, 29 bp, Homo sapiens
gaacgaaagtcggaggttcgaagacgatc

SEQ ID NO: 14397 - DNA, 30 bp, Homo sapiens; identical to SEQ ID NO: 2606

SEQ ID NO: 14398 - DNA, 32 bp, Homo sapiens
gaacgaaagtcggaggttcgaagacgatcaga

SEQ ID NO: 14399 - DNA, 33 bp, Homo sapiens
gaacgaaagtcggaggttcgaagacgatcagat

SEQ ID NO: 14400 - DNA, 34 bp, Homo sapiens
gaacgaaagtcggaggttcgaagacgatcagata

SEQ ID NO: 14401 - DNA, 35 bp, Homo sapiens
gaacgaaagtcggaggttcgaagacgatcagatac

SEQ ID NO: 14402 - DNA, 36 bp, Homo sapiens
gaacgaaagtcggaggttcgaagacgatcagatacc

SEQ ID NO: 14403 - DNA, 17 bp, Homo sapiens
aacgaaagtcggaggtt

SEQ ID NO: 14404 - DNA, 18 bp, Homo sapiens
aacgaaagtcggaggttc

SEQ ID NO: 14405 - DNA, 19 bp, Homo sapiens
aacgaaagtcggaggttcg

SEQ ID NO: 14406 - DNA, 22 bp, Homo sapiens
aacgaaagtcggaggttcgaag

SEQ ID NO: 14407 - DNA, 23 bp, Homo sapiens
aacgaaagtcggaggttcgaaga

SEQ ID NO: 14408 - DNA, 24 bp, Homo sapiens
aacgaaagtcggaggttcgaagac

SEQ ID NO: 14409 - DNA, 25 bp, Homo sapiens
aacgaaagtcggaggttcgaagacg

SEQ ID NO: 14410 - DNA, 27 bp, Homo sapiens
aacgaaagtcggaggttcgaagacgat

SEQ ID NO: 14411 - DNA, 28 bp, Homo sapiens
aacgaaagtcggaggttcgaagacgatc

SEQ ID NO: 14412 - DNA, 29 bp, Homo sapiens
aacgaaagtcggaggttcgaagacgatca

SEQ ID NO: 14413 - DNA, 31 bp, Homo sapiens
aacgaaagtcggaggttcgaagacgatcaga

SEQ ID NO: 14414 - DNA, 32 bp, Homo sapiens
aacgaaagtcggaggttcgaagacgatcagat

SEQ ID NO: 14415 - DNA, 33 bp, Homo sapiens; identical to SEQ ID NO: 2616

SEQ ID NO: 14416 - DNA, 34 bp, Homo sapiens
aacgaaagtcggaggttcgaagacgatcagatac

SEQ ID NO: 14417 - DNA, 35 bp, Homo sapiens
aacgaaagtcggaggttcgaagacgatcagatacc

SEQ ID NO: 14418 - DNA, 16 bp, Homo sapiens
acgaaagtcggaggtt

SEQ ID NO: 14419 - DNA, 17 bp, Homo sapiens
acgaaagtcggaggttc

SEQ ID NO: 14420 - DNA, 18 bp, Homo sapiens
acgaaagtcggaggttcg

SEQ ID NO: 14421 - DNA, 20 bp, Homo sapiens
acgaaagtcggaggttcgaa

SEQ ID NO: 14422 - DNA, 21 bp, Homo sapiens
acgaaagtcggaggttcgaag

SEQ ID NO: 14423 - DNA, 22 bp, Homo sapiens
acgaaagtcggaggttcgaaga

SEQ ID NO: 14424 - DNA, 23 bp, Homo sapiens
acgaaagtcggaggttcgaagac

SEQ ID NO: 14425 - DNA, 26 bp, Homo sapiens
acgaaagtcggaggttcgaagacgat

SEQ ID NO: 14426 - DNA, 27 bp, Homo sapiens
acgaaagtcggaggttcgaagacgatc

SEQ ID NO: 14427 - DNA, 28 bp, Homo sapiens
acgaaagtcggaggttcgaagacgatca

SEQ ID NO: 14428 - DNA, 30 bp, Homo sapiens
acgaaagtcggaggttcgaagacgatcaga

SEQ ID NO: 14429 - DNA, 31 bp, Homo sapiens
acgaaagtcggaggttcgaagacgatcagat

SEQ ID NO: 14430 - DNA, 32 bp, Homo sapiens
acgaaagtcggaggttcgaagacgatcagata

SEQ ID NO: 14431 - DNA, 33 bp, Homo sapiens; identical to SEQ ID NO: 2622

SEQ ID NO: 14432 - DNA, 34 bp, Homo sapiens
acgaaagtcggaggttcgaagacgatcagatacc

SEQ ID NO: 14433 - DNA, 16 bp, Homo sapiens
cgaaagtcggaggttc

SEQ ID NO: 14434 - DNA, 26 bp, Homo sapiens
cgaaagtcggaggttcgaagacgatc

SEQ ID NO: 14435 - DNA, 33 bp, Homo sapiens; identical to SEQ ID NO: 2624

SEQ ID NO: 14436 - DNA, 19 bp, Homo sapiens
gaaagtcggaggttcgaag

SEQ ID NO: 14437 - DNA, 20 bp, Homo sapiens
gaaagtcggaggttcgaaga

SEQ ID NO: 14438 - DNA, 21 bp, Homo sapiens
gaaagtcggaggttcgaagac

SEQ ID NO: 14439 - DNA, 25 bp, Homo sapiens
gaaagtcggaggttcgaagacgatc

SEQ ID NO: 14440 - DNA, 32 bp, Homo sapiens
gaaagtcggaggttcgaagacgatcagatacc

SEQ ID NO: 14441 - DNA, 16 bp, Homo sapiens
aaagtcggaggttcga

SEQ ID NO: 14442 - DNA, 17 bp, Homo sapiens
aaagtcggaggttcgaa

SEQ ID NO: 14443 - DNA, 18 bp, Homo sapiens
aaagtcggaggttcgaag

SEQ ID NO: 14444 - DNA, 19 bp, Homo sapiens
aaagtcggaggttcgaaga

SEQ ID NO: 14445 - DNA, 20 bp, Homo sapiens
aaagtcggaggttcgaagac

SEQ ID NO: 14446 - DNA, 21 bp, Homo sapiens
aaagtcggaggttcgaagacg

SEQ ID NO: 14447 - DNA, 22 bp, Homo sapiens
aaagtcggaggttcgaagacga

SEQ ID NO: 14448 - DNA, 23 bp, Homo sapiens
aaagtcggaggttcgaagacgat

SEQ ID NO: 14449 - DNA, 24 bp, Homo sapiens
aaagtcggaggttcgaagacgatc

SEQ ID NO: 14450 - DNA, 25 bp, Homo sapiens
aaagtcggaggttcgaagacgatca

SEQ ID NO: 14451 - DNA, 26 bp, Homo sapiens
aaagtcggaggttcgaagacgatcag

SEQ ID NO: 14452 - DNA, 27 bp, Homo sapiens
aaagtcggaggttcgaagacgatcaga

SEQ ID NO: 14453 - DNA, 28 bp, Homo sapiens
aaagtcggaggttcgaagacgatcagat

SEQ ID NO: 14454 - DNA, 29 bp, Homo sapiens
aaagtcggaggttcgaagacgatcagata

SEQ ID NO: 14455 - DNA, 30 bp, Homo sapiens; identical to SEQ ID NO: 2640

SEQ ID NO: 14456 - DNA, 31 bp, Homo sapiens; identical to SEQ ID NO: 2641

SEQ ID NO: 14457 - DNA, 32 bp, Homo sapiens; identical to SEQ ID NO: 2642

SEQ ID NO: 14458 - DNA, 16 bp, Homo sapiens
aagtcggaggttcgaa

SEQ ID NO: 14459 - DNA, 17 bp, Homo sapiens
aagtcggaggttcgaag

SEQ ID NO: 14460 - DNA, 18 bp, Homo sapiens
aagtcggaggttcgaaga

SEQ ID NO: 14461 - DNA, 19 bp, Homo sapiens
aagtcggaggttcgaagac

SEQ ID NO: 14462 - DNA, 23 bp, Homo sapiens
aagtcggaggttcgaagacgatc

SEQ ID NO: 14463 - DNA, 24 bp, Homo sapiens
aagtcggaggttcgaagacgatca

SEQ ID NO: 14464 - DNA, 26 bp, Homo sapiens
aagtcggaggttcgaagacgatcaga

SEQ ID NO: 14465 - DNA, 28 bp, Homo sapiens
aagtcggaggttcgaagacgatcagata

SEQ ID NO: 14466 - DNA, 29 bp, Homo sapiens
aagtcggaggttcgaagacgatcagatac

SEQ ID NO: 14467 - DNA, 30 bp, Homo sapiens; identical to SEQ ID NO: 2646

SEQ ID NO: 14468 - DNA, 31 bp, Homo sapiens
aagtcggaggttcgaagacgatcagataccg

SEQ ID NO: 14469 - DNA, 17 bp, Homo sapiens
agtcggaggttcgaaga

SEQ ID NO: 14470 - DNA, 18 bp, Homo sapiens
agtcggaggttcgaagac

SEQ ID NO: 14471 - DNA, 19 bp, Homo sapiens
agtcggaggttcgaagacg

SEQ ID NO: 14472 - DNA, 25 bp, Homo sapiens
agtcggaggttcgaagacgatcaga

SEQ ID NO: 14473 - DNA, 27 bp, Homo sapiens
agtcggaggttcgaagacgatcagata

SEQ ID NO: 14474 - DNA, 29 bp, Homo sapiens
agtcggaggttcgaagacgatcagatacc

SEQ ID NO: 14475 - DNA, 16 bp, Homo sapiens
gtcggaggttcgaaga

SEQ ID NO: 14476 - DNA, 17 bp, Homo sapiens
gtcggaggttcgaagac

SEQ ID NO: 14477 - DNA, 18 bp, Homo sapiens
gtcggaggttcgaagacg

SEQ ID NO: 14478 - DNA, 21 bp, Homo sapiens
gtcggaggttcgaagacgatc

SEQ ID NO: 14479 - DNA, 24 bp, Homo sapiens
gtcggaggttcgaagacgatcaga

SEQ ID NO: 14480 - DNA, 26 bp, Homo sapiens
gtcggaggttcgaagacgatcagata

SEQ ID NO: 14481 - DNA, 27 bp, Homo sapiens
gtcggaggttcgaagacgatcagatac

SEQ ID NO: 14482 - DNA, 28 bp, Homo sapiens
gtcggaggttcgaagacgatcagatacc

SEQ ID NO: 14483 - DNA, 16 bp, Homo sapiens
tcggaggttcgaagac

SEQ ID NO: 14484 - DNA, 17 bp, Homo sapiens
tcggaggttcgaagacg

SEQ ID NO: 14485 - DNA, 18 bp, Homo sapiens
tcggaggttcgaagacga

SEQ ID NO: 14486 - DNA, 19 bp, Homo sapiens
tcggaggttcgaagacgat

SEQ ID NO: 14487 - DNA, 20 bp, Homo sapiens
tcggaggttcgaagacgatc

SEQ ID NO: 14488 - DNA, 23 bp, Homo sapiens
tcggaggttcgaagacgatcaga

SEQ ID NO: 14489 - DNA, 26 bp, Homo sapiens
tcggaggttcgaagacgatcagatac

SEQ ID NO: 14490 - DNA, 27 bp, Homo sapiens
tcggaggttcgaagacgatcagatacc

SEQ ID NO: 14491 - DNA, 16 bp, Homo sapiens
cggaggttcgaagacg

SEQ ID NO: 14492 - DNA, 17 bp, Homo sapiens
cggaggttcgaagacga

SEQ ID NO: 14493 - DNA, 18 bp, Homo sapiens
cggaggttcgaagacgat

SEQ ID NO: 14494 - DNA, 19 bp, Homo sapiens
cggaggttcgaagacgatc

SEQ ID NO: 14495 - DNA, 25 bp, Homo sapiens
cggaggttcgaagacgatcagatac

SEQ ID NO: 14496 - DNA, 26 bp, Homo sapiens
cggaggttcgaagacgatcagatacc

SEQ ID NO: 14497 - DNA, 16 bp, Homo sapiens
ggaggttcgaagacga

SEQ ID NO: 14498 - DNA, 17 bp, Homo sapiens
ggaggttcgaagacgat

SEQ ID NO: 14499 - DNA, 18 bp, Homo sapiens
ggaggttcgaagacgatc

SEQ ID NO: 14500 - DNA, 19 bp, Homo sapiens
ggaggttcgaagacgatca

SEQ ID NO: 14501 - DNA, 24 bp, Homo sapiens
ggaggttcgaagacgatcagatac

SEQ ID NO: 14502 - DNA, 25 bp, Homo sapiens
ggaggttcgaagacgatcagatacc

SEQ ID NO: 14503 - DNA, 32 bp, Homo sapiens
ggaggttcgaagacgatcagataccgtcgtag

SEQ ID NO: 14504 - DNA, 24 bp, Homo sapiens
gaggttcgaagacgatcagatacc

SEQ ID NO: 14505 - DNA, 31 bp, Homo sapiens
gaggttcgaagacgatcagataccgtcgtag

SEQ ID NO: 14506 - DNA, 33 bp, Homo sapiens
gaggttcgaagacgatcagataccgtcgtagtt

SEQ ID NO: 14507 - DNA, 29 bp, Homo sapiens
aggttcgaagacgatcagataccgtcgta

SEQ ID NO: 14508 - DNA, 28 bp, Homo sapiens
ggttcgaagacgatcagataccgtcgta

SEQ ID NO: 14509 - DNA, 32 bp, Homo sapiens
ggttcgaagacgatcagataccgtcgtagttc

SEQ ID NO: 14510 - DNA, 21 bp, Homo sapiens
gttcgaagacgatcagatacc

SEQ ID NO: 14511 - DNA, 30 bp, Homo sapiens
gttcgaagacgatcagataccgtcgtagtt

SEQ ID NO: 14512 - DNA, 20 bp, Homo sapiens
ttcgaagacgatcagatacc

SEQ ID NO: 14513 - DNA, 28 bp, Homo sapiens
ttcgaagacgatcagataccgtcgtagt

SEQ ID NO: 14514 - DNA, 19 bp, Homo sapiens
tcgaagacgatcagatacc

SEQ ID NO: 14515 - DNA, 18 bp, Homo sapiens
cgaagacgatcagatacc

SEQ ID NO: 14516 - DNA, 17 bp, Homo sapiens
gaagacgatcagatacc

SEQ ID NO: 14517 - DNA, 18 bp, Homo sapiens
gaagacgatcagataccg

SEQ ID NO: 14518 - DNA, 31 bp, Homo sapiens; identical to SEQ ID NO: 2659

SEQ ID NO: 14519 - DNA, 32 bp, Homo sapiens; identical to SEQ ID NO: 2660

SEQ ID NO: 14520 - DNA, 16 bp, Homo sapiens
aagacgatcagatacc

SEQ ID NO: 14521 - DNA, 17 bp, Homo sapiens
aagacgatcagataccg

SEQ ID NO: 14522 - DNA, 30 bp, Homo sapiens; identical to SEQ ID NO: 2662

SEQ ID NO: 14523 - DNA, 31 bp, Homo sapiens; identical to SEQ ID NO: 2663

SEQ ID NO: 14524 - DNA, 17 bp, Homo sapiens
agacgatcagataccgt

SEQ ID NO: 14525 - DNA, 29 bp, Homo sapiens
agacgatcagataccgtcgtagttccgac

SEQ ID NO: 14526 - DNA, 30 bp, Homo sapiens
agacgatcagataccgtcgtagttccgacc

SEQ ID NO: 14527 - DNA, 31 bp, Homo sapiens
agacgatcagataccgtcgtagttccgacca

SEQ ID NO: 14528 - DNA, 33 bp, Homo sapiens
agacgatcagataccgtcgtagttccgaccata

SEQ ID NO: 14529 - DNA, 16 bp, Homo sapiens
gacgatcagataccgt

SEQ ID NO: 14530 - DNA, 29 bp, Homo sapiens
gacgatcagataccgtcgtagttccgacc

SEQ ID NO: 14531 - DNA, 30 bp, Homo sapiens
gacgatcagataccgtcgtagttccgacca

SEQ ID NO: 14532 - DNA, 32 bp, Homo sapiens
gacgatcagataccgtcgtagttccgaccata

SEQ ID NO: 14533 - DNA, 27 bp, Homo sapiens
acgatcagataccgtcgtagttccgac

SEQ ID NO: 14534 - DNA, 18 bp, Homo sapiens
cgatcagataccgtcgta

SEQ ID NO: 14535 - DNA, 20 bp, Homo sapiens
cgatcagataccgtcgtagt

SEQ ID NO: 14536 - DNA, 22 bp, Homo sapiens
cgatcagataccgtcgtagttc

SEQ ID NO: 14537 - DNA, 26 bp, Homo sapiens
cgatcagataccgtcgtagttccgac

SEQ ID NO: 14538 - DNA, 27 bp, Homo sapiens
cgatcagataccgtcgtagttccgacc

SEQ ID NO: 14539 - DNA, 21 bp, Homo sapiens
gatcagataccgtcgtagttc

SEQ ID NO: 14540 - DNA, 22 bp, Homo sapiens
gatcagataccgtcgtagttcc

SEQ ID NO: 14541 - DNA, 23 bp, Homo sapiens
gatcagataccgtcgtagttccg

SEQ ID NO: 14542 - DNA, 25 bp, Homo sapiens
gatcagataccgtcgtagttccgac

SEQ ID NO: 14543 - DNA, 26 bp, Homo sapiens
gatcagataccgtcgtagttccgacc

SEQ ID NO: 14544 - DNA, 29 bp, Homo sapiens
gatcagataccgtcgtagttccgaccata

SEQ ID NO: 14545 - DNA, 20 bp, Homo sapiens
atcagataccgtcgtagttc

SEQ ID NO: 14546 - DNA, 21 bp, Homo sapiens
atcagataccgtcgtagttcc

SEQ ID NO: 14547 - DNA, 24 bp, Homo sapiens
atcagataccgtcgtagttccgac

SEQ ID NO: 14548 - DNA, 25 bp, Homo sapiens
atcagataccgtcgtagttccgacc

SEQ ID NO: 14549 - DNA, 28 bp, Homo sapiens
atcagataccgtcgtagttccgaccata

SEQ ID NO: 14550 - DNA, 32 bp, Homo sapiens
atcagataccgtcgtagttccgaccataaacg

SEQ ID NO: 14551 - DNA, 19 bp, Homo sapiens
tcagataccgtcgtagttc

SEQ ID NO: 14552 - DNA, 22 bp, Homo sapiens
tcagataccgtcgtagttccga

SEQ ID NO: 14553 - DNA, 23 bp, Homo sapiens
tcagataccgtcgtagttccgac

SEQ ID NO: 14554 - DNA, 24 bp, Homo sapiens
tcagataccgtcgtagttccgacc

SEQ ID NO: 14555 - DNA, 25 bp, Homo sapiens
tcagataccgtcgtagttccgacca

SEQ ID NO: 14556 - DNA, 27 bp, Homo sapiens
tcagataccgtcgtagttccgaccata

SEQ ID NO: 14557 - DNA, 22 bp, Homo sapiens
cagataccgtcgtagttccgac

SEQ ID NO: 14558 - DNA, 23 bp, Homo sapiens
cagataccgtcgtagttccgacc

SEQ ID NO: 14559 - DNA, 33 bp, Homo sapiens
cagataccgtcgtagttccgaccataaacgatg

SEQ ID NO: 14560 - DNA, 17 bp, Homo sapiens
agataccgtcgtagttc

SEQ ID NO: 14561 - DNA, 19 bp, Homo sapiens
agataccgtcgtagttccg

SEQ ID NO: 14562 - DNA, 21 bp, Homo sapiens
agataccgtcgtagttccgac

SEQ ID NO: 14563 - DNA, 22 bp, Homo sapiens
agataccgtcgtagttccgacc

SEQ ID NO: 14564 - DNA, 17 bp, Homo sapiens
gataccgtcgtagttcc

SEQ ID NO: 14565 - DNA, 18 bp, Homo sapiens
gataccgtcgtagttccg

SEQ ID NO: 14566 - DNA, 19 bp, Homo sapiens
gataccgtcgtagttccga

SEQ ID NO: 14567 - DNA, 20 bp, Homo sapiens
gataccgtcgtagttccgac

SEQ ID NO: 14568 - DNA, 21 bp, Homo sapiens
gataccgtcgtagttccgacc

SEQ ID NO: 14569 - DNA, 22 bp, Homo sapiens
gataccgtcgtagttccgacca

SEQ ID NO: 14570 - DNA, 24 bp, Homo sapiens
gataccgtcgtagttccgaccata

SEQ ID NO: 14571 - DNA, 33 bp, Homo sapiens; identical to SEQ ID NO: 2680

SEQ ID NO: 14572 - DNA, 37 bp, Homo sapiens
gataccgtcgtagttccgaccataaacgatgccgacc

SEQ ID NO: 14573 - DNA, 16 bp, Homo sapiens
ataccgtcgtagttcc

SEQ ID NO: 14574 - DNA, 17 bp, Homo sapiens
ataccgtcgtagttccg

SEQ ID NO: 14575 - DNA, 18 bp, Homo sapiens
ataccgtcgtagttccga

SEQ ID NO: 14576 - DNA, 19 bp, Homo sapiens
ataccgtcgtagttccgac

SEQ ID NO: 14577 - DNA, 32 bp, Homo sapiens; identical to SEQ ID NO: 2681

SEQ ID NO: 14578 - DNA, 16 bp, Homo sapiens
taccgtcgtagttccg

SEQ ID NO: 14579 - DNA, 17 bp, Homo sapiens
taccgtcgtagttccga

SEQ ID NO: 14580 - DNA, 18 bp, Homo sapiens
taccgtcgtagttccgac

SEQ ID NO: 14581 - DNA, 20 bp, Homo sapiens
taccgtcgtagttccgacca

SEQ ID NO: 14582 - DNA, 22 bp, Homo sapiens
taccgtcgtagttccgaccata

SEQ ID NO: 14583 - DNA, 27 bp, Homo sapiens
taccgtcgtagttccgaccataaacga

SEQ ID NO: 14584 - DNA, 29 bp, Homo sapiens
taccgtcgtagttccgaccataaacgatg

SEQ ID NO: 14585 - DNA, 33 bp, Homo sapiens
taccgtcgtagttccgaccataaacgatgccga

SEQ ID NO: 14586 - DNA, 16 bp, Homo sapiens
ccgtcgtagttccgac

SEQ ID NO: 14587 - DNA, 17 bp, Homo sapiens
ccgtcgtagttccgacc

SEQ ID NO: 14588 - DNA, 16 bp, Homo sapiens
cgtcgtagttccgacc

SEQ ID NO: 14589 - DNA, 19 bp, Homo sapiens
cgtcgtagttccgaccata

SEQ ID NO: 14590 - DNA, 26 bp, Homo sapiens
cgtcgtagttccgaccataaacgatg

SEQ ID NO: 14591 - DNA, 28 bp, Homo sapiens
cgtcgtagttccgaccataaacgatgcc

SEQ ID NO: 14592 - DNA, 31 bp, Homo sapiens
cgtcgtagttccgaccataaacgatgccgac

SEQ ID NO: 14593 - DNA, 32 bp, Homo sapiens; identical to SEQ ID NO: 2683

SEQ ID NO: 14594 - DNA, 33 bp, Homo sapiens
cgtcgtagttccgaccataaacgatgccgaccg

SEQ ID NO: 14595 - DNA, 30 bp, Homo sapiens
gtcgtagttccgaccataaacgatgccgac

SEQ ID NO: 14596 - DNA, 31 bp, Homo sapiens
gtcgtagttccgaccataaacgatgccgacc

SEQ ID NO: 14597 - DNA, 17 bp, Homo sapiens
tcgtagttccgaccata

SEQ ID NO: 14598 - DNA, 20 bp, Homo sapiens
tcgtagttccgaccataaac

SEQ ID NO: 14599 - DNA, 26 bp, Homo sapiens
tcgtagttccgaccataaacgatgcc

SEQ ID NO: 14600 - DNA, 30 bp, Homo sapiens; identical to SEQ ID NO: 2686

SEQ ID NO: 14601 - DNA, 16 bp, Homo sapiens
cgtagttccgaccata

SEQ ID NO: 14602 - DNA, 20 bp, Homo sapiens
cgtagttccgaccataaacg

SEQ ID NO: 14603 - DNA, 21 bp, Homo sapiens
cgtagttccgaccataaacga

SEQ ID NO: 14604 - DNA, 25 bp, Homo sapiens
cgtagttccgaccataaacgatgcc

SEQ ID NO: 14605 - DNA, 28 bp, Homo sapiens
cgtagttccgaccataaacgatgccgac

SEQ ID NO: 14606 - DNA, 29 bp, Homo sapiens
cgtagttccgaccataaacgatgccgacc

SEQ ID NO: 14607 - DNA, 30 bp, Homo sapiens
cgtagttccgaccataaacgatgccgaccg

SEQ ID NO: 14608 - DNA, 32 bp, Homo sapiens
cgtagttccgaccataaacgatgccgaccggc

SEQ ID NO: 14609 - DNA, 24 bp, Homo sapiens
gtagttccgaccataaacgatgcc

SEQ ID NO: 14610 - DNA, 28 bp, Homo sapiens
gtagttccgaccataaacgatgccgacc

SEQ ID NO: 14611 - DNA, 29 bp, Homo sapiens
gtagttccgaccataaacgatgccgaccg

SEQ ID NO: 14612 - DNA, 30 bp, Homo sapiens
gtagttccgaccataaacgatgccgaccgg

SEQ ID NO: 14613 - DNA, 23 bp, Homo sapiens
tagttccgaccataaacgatgcc

SEQ ID NO: 14614 - DNA, 27 bp, Homo sapiens
tagttccgaccataaacgatgccgacc

SEQ ID NO: 14615 - DNA, 28 bp, Homo sapiens
tagttccgaccataaacgatgccgaccg

SEQ ID NO: 14616 - DNA, 29 bp, Homo sapiens
tagttccgaccataaacgatgccgaccgg

SEQ ID NO: 14617 - DNA, 17 bp, Homo sapiens
gttccgaccataaacga

SEQ ID NO: 14618 - DNA, 21 bp, Homo sapiens
gttccgaccataaacgatgcc

SEQ ID NO: 14619 - DNA, 23 bp, Homo sapiens
gttccgaccataaacgatgccga

SEQ ID NO: 14620 - DNA, 24 bp, Homo sapiens
gttccgaccataaacgatgccgac

SEQ ID NO: 14621 - DNA, 25 bp, Homo sapiens
gttccgaccataaacgatgccgacc

SEQ ID NO: 14622 - DNA, 26 bp, Homo sapiens
gttccgaccataaacgatgccgaccg

SEQ ID NO: 14623 - DNA, 27 bp, Homo sapiens
gttccgaccataaacgatgccgaccgg

SEQ ID NO: 14624 - DNA, 28 bp, Homo sapiens
gttccgaccataaacgatgccgaccggc

SEQ ID NO: 14625 - DNA, 29 bp, Homo sapiens
gttccgaccataaacgatgccgaccggcg

SEQ ID NO: 14626 - DNA, 30 bp, Homo sapiens
gttccgaccataaacgatgccgaccggcga

SEQ ID NO: 14627 - DNA, 33 bp, Homo sapiens
gttccgaccataaacgatgccgaccggcgatgc

SEQ ID NO: 14628 - DNA, 24 bp, Homo sapiens
ttccgaccataaacgatgccgacc

SEQ ID NO: 14629 - DNA, 22 bp, Homo sapiens
ccgaccataaacgatgccgacc

SEQ ID NO: 14630 - DNA, 21 bp, Homo sapiens
cgaccataaacgatgccgacc

SEQ ID NO: 14631 - DNA, 19 bp, Homo sapiens
gaccataaacgatgccgac

SEQ ID NO: 14632 - DNA, 20 bp, Homo sapiens
gaccataaacgatgccgacc

SEQ ID NO: 14633 - DNA, 21 bp, Homo sapiens
gaccataaacgatgccgaccg

SEQ ID NO: 14634 - DNA, 24 bp, Homo sapiens
gaccataaacgatgccgaccggcg

SEQ ID NO: 14635 - DNA, 27 bp, Homo sapiens
gaccataaacgatgccgaccggcgatg

SEQ ID NO: 14636 - DNA, 20 bp, Homo sapiens
accataaacgatgccgaccg

SEQ ID NO: 14637 - DNA, 18 bp, Homo sapiens
ccataaacgatgccgacc

SEQ ID NO: 14638 - DNA, 17 bp, Homo sapiens
cataaacgatgccgacc

SEQ ID NO: 14639 - DNA, 18 bp, Homo sapiens
cataaacgatgccgaccg

SEQ ID NO: 14640 - DNA, 16 bp, Homo sapiens
ataaacgatgccgacc

SEQ ID NO: 14641 - DNA, 17 bp, Homo sapiens
ataaacgatgccgaccg

SEQ ID NO: 14642 - DNA, 16 bp, Homo sapiens
taaacgatgccgaccg

SEQ ID NO: 14643 - DNA, 17 bp, Homo sapiens
aaacgatgccgaccggc

SEQ ID NO: 14644 - DNA, 18 bp, Homo sapiens
aaacgatgccgaccggcg

SEQ ID NO: 14645 - DNA, 16 bp, Homo sapiens
aacgatgccgaccggc

SEQ ID NO: 14646 - DNA, 17 bp, Homo sapiens
aacgatgccgaccggcg

SEQ ID NO: 14647 - DNA, 19 bp, Homo sapiens
gaccggcgatgcggcggcg

SEQ ID NO: 14648 - DNA, 20 bp, Homo sapiens
gaccggcgatgcggcggcgt

SEQ ID NO: 14649 - DNA, 25 bp, Homo sapiens
gaccggcgatgcggcggcgttattc

SEQ ID NO: 14650 - DNA, 27 bp, Homo sapiens
gaccggcgatgcggcggcgttattccc

SEQ ID NO: 14651 - DNA, 18 bp, Homo sapiens
ccggcgatgcggcggcgt

SEQ ID NO: 14652 - DNA, 19 bp, Homo sapiens
ccggcgatgcggcggcgtt

SEQ ID NO: 14653 - DNA, 20 bp, Homo sapiens
ccggcgatgcggcggcgtta

SEQ ID NO: 14654 - DNA, 17 bp, Homo sapiens
cggcgatgcggcggcgt

SEQ ID NO: 14655 - DNA, 23 bp, Homo sapiens
cggcgatgcggcggcgttattcc

SEQ ID NO: 14656 - DNA, 16 bp, Homo sapiens
ggcgatgcggcggcgt

SEQ ID NO: 14657 - DNA, 17 bp, Homo sapiens
ggcgatgcggcggcgtt

SEQ ID NO: 14658 - DNA, 21 bp, Homo sapiens
ggcgatgcggcggcgttattc

SEQ ID NO: 14659 - DNA, 22 bp, Homo sapiens
ggcgatgcggcggcgttattcc

SEQ ID NO: 14660 - DNA, 23 bp, Homo sapiens
ggcgatgcggcggcgttattccc

SEQ ID NO: 14661 - DNA, 23 bp, Homo sapiens
gcgatgcggcggcgttattccca

SEQ ID NO: 14662 - DNA, 20 bp, Homo sapiens
cgatgcggcggcgttattcc

SEQ ID NO: 14663 - DNA, 21 bp, Homo sapiens
cgatgcggcggcgttattccc

SEQ ID NO: 14664 - DNA, 19 bp, Homo sapiens
gatgcggcggcgttattcc

SEQ ID NO: 14665 - DNA, 20 bp, Homo sapiens
gatgcggcggcgttattccc

SEQ ID NO: 14666 - DNA, 17 bp, Homo sapiens
atgcggcggcgttattc

SEQ ID NO: 14667 - DNA, 18 bp, Homo sapiens
atgcggcggcgttattcc

SEQ ID NO: 14668 - DNA, 19 bp, Homo sapiens
atgcggcggcgttattccc

SEQ ID NO: 14669 - DNA, 22 bp, Homo sapiens
tgcggcggcgttattcccatga

SEQ ID NO: 14670 - DNA, 16 bp, Homo sapiens
cggcggcgttattccc

SEQ ID NO: 14671 - DNA, 26 bp, Homo sapiens
gcgttattcccatgacccgccgggca

SEQ ID NO: 14672 - DNA, 25 bp, Homo sapiens
cgttattcccatgacccgccgggca

SEQ ID NO: 14673 - DNA, 19 bp, Homo sapiens
gttattcccatgacccgcc

SEQ ID NO: 14674 - DNA, 24 bp, Homo sapiens
gttattcccatgacccgccgggca

SEQ ID NO: 14675 - DNA, 22 bp, Homo sapiens
ttattcccatgacccgccgggc

SEQ ID NO: 14676 - DNA, 23 bp, Homo sapiens
ttattcccatgacccgccgggca

SEQ ID NO: 14677 - DNA, 26 bp, Homo sapiens
ttattcccatgacccgccgggcagct

SEQ ID NO: 14678 - DNA, 30 bp, Homo sapiens
ttattcccatgacccgccgggcagcttccg

SEQ ID NO: 14679 - DNA, 33 bp, Homo sapiens
ttattcccatgacccgccgggcagcttccggga

SEQ ID NO: 14680 - DNA, 16 bp, Homo sapiens
tattcccatgacccgc

SEQ ID NO: 14681 - DNA, 17 bp, Homo sapiens
tattcccatgacccgcc

SEQ ID NO: 14682 - DNA, 21 bp, Homo sapiens
tattcccatgacccgccgggc

SEQ ID NO: 14683 - DNA, 22 bp, Homo sapiens
tattcccatgacccgccgggca

SEQ ID NO: 14684 - DNA, 25 bp, Homo sapiens
tattcccatgacccgccgggcagct

SEQ ID NO: 14685 - DNA, 28 bp, Homo sapiens
tattcccatgacccgccgggcagcttcc

SEQ ID NO: 14686 - DNA, 29 bp, Homo sapiens
tattcccatgacccgccgggcagcttccg

SEQ ID NO: 14687 - DNA, 31 bp, Homo sapiens
tattcccatgacccgccgggcagcttccggg

SEQ ID NO: 14688 - DNA, 32 bp, Homo sapiens; identical to SEQ ID NO: 2709

SEQ ID NO: 14689 - DNA, 33 bp, Homo sapiens
tattcccatgacccgccgggcagcttccgggaa

SEQ ID NO: 14690 - DNA, 16 bp, Homo sapiens
attcccatgacccgcc

SEQ ID NO: 14691 - DNA, 20 bp, Homo sapiens
attcccatgacccgccgggc

SEQ ID NO: 14692 - DNA, 21 bp, Homo sapiens
attcccatgacccgccgggca

SEQ ID NO: 14693 - DNA, 22 bp, Homo sapiens
attcccatgacccgccgggcag

SEQ ID NO: 14694 - DNA, 24 bp, Homo sapiens
attcccatgacccgccgggcagct

SEQ ID NO: 14695 - DNA, 31 bp, Homo sapiens
attcccatgacccgccgggcagcttccggga

SEQ ID NO: 14696 - DNA, 19 bp, Homo sapiens
ttcccatgacccgccgggc

SEQ ID NO: 14697 - DNA, 20 bp, Homo sapiens
ttcccatgacccgccgggca

SEQ ID NO: 14698 - DNA, 21 bp, Homo sapiens
ttcccatgacccgccgggcag

SEQ ID NO: 14699 - DNA, 23 bp, Homo sapiens
ttcccatgacccgccgggcagct

SEQ ID NO: 14700 - DNA, 29 bp, Homo sapiens
ttcccatgacccgccgggcagcttccggg

SEQ ID NO: 14701 - DNA, 30 bp, Homo sapiens
ttcccatgacccgccgggcagcttccggga

SEQ ID NO: 14702 - DNA, 18 bp, Homo sapiens
tcccatgacccgccgggc

SEQ ID NO: 14703 - DNA, 19 bp, Homo sapiens
tcccatgacccgccgggca

SEQ ID NO: 14704 - DNA, 17 bp, Homo sapiens
cccatgacccgccgggc

SEQ ID NO: 14705 - DNA, 18 bp, Homo sapiens
cccatgacccgccgggca

SEQ ID NO: 14706 - DNA, 16 bp, Homo sapiens
ccatgacccgccgggc

SEQ ID NO: 14707 - DNA, 17 bp, Homo sapiens
ccatgacccgccgggca

SEQ ID NO: 14708 - DNA, 28 bp, Homo sapiens
ccatgacccgccgggcagcttccgggaa

SEQ ID NO: 14709 - DNA, 29 bp, Homo sapiens
ccatgacccgccgggcagcttccgggaaa

SEQ ID NO: 14710 - DNA, 31 bp, Homo sapiens
ccatgacccgccgggcagcttccgggaaacc

SEQ ID NO: 14711 - DNA, 32 bp, Homo sapiens
ccatgacccgccgggcagcttccgggaaacca

SEQ ID NO: 14712 - DNA, 16 bp, Homo sapiens
catgacccgccgggca

SEQ ID NO: 14713 - DNA, 19 bp, Homo sapiens
catgacccgccgggcagct

SEQ ID NO: 14714 - DNA, 22 bp, Homo sapiens
catgacccgccgggcagcttcc

SEQ ID NO: 14715 - DNA, 23 bp, Homo sapiens
catgacccgccgggcagcttccg

SEQ ID NO: 14716 - DNA, 25 bp, Homo sapiens
catgacccgccgggcagcttccggg

SEQ ID NO: 14717 - DNA, 26 bp, Homo sapiens
catgacccgccgggcagcttccggga

SEQ ID NO: 14718 - DNA, 27 bp, Homo sapiens
catgacccgccgggcagcttccgggaa

SEQ ID NO: 14719 - DNA, 28 bp, Homo sapiens
catgacccgccgggcagcttccgggaaa

SEQ ID NO: 14720 - DNA, 29 bp, Homo sapiens
catgacccgccgggcagcttccgggaaac

SEQ ID NO: 14721 - DNA, 30 bp, Homo sapiens; identical to SEQ ID NO: 2720

SEQ ID NO: 14722 - DNA, 31 bp, Homo sapiens; identical to SEQ ID NO: 2721

SEQ ID NO: 14723 - DNA, 33 bp, Homo sapiens
catgacccgccgggcagcttccgggaaaccaaa

SEQ ID NO: 14724 - DNA, 35 bp, Homo sapiens
catgacccgccgggcagcttccgggaaaccaaagt

SEQ ID NO: 14725 - DNA, 36 bp, Homo sapiens
catgacccgccgggcagcttccgggaaaccaaagtc

SEQ ID NO: 14726 - DNA, 37 bp, Homo sapiens
catgacccgccgggcagcttccgggaaaccaaagtct

SEQ ID NO: 14727 - DNA, 38 bp, Homo sapiens
catgacccgccgggcagcttccgggaaaccaaagtctt

SEQ ID NO: 14728 - DNA, 39 bp, Homo sapiens
catgacccgccgggcagcttccgggaaaccaaagtcttt

SEQ ID NO: 14729 - DNA, 17 bp, Homo sapiens
atgacccgccgggcagc

SEQ ID NO: 14730 - DNA, 18 bp, Homo sapiens
atgacccgccgggcagct

SEQ ID NO: 14731 - DNA, 19 bp, Homo sapiens
atgacccgccgggcagctt

SEQ ID NO: 14732 - DNA, 20 bp, Homo sapiens
atgacccgccgggcagcttc

SEQ ID NO: 14733 - DNA, 21 bp, Homo sapiens
atgacccgccgggcagcttcc

SEQ ID NO: 14734 - DNA, 22 bp, Homo sapiens
atgacccgccgggcagcttccg

SEQ ID NO: 14735 - DNA, 23 bp, Homo sapiens
atgacccgccgggcagcttccgg

SEQ ID NO: 14736 - DNA, 24 bp, Homo sapiens
atgacccgccgggcagcttccggg

SEQ ID NO: 14737 - DNA, 25 bp, Homo sapiens
atgacccgccgggcagcttccggga

SEQ ID NO: 14738 - DNA, 26 bp, Homo sapiens
atgacccgccgggcagcttccgggaa

SEQ ID NO: 14739 - DNA, 27 bp, Homo sapiens
atgacccgccgggcagcttccgggaaa

SEQ ID NO: 14740 - DNA, 28 bp, Homo sapiens
atgacccgccgggcagcttccgggaaac

SEQ ID NO: 14741 - DNA, 29 bp, Homo sapiens
atgacccgccgggcagcttccgggaaacc

SEQ ID NO: 14742 - DNA, 30 bp, Homo sapiens; identical to SEQ ID NO: 2734

SEQ ID NO: 14743 - DNA, 31 bp, Homo sapiens
atgacccgccgggcagcttccgggaaaccaa

SEQ ID NO: 14744 - DNA, 32 bp, Homo sapiens; identical to SEQ ID NO: 2735

SEQ ID NO: 14745 - DNA, 33 bp, Homo sapiens; identical to SEQ ID NO: 2736

SEQ ID NO: 14746 - DNA, 34 bp, Homo sapiens
atgacccgccgggcagcttccgggaaaccaaagt

SEQ ID NO: 14747 - DNA, 35 bp, Homo sapiens
atgacccgccgggcagcttccgggaaaccaaagtc

SEQ ID NO: 14748 - DNA, 36 bp, Homo sapiens
atgacccgccgggcagcttccgggaaaccaaagtct

SEQ ID NO: 14749 - DNA, 37 bp, Homo sapiens
atgacccgccgggcagcttccgggaaaccaaagtctt

SEQ ID NO: 14750 - DNA, 38 bp, Homo sapiens
atgacccgccgggcagcttccgggaaaccaaagtcttt

SEQ ID NO: 14751 - DNA, 40 bp, Homo sapiens
atgacccgccgggcagcttccgggaaaccaaagtctttgg

SEQ ID NO: 14752 - DNA, 16 bp, Homo sapiens
tgacccgccgggcagc

SEQ ID NO: 14753 - DNA, 17 bp, Homo sapiens
tgacccgccgggcagct

SEQ ID NO: 14754 - DNA, 18 bp, Homo sapiens
tgacccgccgggcagctt

SEQ ID NO: 14755 - DNA, 19 bp, Homo sapiens
tgacccgccgggcagcttc

SEQ ID NO: 14756 - DNA, 20 bp, Homo sapiens
tgacccgccgggcagcttcc

SEQ ID NO: 14757 - DNA, 21 bp, Homo sapiens
tgacccgccgggcagcttccg

SEQ ID NO: 14758 - DNA, 24 bp, Homo sapiens
tgacccgccgggcagcttccggga

SEQ ID NO: 14759 - DNA, 25 bp, Homo sapiens
tgacccgccgggcagcttccgggaa

SEQ ID NO: 14760 - DNA, 26 bp, Homo sapiens
tgacccgccgggcagcttccgggaaa

SEQ ID NO: 14761 - DNA, 27 bp, Homo sapiens
tgacccgccgggcagcttccgggaaac

SEQ ID NO: 14762 - DNA, 28 bp, Homo sapiens
tgacccgccgggcagcttccgggaaacc

SEQ ID NO: 14763 - DNA, 29 bp, Homo sapiens
tgacccgccgggcagcttccgggaaacca

SEQ ID NO: 14764 - DNA, 30 bp, Homo sapiens
tgacccgccgggcagcttccgggaaaccaa

SEQ ID NO: 14765 - DNA, 31 bp, Homo sapiens
tgacccgccgggcagcttccgggaaaccaaa

SEQ ID NO: 14766 - DNA, 32 bp, Homo sapiens; identical to SEQ ID NO: 2748

SEQ ID NO: 14767 - DNA, 33 bp, Homo sapiens
tgacccgccgggcagcttccgggaaaccaaagt

SEQ ID NO: 14768 - DNA, 34 bp, Homo sapiens
tgacccgccgggcagcttccgggaaaccaaagtc

SEQ ID NO: 14769 - DNA, 35 bp, Homo sapiens
tgacccgccgggcagcttccgggaaaccaaagtct

SEQ ID NO: 14770 - DNA, 36 bp, Homo sapiens
tgacccgccgggcagcttccgggaaaccaaagtctt

SEQ ID NO: 14771 - DNA, 37 bp, Homo sapiens
tgacccgccgggcagcttccgggaaaccaaagtcttt

SEQ ID NO: 14772 - DNA, 16 bp, Homo sapiens
gacccgccgggcagct

SEQ ID NO: 14773 - DNA, 17 bp, Homo sapiens
gacccgccgggcagctt

SEQ ID NO: 14774 - DNA, 20 bp, Homo sapiens
gacccgccgggcagcttccg

SEQ ID NO: 14775 - DNA, 23 bp, Homo sapiens
gacccgccgggcagcttccggga

SEQ ID NO: 14776 - DNA, 24 bp, Homo sapiens
gacccgccgggcagcttccgggaa

SEQ ID NO: 14777 - DNA, 26 bp, Homo sapiens
gacccgccgggcagcttccgggaaac

SEQ ID NO: 14778 - DNA, 27 bp, Homo sapiens
gacccgccgggcagcttccgggaaacc

SEQ ID NO: 14779 - DNA, 31 bp, Homo sapiens; identical to SEQ ID NO: 2749

SEQ ID NO: 14780 - DNA, 32 bp, Homo sapiens
gacccgccgggcagcttccgggaaaccaaagt

SEQ ID NO: 14781 - DNA, 33 bp, Homo sapiens
gacccgccgggcagcttccgggaaaccaaagtc

SEQ ID NO: 14782 - DNA, 35 bp, Homo sapiens
gacccgccgggcagcttccgggaaaccaaagtctt

SEQ ID NO: 14783 - DNA, 19 bp, Homo sapiens
acccgccgggcagcttccg

SEQ ID NO: 14784 - DNA, 23 bp, Homo sapiens
acccgccgggcagcttccgggaa

SEQ ID NO: 14785 - DNA, 26 bp, Homo sapiens
acccgccgggcagcttccgggaaacc

SEQ ID NO: 14786 - DNA, 30 bp, Homo sapiens
acccgccgggcagcttccgggaaaccaaag

SEQ ID NO: 14787 - DNA, 32 bp, Homo sapiens
acccgccgggcagcttccgggaaaccaaagtc

SEQ ID NO: 14788 - DNA, 33 bp, Homo sapiens
acccgccgggcagcttccgggaaaccaaagtct

SEQ ID NO: 14789 - DNA, 21 bp, Homo sapiens
cccgccgggcagcttccggga

SEQ ID NO: 14790 - DNA, 22 bp, Homo sapiens
cccgccgggcagcttccgggaa

SEQ ID NO: 14791 - DNA, 29 bp, Homo sapiens
cccgccgggcagcttccgggaaaccaaag

SEQ ID NO: 14792 - DNA, 33 bp, Homo sapiens
cccgccgggcagcttccgggaaaccaaagtctt

SEQ ID NO: 14793 - DNA, 16 bp, Homo sapiens
ccgccgggcagcttcc

SEQ ID NO: 14794 - DNA, 28 bp, Homo sapiens
ccgccgggcagcttccgggaaaccaaag

SEQ ID NO: 14795 - DNA, 28 bp, Homo sapiens
ccgggcagcttccgggaaaccaaagtct

SEQ ID NO: 14796 - DNA, 24 bp, Homo sapiens
cgggcagcttccgggaaaccaaag

SEQ ID NO: 14797 - DNA, 26 bp, Homo sapiens
cgggcagcttccgggaaaccaaagtc

SEQ ID NO: 14798 - DNA, 27 bp, Homo sapiens
cgggcagcttccgggaaaccaaagtct

SEQ ID NO: 14799 - DNA, 28 bp, Homo sapiens
cgggcagcttccgggaaaccaaagtctt

SEQ ID NO: 14800 - DNA, 22 bp, Homo sapiens
aagtctttgggttccgggggga

SEQ ID NO: 14801 - DNA, 21 bp, Homo sapiens
agtctttgggttccgggggga

SEQ ID NO: 14802 - DNA, 24 bp, Homo sapiens
agtctttgggttccggggggagta

SEQ ID NO: 14803 - DNA, 20 bp, Homo sapiens
gtctttgggttccgggggga

SEQ ID NO: 14804 - DNA, 23 bp, Homo sapiens
gtctttgggttccggggggagta

SEQ ID NO: 14805 - DNA, 19 bp, Homo sapiens
ctttgggttccggggggag

SEQ ID NO: 14806 - DNA, 20 bp, Homo sapiens
ctttgggttccggggggagt

SEQ ID NO: 14807 - DNA, 19 bp, Homo sapiens
tttgggttccggggggagt

SEQ ID NO: 14808 - DNA, 20 bp, Homo sapiens
tttgggttccggggggagta

SEQ ID NO: 14809 - DNA, 22 bp, Homo sapiens
tttgggttccggggggagtatg

SEQ ID NO: 14810 - DNA, 25 bp, Homo sapiens
tttgggttccggggggagtatggtt

SEQ ID NO: 14811 - DNA, 26 bp, Homo sapiens
tttgggttccggggggagtatggttg

SEQ ID NO: 14812 - DNA, 27 bp, Homo sapiens
tttgggttccggggggagtatggttgc

SEQ ID NO: 14813 - DNA, 28 bp, Homo sapiens
tttgggttccggggggagtatggttgca

SEQ ID NO: 14814 - DNA, 31 bp, Homo sapiens
tttgggttccggggggagtatggttgcaaag

SEQ ID NO: 14815 - DNA, 32 bp, Homo sapiens; identical to SEQ ID NO: 2756

SEQ ID NO: 14816 - DNA, 33 bp, Homo sapiens; identical to SEQ ID NO: 2757

SEQ ID NO: 14817 - DNA, 17 bp, Homo sapiens
ttgggttccggggggag

SEQ ID NO: 14818 - DNA, 19 bp, Homo sapiens
ttgggttccggggggagta

SEQ ID NO: 14819 - DNA, 21 bp, Homo sapiens
ttgggttccggggggagtatg

SEQ ID NO: 14820 - DNA, 23 bp, Homo sapiens
ttgggttccggggggagtatggt

SEQ ID NO: 14821 - DNA, 24 bp, Homo sapiens
ttgggttccggggggagtatggtt

SEQ ID NO: 14822 - DNA, 25 bp, Homo sapiens
ttgggttccggggggagtatggttg

SEQ ID NO: 14823 - DNA, 26 bp, Homo sapiens
ttgggttccggggggagtatggttgc

SEQ ID NO: 14824 - DNA, 27 bp, Homo sapiens
ttgggttccggggggagtatggttgca

SEQ ID NO: 14825 - DNA, 29 bp, Homo sapiens
ttgggttccggggggagtatggttgcaaa

SEQ ID NO: 14826 - DNA, 30 bp, Homo sapiens
ttgggttccggggggagtatggttgcaaag

SEQ ID NO: 14827 - DNA, 31 bp, Homo sapiens; identical to SEQ ID NO: 2763

SEQ ID NO: 14828 - DNA, 32 bp, Homo sapiens; identical to SEQ ID NO: 2764

SEQ ID NO: 14829 - DNA, 33 bp, Homo sapiens; identical to SEQ ID NO: 2765

SEQ ID NO: 14830 - DNA, 17 bp, Homo sapiens
tgggttccggggggagt

SEQ ID NO: 14831 - DNA, 18 bp, Homo sapiens
tgggttccggggggagta

SEQ ID NO: 14832 - DNA, 20 bp, Homo sapiens
tgggttccggggggagtatg

SEQ ID NO: 14833 - DNA, 23 bp, Homo sapiens
tgggttccggggggagtatggtt

SEQ ID NO: 14834 - DNA, 24 bp, Homo sapiens
tgggttccggggggagtatggttg

SEQ ID NO: 14835 - DNA, 25 bp, Homo sapiens
tgggttccggggggagtatggttgc

SEQ ID NO: 14836 - DNA, 26 bp, Homo sapiens
tgggttccggggggagtatggttgca

SEQ ID NO: 14837 - DNA, 30 bp, Homo sapiens
tgggttccggggggagtatggttgcaaagc

SEQ ID NO: 14838 - DNA, 31 bp, Homo sapiens; identical to SEQ ID NO: 2768

SEQ ID NO: 14839 - DNA, 32 bp, Homo sapiens; identical to SEQ ID NO: 2769

SEQ ID NO: 14840 - DNA, 23 bp, Homo sapiens
gggttccggggggagtatggttg

SEQ ID NO: 14841 - DNA, 25 bp, Homo sapiens
gggttccggggggagtatggttgca

SEQ ID NO: 14842 - DNA, 30 bp, Homo sapiens
gggttccggggggagtatggttgcaaagct

SEQ ID NO: 14843 - DNA, 31 bp, Homo sapiens
gggttccggggggagtatggttgcaaagctg

SEQ ID NO: 14844 - DNA, 23 bp, Homo sapiens
ggggggagtatggttgcaaagct

SEQ ID NO: 14845 - DNA, 23 bp, Homo sapiens
gggggagtatggttgcaaagctg

SEQ ID NO: 14846 - DNA, 28 bp, Homo sapiens
gggggagtatggttgcaaagctgaaact

SEQ ID NO: 14847 - DNA, 22 bp, Homo sapiens
ggggagtatggttgcaaagctg

SEQ ID NO: 14848 - DNA, 27 bp, Homo sapiens
ggggagtatggttgcaaagctgaaact

SEQ ID NO: 14849 - DNA, 21 bp, Homo sapiens
gggagtatggttgcaaagctg

SEQ ID NO: 14850 - DNA, 24 bp, Homo sapiens
gagtatggttgcaaagctgaaact

SEQ ID NO: 14851 - DNA, 16 bp, Homo sapiens
agtatggttgcaaagc

SEQ ID NO: 14852 - DNA, 23 bp, Homo sapiens
agtatggttgcaaagctgaaact

SEQ ID NO: 14853 - DNA, 26 bp, Homo sapiens
agtatggttgcaaagctgaaacttaa

SEQ ID NO: 14854 - DNA, 17 bp, Homo sapiens
gtatggttgcaaagctg

SEQ ID NO: 14855 - DNA, 18 bp, Homo sapiens
gtatggttgcaaagctga

SEQ ID NO: 14856 - DNA, 19 bp, Homo sapiens
gtatggttgcaaagctgaa

SEQ ID NO: 14857 - DNA, 22 bp, Homo sapiens
gtatggttgcaaagctgaaact

SEQ ID NO: 14858 - DNA, 25 bp, Homo sapiens
gtatggttgcaaagctgaaacttaa

SEQ ID NO: 14859 - DNA, 21 bp, Homo sapiens
tatggttgcaaagctgaaact

SEQ ID NO: 14860 - DNA, 24 bp, Homo sapiens
tatggttgcaaagctgaaacttaa

SEQ ID NO: 14861 - DNA, 20 bp, Homo sapiens
atggttgcaaagctgaaact

SEQ ID NO: 14862 - DNA, 21 bp, Homo sapiens
atggttgcaaagctgaaactt

SEQ ID NO: 14863 - DNA, 19 bp, Homo sapiens
tggttgcaaagctgaaact

SEQ ID NO: 14864 - DNA, 17 bp, Homo sapiens
gttgcaaagctgaaact

SEQ ID NO: 14865 - DNA, 17 bp, Homo sapiens
ttgcaaagctgaaactt

SEQ ID NO: 14866 - DNA, 16 bp, Homo sapiens
tgcaaagctgaaactt

SEQ ID NO: 14867 - DNA, 18 bp, Homo sapiens
tgcaaagctgaaacttaa

SEQ ID NO: 14868 - DNA, 37 bp, Homo sapiens
caaagctgaaacttaaaggaattgacggaagggcacc

SEQ ID NO: 14869 - DNA, 35 bp, Homo sapiens
aagctgaaacttaaaggaattgacggaagggcacc

SEQ ID NO: 14870 - DNA, 33 bp, Homo sapiens
gctgaaacttaaaggaattgacggaagggcacc

SEQ ID NO: 14871 - DNA, 32 bp, Homo sapiens
ctgaaacttaaaggaattgacggaagggcacc

SEQ ID NO: 14872 - DNA, 33 bp, Homo sapiens
ctgaaacttaaaggaattgacggaagggcacca

SEQ ID NO: 14873 - DNA, 31 bp, Homo sapiens
tgaaacttaaaggaattgacggaagggcacc

SEQ ID NO: 14874 - DNA, 24 bp, Homo sapiens
gaaacttaaaggaattgacggaag

SEQ ID NO: 14875 - DNA, 30 bp, Homo sapiens; identical to SEQ ID NO: 2772

SEQ ID NO: 14876 - DNA, 31 bp, Homo sapiens
gaaacttaaaggaattgacggaagggcacca

SEQ ID NO: 14877 - DNA, 33 bp, Homo sapiens
gaaacttaaaggaattgacggaagggcaccacc

SEQ ID NO: 14878 - DNA, 29 bp, Homo sapiens
aaacttaaaggaattgacggaagggcacc

SEQ ID NO: 14879 - DNA, 30 bp, Homo sapiens
aaacttaaaggaattgacggaagggcacca

SEQ ID NO: 14880 - DNA, 26 bp, Homo sapiens
aacttaaaggaattgacggaagggca

SEQ ID NO: 14881 - DNA, 28 bp, Homo sapiens
aacttaaaggaattgacggaagggcacc

SEQ ID NO: 14882 - DNA, 29 bp, Homo sapiens
aacttaaaggaattgacggaagggcacca

SEQ ID NO: 14883 - DNA, 19 bp, Homo sapiens
acttaaaggaattgacgga

SEQ ID NO: 14884 - DNA, 25 bp, Homo sapiens
acttaaaggaattgacggaagggca

SEQ ID NO: 14885 - DNA, 27 bp, Homo sapiens
acttaaaggaattgacggaagggcacc

SEQ ID NO: 14886 - DNA, 28 bp, Homo sapiens
acttaaaggaattgacggaagggcacca

SEQ ID NO: 14887 - DNA, 24 bp, Homo sapiens
cttaaaggaattgacggaagggca

SEQ ID NO: 14888 - DNA, 26 bp, Homo sapiens
cttaaaggaattgacggaagggcacc

SEQ ID NO: 14889 - DNA, 27 bp, Homo sapiens
cttaaaggaattgacggaagggcacca

SEQ ID NO: 14890 - DNA, 33 bp, Homo sapiens
cttaaaggaattgacggaagggcaccaccagga

SEQ ID NO: 14891 - DNA, 25 bp, Homo sapiens
ttaaaggaattgacggaagggcacc

SEQ ID NO: 14892 - DNA, 26 bp, Homo sapiens
ttaaaggaattgacggaagggcacca

SEQ ID NO: 14893 - DNA, 33 bp, Homo sapiens; identical to SEQ ID NO: 2776

SEQ ID NO: 14894 - DNA, 24 bp, Homo sapiens
taaaggaattgacggaagggcacc

SEQ ID NO: 14895 - DNA, 25 bp, Homo sapiens
taaaggaattgacggaagggcacca

SEQ ID NO: 14896 - DNA, 27 bp, Homo sapiens
taaaggaattgacggaagggcaccacc

SEQ ID NO: 14897 - DNA, 32 bp, Homo sapiens; identical to SEQ ID NO: 2778

SEQ ID NO: 14898 - DNA, 43 bp, Homo sapiens
taaaggaattgacggaagggcaccaccaggagtggagcctgcg

SEQ ID NO: 14899 - DNA, 21 bp, Homo sapiens
aaaggaattgacggaagggca

SEQ ID NO: 14900 - DNA, 22 bp, Homo sapiens
aaaggaattgacggaagggcac

SEQ ID NO: 14901 - DNA, 23 bp, Homo sapiens
aaaggaattgacggaagggcacc

SEQ ID NO: 14902 - DNA, 24 bp, Homo sapiens
aaaggaattgacggaagggcacca

SEQ ID NO: 14903 - DNA, 30 bp, Homo sapiens
aaaggaattgacggaagggcaccaccagga

SEQ ID NO: 14904 - DNA, 31 bp, Homo sapiens; identical to SEQ ID NO: 2780

SEQ ID NO: 14905 - DNA, 32 bp, Homo sapiens; identical to SEQ ID NO: 2781

SEQ ID NO: 14906 - DNA, 42 bp, Homo sapiens
aaaggaattgacggaagggcaccaccaggagtggagcctgcg

SEQ ID NO: 14907 - DNA, 20 bp, Homo sapiens
aaggaattgacggaagggca

SEQ ID NO: 14908 - DNA, 22 bp, Homo sapiens
aaggaattgacggaagggcacc

SEQ ID NO: 14909 - DNA, 23 bp, Homo sapiens
aaggaattgacggaagggcacca

SEQ ID NO: 14910 - DNA, 29 bp, Homo sapiens
aaggaattgacggaagggcaccaccagga

SEQ ID NO: 14911 - DNA, 33 bp, Homo sapiens
aaggaattgacggaagggcaccaccaggagtgg

SEQ ID NO: 14912 - DNA, 41 bp, Homo sapiens
aaggaattgacggaagggcaccaccaggagtggagcctgcg

SEQ ID NO: 14913 - DNA, 19 bp, Homo sapiens
aggaattgacggaagggca

SEQ ID NO: 14914 - DNA, 21 bp, Homo sapiens
aggaattgacggaagggcacc

SEQ ID NO: 14915 - DNA, 22 bp, Homo sapiens
aggaattgacggaagggcacca

SEQ ID NO: 14916 - DNA, 28 bp, Homo sapiens
aggaattgacggaagggcaccaccagga

SEQ ID NO: 14917 - DNA, 33 bp, Homo sapiens
aggaattgacggaagggcaccaccaggagtgga

SEQ ID NO: 14918 - DNA, 40 bp, Homo sapiens
aggaattgacggaagggcaccaccaggagtggagcctgcg

SEQ ID NO: 14919 - DNA, 18 bp, Homo sapiens
ggaattgacggaagggca

SEQ ID NO: 14920 - DNA, 17 bp, Homo sapiens
gaattgacggaagggca

SEQ ID NO: 14921 - DNA, 19 bp, Homo sapiens
gaattgacggaagggcacc

SEQ ID NO: 14922 - DNA, 30 bp, Homo sapiens
gaattgacggaagggcaccaccaggagtgg

SEQ ID NO: 14923 - DNA, 16 bp, Homo sapiens
aattgacggaagggca

SEQ ID NO: 14924 - DNA, 18 bp, Homo sapiens
aattgacggaagggcacc

SEQ ID NO: 14925 - DNA, 19 bp, Homo sapiens
aattgacggaagggcacca

SEQ ID NO: 14926 - DNA, 21 bp, Homo sapiens
aattgacggaagggcaccacc

SEQ ID NO: 14927 - DNA, 25 bp, Homo sapiens
aattgacggaagggcaccaccagga

SEQ ID NO: 14928 - DNA, 33 bp, Homo sapiens; identical to SEQ ID NO: 2785

SEQ ID NO: 14929 - DNA, 17 bp, Homo sapiens
attgacggaagggcacc

SEQ ID NO: 14930 - DNA, 18 bp, Homo sapiens
attgacggaagggcacca

SEQ ID NO: 14931 - DNA, 21 bp, Homo sapiens
attgacggaagggcaccacca

SEQ ID NO: 14932 - DNA, 24 bp, Homo sapiens
attgacggaagggcaccaccagga

SEQ ID NO: 14933 - DNA, 27 bp, Homo sapiens
attgacggaagggcaccaccaggagtg

SEQ ID NO: 14934 - DNA, 28 bp, Homo sapiens
attgacggaagggcaccaccaggagtgg

SEQ ID NO: 14935 - DNA, 29 bp, Homo sapiens
attgacggaagggcaccaccaggagtgga

SEQ ID NO: 14936 - DNA, 32 bp, Homo sapiens
attgacggaagggcaccaccaggagtggagcc

SEQ ID NO: 14937 - DNA, 16 bp, Homo sapiens
ttgacggaagggcacc

SEQ ID NO: 14938 - DNA, 17 bp, Homo sapiens
ttgacggaagggcacca

SEQ ID NO: 14939 - DNA, 20 bp, Homo sapiens
ttgacggaagggcaccacca

SEQ ID NO: 14940 - DNA, 23 bp, Homo sapiens
ttgacggaagggcaccaccagga

SEQ ID NO: 14941 - DNA, 26 bp, Homo sapiens
ttgacggaagggcaccaccaggagtg

SEQ ID NO: 14942 - DNA, 27 bp, Homo sapiens
ttgacggaagggcaccaccaggagtgg

SEQ ID NO: 14943 - DNA, 28 bp, Homo sapiens
ttgacggaagggcaccaccaggagtgga

SEQ ID NO: 14944 - DNA, 24 bp, Homo sapiens
acggaagggcaccaccaggagtgg

SEQ ID NO: 14945 - DNA, 32 bp, Homo sapiens
acggaagggcaccaccaggagtggagcctgcg

SEQ ID NO: 14946 - DNA, 19 bp, Homo sapiens
cggaagggcaccaccagga

SEQ ID NO: 14947 - DNA, 22 bp, Homo sapiens
cggaagggcaccaccaggagtg

SEQ ID NO: 14948 - DNA, 24 bp, Homo sapiens
cggaagggcaccaccaggagtgga

SEQ ID NO: 14949 - DNA, 32 bp, Homo sapiens
gaagggcaccaccaggagtggagcctgcggct

SEQ ID NO: 14950 - DNA, 33 bp, Homo sapiens
gaagggcaccaccaggagtggagcctgcggctt

SEQ ID NO: 14951 - DNA, 32 bp, Homo sapiens
aagggcaccaccaggagtggagcctgcggctt

SEQ ID NO: 14952 - DNA, 21 bp, Homo sapiens
caccaccaggagtggagcctg

SEQ ID NO: 14953 - DNA, 33 bp, Homo sapiens
caccaccaggagtggagcctgcggcttaatttg

SEQ ID NO: 14954 - DNA, 26 bp, Homo sapiens
accaccaggagtggagcctgcggctt

SEQ ID NO: 14955 - DNA, 26 bp, Homo sapiens
ccaccaggagtggagcctgcggctta

SEQ ID NO: 14956 - DNA, 17 bp, Homo sapiens
caccaggagtggagcct

SEQ ID NO: 14957 - DNA, 25 bp, Homo sapiens
caccaggagtggagcctgcggctta

SEQ ID NO: 14958 - DNA, 16 bp, Homo sapiens
accaggagtggagcct

SEQ ID NO: 14959 - DNA, 21 bp, Homo sapiens
accaggagtggagcctgcggc

SEQ ID NO: 14960 - DNA, 22 bp, Homo sapiens
accaggagtggagcctgcggct

SEQ ID NO: 14961 - DNA, 23 bp, Homo sapiens
accaggagtggagcctgcggctt

SEQ ID NO: 14962 - DNA, 24 bp, Homo sapiens
accaggagtggagcctgcggctta

SEQ ID NO: 14963 - DNA, 25 bp, Homo sapiens
accaggagtggagcctgcggcttaa

SEQ ID NO: 14964 - DNA, 27 bp, Homo sapiens
accaggagtggagcctgcggcttaatt

SEQ ID NO: 14965 - DNA, 28 bp, Homo sapiens
accaggagtggagcctgcggcttaattt

SEQ ID NO: 14966 - DNA, 29 bp, Homo sapiens
accaggagtggagcctgcggcttaatttg

SEQ ID NO: 14967 - DNA, 31 bp, Homo sapiens
accaggagtggagcctgcggcttaatttgac

SEQ ID NO: 14968 - DNA, 33 bp, Homo sapiens; identical to SEQ ID NO: 2793

SEQ ID NO: 14969 - DNA, 20 bp, Homo sapiens
ccaggagtggagcctgcggc

SEQ ID NO: 14970 - DNA, 22 bp, Homo sapiens
ccaggagtggagcctgcggctt

SEQ ID NO: 14971 - DNA, 23 bp, Homo sapiens
ccaggagtggagcctgcggctta

SEQ ID NO: 14972 - DNA, 26 bp, Homo sapiens
ccaggagtggagcctgcggcttaatt

SEQ ID NO: 14973 - DNA, 28 bp, Homo sapiens
ccaggagtggagcctgcggcttaatttg

SEQ ID NO: 14974 - DNA, 16 bp, Homo sapiens
caggagtggagcctgc

SEQ ID NO: 14975 - DNA, 21 bp, Homo sapiens
caggagtggagcctgcggctt

SEQ ID NO: 14976 - DNA, 22 bp, Homo sapiens
caggagtggagcctgcggctta

SEQ ID NO: 14977 - DNA, 18 bp, Homo sapiens
aggagtggagcctgcggc

SEQ ID NO: 14978 - DNA, 19 bp, Homo sapiens
aggagtggagcctgcggct

SEQ ID NO: 14979 - DNA, 20 bp, Homo sapiens
aggagtggagcctgcggctt

SEQ ID NO: 14980 - DNA, 21 bp, Homo sapiens
aggagtggagcctgcggctta

SEQ ID NO: 14981 - DNA, 24 bp, Homo sapiens
aggagtggagcctgcggcttaatt

SEQ ID NO: 14982 - DNA, 26 bp, Homo sapiens
aggagtggagcctgcggcttaatttg

SEQ ID NO: 14983 - DNA, 18 bp, Homo sapiens
gagtggagcctgcggctt

SEQ ID NO: 14984 - DNA, 24 bp, Homo sapiens
gagtggagcctgcggcttaatttg

SEQ ID NO: 14985 - DNA, 17 bp, Homo sapiens
agtggagcctgcggctt

SEQ ID NO: 14986 - DNA, 17 bp, Homo sapiens
gtggagcctgcggctta

SEQ ID NO: 14987 - DNA, 22 bp, Homo sapiens
gcctgcggcttaatttgactca

SEQ ID NO: 14988 - DNA, 25 bp, Homo sapiens
gcctgcggcttaatttgactcaaca

SEQ ID NO: 14989 - DNA, 29 bp, Homo sapiens
gcctgcggcttaatttgactcaacacggg

SEQ ID NO: 14990 - DNA, 30 bp, Homo sapiens
gcctgcggcttaatttgactcaacacggga

SEQ ID NO: 14991 - DNA, 31 bp, Homo sapiens
gcctgcggcttaatttgactcaacacgggaa

SEQ ID NO: 14992 - DNA, 27 bp, Homo sapiens
tgcggcttaatttgactcaacacggga

SEQ ID NO: 14993 - DNA, 28 bp, Homo sapiens
tgcggcttaatttgactcaacacgggaa

SEQ ID NO: 14994 - DNA, 18 bp, Homo sapiens
atttgactcaacacggga

SEQ ID NO: 14995 - DNA, 19 bp, Homo sapiens
atttgactcaacacgggaa

SEQ ID NO: 14996 - DNA, 18 bp, Homo sapiens
tttgactcaacacgggaa

SEQ ID NO: 14997 - DNA, 29 bp, Homo sapiens
caacacgggaaacctcacccggcccggac

SEQ ID NO: 14998 - DNA, 31 bp, Homo sapiens
caacacgggaaacctcacccggcccggacac

SEQ ID NO: 14999 - DNA, 32 bp, Homo sapiens; identical to SEQ ID NO: 2797

SEQ ID NO: 15000 - DNA, 37 bp, Homo sapiens
caacacgggaaacctcacccggcccggacacggacag

SEQ ID NO: 15001 - DNA, 45 bp, Homo sapiens
caacacgggaaacctcacccggcccggacacggacaggattgaca

SEQ ID NO: 15002 - DNA, 28 bp, Homo sapiens
aacacgggaaacctcacccggcccggac

SEQ ID NO: 15003 - DNA, 29 bp, Homo sapiens
aacacgggaaacctcacccggcccggaca

SEQ ID NO: 15004 - DNA, 30 bp, Homo sapiens; identical to SEQ ID NO: 2800

SEQ ID NO: 15005 - DNA, 31 bp, Homo sapiens; identical to SEQ ID NO: 2801

SEQ ID NO: 15006 - DNA, 34 bp, Homo sapiens
aacacgggaaacctcacccggcccggacacggac

SEQ ID NO: 15007 - DNA, 35 bp, Homo sapiens
aacacgggaaacctcacccggcccggacacggaca

SEQ ID NO: 15008 - DNA, 36 bp, Homo sapiens
aacacgggaaacctcacccggcccggacacggacag

SEQ ID NO: 15009 - DNA, 37 bp, Homo sapiens
aacacgggaaacctcacccggcccggacacggacagg

SEQ ID NO: 15010 - DNA, 41 bp, Homo sapiens
aacacgggaaacctcacccggcccggacacggacaggattg

SEQ ID NO: 15011 - DNA, 43 bp, Homo sapiens
aacacgggaaacctcacccggcccggacacggacaggattgac

SEQ ID NO: 15012 - DNA, 44 bp, Homo sapiens
aacacgggaaacctcacccggcccggacacggacaggattgaca

SEQ ID NO: 15013 - DNA, 46 bp, Homo sapiens
aacacgggaaacctcacccggcccggacacggacaggattgacaga

SEQ ID NO: 15014 - DNA, 47 bp, Homo sapiens
aacacgggaaacctcacccggcccggacacggacaggattgacagat

SEQ ID NO: 15015 - DNA, 27 bp, Homo sapiens
acacgggaaacctcacccggcccggac

SEQ ID NO: 15016 - DNA, 28 bp, Homo sapiens
acacgggaaacctcacccggcccggaca

SEQ ID NO: 15017 - DNA, 29 bp, Homo sapiens
acacgggaaacctcacccggcccggacac

SEQ ID NO: 15018 - DNA, 30 bp, Homo sapiens; identical to SEQ ID NO: 2805

SEQ ID NO: 15019 - DNA, 33 bp, Homo sapiens; identical to SEQ ID NO: 2806

SEQ ID NO: 15020 - DNA, 35 bp, Homo sapiens
acacgggaaacctcacccggcccggacacggacag

SEQ ID NO: 15021 - DNA, 40 bp, Homo sapiens
acacgggaaacctcacccggcccggacacggacaggattg

SEQ ID NO: 15022 - DNA, 42 bp, Homo sapiens
acacgggaaacctcacccggcccggacacggacaggattgac

SEQ ID NO: 15023 - DNA, 43 bp, Homo sapiens
acacgggaaacctcacccggcccggacacggacaggattgaca

SEQ ID NO: 15024 - DNA, 45 bp, Homo sapiens
acacgggaaacctcacccggcccggacacggacaggattgacaga

SEQ ID NO: 15025 - DNA, 46 bp, Homo sapiens
acacgggaaacctcacccggcccggacacggacaggattgacagat

SEQ ID NO: 15026 - DNA, 47 bp, Homo sapiens
acacgggaaacctcacccggcccggacacggacaggattgacagatt

SEQ ID NO: 15027 - DNA, 26 bp, Homo sapiens
cacgggaaacctcacccggcccggac

SEQ ID NO: 15028 - DNA, 27 bp, Homo sapiens
cacgggaaacctcacccggcccggaca

SEQ ID NO: 15029 - DNA, 28 bp, Homo sapiens
cacgggaaacctcacccggcccggacac

SEQ ID NO: 15030 - DNA, 29 bp, Homo sapiens
cacgggaaacctcacccggcccggacacg

SEQ ID NO: 15031 - DNA, 32 bp, Homo sapiens
cacgggaaacctcacccggcccggacacggac

SEQ ID NO: 15032 - DNA, 33 bp, Homo sapiens
cacgggaaacctcacccggcccggacacggaca

SEQ ID NO: 15033 - DNA, 34 bp, Homo sapiens
cacgggaaacctcacccggcccggacacggacag

SEQ ID NO: 15034 - DNA, 39 bp, Homo sapiens
cacgggaaacctcacccggcccggacacggacaggattg

SEQ ID NO: 15035 - DNA, 41 bp, Homo sapiens
cacgggaaacctcacccggcccggacacggacaggattgac

SEQ ID NO: 15036 - DNA, 42 bp, Homo sapiens
cacgggaaacctcacccggcccggacacggacaggattgaca

SEQ ID NO: 15037 - DNA, 45 bp, Homo sapiens
cacgggaaacctcacccggcccggacacggacaggattgacagat

SEQ ID NO: 15038 - DNA, 46 bp, Homo sapiens
cacgggaaacctcacccggcccggacacggacaggattgacagatt

SEQ ID NO: 15039 - DNA, 25 bp, Homo sapiens
acgggaaacctcacccggcccggac

SEQ ID NO: 15040 - DNA, 28 bp, Homo sapiens
acgggaaacctcacccggcccggacacg

SEQ ID NO: 15041 - DNA, 33 bp, Homo sapiens; identical to SEQ ID NO: 2811

SEQ ID NO: 15042 - DNA, 40 bp, Homo sapiens
acgggaaacctcacccggcccggacacggacaggattgac

SEQ ID NO: 15043 - DNA, 41 bp, Homo sapiens
acgggaaacctcacccggcccggacacggacaggattgaca

SEQ ID NO: 15044 - DNA, 43 bp, Homo sapiens
acgggaaacctcacccggcccggacacggacaggattgacaga

SEQ ID NO: 15045 - DNA, 44 bp, Homo sapiens
acgggaaacctcacccggcccggacacggacaggattgacagat

SEQ ID NO: 15046 - DNA, 45 bp, Homo sapiens
acgggaaacctcacccggcccggacacggacaggattgacagatt

SEQ ID NO: 15047 - DNA, 46 bp, Homo sapiens
acgggaaacctcacccggcccggacacggacaggattgacagattg

SEQ ID NO: 15048 - DNA, 24 bp, Homo sapiens
cgggaaacctcacccggcccggac

SEQ ID NO: 15049 - DNA, 25 bp, Homo sapiens
cgggaaacctcacccggcccggaca

SEQ ID NO: 15050 - DNA, 26 bp, Homo sapiens
cgggaaacctcacccggcccggacac

SEQ ID NO: 15051 - DNA, 27 bp, Homo sapiens
cgggaaacctcacccggcccggacacg

SEQ ID NO: 15052 - DNA, 31 bp, Homo sapiens
cgggaaacctcacccggcccggacacggaca

SEQ ID NO: 15053 - DNA, 32 bp, Homo sapiens; identical to SEQ ID NO: 2815

SEQ ID NO: 15054 - DNA, 33 bp, Homo sapiens
cgggaaacctcacccggcccggacacggacagg

SEQ ID NO: 15055 - DNA, 37 bp, Homo sapiens
cgggaaacctcacccggcccggacacggacaggattg

SEQ ID NO: 15056 - DNA, 39 bp, Homo sapiens
cgggaaacctcacccggcccggacacggacaggattgac

SEQ ID NO: 15057 - DNA, 40 bp, Homo sapiens
cgggaaacctcacccggcccggacacggacaggattgaca

SEQ ID NO: 15058 - DNA, 41 bp, Homo sapiens
cgggaaacctcacccggcccggacacggacaggattgacag

SEQ ID NO: 15059 - DNA, 42 bp, Homo sapiens
cgggaaacctcacccggcccggacacggacaggattgacaga

SEQ ID NO: 15060 - DNA, 43 bp, Homo sapiens
cgggaaacctcacccggcccggacacggacaggattgacagat

SEQ ID NO: 15061 - DNA, 44 bp, Homo sapiens
cgggaaacctcacccggcccggacacggacaggattgacagatt

SEQ ID NO: 15062 - DNA, 45 bp, Homo sapiens
cgggaaacctcacccggcccggacacggacaggattgacagattg

SEQ ID NO: 15063 - DNA, 47 bp, Homo sapiens
cgggaaacctcacccggcccggacacggacaggattgacagattgat

SEQ ID NO: 15064 - DNA, 23 bp, Homo sapiens
gggaaacctcacccggcccggac

SEQ ID NO: 15065 - DNA, 24 bp, Homo sapiens
gggaaacctcacccggcccggaca

SEQ ID NO: 15066 - DNA, 25 bp, Homo sapiens
gggaaacctcacccggcccggacac

SEQ ID NO: 15067 - DNA, 26 bp, Homo sapiens
gggaaacctcacccggcccggacacg

SEQ ID NO: 15068 - DNA, 27 bp, Homo sapiens
gggaaacctcacccggcccggacacgg

SEQ ID NO: 15069 - DNA, 29 bp, Homo sapiens
gggaaacctcacccggcccggacacggac

SEQ ID NO: 15070 - DNA, 30 bp, Homo sapiens
gggaaacctcacccggcccggacacggaca

SEQ ID NO: 15071 - DNA, 31 bp, Homo sapiens; identical to SEQ ID NO: 2819

SEQ ID NO: 15072 - DNA, 32 bp, Homo sapiens
gggaaacctcacccggcccggacacggacagg

SEQ ID NO: 15073 - DNA, 36 bp, Homo sapiens
gggaaacctcacccggcccggacacggacaggattg

SEQ ID NO: 15074 - DNA, 22 bp, Homo sapiens
ggaaacctcacccggcccggac

SEQ ID NO: 15075 - DNA, 23 bp, Homo sapiens
ggaaacctcacccggcccggaca

SEQ ID NO: 15076 - DNA, 24 bp, Homo sapiens
ggaaacctcacccggcccggacac

SEQ ID NO: 15077 - DNA, 25 bp, Homo sapiens
ggaaacctcacccggcccggacacg

SEQ ID NO: 15078 - DNA, 26 bp, Homo sapiens
ggaaacctcacccggcccggacacgg

SEQ ID NO: 15079 - DNA, 27 bp, Homo sapiens
ggaaacctcacccggcccggacacgga

SEQ ID NO: 15080 - DNA, 28 bp, Homo sapiens
ggaaacctcacccggcccggacacggac

SEQ ID NO: 15081 - DNA, 29 bp, Homo sapiens
ggaaacctcacccggcccggacacggaca

SEQ ID NO: 15082 - DNA, 30 bp, Homo sapiens; identical to SEQ ID NO: 2826

SEQ ID NO: 15083 - DNA, 35 bp, Homo sapiens
ggaaacctcacccggcccggacacggacaggattg

SEQ ID NO: 15084 - DNA, 21 bp, Homo sapiens
gaaacctcacccggcccggac

SEQ ID NO: 15085 - DNA, 22 bp, Homo sapiens
gaaacctcacccggcccggaca

SEQ ID NO: 15086 - DNA, 23 bp, Homo sapiens
gaaacctcacccggcccggacac

SEQ ID NO: 15087 - DNA, 24 bp, Homo sapiens
gaaacctcacccggcccggacacg

SEQ ID NO: 15088 - DNA, 27 bp, Homo sapiens
gaaacctcacccggcccggacacggac

SEQ ID NO: 15089 - DNA, 28 bp, Homo sapiens
gaaacctcacccggcccggacacggaca

SEQ ID NO: 15090 - DNA, 29 bp, Homo sapiens
gaaacctcacccggcccggacacggacag

SEQ ID NO: 15091 - DNA, 20 bp, Homo sapiens
aaacctcacccggcccggac

SEQ ID NO: 15092 - DNA, 21 bp, Homo sapiens
aaacctcacccggcccggaca

SEQ ID NO: 15093 - DNA, 22 bp, Homo sapiens
aaacctcacccggcccggacac

SEQ ID NO: 15094 - DNA, 23 bp, Homo sapiens
aaacctcacccggcccggacacg

SEQ ID NO: 15095 - DNA, 26 bp, Homo sapiens
aaacctcacccggcccggacacggac

SEQ ID NO: 15096 - DNA, 27 bp, Homo sapiens
aaacctcacccggcccggacacggaca

SEQ ID NO: 15097 - DNA, 28 bp, Homo sapiens
aaacctcacccggcccggacacggacag

SEQ ID NO: 15098 - DNA, 33 bp, Homo sapiens
aaacctcacccggcccggacacggacaggattg

SEQ ID NO: 15099 - DNA, 18 bp, Homo sapiens
aacctcacccggcccgga

SEQ ID NO: 15100 - DNA, 19 bp, Homo sapiens
aacctcacccggcccggac

SEQ ID NO: 15101 - DNA, 20 bp, Homo sapiens
aacctcacccggcccggaca

SEQ ID NO: 15102 - DNA, 21 bp, Homo sapiens
aacctcacccggcccggacac

SEQ ID NO: 15103 - DNA, 22 bp, Homo sapiens
aacctcacccggcccggacacg

SEQ ID NO: 15104 - DNA, 24 bp, Homo sapiens
aacctcacccggcccggacacgga

SEQ ID NO: 15105 - DNA, 25 bp, Homo sapiens
aacctcacccggcccggacacggac

SEQ ID NO: 15106 - DNA, 26 bp, Homo sapiens
aacctcacccggcccggacacggaca

SEQ ID NO: 15107 - DNA, 27 bp, Homo sapiens
aacctcacccggcccggacacggacag

SEQ ID NO: 15108 - DNA, 29 bp, Homo sapiens
aacctcacccggcccggacacggacagga

SEQ ID NO: 15109 - DNA, 32 bp, Homo sapiens; identical to SEQ ID NO: 2840

SEQ ID NO: 15110 - DNA, 33 bp, Homo sapiens
aacctcacccggcccggacacggacaggattga

SEQ ID NO: 15111 - DNA, 37 bp, Homo sapiens
aacctcacccggcccggacacggacaggattgacaga

SEQ ID NO: 15112 - DNA, 18 bp, Homo sapiens
acctcacccggcccggac

SEQ ID NO: 15113 - DNA, 19 bp, Homo sapiens
acctcacccggcccggaca

SEQ ID NO: 15114 - DNA, 20 bp, Homo sapiens
acctcacccggcccggacac

SEQ ID NO: 15115 - DNA, 21 bp, Homo sapiens
acctcacccggcccggacacg

SEQ ID NO: 15116 - DNA, 22 bp, Homo sapiens
acctcacccggcccggacacgg

SEQ ID NO: 15117 - DNA, 23 bp, Homo sapiens
acctcacccggcccggacacgga

SEQ ID NO: 15118 - DNA, 24 bp, Homo sapiens
acctcacccggcccggacacggac

SEQ ID NO: 15119 - DNA, 25 bp, Homo sapiens
acctcacccggcccggacacggaca

SEQ ID NO: 15120 - DNA, 26 bp, Homo sapiens
acctcacccggcccggacacggacag

SEQ ID NO: 15121 - DNA, 28 bp, Homo sapiens
acctcacccggcccggacacggacagga

SEQ ID NO: 15122 - DNA, 31 bp, Homo sapiens
acctcacccggcccggacacggacaggattg

SEQ ID NO: 15123 - DNA, 32 bp, Homo sapiens
acctcacccggcccggacacggacaggattga

SEQ ID NO: 15124 - DNA, 17 bp, Homo sapiens
cctcacccggcccggac

SEQ ID NO: 15125 - DNA, 18 bp, Homo sapiens
cctcacccggcccggaca

SEQ ID NO: 15126 - DNA, 19 bp, Homo sapiens
cctcacccggcccggacac

SEQ ID NO: 15127 - DNA, 20 bp, Homo sapiens
cctcacccggcccggacacg

SEQ ID NO: 15128 - DNA, 22 bp, Homo sapiens
cctcacccggcccggacacgga

SEQ ID NO: 15129 - DNA, 23 bp, Homo sapiens
cctcacccggcccggacacggac

SEQ ID NO: 15130 - DNA, 24 bp, Homo sapiens
cctcacccggcccggacacggaca

SEQ ID NO: 15131 - DNA, 25 bp, Homo sapiens
cctcacccggcccggacacggacag

SEQ ID NO: 15132 - DNA, 27 bp, Homo sapiens
cctcacccggcccggacacggacagga

SEQ ID NO: 15133 - DNA, 31 bp, Homo sapiens
cctcacccggcccggacacggacaggattga

SEQ ID NO: 15134 - DNA, 16 bp, Homo sapiens
ctcacccggcccggac

SEQ ID NO: 15135 - DNA, 17 bp, Homo sapiens
ctcacccggcccggaca

SEQ ID NO: 15136 - DNA, 18 bp, Homo sapiens
ctcacccggcccggacac

SEQ ID NO: 15137 - DNA, 19 bp, Homo sapiens
ctcacccggcccggacacg

SEQ ID NO: 15138 - DNA, 22 bp, Homo sapiens
ctcacccggcccggacacggac

SEQ ID NO: 15139 - DNA, 23 bp, Homo sapiens
ctcacccggcccggacacggaca

SEQ ID NO: 15140 - DNA, 24 bp, Homo sapiens
ctcacccggcccggacacggacag

SEQ ID NO: 15141 - DNA, 16 bp, Homo sapiens
tcacccggcccggaca

SEQ ID NO: 15142 - DNA, 17 bp, Homo sapiens
tcacccggcccggacac

SEQ ID NO: 15143 - DNA, 18 bp, Homo sapiens
tcacccggcccggacacg

SEQ ID NO: 15144 - DNA, 19 bp, Homo sapiens
tcacccggcccggacacgg

SEQ ID NO: 15145 - DNA, 20 bp, Homo sapiens
tcacccggcccggacacgga

SEQ ID NO: 15146 - DNA, 21 bp, Homo sapiens
tcacccggcccggacacggac

SEQ ID NO: 15147 - DNA, 22 bp, Homo sapiens
tcacccggcccggacacggaca

SEQ ID NO: 15148 - DNA, 23 bp, Homo sapiens
tcacccggcccggacacggacag

SEQ ID NO: 15149 - DNA, 24 bp, Homo sapiens
tcacccggcccggacacggacagg

SEQ ID NO: 15150 - DNA, 28 bp, Homo sapiens
tcacccggcccggacacggacaggattg

SEQ ID NO: 15151 - DNA, 31 bp, Homo sapiens
tcacccggcccggacacggacaggattgaca

SEQ ID NO: 15152 - DNA, 33 bp, Homo sapiens; identical to SEQ ID NO: 2860

SEQ ID NO: 15153 - DNA, 42 bp, Homo sapiens
tcacccggcccggacacggacaggattgacagattgatagct

SEQ ID NO: 15154 - DNA, 16 bp, Homo sapiens
cacccggcccggacac

SEQ ID NO: 15155 - DNA, 17 bp, Homo sapiens
cacccggcccggacacg

SEQ ID NO: 15156 - DNA, 18 bp, Homo sapiens
cacccggcccggacacgg

SEQ ID NO: 15157 - DNA, 19 bp, Homo sapiens
cacccggcccggacacgga

SEQ ID NO: 15158 - DNA, 20 bp, Homo sapiens
cacccggcccggacacggac

SEQ ID NO: 15159 - DNA, 21 bp, Homo sapiens
cacccggcccggacacggaca

SEQ ID NO: 15160 - DNA, 22 bp, Homo sapiens
cacccggcccggacacggacag

SEQ ID NO: 15161 - DNA, 23 bp, Homo sapiens
cacccggcccggacacggacagg

SEQ ID NO: 15162 - DNA, 32 bp, Homo sapiens
cacccggcccggacacggacaggattgacaga

SEQ ID NO: 15163 - DNA, 33 bp, Homo sapiens
cacccggcccggacacggacaggattgacagat

SEQ ID NO: 15164 - DNA, 35 bp, Homo sapiens
cacccggcccggacacggacaggattgacagattg

SEQ ID NO: 15165 - DNA, 41 bp, Homo sapiens
cacccggcccggacacggacaggattgacagattgatagct

SEQ ID NO: 15166 - DNA, 16 bp, Homo sapiens
acccggcccggacacg

SEQ ID NO: 15167 - DNA, 19 bp, Homo sapiens
acccggcccggacacggac

SEQ ID NO: 15168 - DNA, 20 bp, Homo sapiens
acccggcccggacacggaca

SEQ ID NO: 15169 - DNA, 21 bp, Homo sapiens
acccggcccggacacggacag

SEQ ID NO: 15170 - DNA, 33 bp, Homo sapiens
acccggcccggacacggacaggattgacagatt

SEQ ID NO: 15171 - DNA, 40 bp, Homo sapiens
acccggcccggacacggacaggattgacagattgatagct

SEQ ID NO: 15172 - DNA, 16 bp, Homo sapiens
cccggcccggacacgg

SEQ ID NO: 15173 - DNA, 17 bp, Homo sapiens
cccggcccggacacgga

SEQ ID NO: 15174 - DNA, 18 bp, Homo sapiens
cccggcccggacacggac

SEQ ID NO: 15175 - DNA, 19 bp, Homo sapiens
cccggcccggacacggaca

SEQ ID NO: 15176 - DNA, 20 bp, Homo sapiens
cccggcccggacacggacag

SEQ ID NO: 15177 - DNA, 21 bp, Homo sapiens
cccggcccggacacggacagg

SEQ ID NO: 15178 - DNA, 30 bp, Homo sapiens
cccggcccggacacggacaggattgacaga

SEQ ID NO: 15179 - DNA, 39 bp, Homo sapiens
cccggcccggacacggacaggattgacagattgatagct

SEQ ID NO: 15180 - DNA, 17 bp, Homo sapiens
ccggcccggacacggac

SEQ ID NO: 15181 - DNA, 18 bp, Homo sapiens
ccggcccggacacggaca

SEQ ID NO: 15182 - DNA, 19 bp, Homo sapiens
ccggcccggacacggacag

SEQ ID NO: 15183 - DNA, 29 bp, Homo sapiens
ccggcccggacacggacaggattgacaga

SEQ ID NO: 15184 - DNA, 38 bp, Homo sapiens
ccggcccggacacggacaggattgacagattgatagct

SEQ ID NO: 15185 - DNA, 16 bp, Homo sapiens
cggcccggacacggac

SEQ ID NO: 15186 - DNA, 17 bp, Homo sapiens
cggcccggacacggaca

SEQ ID NO: 15187 - DNA, 18 bp, Homo sapiens
cggcccggacacggacag

SEQ ID NO: 15188 - DNA, 19 bp, Homo sapiens
cggcccggacacggacagg

SEQ ID NO: 15189 - DNA, 23 bp, Homo sapiens
cggcccggacacggacaggattg

SEQ ID NO: 15190 - DNA, 24 bp, Homo sapiens
cggcccggacacggacaggattga

SEQ ID NO: 15191 - DNA, 25 bp, Homo sapiens
cggcccggacacggacaggattgac

SEQ ID NO: 15192 - DNA, 26 bp, Homo sapiens
cggcccggacacggacaggattgaca

SEQ ID NO: 15193 - DNA, 27 bp, Homo sapiens
cggcccggacacggacaggattgacag

SEQ ID NO: 15194 - DNA, 28 bp, Homo sapiens
cggcccggacacggacaggattgacaga

SEQ ID NO: 15195 - DNA, 29 bp, Homo sapiens
cggcccggacacggacaggattgacagat

SEQ ID NO: 15196 - DNA, 30 bp, Homo sapiens; identical to SEQ ID NO: 2879

SEQ ID NO: 15197 - DNA, 31 bp, Homo sapiens; identical to SEQ ID NO: 2880

SEQ ID NO: 15198 - DNA, 32 bp, Homo sapiens; identical to SEQ ID NO: 2881

SEQ ID NO: 15199 - DNA, 33 bp, Homo sapiens; identical to SEQ ID NO: 2882

SEQ ID NO: 15200 - DNA, 37 bp, Homo sapiens
cggcccggacacggacaggattgacagattgatagct

SEQ ID NO: 15201 - DNA, 39 bp, Homo sapiens
cggcccggacacggacaggattgacagattgatagctct

SEQ ID NO: 15202 - DNA, 16 bp, Homo sapiens
ggcccggacacggaca

SEQ ID NO: 15203 - DNA, 17 bp, Homo sapiens
ggcccggacacggacag

SEQ ID NO: 15204 - DNA, 22 bp, Homo sapiens
ggcccggacacggacaggattg

SEQ ID NO: 15205 - DNA, 25 bp, Homo sapiens
ggcccggacacggacaggattgaca

SEQ ID NO: 15206 - DNA, 26 bp, Homo sapiens
ggcccggacacggacaggattgacag

SEQ ID NO: 15207 - DNA, 27 bp, Homo sapiens
ggcccggacacggacaggattgacaga

SEQ ID NO: 15208 - DNA, 28 bp, Homo sapiens
ggcccggacacggacaggattgacagat

SEQ ID NO: 15209 - DNA, 29 bp, Homo sapiens
ggcccggacacggacaggattgacagatt

SEQ ID NO: 15210 - DNA, 30 bp, Homo sapiens; identical to SEQ ID NO: 2889

SEQ ID NO: 15211 - DNA, 31 bp, Homo sapiens
ggcccggacacggacaggattgacagattga

SEQ ID NO: 15212 - DNA, 32 bp, Homo sapiens; identical to SEQ ID NO: 2890

SEQ ID NO: 15213 - DNA, 33 bp, Homo sapiens
ggcccggacacggacaggattgacagattgata

SEQ ID NO: 15214 - DNA, 36 bp, Homo sapiens
ggcccggacacggacaggattgacagattgatagct

SEQ ID NO: 15215 - DNA, 40 bp, Homo sapiens
ggcccggacacggacaggattgacagattgatagctcttt

SEQ ID NO: 15216 - DNA, 21 bp, Homo sapiens
gcccggacacggacaggattg

SEQ ID NO: 15217 - DNA, 24 bp, Homo sapiens
gcccggacacggacaggattgaca

SEQ ID NO: 15218 - DNA, 26 bp, Homo sapiens
gcccggacacggacaggattgacaga

SEQ ID NO: 15219 - DNA, 29 bp, Homo sapiens
gcccggacacggacaggattgacagattg

SEQ ID NO: 15220 - DNA, 30 bp, Homo sapiens
gcccggacacggacaggattgacagattga

SEQ ID NO: 15221 - DNA, 31 bp, Homo sapiens
gcccggacacggacaggattgacagattgat

SEQ ID NO: 15222 - DNA, 32 bp, Homo sapiens
gcccggacacggacaggattgacagattgata

SEQ ID NO: 15223 - DNA, 22 bp, Homo sapiens
cccggacacggacaggattgac

SEQ ID NO: 15224 - DNA, 23 bp, Homo sapiens
cccggacacggacaggattgaca

SEQ ID NO: 15225 - DNA, 25 bp, Homo sapiens
cccggacacggacaggattgacaga

SEQ ID NO: 15226 - DNA, 27 bp, Homo sapiens
cccggacacggacaggattgacagatt

SEQ ID NO: 15227 - DNA, 29 bp, Homo sapiens
cccggacacggacaggattgacagattga

SEQ ID NO: 15228 - DNA, 33 bp, Homo sapiens
cccggacacggacaggattgacagattgatagc

SEQ ID NO: 15229 - DNA, 21 bp, Homo sapiens
ccggacacggacaggattgac

SEQ ID NO: 15230 - DNA, 22 bp, Homo sapiens
ccggacacggacaggattgaca

SEQ ID NO: 15231 - DNA, 23 bp, Homo sapiens
ccggacacggacaggattgacag

SEQ ID NO: 15232 - DNA, 24 bp, Homo sapiens
ccggacacggacaggattgacaga

SEQ ID NO: 15233 - DNA, 25 bp, Homo sapiens
ccggacacggacaggattgacagat

SEQ ID NO: 15234 - DNA, 26 bp, Homo sapiens
ccggacacggacaggattgacagatt

SEQ ID NO: 15235 - DNA, 27 bp, Homo sapiens
ccggacacggacaggattgacagattg

SEQ ID NO: 15236 - DNA, 28 bp, Homo sapiens
ccggacacggacaggattgacagattga

SEQ ID NO: 15237 - DNA, 29 bp, Homo sapiens
ccggacacggacaggattgacagattgat

SEQ ID NO: 15238 - DNA, 32 bp, Homo sapiens; identical to SEQ ID NO: 2897

SEQ ID NO: 15239 - DNA, 33 bp, Homo sapiens; identical to SEQ ID NO: 2898

SEQ ID NO: 15240 - DNA, 38 bp, Homo sapiens
ccggacacggacaggattgacagattgatagctctttc

SEQ ID NO: 15241 - DNA, 45 bp, Homo sapiens
ccggacacggacaggattgacagattgatagctctttctcgattc

SEQ ID NO: 15242 - DNA, 20 bp, Homo sapiens
cggacacggacaggattgac

SEQ ID NO: 15243 - DNA, 21 bp, Homo sapiens
cggacacggacaggattgaca

SEQ ID NO: 15244 - DNA, 22 bp, Homo sapiens
cggacacggacaggattgacag

SEQ ID NO: 15245 - DNA, 23 bp, Homo sapiens
cggacacggacaggattgacaga

SEQ ID NO: 15246 - DNA, 24 bp, Homo sapiens
cggacacggacaggattgacagat

SEQ ID NO: 15247 - DNA, 25 bp, Homo sapiens
cggacacggacaggattgacagatt

SEQ ID NO: 15248 - DNA, 26 bp, Homo sapiens
cggacacggacaggattgacagattg

SEQ ID NO: 15249 - DNA, 27 bp, Homo sapiens
cggacacggacaggattgacagattga

SEQ ID NO: 15250 - DNA, 28 bp, Homo sapiens
cggacacggacaggattgacagattgat

SEQ ID NO: 15251 - DNA, 29 bp, Homo sapiens
cggacacggacaggattgacagattgata

SEQ ID NO: 15252 - DNA, 31 bp, Homo sapiens
cggacacggacaggattgacagattgatagc

SEQ ID NO: 15253 - DNA, 32 bp, Homo sapiens; identical to SEQ ID NO: 2907

SEQ ID NO: 15254 - DNA, 33 bp, Homo sapiens
cggacacggacaggattgacagattgatagctc

SEQ ID NO: 15255 - DNA, 17 bp, Homo sapiens
ggacacggacaggattg

SEQ ID NO: 15256 - DNA, 19 bp, Homo sapiens
ggacacggacaggattgac

SEQ ID NO: 15257 - DNA, 20 bp, Homo sapiens
ggacacggacaggattgaca

SEQ ID NO: 15258 - DNA, 21 bp, Homo sapiens
ggacacggacaggattgacag

SEQ ID NO: 15259 - DNA, 22 bp, Homo sapiens
ggacacggacaggattgacaga

SEQ ID NO: 15260 - DNA, 23 bp, Homo sapiens
ggacacggacaggattgacagat

SEQ ID NO: 15261 - DNA, 24 bp, Homo sapiens
ggacacggacaggattgacagatt

SEQ ID NO: 15262 - DNA, 25 bp, Homo sapiens
ggacacggacaggattgacagattg

SEQ ID NO: 15263 - DNA, 26 bp, Homo sapiens
ggacacggacaggattgacagattga

SEQ ID NO: 15264 - DNA, 27 bp, Homo sapiens
ggacacggacaggattgacagattgat

SEQ ID NO: 15265 - DNA, 28 bp, Homo sapiens
ggacacggacaggattgacagattgata

SEQ ID NO: 15266 - DNA, 31 bp, Homo sapiens; identical to SEQ ID NO: 2915

SEQ ID NO: 15267 - DNA, 32 bp, Homo sapiens
ggacacggacaggattgacagattgatagctc

SEQ ID NO: 15268 - DNA, 33 bp, Homo sapiens
ggacacggacaggattgacagattgatagctct

SEQ ID NO: 15269 - DNA, 18 bp, Homo sapiens
gacacggacaggattgac

SEQ ID NO: 15270 - DNA, 19 bp, Homo sapiens
gacacggacaggattgaca

SEQ ID NO: 15271 - DNA, 20 bp, Homo sapiens
gacacggacaggattgacag

SEQ ID NO: 15272 - DNA, 21 bp, Homo sapiens
gacacggacaggattgacaga

SEQ ID NO: 15273 - DNA, 22 bp, Homo sapiens
gacacggacaggattgacagat

SEQ ID NO: 15274 - DNA, 23 bp, Homo sapiens
gacacggacaggattgacagatt

SEQ ID NO: 15275 - DNA, 24 bp, Homo sapiens
gacacggacaggattgacagattg

SEQ ID NO: 15276 - DNA, 25 bp, Homo sapiens
gacacggacaggattgacagattga

SEQ ID NO: 15277 - DNA, 26 bp, Homo sapiens
gacacggacaggattgacagattgat

SEQ ID NO: 15278 - DNA, 27 bp, Homo sapiens
gacacggacaggattgacagattgata

SEQ ID NO: 15279 - DNA, 29 bp, Homo sapiens
gacacggacaggattgacagattgatagc

SEQ ID NO: 15280 - DNA, 30 bp, Homo sapiens; identical to SEQ ID NO: 2921

SEQ ID NO: 15281 - DNA, 31 bp, Homo sapiens; identical to SEQ ID NO: 2922

SEQ ID NO: 15282 - DNA, 32 bp, Homo sapiens; identical to SEQ ID NO: 2923

SEQ ID NO: 15283 - DNA, 34 bp, Homo sapiens
gacacggacaggattgacagattgatagctcttt

SEQ ID NO: 15284 - DNA, 17 bp, Homo sapiens
acacggacaggattgac

SEQ ID NO: 15285 - DNA, 18 bp, Homo sapiens
acacggacaggattgaca

SEQ ID NO: 15286 - DNA, 19 bp, Homo sapiens
acacggacaggattgacag

SEQ ID NO: 15287 - DNA, 20 bp, Homo sapiens
acacggacaggattgacaga

SEQ ID NO: 15288 - DNA, 21 bp, Homo sapiens
acacggacaggattgacagat

SEQ ID NO: 15289 - DNA, 22 bp, Homo sapiens
acacggacaggattgacagatt

SEQ ID NO: 15290 - DNA, 23 bp, Homo sapiens
acacggacaggattgacagattg

SEQ ID NO: 15291 - DNA, 24 bp, Homo sapiens
acacggacaggattgacagattga

SEQ ID NO: 15292 - DNA, 25 bp, Homo sapiens
acacggacaggattgacagattgat

SEQ ID NO: 15293 - DNA, 26 bp, Homo sapiens
acacggacaggattgacagattgata

SEQ ID NO: 15294 - DNA, 28 bp, Homo sapiens
acacggacaggattgacagattgatagc

SEQ ID NO: 15295 - DNA, 29 bp, Homo sapiens
acacggacaggattgacagattgatagct

SEQ ID NO: 15296 - DNA, 30 bp, Homo sapiens
acacggacaggattgacagattgatagctc

SEQ ID NO: 15297 - DNA, 31 bp, Homo sapiens
acacggacaggattgacagattgatagctct

SEQ ID NO: 15298 - DNA, 33 bp, Homo sapiens; identical to SEQ ID NO: 2932

SEQ ID NO: 15299 - DNA, 16 bp, Homo sapiens
cacggacaggattgac

SEQ ID NO: 15300 - DNA, 17 bp, Homo sapiens
cacggacaggattgaca

SEQ ID NO: 15301 - DNA, 18 bp, Homo sapiens
cacggacaggattgacag

SEQ ID NO: 15302 - DNA, 19 bp, Homo sapiens
cacggacaggattgacaga

SEQ ID NO: 15303 - DNA, 20 bp, Homo sapiens
cacggacaggattgacagat

SEQ ID NO: 15304 - DNA, 21 bp, Homo sapiens
cacggacaggattgacagatt

SEQ ID NO: 15305 - DNA, 22 bp, Homo sapiens
cacggacaggattgacagattg

SEQ ID NO: 15306 - DNA, 23 bp, Homo sapiens
cacggacaggattgacagattga

SEQ ID NO: 15307 - DNA, 24 bp, Homo sapiens
cacggacaggattgacagattgat

SEQ ID NO: 15308 - DNA, 25 bp, Homo sapiens
cacggacaggattgacagattgata

SEQ ID NO: 15309 - DNA, 27 bp, Homo sapiens
cacggacaggattgacagattgatagc

SEQ ID NO: 15310 - DNA, 28 bp, Homo sapiens
cacggacaggattgacagattgatagct

SEQ ID NO: 15311 - DNA, 29 bp, Homo sapiens
cacggacaggattgacagattgatagctc

SEQ ID NO: 15312 - DNA, 30 bp, Homo sapiens
cacggacaggattgacagattgatagctct

SEQ ID NO: 15313 - DNA, 32 bp, Homo sapiens
cacggacaggattgacagattgatagctcttt

SEQ ID NO: 15314 - DNA, 33 bp, Homo sapiens
cacggacaggattgacagattgatagctctttc

SEQ ID NO: 15315 - DNA, 34 bp, Homo sapiens
cacggacaggattgacagattgatagctctttct

SEQ ID NO: 15316 - DNA, 40 bp, Homo sapiens
cacggacaggattgacagattgatagctctttctcgattc

SEQ ID NO: 15317 - DNA, 41 bp, Homo sapiens
cacggacaggattgacagattgatagctctttctcgattcc

SEQ ID NO: 15318 - DNA, 16 bp, Homo sapiens
acggacaggattgaca

SEQ ID NO: 15319 - DNA, 17 bp, Homo sapiens
acggacaggattgacag

SEQ ID NO: 15320 - DNA, 18 bp, Homo sapiens
acggacaggattgacaga

SEQ ID NO: 15321 - DNA, 19 bp, Homo sapiens
acggacaggattgacagat

SEQ ID NO: 15322 - DNA, 20 bp, Homo sapiens
acggacaggattgacagatt

SEQ ID NO: 15323 - DNA, 21 bp, Homo sapiens
acggacaggattgacagattg

SEQ ID NO: 15324 - DNA, 22 bp, Homo sapiens
acggacaggattgacagattga

SEQ ID NO: 15325 - DNA, 23 bp, Homo sapiens
acggacaggattgacagattgat

SEQ ID NO: 15326 - DNA, 26 bp, Homo sapiens
acggacaggattgacagattgatagc

SEQ ID NO: 15327 - DNA, 27 bp, Homo sapiens
acggacaggattgacagattgatagct

SEQ ID NO: 15328 - DNA, 28 bp, Homo sapiens
acggacaggattgacagattgatagctc

SEQ ID NO: 15329 - DNA, 29 bp, Homo sapiens
acggacaggattgacagattgatagctct

SEQ ID NO: 15330 - DNA, 31 bp, Homo sapiens; identical to SEQ ID NO: 2944

SEQ ID NO: 15331 - DNA, 32 bp, Homo sapiens
acggacaggattgacagattgatagctctttc

SEQ ID NO: 15332 - DNA, 33 bp, Homo sapiens; identical to SEQ ID NO: 2945

SEQ ID NO: 15333 - DNA, 39 bp, Homo sapiens
acggacaggattgacagattgatagctctttctcgattc

SEQ ID NO: 15334 - DNA, 16 bp, Homo sapiens
cggacaggattgacag

SEQ ID NO: 15335 - DNA, 17 bp, Homo sapiens
cggacaggattgacaga

SEQ ID NO: 15336 - DNA, 18 bp, Homo sapiens
cggacaggattgacagat

SEQ ID NO: 15337 - DNA, 19 bp, Homo sapiens
cggacaggattgacagatt

SEQ ID NO: 15338 - DNA, 20 bp, Homo sapiens
cggacaggattgacagattg

SEQ ID NO: 15339 - DNA, 21 bp, Homo sapiens
cggacaggattgacagattga

SEQ ID NO: 15340 - DNA, 22 bp, Homo sapiens
cggacaggattgacagattgat

SEQ ID NO: 15341 - DNA, 23 bp, Homo sapiens
cggacaggattgacagattgata

SEQ ID NO: 15342 - DNA, 24 bp, Homo sapiens
cggacaggattgacagattgatag

SEQ ID NO: 15343 - DNA, 25 bp, Homo sapiens
cggacaggattgacagattgatagc

SEQ ID NO: 15344 - DNA, 26 bp, Homo sapiens
cggacaggattgacagattgatagct

SEQ ID NO: 15345 - DNA, 27 bp, Homo sapiens
cggacaggattgacagattgatagctc

SEQ ID NO: 15346 - DNA, 28 bp, Homo sapiens
cggacaggattgacagattgatagctct

SEQ ID NO: 15347 - DNA, 30 bp, Homo sapiens; identical to SEQ ID NO: 2956

SEQ ID NO: 15348 - DNA, 31 bp, Homo sapiens
cggacaggattgacagattgatagctctttc

SEQ ID NO: 15349 - DNA, 32 bp, Homo sapiens; identical to SEQ ID NO: 2957

SEQ ID NO: 15350 - DNA, 33 bp, Homo sapiens
cggacaggattgacagattgatagctctttctc

SEQ ID NO: 15351 - DNA, 16 bp, Homo sapiens
ggacaggattgacaga

SEQ ID NO: 15352 - DNA, 17 bp, Homo sapiens
ggacaggattgacagat

SEQ ID NO: 15353 - DNA, 18 bp, Homo sapiens
ggacaggattgacagatt

SEQ ID NO: 15354 - DNA, 19 bp, Homo sapiens
ggacaggattgacagattg

SEQ ID NO: 15355 - DNA, 20 bp, Homo sapiens
ggacaggattgacagattga

SEQ ID NO: 15356 - DNA, 21 bp, Homo sapiens
ggacaggattgacagattgat

SEQ ID NO: 15357 - DNA, 22 bp, Homo sapiens
ggacaggattgacagattgata

SEQ ID NO: 15358 - DNA, 24 bp, Homo sapiens
ggacaggattgacagattgatagc

SEQ ID NO: 15359 - DNA, 25 bp, Homo sapiens
ggacaggattgacagattgatagct

SEQ ID NO: 15360 - DNA, 26 bp, Homo sapiens
ggacaggattgacagattgatagctc

SEQ ID NO: 15361 - DNA, 27 bp, Homo sapiens
ggacaggattgacagattgatagctct

SEQ ID NO: 15362 - DNA, 28 bp, Homo sapiens
ggacaggattgacagattgatagctctt

SEQ ID NO: 15363 - DNA, 29 bp, Homo sapiens
ggacaggattgacagattgatagctcttt

SEQ ID NO: 15364 - DNA, 30 bp, Homo sapiens
ggacaggattgacagattgatagctctttc

SEQ ID NO: 15365 - DNA, 31 bp, Homo sapiens; identical to SEQ ID NO: 2964

SEQ ID NO: 15366 - DNA, 32 bp, Homo sapiens
ggacaggattgacagattgatagctctttctc

SEQ ID NO: 15367 - DNA, 33 bp, Homo sapiens
ggacaggattgacagattgatagctctttctcg

SEQ ID NO: 15368 - DNA, 36 bp, Homo sapiens
ggacaggattgacagattgatagctctttctcgatt

SEQ ID NO: 15369 - DNA, 16 bp, Homo sapiens
gacaggattgacagat

SEQ ID NO: 15370 - DNA, 17 bp, Homo sapiens
gacaggattgacagatt

SEQ ID NO: 15371 - DNA, 18 bp, Homo sapiens
gacaggattgacagattg

SEQ ID NO: 15372 - DNA, 19 bp, Homo sapiens
gacaggattgacagattga

SEQ ID NO: 15373 - DNA, 20 bp, Homo sapiens
gacaggattgacagattgat

SEQ ID NO: 15374 - DNA, 23 bp, Homo sapiens
gacaggattgacagattgatagc

SEQ ID NO: 15375 - DNA, 24 bp, Homo sapiens
gacaggattgacagattgatagct

SEQ ID NO: 15376 - DNA, 25 bp, Homo sapiens
gacaggattgacagattgatagctc

SEQ ID NO: 15377 - DNA, 26 bp, Homo sapiens
gacaggattgacagattgatagctct

SEQ ID NO: 15378 - DNA, 28 bp, Homo sapiens
gacaggattgacagattgatagctcttt

SEQ ID NO: 15379 - DNA, 29 bp, Homo sapiens
gacaggattgacagattgatagctctttc

SEQ ID NO: 15380 - DNA, 30 bp, Homo sapiens; identical to SEQ ID NO: 2972

SEQ ID NO: 15381 - DNA, 31 bp, Homo sapiens
gacaggattgacagattgatagctctttctc

SEQ ID NO: 15382 - DNA, 32 bp, Homo sapiens
gacaggattgacagattgatagctctttctcg

SEQ ID NO: 15383 - DNA, 35 bp, Homo sapiens
gacaggattgacagattgatagctctttctcgatt

SEQ ID NO: 15384 - DNA, 16 bp, Homo sapiens
acaggattgacagatt

SEQ ID NO: 15385 - DNA, 18 bp, Homo sapiens
acaggattgacagattga

SEQ ID NO: 15386 - DNA, 19 bp, Homo sapiens
acaggattgacagattgat

SEQ ID NO: 15387 - DNA, 20 bp, Homo sapiens
acaggattgacagattgata

SEQ ID NO: 15388 - DNA, 23 bp, Homo sapiens
acaggattgacagattgatagct

SEQ ID NO: 15389 - DNA, 24 bp, Homo sapiens
acaggattgacagattgatagctc

SEQ ID NO: 15390 - DNA, 25 bp, Homo sapiens
acaggattgacagattgatagctct

SEQ ID NO: 15391 - DNA, 27 bp, Homo sapiens
acaggattgacagattgatagctcttt

SEQ ID NO: 15392 - DNA, 17 bp, Homo sapiens
caggattgacagattga

SEQ ID NO: 15393 - DNA, 18 bp, Homo sapiens
caggattgacagattgat

SEQ ID NO: 15394 - DNA, 19 bp, Homo sapiens
caggattgacagattgata

SEQ ID NO: 15395 - DNA, 21 bp, Homo sapiens
caggattgacagattgatagc

SEQ ID NO: 15396 - DNA, 22 bp, Homo sapiens
caggattgacagattgatagct

SEQ ID NO: 15397 - DNA, 23 bp, Homo sapiens
caggattgacagattgatagctc

SEQ ID NO: 15398 - DNA, 24 bp, Homo sapiens
caggattgacagattgatagctct

SEQ ID NO: 15399 - DNA, 21 bp, Homo sapiens
aggattgacagattgatagct

SEQ ID NO: 15400 - DNA, 22 bp, Homo sapiens
aggattgacagattgatagctc

SEQ ID NO: 15401 - DNA, 23 bp, Homo sapiens
aggattgacagattgatagctct

SEQ ID NO: 15402 - DNA, 25 bp, Homo sapiens
aggattgacagattgatagctcttt

SEQ ID NO: 15403 - DNA, 20 bp, Homo sapiens
ggattgacagattgatagct

SEQ ID NO: 15404 - DNA, 21 bp, Homo sapiens
ggattgacagattgatagctc

SEQ ID NO: 15405 - DNA, 24 bp, Homo sapiens
ggattgacagattgatagctcttt

SEQ ID NO: 15406 - DNA, 19 bp, Homo sapiens
gattgacagattgatagct

SEQ ID NO: 15407 - DNA, 20 bp, Homo sapiens
gattgacagattgatagctc

SEQ ID NO: 15408 - DNA, 23 bp, Homo sapiens
gattgacagattgatagctcttt

SEQ ID NO: 15409 - DNA, 30 bp, Homo sapiens
gattgacagattgatagctctttctcgatt

SEQ ID NO: 15410 - DNA, 33 bp, Homo sapiens
gattgacagattgatagctctttctcgattccg

SEQ ID NO: 15411 - DNA, 18 bp, Homo sapiens
attgacagattgatagct

SEQ ID NO: 15412 - DNA, 19 bp, Homo sapiens
attgacagattgatagctc

SEQ ID NO: 15413 - DNA, 23 bp, Homo sapiens
attgacagattgatagctctttc

SEQ ID NO: 15414 - DNA, 29 bp, Homo sapiens
attgacagattgatagctctttctcgatt

SEQ ID NO: 15415 - DNA, 31 bp, Homo sapiens
attgacagattgatagctctttctcgattcc

SEQ ID NO: 15416 - DNA, 32 bp, Homo sapiens
attgacagattgatagctctttctcgattccg

SEQ ID NO: 15417 - DNA, 16 bp, Homo sapiens
ttgacagattgatagc

SEQ ID NO: 15418 - DNA, 17 bp, Homo sapiens
ttgacagattgatagct

SEQ ID NO: 15419 - DNA, 18 bp, Homo sapiens
ttgacagattgatagctc

SEQ ID NO: 15420 - DNA, 22 bp, Homo sapiens
ttgacagattgatagctctttc

SEQ ID NO: 15421 - DNA, 28 bp, Homo sapiens
ttgacagattgatagctctttctcgatt

SEQ ID NO: 15422 - DNA, 21 bp, Homo sapiens
gacagattgatagctctttct

SEQ ID NO: 15423 - DNA, 18 bp, Homo sapiens
cagattgatagctctttc

SEQ ID NO: 15424 - DNA, 31 bp, Homo sapiens
cagattgatagctctttctcgattccgtggg

SEQ ID NO: 15425 - DNA, 32 bp, Homo sapiens
cagattgatagctctttctcgattccgtgggt

SEQ ID NO: 15426 - DNA, 33 bp, Homo sapiens
cagattgatagctctttctcgattccgtgggtg

SEQ ID NO: 15427 - DNA, 17 bp, Homo sapiens
agattgatagctctttc

SEQ ID NO: 15428 - DNA, 33 bp, Homo sapiens; identical to SEQ ID NO: 2976

SEQ ID NO: 15429 - DNA, 18 bp, Homo sapiens
ttgatagctctttctcga

SEQ ID NO: 15430 - DNA, 33 bp, Homo sapiens
tagctctttctcgattccgtgggtggtggtgca

SEQ ID NO: 15431 - DNA, 32 bp, Homo sapiens
ctttctcgattccgtgggtggtggtgcatggc

SEQ ID NO: 15432 - DNA, 33 bp, Homo sapiens
ctttctcgattccgtgggtggtggtgcatggcc

SEQ ID NO: 15433 - DNA, 32 bp, Homo sapiens
cgattccgtgggtggtggtgcatggccgttct

SEQ ID NO: 15434 - DNA, 29 bp, Homo sapiens
attccgtgggtggtggtgcatggccgttc

SEQ ID NO: 15435 - DNA, 30 bp, Homo sapiens
attccgtgggtggtggtgcatggccgttct

SEQ ID NO: 15436 - DNA, 19 bp, Homo sapiens
ttccgtgggtggtggtgca

SEQ ID NO: 15437 - DNA, 31 bp, Homo sapiens
ttccgtgggtggtggtgcatggccgttctta

SEQ ID NO: 15438 - DNA, 33 bp, Homo sapiens
ttccgtgggtggtggtgcatggccgttcttagt

SEQ ID NO: 15439 - DNA, 33 bp, Homo sapiens; identical to SEQ ID NO: 2977

SEQ ID NO: 15440 - DNA, 32 bp, Homo sapiens
gtgggtggtggtgcatggccgttcttagttgg

SEQ ID NO: 15441 - DNA, 27 bp, Homo sapiens
gtggtgcatggccgttcttagttggtg

SEQ ID NO: 15442 - DNA, 21 bp, Homo sapiens
catggccgttcttagttggtg

SEQ ID NO: 15443 - DNA, 33 bp, Homo sapiens
catggccgttcttagttggtggagcgatttgtc

SEQ ID NO: 15444 - DNA, 19 bp, Homo sapiens
tggccgttcttagttggtg

SEQ ID NO: 15445 - DNA, 21 bp, Homo sapiens
tggccgttcttagttggtgga

SEQ ID NO: 15446 - DNA, 17 bp, Homo sapiens
gccgttcttagttggtg

SEQ ID NO: 15447 - DNA, 19 bp, Homo sapiens
cgttcttagttggtggagc

SEQ ID NO: 15448 - DNA, 27 bp, Homo sapiens
gttcttagttggtggagcgatttgtct

SEQ ID NO: 15449 - DNA, 23 bp, Homo sapiens
ttagttggtggagcgatttgtct

SEQ ID NO: 15450 - DNA, 31 bp, Homo sapiens
ttagttggtggagcgatttgtctggttaatt

SEQ ID NO: 15451 - DNA, 32 bp, Homo sapiens
ttagttggtggagcgatttgtctggttaattc

SEQ ID NO: 15452 - DNA, 33 bp, Homo sapiens
ttagttggtggagcgatttgtctggttaattcc

SEQ ID NO: 15453 - DNA, 22 bp, Homo sapiens
tagttggtggagcgatttgtct

SEQ ID NO: 15454 - DNA, 25 bp, Homo sapiens
gttggtggagcgatttgtctggtta

SEQ ID NO: 15455 - DNA, 32 bp, Homo sapiens
tggagcgatttgtctggttaattccgataacg

SEQ ID NO: 15456 - DNA, 23 bp, Homo sapiens
ggagcgatttgtctggttaattc

SEQ ID NO: 15457 - DNA, 17 bp, Homo sapiens
gagcgatttgtctggtt

SEQ ID NO: 15458 - DNA, 18 bp, Homo sapiens
gagcgatttgtctggtta

SEQ ID NO: 15459 - DNA, 22 bp, Homo sapiens
gagcgatttgtctggttaattc

SEQ ID NO: 15460 - DNA, 23 bp, Homo sapiens
gagcgatttgtctggttaattcc

SEQ ID NO: 15461 - DNA, 25 bp, Homo sapiens
gagcgatttgtctggttaattccga

SEQ ID NO: 15462 - DNA, 26 bp, Homo sapiens
gagcgatttgtctggttaattccgat

SEQ ID NO: 15463 - DNA, 30 bp, Homo sapiens
gagcgatttgtctggttaattccgataacg

SEQ ID NO: 15464 - DNA, 16 bp, Homo sapiens
agcgatttgtctggtt

SEQ ID NO: 15465 - DNA, 20 bp, Homo sapiens
agcgatttgtctggttaatt

SEQ ID NO: 15466 - DNA, 21 bp, Homo sapiens
agcgatttgtctggttaattc

SEQ ID NO: 15467 - DNA, 24 bp, Homo sapiens
agcgatttgtctggttaattccga

SEQ ID NO: 15468 - DNA, 29 bp, Homo sapiens
agcgatttgtctggttaattccgataacg

SEQ ID NO: 15469 - DNA, 16 bp, Homo sapiens
gcgatttgtctggtta

SEQ ID NO: 15470 - DNA, 17 bp, Homo sapiens
gcgatttgtctggttaa

SEQ ID NO: 15471 - DNA, 20 bp, Homo sapiens
gcgatttgtctggttaattc

SEQ ID NO: 15472 - DNA, 23 bp, Homo sapiens
gcgatttgtctggttaattccga

SEQ ID NO: 15473 - DNA, 25 bp, Homo sapiens
gcgatttgtctggttaattccgata

SEQ ID NO: 15474 - DNA, 19 bp, Homo sapiens
cgatttgtctggttaattc

SEQ ID NO: 15475 - DNA, 20 bp, Homo sapiens
cgatttgtctggttaattcc

SEQ ID NO: 15476 - DNA, 42 bp, Homo sapiens
cgatttgtctggttaattccgataacgaacgagactctggca

SEQ ID NO: 15477 - DNA, 17 bp, Homo sapiens
gatttgtctggttaatt

SEQ ID NO: 15478 - DNA, 18 bp, Homo sapiens
gatttgtctggttaattc

SEQ ID NO: 15479 - DNA, 19 bp, Homo sapiens
gatttgtctggttaattcc

SEQ ID NO: 15480 - DNA, 41 bp, Homo sapiens
gatttgtctggttaattccgataacgaacgagactctggca

SEQ ID NO: 15481 - DNA, 16 bp, Homo sapiens
atttgtctggttaatt

SEQ ID NO: 15482 - DNA, 17 bp, Homo sapiens
atttgtctggttaattc

SEQ ID NO: 15483 - DNA, 18 bp, Homo sapiens
atttgtctggttaattcc

SEQ ID NO: 15484 - DNA, 20 bp, Homo sapiens
atttgtctggttaattccga

SEQ ID NO: 15485 - DNA, 33 bp, Homo sapiens
atttgtctggttaattccgataacgaacgagac

SEQ ID NO: 15486 - DNA, 39 bp, Homo sapiens
atttgtctggttaattccgataacgaacgagactctggc

SEQ ID NO: 15487 - DNA, 40 bp, Homo sapiens
atttgtctggttaattccgataacgaacgagactctggca

SEQ ID NO: 15488 - DNA, 44 bp, Homo sapiens
atttgtctggttaattccgataacgaacgagactctggcatgct

SEQ ID NO: 15489 - DNA, 17 bp, Homo sapiens
tttgtctggttaattcc

SEQ ID NO: 15490 - DNA, 19 bp, Homo sapiens
tttgtctggttaattccga

SEQ ID NO: 15491 - DNA, 21 bp, Homo sapiens
tttgtctggttaattccgata

SEQ ID NO: 15492 - DNA, 31 bp, Homo sapiens
tttgtctggttaattccgataacgaacgaga

SEQ ID NO: 15493 - DNA, 33 bp, Homo sapiens; identical to SEQ ID NO: 2982

SEQ ID NO: 15494 - DNA, 42 bp, Homo sapiens
ttgtctggttaattccgataacgaacgagactctggcatgct

SEQ ID NO: 15495 - DNA, 36 bp, Homo sapiens
tgtctggttaattccgataacgaacgagactctggc

SEQ ID NO: 15496 - DNA, 39 bp, Homo sapiens
tgtctggttaattccgataacgaacgagactctggcatg

SEQ ID NO: 15497 - DNA, 41 bp, Homo sapiens
tgtctggttaattccgataacgaacgagactctggcatgct

SEQ ID NO: 15498 - DNA, 30 bp, Homo sapiens
gtctggttaattccgataacgaacgagact

SEQ ID NO: 15499 - DNA, 36 bp, Homo sapiens
gtctggttaattccgataacgaacgagactctggca

SEQ ID NO: 15500 - DNA, 38 bp, Homo sapiens
gtctggttaattccgataacgaacgagactctggcatg

SEQ ID NO: 15501 - DNA, 40 bp, Homo sapiens
gtctggttaattccgataacgaacgagactctggcatgct

SEQ ID NO: 15502 - DNA, 44 bp, Homo sapiens
gtctggttaattccgataacgaacgagactctggcatgctaact

SEQ ID NO: 15503 - DNA, 35 bp, Homo sapiens
tctggttaattccgataacgaacgagactctggca

SEQ ID NO: 15504 - DNA, 37 bp, Homo sapiens
tctggttaattccgataacgaacgagactctggcatg

SEQ ID NO: 15505 - DNA, 39 bp, Homo sapiens
tctggttaattccgataacgaacgagactctggcatgct

SEQ ID NO: 15506 - DNA, 33 bp, Homo sapiens
ctggttaattccgataacgaacgagactctggc

SEQ ID NO: 15507 - DNA, 38 bp, Homo sapiens
ctggttaattccgataacgaacgagactctggcatgct

SEQ ID NO: 15508 - DNA, 32 bp, Homo sapiens
tggttaattccgataacgaacgagactctggc

SEQ ID NO: 15509 - DNA, 33 bp, Homo sapiens; identical to SEQ ID NO: 2983

SEQ ID NO: 15510 - DNA, 34 bp, Homo sapiens
tggttaattccgataacgaacgagactctggcat

SEQ ID NO: 15511 - DNA, 35 bp, Homo sapiens
tggttaattccgataacgaacgagactctggcatg

SEQ ID NO: 15512 - DNA, 36 bp, Homo sapiens
tggttaattccgataacgaacgagactctggcatgc

SEQ ID NO: 15513 - DNA, 37 bp, Homo sapiens
tggttaattccgataacgaacgagactctggcatgct

SEQ ID NO: 15514 - DNA, 40 bp, Homo sapiens
tggttaattccgataacgaacgagactctggcatgctaac

SEQ ID NO: 15515 - DNA, 24 bp, Homo sapiens
ggttaattccgataacgaacgaga

SEQ ID NO: 15516 - DNA, 25 bp, Homo sapiens
ggttaattccgataacgaacgagac

SEQ ID NO: 15517 - DNA, 26 bp, Homo sapiens
ggttaattccgataacgaacgagact

SEQ ID NO: 15518 - DNA, 27 bp, Homo sapiens
ggttaattccgataacgaacgagactc

SEQ ID NO: 15519 - DNA, 28 bp, Homo sapiens
ggttaattccgataacgaacgagactct

SEQ ID NO: 15520 - DNA, 29 bp, Homo sapiens
ggttaattccgataacgaacgagactctg

SEQ ID NO: 15521 - DNA, 30 bp, Homo sapiens
ggttaattccgataacgaacgagactctgg

SEQ ID NO: 15522 - DNA, 31 bp, Homo sapiens; identical to SEQ ID NO: 2988

SEQ ID NO: 15523 - DNA, 32 bp, Homo sapiens; identical to SEQ ID NO: 2989

SEQ ID NO: 15524 - DNA, 33 bp, Homo sapiens; identical to SEQ ID NO: 2990

SEQ ID NO: 15525 - DNA, 34 bp, Homo sapiens
ggttaattccgataacgaacgagactctggcatg

SEQ ID NO: 15526 - DNA, 35 bp, Homo sapiens
ggttaattccgataacgaacgagactctggcatgc

SEQ ID NO: 15527 - DNA, 36 bp, Homo sapiens
ggttaattccgataacgaacgagactctggcatgct

SEQ ID NO: 15528 - DNA, 37 bp, Homo sapiens
ggttaattccgataacgaacgagactctggcatgcta

SEQ ID NO: 15529 - DNA, 38 bp, Homo sapiens
ggttaattccgataacgaacgagactctggcatgctaa

SEQ ID NO: 15530 - DNA, 39 bp, Homo sapiens
ggttaattccgataacgaacgagactctggcatgctaac

SEQ ID NO: 15531 - DNA, 40 bp, Homo sapiens
ggttaattccgataacgaacgagactctggcatgctaact

SEQ ID NO: 15532 - DNA, 41 bp, Homo sapiens
ggttaattccgataacgaacgagactctggcatgctaacta

SEQ ID NO: 15533 - DNA, 44 bp, Homo sapiens
ggttaattccgataacgaacgagactctggcatgctaactagtt

SEQ ID NO: 15534 - DNA, 24 bp, Homo sapiens
gttaattccgataacgaacgagac

SEQ ID NO: 15535 - DNA, 25 bp, Homo sapiens
gttaattccgataacgaacgagact

SEQ ID NO: 15536 - DNA, 30 bp, Homo sapiens; identical to SEQ ID NO: 2991

SEQ ID NO: 15537 - DNA, 31 bp, Homo sapiens; identical to SEQ ID NO: 2992

SEQ ID NO: 15538 - DNA, 32 bp, Homo sapiens; identical to SEQ ID NO: 2993

SEQ ID NO: 15539 - DNA, 33 bp, Homo sapiens; identical to SEQ ID NO: 2994

SEQ ID NO: 15540 - DNA, 34 bp, Homo sapiens
gttaattccgataacgaacgagactctggcatgc

SEQ ID NO: 15541 - DNA, 35 bp, Homo sapiens
gttaattccgataacgaacgagactctggcatgct

SEQ ID NO: 15542 - DNA, 36 bp, Homo sapiens
gttaattccgataacgaacgagactctggcatgcta

SEQ ID NO: 15543 - DNA, 37 bp, Homo sapiens
gttaattccgataacgaacgagactctggcatgctaa

SEQ ID NO: 15544 - DNA, 38 bp, Homo sapiens
gttaattccgataacgaacgagactctggcatgctaac

SEQ ID NO: 15545 - DNA, 39 bp, Homo sapiens
gttaattccgataacgaacgagactctggcatgctaact

SEQ ID NO: 15546 - DNA, 40 bp, Homo sapiens
gttaattccgataacgaacgagactctggcatgctaacta

SEQ ID NO: 15547 - DNA, 41 bp, Homo sapiens
gttaattccgataacgaacgagactctggcatgctaactag

SEQ ID NO: 15548 - DNA, 43 bp, Homo sapiens
gttaattccgataacgaacgagactctggcatgctaactagtt

SEQ ID NO: 15549 - DNA, 29 bp, Homo sapiens
ttaattccgataacgaacgagactctggc

SEQ ID NO: 15550 - DNA, 30 bp, Homo sapiens; identical to SEQ ID NO: 2995

SEQ ID NO: 15551 - DNA, 31 bp, Homo sapiens; identical to SEQ ID NO: 2996

SEQ ID NO: 15552 - DNA, 32 bp, Homo sapiens; identical to SEQ ID NO: 2997

SEQ ID NO: 15553 - DNA, 33 bp, Homo sapiens; identical to SEQ ID NO: 2998

SEQ ID NO: 15554 - DNA, 34 bp, Homo sapiens
ttaattccgataacgaacgagactctggcatgct

SEQ ID NO: 15555 - DNA, 28 bp, Homo sapiens
taattccgataacgaacgagactctggc

SEQ ID NO: 15556 - DNA, 29 bp, Homo sapiens
taattccgataacgaacgagactctggca

SEQ ID NO: 15557 - DNA, 30 bp, Homo sapiens; identical to SEQ ID NO: 3001

SEQ ID NO: 15558 - DNA, 31 bp, Homo sapiens; identical to SEQ ID NO: 3002

SEQ ID NO: 15559 - DNA, 32 bp, Homo sapiens; identical to SEQ ID NO: 3003

SEQ ID NO: 15560 - DNA, 33 bp, Homo sapiens; identical to SEQ ID NO: 3004

SEQ ID NO: 15561 - DNA, 34 bp, Homo sapiens
taattccgataacgaacgagactctggcatgcta

SEQ ID NO: 15562 - DNA, 36 bp, Homo sapiens
taattccgataacgaacgagactctggcatgctaac

SEQ ID NO: 15563 - DNA, 37 bp, Homo sapiens
taattccgataacgaacgagactctggcatgctaact

SEQ ID NO: 15564 - DNA, 44 bp, Homo sapiens
taattccgataacgaacgagactctggcatgctaactagttacg

SEQ ID NO: 15565 - DNA, 24 bp, Homo sapiens
aattccgataacgaacgagactct

SEQ ID NO: 15566 - DNA, 27 bp, Homo sapiens
aattccgataacgaacgagactctggc

SEQ ID NO: 15567 - DNA, 28 bp, Homo sapiens
aattccgataacgaacgagactctggca

SEQ ID NO: 15568 - DNA, 29 bp, Homo sapiens
aattccgataacgaacgagactctggcat

SEQ ID NO: 15569 - DNA, 30 bp, Homo sapiens; identical to SEQ ID NO: 3008

SEQ ID NO: 15570 - DNA, 31 bp, Homo sapiens; identical to SEQ ID NO: 3009

SEQ ID NO: 15571 - DNA, 32 bp, Homo sapiens; identical to SEQ ID NO: 3010

SEQ ID NO: 15572 - DNA, 33 bp, Homo sapiens; identical to SEQ ID NO: 3011

SEQ ID NO: 15573 - DNA, 34 bp, Homo sapiens
aattccgataacgaacgagactctggcatgctaa

SEQ ID NO: 15574 - DNA, 35 bp, Homo sapiens
aattccgataacgaacgagactctggcatgctaac

SEQ ID NO: 15575 - DNA, 36 bp, Homo sapiens
aattccgataacgaacgagactctggcatgctaact

SEQ ID NO: 15576 - DNA, 37 bp, Homo sapiens
aattccgataacgaacgagactctggcatgctaacta

SEQ ID NO: 15577 - DNA, 40 bp, Homo sapiens
aattccgataacgaacgagactctggcatgctaactagtt

SEQ ID NO: 15578 - DNA, 41 bp, Homo sapiens
aattccgataacgaacgagactctggcatgctaactagtta

SEQ ID NO: 15579 - DNA, 42 bp, Homo sapiens
aattccgataacgaacgagactctggcatgctaactagttac

SEQ ID NO: 15580 - DNA, 43 bp, Homo sapiens
aattccgataacgaacgagactctggcatgctaactagttacg

SEQ ID NO: 15581 - DNA, 45 bp, Homo sapiens
aattccgataacgaacgagactctggcatgctaactagttacgcg

SEQ ID NO: 15582 - DNA, 17 bp, Homo sapiens
attccgataacgaacga

SEQ ID NO: 15583 - DNA, 21 bp, Homo sapiens
attccgataacgaacgagact

SEQ ID NO: 15584 - DNA, 23 bp, Homo sapiens
attccgataacgaacgagactct

SEQ ID NO: 15585 - DNA, 26 bp, Homo sapiens
attccgataacgaacgagactctggc

SEQ ID NO: 15586 - DNA, 27 bp, Homo sapiens
attccgataacgaacgagactctggca

SEQ ID NO: 15587 - DNA, 28 bp, Homo sapiens
attccgataacgaacgagactctggcat

SEQ ID NO: 15588 - DNA, 29 bp, Homo sapiens
attccgataacgaacgagactctggcatg

SEQ ID NO: 15589 - DNA, 30 bp, Homo sapiens; identical to SEQ ID NO: 3016

SEQ ID NO: 15590 - DNA, 31 bp, Homo sapiens; identical to SEQ ID NO: 3017

SEQ ID NO: 15591 - DNA, 32 bp, Homo sapiens; identical to SEQ ID NO: 3018

SEQ ID NO: 15592 - DNA, 33 bp, Homo sapiens
attccgataacgaacgagactctggcatgctaa

SEQ ID NO: 15593 - DNA, 34 bp, Homo sapiens
attccgataacgaacgagactctggcatgctaac

SEQ ID NO: 15594 - DNA, 35 bp, Homo sapiens
attccgataacgaacgagactctggcatgctaact

SEQ ID NO: 15595 - DNA, 39 bp, Homo sapiens
attccgataacgaacgagactctggcatgctaactagtt

SEQ ID NO: 15596 - DNA, 40 bp, Homo sapiens
attccgataacgaacgagactctggcatgctaactagtta

SEQ ID NO: 15597 - DNA, 41 bp, Homo sapiens
attccgataacgaacgagactctggcatgctaactagttac

SEQ ID NO: 15598 - DNA, 42 bp, Homo sapiens
attccgataacgaacgagactctggcatgctaactagttacg

SEQ ID NO: 15599 - DNA, 20 bp, Homo sapiens
ttccgataacgaacgagact

SEQ ID NO: 15600 - DNA, 22 bp, Homo sapiens
ttccgataacgaacgagactct

SEQ ID NO: 15601 - DNA, 25 bp, Homo sapiens
ttccgataacgaacgagactctggc

SEQ ID NO: 15602 - DNA, 26 bp, Homo sapiens
ttccgataacgaacgagactctggca

SEQ ID NO: 15603 - DNA, 27 bp, Homo sapiens
ttccgataacgaacgagactctggcat

SEQ ID NO: 15604 - DNA, 28 bp, Homo sapiens
ttccgataacgaacgagactctggcatg

SEQ ID NO: 15605 - DNA, 29 bp, Homo sapiens
ttccgataacgaacgagactctggcatgc

SEQ ID NO: 15606 - DNA, 30 bp, Homo sapiens; identical to SEQ ID NO: 3024

SEQ ID NO: 15607 - DNA, 31 bp, Homo sapiens; identical to SEQ ID NO: 3025

SEQ ID NO: 15608 - DNA, 32 bp, Homo sapiens
ttccgataacgaacgagactctggcatgctaa

SEQ ID NO: 15609 - DNA, 33 bp, Homo sapiens; identical to SEQ ID NO: 3026

SEQ ID NO: 15610 - DNA, 34 bp, Homo sapiens
ttccgataacgaacgagactctggcatgctaact

SEQ ID NO: 15611 - DNA, 35 bp, Homo sapiens
ttccgataacgaacgagactctggcatgctaacta

SEQ ID NO: 15612 - DNA, 38 bp, Homo sapiens
ttccgataacgaacgagactctggcatgctaactagtt

SEQ ID NO: 15613 - DNA, 39 bp, Homo sapiens
ttccgataacgaacgagactctggcatgctaactagtta

SEQ ID NO: 15614 - DNA, 24 bp, Homo sapiens
tccgataacgaacgagactctggc

SEQ ID NO: 15615 - DNA, 25 bp, Homo sapiens
tccgataacgaacgagactctggca

SEQ ID NO: 15616 - DNA, 26 bp, Homo sapiens
tccgataacgaacgagactctggcat

SEQ ID NO: 15617 - DNA, 27 bp, Homo sapiens
tccgataacgaacgagactctggcatg

SEQ ID NO: 15618 - DNA, 28 bp, Homo sapiens
tccgataacgaacgagactctggcatgc

SEQ ID NO: 15619 - DNA, 29 bp, Homo sapiens
tccgataacgaacgagactctggcatgct

SEQ ID NO: 15620 - DNA, 30 bp, Homo sapiens; identical to SEQ ID NO: 3033

SEQ ID NO: 15621 - DNA, 31 bp, Homo sapiens
tccgataacgaacgagactctggcatgctaa

SEQ ID NO: 15622 - DNA, 32 bp, Homo sapiens; identical to SEQ ID NO: 3034

SEQ ID NO: 15623 - DNA, 33 bp, Homo sapiens; identical to SEQ ID NO: 3035

SEQ ID NO: 15624 - DNA, 37 bp, Homo sapiens
tccgataacgaacgagactctggcatgctaactagtt

SEQ ID NO: 15625 - DNA, 40 bp, Homo sapiens
tccgataacgaacgagactctggcatgctaactagttacg

SEQ ID NO: 15626 - DNA, 23 bp, Homo sapiens
ccgataacgaacgagactctggc

SEQ ID NO: 15627 - DNA, 24 bp, Homo sapiens
ccgataacgaacgagactctggca

SEQ ID NO: 15628 - DNA, 25 bp, Homo sapiens
ccgataacgaacgagactctggcat

SEQ ID NO: 15629 - DNA, 26 bp, Homo sapiens
ccgataacgaacgagactctggcatg

SEQ ID NO: 15630 - DNA, 27 bp, Homo sapiens
ccgataacgaacgagactctggcatgc

SEQ ID NO: 15631 - DNA, 28 bp, Homo sapiens
ccgataacgaacgagactctggcatgct

SEQ ID NO: 15632 - DNA, 29 bp, Homo sapiens
ccgataacgaacgagactctggcatgcta

SEQ ID NO: 15633 - DNA, 30 bp, Homo sapiens
ccgataacgaacgagactctggcatgctaa

SEQ ID NO: 15634 - DNA, 31 bp, Homo sapiens; identical to SEQ ID NO: 3043

SEQ ID NO: 15635 - DNA, 32 bp, Homo sapiens; identical to SEQ ID NO: 3044

SEQ ID NO: 15636 - DNA, 33 bp, Homo sapiens; identical to SEQ ID NO: 3045

SEQ ID NO: 15637 - DNA, 36 bp, Homo sapiens
ccgataacgaacgagactctggcatgctaactagtt

SEQ ID NO: 15638 - DNA, 39 bp, Homo sapiens
ccgataacgaacgagactctggcatgctaactagttacg

SEQ ID NO: 15639 - DNA, 21 bp, Homo sapiens
cgataacgaacgagactctgg

SEQ ID NO: 15640 - DNA, 22 bp, Homo sapiens
cgataacgaacgagactctggc

SEQ ID NO: 15641 - DNA, 23 bp, Homo sapiens
cgataacgaacgagactctggca

SEQ ID NO: 15642 - DNA, 24 bp, Homo sapiens
cgataacgaacgagactctggcat

SEQ ID NO: 15643 - DNA, 25 bp, Homo sapiens
cgataacgaacgagactctggcatg

SEQ ID NO: 15644 - DNA, 26 bp, Homo sapiens
cgataacgaacgagactctggcatgc

SEQ ID NO: 15645 - DNA, 27 bp, Homo sapiens
cgataacgaacgagactctggcatgct

SEQ ID NO: 15646 - DNA, 28 bp, Homo sapiens
cgataacgaacgagactctggcatgcta

SEQ ID NO: 15647 - DNA, 29 bp, Homo sapiens
cgataacgaacgagactctggcatgctaa

SEQ ID NO: 15648 - DNA, 30 bp, Homo sapiens; identical to SEQ ID NO: 3054

SEQ ID NO: 15649 - DNA, 31 bp, Homo sapiens; identical to SEQ ID NO: 3055

SEQ ID NO: 15650 - DNA, 32 bp, Homo sapiens; identical to SEQ ID NO: 3056

SEQ ID NO: 15651 - DNA, 33 bp, Homo sapiens; identical to SEQ ID NO: 3057

SEQ ID NO: 15652 - DNA, 34 bp, Homo sapiens
cgataacgaacgagactctggcatgctaactagt

SEQ ID NO: 15653 - DNA, 35 bp, Homo sapiens
cgataacgaacgagactctggcatgctaactagtt

SEQ ID NO: 15654 - DNA, 38 bp, Homo sapiens
cgataacgaacgagactctggcatgctaactagttacg

SEQ ID NO: 15655 - DNA, 40 bp, Homo sapiens
cgataacgaacgagactctggcatgctaactagttacgcg

SEQ ID NO: 15656 - DNA, 43 bp, Homo sapiens
cgataacgaacgagactctggcatgctaactagttacgcgacc

SEQ ID NO: 15657 - DNA, 44 bp, Homo sapiens
cgataacgaacgagactctggcatgctaactagttacgcgaccc

SEQ ID NO: 15658 - DNA, 45 bp, Homo sapiens
cgataacgaacgagactctggcatgctaactagttacgcgacccc

SEQ ID NO: 15659 - DNA, 16 bp, Homo sapiens
gataacgaacgagact

SEQ ID NO: 15660 - DNA, 18 bp, Homo sapiens
gataacgaacgagactct

SEQ ID NO: 15661 - DNA, 19 bp, Homo sapiens
gataacgaacgagactctg

SEQ ID NO: 15662 - DNA, 20 bp, Homo sapiens
gataacgaacgagactctgg

SEQ ID NO: 15663 - DNA, 21 bp, Homo sapiens
gataacgaacgagactctggc

SEQ ID NO: 15664 - DNA, 22 bp, Homo sapiens
gataacgaacgagactctggca

SEQ ID NO: 15665 - DNA, 23 bp, Homo sapiens
gataacgaacgagactctggcat

SEQ ID NO: 15666 - DNA, 24 bp, Homo sapiens
gataacgaacgagactctggcatg

SEQ ID NO: 15667 - DNA, 25 bp, Homo sapiens
gataacgaacgagactctggcatgc

SEQ ID NO: 15668 - DNA, 26 bp, Homo sapiens
gataacgaacgagactctggcatgct

SEQ ID NO: 15669 - DNA, 27 bp, Homo sapiens
gataacgaacgagactctggcatgcta

SEQ ID NO: 15670 - DNA, 28 bp, Homo sapiens
gataacgaacgagactctggcatgctaa

SEQ ID NO: 15671 - DNA, 29 bp, Homo sapiens
gataacgaacgagactctggcatgctaac

SEQ ID NO: 15672 - DNA, 30 bp, Homo sapiens; identical to SEQ ID NO: 3068

SEQ ID NO: 15673 - DNA, 31 bp, Homo sapiens; identical to SEQ ID NO: 3069

SEQ ID NO: 15674 - DNA, 32 bp, Homo sapiens; identical to SEQ ID NO: 3070

SEQ ID NO: 15675 - DNA, 33 bp, Homo sapiens; identical to SEQ ID NO: 3071

SEQ ID NO: 15676 - DNA, 34 bp, Homo sapiens
gataacgaacgagactctggcatgctaactagtt

SEQ ID NO: 15677 - DNA, 35 bp, Homo sapiens
gataacgaacgagactctggcatgctaactagtta

SEQ ID NO: 15678 - DNA, 36 bp, Homo sapiens
gataacgaacgagactctggcatgctaactagttac

SEQ ID NO: 15679 - DNA, 37 bp, Homo sapiens
gataacgaacgagactctggcatgctaactagttacg

SEQ ID NO: 15680 - DNA, 39 bp, Homo sapiens
gataacgaacgagactctggcatgctaactagttacgcg

SEQ ID NO: 15681 - DNA, 40 bp, Homo sapiens
gataacgaacgagactctggcatgctaactagttacgcga

SEQ ID NO: 15682 - DNA, 41 bp, Homo sapiens
gataacgaacgagactctggcatgctaactagttacgcgac

SEQ ID NO: 15683 - DNA, 42 bp, Homo sapiens
gataacgaacgagactctggcatgctaactagttacgcgacc

SEQ ID NO: 15684 - DNA, 43 bp, Homo sapiens
gataacgaacgagactctggcatgctaactagttacgcgaccc

SEQ ID NO: 15685 - DNA, 44 bp, Homo sapiens
gataacgaacgagactctggcatgctaactagttacgcgacccc

SEQ ID NO: 15686 - DNA, 45 bp, Homo sapiens
gataacgaacgagactctggcatgctaactagttacgcgaccccc

SEQ ID NO: 15687 - DNA, 46 bp, Homo sapiens
gataacgaacgagactctggcatgctaactagttacgcgacccccg

SEQ ID NO: 15688 - DNA, 47 bp, Homo sapiens
gataacgaacgagactctggcatgctaactagttacgcgacccccga

SEQ ID NO: 15689 - DNA, 18 bp, Homo sapiens
ataacgaacgagactctg

SEQ ID NO: 15690 - DNA, 19 bp, Homo sapiens
ataacgaacgagactctgg

SEQ ID NO: 15691 - DNA, 20 bp, Homo sapiens
ataacgaacgagactctggc

SEQ ID NO: 15692 - DNA, 21 bp, Homo sapiens
ataacgaacgagactctggca

SEQ ID NO: 15693 - DNA, 22 bp, Homo sapiens
ataacgaacgagactctggcat

SEQ ID NO: 15694 - DNA, 23 bp, Homo sapiens
ataacgaacgagactctggcatg

SEQ ID NO: 15695 - DNA, 24 bp, Homo sapiens
ataacgaacgagactctggcatgc

SEQ ID NO: 15696 - DNA, 25 bp, Homo sapiens
ataacgaacgagactctggcatgct

SEQ ID NO: 15697 - DNA, 26 bp, Homo sapiens
ataacgaacgagactctggcatgcta

SEQ ID NO: 15698 - DNA, 27 bp, Homo sapiens
ataacgaacgagactctggcatgctaa

SEQ ID NO: 15699 - DNA, 28 bp, Homo sapiens
ataacgaacgagactctggcatgctaac

SEQ ID NO: 15700 - DNA, 29 bp, Homo sapiens
ataacgaacgagactctggcatgctaact

SEQ ID NO: 15701 - DNA, 30 bp, Homo sapiens; identical to SEQ ID NO: 3082

SEQ ID NO: 15702 - DNA, 31 bp, Homo sapiens; identical to SEQ ID NO: 3083

SEQ ID NO: 15703 - DNA, 32 bp, Homo sapiens; identical to SEQ ID NO: 3084

SEQ ID NO: 15704 - DNA, 33 bp, Homo sapiens; identical to SEQ ID NO: 3085

SEQ ID NO: 15705 - DNA, 34 bp, Homo sapiens
ataacgaacgagactctggcatgctaactagtta

SEQ ID NO: 15706 - DNA, 36 bp, Homo sapiens
ataacgaacgagactctggcatgctaactagttacg

SEQ ID NO: 15707 - DNA, 38 bp, Homo sapiens
ataacgaacgagactctggcatgctaactagttacgcg

SEQ ID NO: 15708 - DNA, 39 bp, Homo sapiens
ataacgaacgagactctggcatgctaactagttacgcga

SEQ ID NO: 15709 - DNA, 40 bp, Homo sapiens
ataacgaacgagactctggcatgctaactagttacgcgac

SEQ ID NO: 15710 - DNA, 41 bp, Homo sapiens
ataacgaacgagactctggcatgctaactagttacgcgacc

SEQ ID NO: 15711 - DNA, 42 bp, Homo sapiens
ataacgaacgagactctggcatgctaactagttacgcgaccc

SEQ ID NO: 15712 - DNA, 43 bp, Homo sapiens
ataacgaacgagactctggcatgctaactagttacgcgacccc

SEQ ID NO: 15713 - DNA, 44 bp, Homo sapiens
ataacgaacgagactctggcatgctaactagttacgcgaccccc

SEQ ID NO: 15714 - DNA, 45 bp, Homo sapiens
ataacgaacgagactctggcatgctaactagttacgcgacccccg

SEQ ID NO: 15715 - DNA, 46 bp, Homo sapiens
ataacgaacgagactctggcatgctaactagttacgcgacccccga

SEQ ID NO: 15716 - DNA, 47 bp, Homo sapiens
ataacgaacgagactctggcatgctaactagttacgcgacccccgag

SEQ ID NO: 15717 - DNA, 16 bp, Homo sapiens
taacgaacgagactct

SEQ ID NO: 15718 - DNA, 19 bp, Homo sapiens
taacgaacgagactctggc

SEQ ID NO: 15719 - DNA, 20 bp, Homo sapiens
taacgaacgagactctggca

SEQ ID NO: 15720 - DNA, 21 bp, Homo sapiens
taacgaacgagactctggcat

SEQ ID NO: 15721 - DNA, 22 bp, Homo sapiens
taacgaacgagactctggcatg

SEQ ID NO: 15722 - DNA, 23 bp, Homo sapiens
taacgaacgagactctggcatgc

SEQ ID NO: 15723 - DNA, 24 bp, Homo sapiens
taacgaacgagactctggcatgct

SEQ ID NO: 15724 - DNA, 25 bp, Homo sapiens
taacgaacgagactctggcatgcta

SEQ ID NO: 15725 - DNA, 26 bp, Homo sapiens
taacgaacgagactctggcatgctaa

SEQ ID NO: 15726 - DNA, 27 bp, Homo sapiens
taacgaacgagactctggcatgctaac

SEQ ID NO: 15727 - DNA, 28 bp, Homo sapiens
taacgaacgagactctggcatgctaact

SEQ ID NO: 15728 - DNA, 29 bp, Homo sapiens
taacgaacgagactctggcatgctaacta

SEQ ID NO: 15729 - DNA, 30 bp, Homo sapiens; identical to SEQ ID NO: 3096

SEQ ID NO: 15730 - DNA, 31 bp, Homo sapiens; identical to SEQ ID NO: 3097

SEQ ID NO: 15731 - DNA, 32 bp, Homo sapiens; identical to SEQ ID NO: 3098

SEQ ID NO: 15732 - DNA, 33 bp, Homo sapiens
taacgaacgagactctggcatgctaactagtta

SEQ ID NO: 15733 - DNA, 35 bp, Homo sapiens
taacgaacgagactctggcatgctaactagttacg

SEQ ID NO: 15734 - DNA, 37 bp, Homo sapiens
taacgaacgagactctggcatgctaactagttacgcg

SEQ ID NO: 15735 - DNA, 39 bp, Homo sapiens
taacgaacgagactctggcatgctaactagttacgcgac

SEQ ID NO: 15736 - DNA, 40 bp, Homo sapiens
taacgaacgagactctggcatgctaactagttacgcgacc

SEQ ID NO: 15737 - DNA, 41 bp, Homo sapiens
taacgaacgagactctggcatgctaactagttacgcgaccc

SEQ ID NO: 15738 - DNA, 42 bp, Homo sapiens
taacgaacgagactctggcatgctaactagttacgcgacccc

SEQ ID NO: 15739 - DNA, 43 bp, Homo sapiens
taacgaacgagactctggcatgctaactagttacgcgaccccc

SEQ ID NO: 15740 - DNA, 47 bp, Homo sapiens
taacgaacgagactctggcatgctaactagttacgcgacccccgagc

SEQ ID NO: 15741 - DNA, 16 bp, Homo sapiens
aacgaacgagactctg

SEQ ID NO: 15742 - DNA, 17 bp, Homo sapiens
aacgaacgagactctgg

SEQ ID NO: 15743 - DNA, 18 bp, Homo sapiens
aacgaacgagactctggc

SEQ ID NO: 15744 - DNA, 19 bp, Homo sapiens
aacgaacgagactctggca

SEQ ID NO: 15745 - DNA, 20 bp, Homo sapiens
aacgaacgagactctggcat

SEQ ID NO: 15746 - DNA, 21 bp, Homo sapiens
aacgaacgagactctggcatg

SEQ ID NO: 15747 - DNA, 22 bp, Homo sapiens
aacgaacgagactctggcatgc

SEQ ID NO: 15748 - DNA, 23 bp, Homo sapiens
aacgaacgagactctggcatgct

SEQ ID NO: 15749 - DNA, 24 bp, Homo sapiens
aacgaacgagactctggcatgcta

SEQ ID NO: 15750 - DNA, 25 bp, Homo sapiens
aacgaacgagactctggcatgctaa

SEQ ID NO: 15751 - DNA, 26 bp, Homo sapiens
aacgaacgagactctggcatgctaac

SEQ ID NO: 15752 - DNA, 27 bp, Homo sapiens
aacgaacgagactctggcatgctaact

SEQ ID NO: 15753 - DNA, 28 bp, Homo sapiens
aacgaacgagactctggcatgctaacta

SEQ ID NO: 15754 - DNA, 29 bp, Homo sapiens
aacgaacgagactctggcatgctaactag

SEQ ID NO: 15755 - DNA, 30 bp, Homo sapiens; identical to SEQ ID NO: 3111

SEQ ID NO: 15756 - DNA, 31 bp, Homo sapiens; identical to SEQ ID NO: 3112

SEQ ID NO: 15757 - DNA, 32 bp, Homo sapiens; identical to SEQ ID NO: 3113

SEQ ID NO: 15758 - DNA, 33 bp, Homo sapiens; identical to SEQ ID NO: 3114

SEQ ID NO: 15759 - DNA, 34 bp, Homo sapiens
aacgaacgagactctggcatgctaactagttacg

SEQ ID NO: 15760 - DNA, 36 bp, Homo sapiens
aacgaacgagactctggcatgctaactagttacgcg

SEQ ID NO: 15761 - DNA, 37 bp, Homo sapiens
aacgaacgagactctggcatgctaactagttacgcga

SEQ ID NO: 15762 - DNA, 38 bp, Homo sapiens
aacgaacgagactctggcatgctaactagttacgcgac

SEQ ID NO: 15763 - DNA, 39 bp, Homo sapiens
aacgaacgagactctggcatgctaactagttacgcgacc

SEQ ID NO: 15764 - DNA, 40 bp, Homo sapiens
aacgaacgagactctggcatgctaactagttacgcgaccc

SEQ ID NO: 15765 - DNA, 41 bp, Homo sapiens
aacgaacgagactctggcatgctaactagttacgcgacccc

SEQ ID NO: 15766 - DNA, 42 bp, Homo sapiens
aacgaacgagactctggcatgctaactagttacgcgaccccc

SEQ ID NO: 15767 - DNA, 43 bp, Homo sapiens
aacgaacgagactctggcatgctaactagttacgcgacccccg

SEQ ID NO: 15768 - DNA, 44 bp, Homo sapiens
aacgaacgagactctggcatgctaactagttacgcgacccccga

SEQ ID NO: 15769 - DNA, 45 bp, Homo sapiens
aacgaacgagactctggcatgctaactagttacgcgacccccgag

SEQ ID NO: 15770 - DNA, 46 bp, Homo sapiens
aacgaacgagactctggcatgctaactagttacgcgacccccgagc

SEQ ID NO: 15771 - DNA, 47 bp, Homo sapiens
aacgaacgagactctggcatgctaactagttacgcgacccccgagcg

SEQ ID NO: 15772 - DNA, 16 bp, Homo sapiens
acgaacgagactctgg

SEQ ID NO: 15773 - DNA, 17 bp, Homo sapiens
acgaacgagactctggc

SEQ ID NO: 15774 - DNA, 18 bp, Homo sapiens
acgaacgagactctggca

SEQ ID NO: 15775 - DNA, 19 bp, Homo sapiens
acgaacgagactctggcat

SEQ ID NO: 15776 - DNA, 20 bp, Homo sapiens
acgaacgagactctggcatg

SEQ ID NO: 15777 - DNA, 21 bp, Homo sapiens
acgaacgagactctggcatgc

SEQ ID NO: 15778 - DNA, 22 bp, Homo sapiens
acgaacgagactctggcatgct

SEQ ID NO: 15779 - DNA, 23 bp, Homo sapiens
acgaacgagactctggcatgcta

SEQ ID NO: 15780 - DNA, 24 bp, Homo sapiens
acgaacgagactctggcatgctaa

SEQ ID NO: 15781 - DNA, 25 bp, Homo sapiens
acgaacgagactctggcatgctaac

SEQ ID NO: 15782 - DNA, 26 bp, Homo sapiens
acgaacgagactctggcatgctaact

SEQ ID NO: 15783 - DNA, 27 bp, Homo sapiens
acgaacgagactctggcatgctaacta

SEQ ID NO: 15784 - DNA, 28 bp, Homo sapiens
acgaacgagactctggcatgctaactag

SEQ ID NO: 15785 - DNA, 29 bp, Homo sapiens
acgaacgagactctggcatgctaactagt

SEQ ID NO: 15786 - DNA, 30 bp, Homo sapiens; identical to SEQ ID NO: 3128

SEQ ID NO: 15787 - DNA, 31 bp, Homo sapiens; identical to SEQ ID NO: 3129

SEQ ID NO: 15788 - DNA, 32 bp, Homo sapiens; identical to SEQ ID NO: 3130

SEQ ID NO: 15789 - DNA, 33 bp, Homo sapiens; identical to SEQ ID NO: 3131

SEQ ID NO: 15790 - DNA, 35 bp, Homo sapiens
acgaacgagactctggcatgctaactagttacgcg

SEQ ID NO: 15791 - DNA, 36 bp, Homo sapiens
acgaacgagactctggcatgctaactagttacgcga

SEQ ID NO: 15792 - DNA, 37 bp, Homo sapiens
acgaacgagactctggcatgctaactagttacgcgac

SEQ ID NO: 15793 - DNA, 38 bp, Homo sapiens
acgaacgagactctggcatgctaactagttacgcgacc

SEQ ID NO: 15794 - DNA, 39 bp, Homo sapiens
acgaacgagactctggcatgctaactagttacgcgaccc

SEQ ID NO: 15795 - DNA, 40 bp, Homo sapiens
acgaacgagactctggcatgctaactagttacgcgacccc

SEQ ID NO: 15796 - DNA, 41 bp, Homo sapiens
acgaacgagactctggcatgctaactagttacgcgaccccc

SEQ ID NO: 15797 - DNA, 42 bp, Homo sapiens
acgaacgagactctggcatgctaactagttacgcgacccccg

SEQ ID NO: 15798 - DNA, 43 bp, Homo sapiens
acgaacgagactctggcatgctaactagttacgcgacccccga

SEQ ID NO: 15799 - DNA, 44 bp, Homo sapiens
acgaacgagactctggcatgctaactagttacgcgacccccgag

SEQ ID NO: 15800 - DNA, 45 bp, Homo sapiens
acgaacgagactctggcatgctaactagttacgcgacccccgagc

SEQ ID NO: 15801 - DNA, 46 bp, Homo sapiens
acgaacgagactctggcatgctaactagttacgcgacccccgagcg

SEQ ID NO: 15802 - DNA, 16 bp, Homo sapiens
cgaacgagactctggc

SEQ ID NO: 15803 - DNA, 17 bp, Homo sapiens
cgaacgagactctggca

SEQ ID NO: 15804 - DNA, 18 bp, Homo sapiens
cgaacgagactctggcat

SEQ ID NO: 15805 - DNA, 19 bp, Homo sapiens
cgaacgagactctggcatg

SEQ ID NO: 15806 - DNA, 20 bp, Homo sapiens
cgaacgagactctggcatgc

SEQ ID NO: 15807 - DNA, 21 bp, Homo sapiens
cgaacgagactctggcatgct

SEQ ID NO: 15808 - DNA, 22 bp, Homo sapiens
cgaacgagactctggcatgcta

SEQ ID NO: 15809 - DNA, 23 bp, Homo sapiens
cgaacgagactctggcatgctaa

SEQ ID NO: 15810 - DNA, 24 bp, Homo sapiens
cgaacgagactctggcatgctaac

SEQ ID NO: 15811 - DNA, 25 bp, Homo sapiens
cgaacgagactctggcatgctaact

SEQ ID NO: 15812 - DNA, 26 bp, Homo sapiens
cgaacgagactctggcatgctaacta

SEQ ID NO: 15813 - DNA, 27 bp, Homo sapiens
cgaacgagactctggcatgctaactag

SEQ ID NO: 15814 - DNA, 28 bp, Homo sapiens
cgaacgagactctggcatgctaactagt

SEQ ID NO: 15815 - DNA, 29 bp, Homo sapiens
cgaacgagactctggcatgctaactagtt

SEQ ID NO: 15816 - DNA, 30 bp, Homo sapiens; identical to SEQ ID NO: 3146

SEQ ID NO: 15817 - DNA, 31 bp, Homo sapiens; identical to SEQ ID NO: 3147

SEQ ID NO: 15818 - DNA, 32 bp, Homo sapiens; identical to SEQ ID NO: 3148

SEQ ID NO: 15819 - DNA, 33 bp, Homo sapiens
cgaacgagactctggcatgctaactagttacgc

SEQ ID NO: 15820 - DNA, 34 bp, Homo sapiens
cgaacgagactctggcatgctaactagttacgcg

SEQ ID NO: 15821 - DNA, 35 bp, Homo sapiens
cgaacgagactctggcatgctaactagttacgcga

SEQ ID NO: 15822 - DNA, 36 bp, Homo sapiens
cgaacgagactctggcatgctaactagttacgcgac

SEQ ID NO: 15823 - DNA, 37 bp, Homo sapiens
cgaacgagactctggcatgctaactagttacgcgacc

SEQ ID NO: 15824 - DNA, 38 bp, Homo sapiens
cgaacgagactctggcatgctaactagttacgcgaccc

SEQ ID NO: 15825 - DNA, 39 bp, Homo sapiens
cgaacgagactctggcatgctaactagttacgcgacccc

SEQ ID NO: 15826 - DNA, 40 bp, Homo sapiens
cgaacgagactctggcatgctaactagttacgcgaccccc

SEQ ID NO: 15827 - DNA, 41 bp, Homo sapiens
cgaacgagactctggcatgctaactagttacgcgacccccg

SEQ ID NO: 15828 - DNA, 42 bp, Homo sapiens
cgaacgagactctggcatgctaactagttacgcgacccccga

SEQ ID NO: 15829 - DNA, 43 bp, Homo sapiens
cgaacgagactctggcatgctaactagttacgcgacccccgag

SEQ ID NO: 15830 - DNA, 44 bp, Homo sapiens
cgaacgagactctggcatgctaactagttacgcgacccccgagc

SEQ ID NO: 15831 - DNA, 16 bp, Homo sapiens
gaacgagactctggca

SEQ ID NO: 15832 - DNA, 17 bp, Homo sapiens
gaacgagactctggcat

SEQ ID NO: 15833 - DNA, 18 bp, Homo sapiens
gaacgagactctggcatg

SEQ ID NO: 15834 - DNA, 19 bp, Homo sapiens
gaacgagactctggcatgc

SEQ ID NO: 15835 - DNA, 20 bp, Homo sapiens
gaacgagactctggcatgct

SEQ ID NO: 15836 - DNA, 21 bp, Homo sapiens
gaacgagactctggcatgcta

SEQ ID NO: 15837 - DNA, 22 bp, Homo sapiens
gaacgagactctggcatgctaa

SEQ ID NO: 15838 - DNA, 23 bp, Homo sapiens
gaacgagactctggcatgctaac

SEQ ID NO: 15839 - DNA, 24 bp, Homo sapiens
gaacgagactctggcatgctaact

SEQ ID NO: 15840 - DNA, 25 bp, Homo sapiens
gaacgagactctggcatgctaacta

SEQ ID NO: 15841 - DNA, 26 bp, Homo sapiens
gaacgagactctggcatgctaactag

SEQ ID NO: 15842 - DNA, 27 bp, Homo sapiens
gaacgagactctggcatgctaactagt

SEQ ID NO: 15843 - DNA, 28 bp, Homo sapiens
gaacgagactctggcatgctaactagtt

SEQ ID NO: 15844 - DNA, 29 bp, Homo sapiens
gaacgagactctggcatgctaactagtta

SEQ ID NO: 15845 - DNA, 30 bp, Homo sapiens; identical to SEQ ID NO: 3163

SEQ ID NO: 15846 - DNA, 31 bp, Homo sapiens; identical to SEQ ID NO: 3164

SEQ ID NO: 15847 - DNA, 33 bp, Homo sapiens; identical to SEQ ID NO: 3165

SEQ ID NO: 15848 - DNA, 34 bp, Homo sapiens
gaacgagactctggcatgctaactagttacgcga

SEQ ID NO: 15849 - DNA, 35 bp, Homo sapiens
gaacgagactctggcatgctaactagttacgcgac

SEQ ID NO: 15850 - DNA, 36 bp, Homo sapiens
gaacgagactctggcatgctaactagttacgcgacc

SEQ ID NO: 15851 - DNA, 37 bp, Homo sapiens
gaacgagactctggcatgctaactagttacgcgaccc

SEQ ID NO: 15852 - DNA, 38 bp, Homo sapiens
gaacgagactctggcatgctaactagttacgcgacccc

SEQ ID NO: 15853 - DNA, 39 bp, Homo sapiens
gaacgagactctggcatgctaactagttacgcgaccccc

SEQ ID NO: 15854 - DNA, 40 bp, Homo sapiens
gaacgagactctggcatgctaactagttacgcgacccccg

SEQ ID NO: 15855 - DNA, 41 bp, Homo sapiens
gaacgagactctggcatgctaactagttacgcgacccccga

SEQ ID NO: 15856 - DNA, 42 bp, Homo sapiens
gaacgagactctggcatgctaactagttacgcgacccccgag

SEQ ID NO: 15857 - DNA, 43 bp, Homo sapiens
gaacgagactctggcatgctaactagttacgcgacccccgagc

SEQ ID NO: 15858 - DNA, 16 bp, Homo sapiens
aacgagactctggcat

SEQ ID NO: 15859 - DNA, 17 bp, Homo sapiens
aacgagactctggcatg

SEQ ID NO: 15860 - DNA, 18 bp, Homo sapiens
aacgagactctggcatgc

SEQ ID NO: 15861 - DNA, 19 bp, Homo sapiens
aacgagactctggcatgct

SEQ ID NO: 15862 - DNA, 20 bp, Homo sapiens
aacgagactctggcatgcta

SEQ ID NO: 15863 - DNA, 21 bp, Homo sapiens
aacgagactctggcatgctaa

SEQ ID NO: 15864 - DNA, 22 bp, Homo sapiens
aacgagactctggcatgctaac

SEQ ID NO: 15865 - DNA, 23 bp, Homo sapiens
aacgagactctggcatgctaact

SEQ ID NO: 15866 - DNA, 24 bp, Homo sapiens
aacgagactctggcatgctaacta

SEQ ID NO: 15867 - DNA, 25 bp, Homo sapiens
aacgagactctggcatgctaactag

SEQ ID NO: 15868 - DNA, 26 bp, Homo sapiens
aacgagactctggcatgctaactagt

SEQ ID NO: 15869 - DNA, 27 bp, Homo sapiens
aacgagactctggcatgctaactagtt

SEQ ID NO: 15870 - DNA, 28 bp, Homo sapiens
aacgagactctggcatgctaactagtta

SEQ ID NO: 15871 - DNA, 29 bp, Homo sapiens
aacgagactctggcatgctaactagttac

SEQ ID NO: 15872 - DNA, 30 bp, Homo sapiens; identical to SEQ ID NO: 3180

SEQ ID NO: 15873 - DNA, 31 bp, Homo sapiens; identical to SEQ ID NO: 3181

SEQ ID NO: 15874 - DNA, 32 bp, Homo sapiens; identical to SEQ ID NO: 3182

SEQ ID NO: 15875 - DNA, 33 bp, Homo sapiens; identical to SEQ ID NO: 3183

SEQ ID NO: 15876 - DNA, 34 bp, Homo sapiens
aacgagactctggcatgctaactagttacgcgac

SEQ ID NO: 15877 - DNA, 35 bp, Homo sapiens
aacgagactctggcatgctaactagttacgcgacc

SEQ ID NO: 15878 - DNA, 36 bp, Homo sapiens
aacgagactctggcatgctaactagttacgcgaccc

SEQ ID NO: 15879 - DNA, 37 bp, Homo sapiens
aacgagactctggcatgctaactagttacgcgacccc

SEQ ID NO: 15880 - DNA, 38 bp, Homo sapiens
aacgagactctggcatgctaactagttacgcgaccccc

SEQ ID NO: 15881 - DNA, 39 bp, Homo sapiens
aacgagactctggcatgctaactagttacgcgacccccg

SEQ ID NO: 15882 - DNA, 40 bp, Homo sapiens
aacgagactctggcatgctaactagttacgcgacccccga

SEQ ID NO: 15883 - DNA, 41 bp, Homo sapiens
aacgagactctggcatgctaactagttacgcgacccccgag

SEQ ID NO: 15884 - DNA, 42 bp, Homo sapiens
aacgagactctggcatgctaactagttacgcgacccccgagc

SEQ ID NO: 15885 - DNA, 43 bp, Homo sapiens
aacgagactctggcatgctaactagttacgcgacccccgagcg

SEQ ID NO: 15886 - DNA, 46 bp, Homo sapiens
aacgagactctggcatgctaactagttacgcgacccccgagcggtc

SEQ ID NO: 15887 - DNA, 47 bp, Homo sapiens
aacgagactctggcatgctaactagttacgcgacccccgagcggtcg

SEQ ID NO: 15888 - DNA, 16 bp, Homo sapiens
acgagactctggcatg

SEQ ID NO: 15889 - DNA, 17 bp, Homo sapiens
acgagactctggcatgc

SEQ ID NO: 15890 - DNA, 18 bp, Homo sapiens
acgagactctggcatgct

SEQ ID NO: 15891 - DNA, 19 bp, Homo sapiens
acgagactctggcatgcta

SEQ ID NO: 15892 - DNA, 20 bp, Homo sapiens
acgagactctggcatgctaa

SEQ ID NO: 15893 - DNA, 21 bp, Homo sapiens
acgagactctggcatgctaac

SEQ ID NO: 15894 - DNA, 22 bp, Homo sapiens
acgagactctggcatgctaact

SEQ ID NO: 15895 - DNA, 23 bp, Homo sapiens
acgagactctggcatgctaacta

SEQ ID NO: 15896 - DNA, 24 bp, Homo sapiens
acgagactctggcatgctaactag

SEQ ID NO: 15897 - DNA, 25 bp, Homo sapiens
acgagactctggcatgctaactagt

SEQ ID NO: 15898 - DNA, 26 bp, Homo sapiens
acgagactctggcatgctaactagtt

SEQ ID NO: 15899 - DNA, 27 bp, Homo sapiens
acgagactctggcatgctaactagtta

SEQ ID NO: 15900 - DNA, 28 bp, Homo sapiens
acgagactctggcatgctaactagttac

SEQ ID NO: 15901 - DNA, 29 bp, Homo sapiens
acgagactctggcatgctaactagttacg

SEQ ID NO: 15902 - DNA, 31 bp, Homo sapiens; identical to SEQ ID NO: 3198

SEQ ID NO: 15903 - DNA, 32 bp, Homo sapiens; identical to SEQ ID NO: 3199

SEQ ID NO: 15904 - DNA, 33 bp, Homo sapiens; identical to SEQ ID NO: 3200

SEQ ID NO: 15905 - DNA, 34 bp, Homo sapiens
acgagactctggcatgctaactagttacgcgacc

SEQ ID NO: 15906 - DNA, 35 bp, Homo sapiens
acgagactctggcatgctaactagttacgcgaccc

SEQ ID NO: 15907 - DNA, 36 bp, Homo sapiens
acgagactctggcatgctaactagttacgcgacccc

SEQ ID NO: 15908 - DNA, 37 bp, Homo sapiens
acgagactctggcatgctaactagttacgcgaccccc

SEQ ID NO: 15909 - DNA, 38 bp, Homo sapiens
acgagactctggcatgctaactagttacgcgacccccg

SEQ ID NO: 15910 - DNA, 39 bp, Homo sapiens
acgagactctggcatgctaactagttacgcgacccccga

SEQ ID NO: 15911 - DNA, 40 bp, Homo sapiens
acgagactctggcatgctaactagttacgcgacccccgag

SEQ ID NO: 15912 - DNA, 41 bp, Homo sapiens
acgagactctggcatgctaactagttacgcgacccccgagc

SEQ ID NO: 15913 - DNA, 46 bp, Homo sapiens
acgagactctggcatgctaactagttacgcgacccccgagcggtcg

SEQ ID NO: 15914 - DNA, 16 bp, Homo sapiens
cgagactctggcatgc

SEQ ID NO: 15915 - DNA, 17 bp, Homo sapiens
cgagactctggcatgct

SEQ ID NO: 15916 - DNA, 18 bp, Homo sapiens
cgagactctggcatgcta

SEQ ID NO: 15917 - DNA, 20 bp, Homo sapiens
cgagactctggcatgctaac

SEQ ID NO: 15918 - DNA, 21 bp, Homo sapiens
cgagactctggcatgctaact

SEQ ID NO: 15919 - DNA, 22 bp, Homo sapiens
cgagactctggcatgctaacta

SEQ ID NO: 15920 - DNA, 25 bp, Homo sapiens
cgagactctggcatgctaactagtt

SEQ ID NO: 15921 - DNA, 28 bp, Homo sapiens
cgagactctggcatgctaactagttacg

SEQ ID NO: 15922 - DNA, 30 bp, Homo sapiens; identical to SEQ ID NO: 3202

SEQ ID NO: 15923 - DNA, 32 bp, Homo sapiens
cgagactctggcatgctaactagttacgcgac

SEQ ID NO: 15924 - DNA, 33 bp, Homo sapiens; identical to SEQ ID NO: 3203

SEQ ID NO: 15925 - DNA, 35 bp, Homo sapiens
cgagactctggcatgctaactagttacgcgacccc

SEQ ID NO: 15926 - DNA, 16 bp, Homo sapiens
gagactctggcatgct

SEQ ID NO: 15927 - DNA, 17 bp, Homo sapiens
gagactctggcatgcta

SEQ ID NO: 15928 - DNA, 19 bp, Homo sapiens
gagactctggcatgctaac

SEQ ID NO: 15929 - DNA, 20 bp, Homo sapiens
gagactctggcatgctaact

SEQ ID NO: 15930 - DNA, 21 bp, Homo sapiens
gagactctggcatgctaacta

SEQ ID NO: 15931 - DNA, 24 bp, Homo sapiens
gagactctggcatgctaactagtt

SEQ ID NO: 15932 - DNA, 27 bp, Homo sapiens
gagactctggcatgctaactagttacg

SEQ ID NO: 15933 - DNA, 29 bp, Homo sapiens
gagactctggcatgctaactagttacgcg

SEQ ID NO: 15934 - DNA, 32 bp, Homo sapiens
gagactctggcatgctaactagttacgcgacc

SEQ ID NO: 15935 - DNA, 33 bp, Homo sapiens
gagactctggcatgctaactagttacgcgaccc

SEQ ID NO: 15936 - DNA, 16 bp, Homo sapiens
agactctggcatgcta

SEQ ID NO: 15937 - DNA, 18 bp, Homo sapiens
agactctggcatgctaac

SEQ ID NO: 15938 - DNA, 19 bp, Homo sapiens
agactctggcatgctaact

SEQ ID NO: 15939 - DNA, 23 bp, Homo sapiens
agactctggcatgctaactagtt

SEQ ID NO: 15940 - DNA, 26 bp, Homo sapiens
agactctggcatgctaactagttacg

SEQ ID NO: 15941 - DNA, 28 bp, Homo sapiens
agactctggcatgctaactagttacgcg

SEQ ID NO: 15942 - DNA, 30 bp, Homo sapiens
agactctggcatgctaactagttacgcgac

SEQ ID NO: 15943 - DNA, 31 bp, Homo sapiens
agactctggcatgctaactagttacgcgacc

SEQ ID NO: 15944 - DNA, 32 bp, Homo sapiens
agactctggcatgctaactagttacgcgaccc

SEQ ID NO: 15945 - DNA, 33 bp, Homo sapiens; identical to SEQ ID NO: 3206

SEQ ID NO: 15946 - DNA, 35 bp, Homo sapiens
agactctggcatgctaactagttacgcgacccccg

SEQ ID NO: 15947 - DNA, 17 bp, Homo sapiens
gactctggcatgctaac

SEQ ID NO: 15948 - DNA, 18 bp, Homo sapiens
gactctggcatgctaact

SEQ ID NO: 15949 - DNA, 19 bp, Homo sapiens
gactctggcatgctaacta

SEQ ID NO: 15950 - DNA, 23 bp, Homo sapiens
gactctggcatgctaactagtta

SEQ ID NO: 15951 - DNA, 28 bp, Homo sapiens
gactctggcatgctaactagttacgcga

SEQ ID NO: 15952 - DNA, 32 bp, Homo sapiens
gactctggcatgctaactagttacgcgacccc

SEQ ID NO: 15953 - DNA, 33 bp, Homo sapiens
gactctggcatgctaactagttacgcgaccccc

SEQ ID NO: 15954 - DNA, 28 bp, Homo sapiens
actctggcatgctaactagttacgcgac

SEQ ID NO: 15955 - DNA, 29 bp, Homo sapiens
actctggcatgctaactagttacgcgacc

SEQ ID NO: 15956 - DNA, 31 bp, Homo sapiens
actctggcatgctaactagttacgcgacccc

SEQ ID NO: 15957 - DNA, 33 bp, Homo sapiens
actctggcatgctaactagttacgcgacccccg

SEQ ID NO: 15958 - DNA, 47 bp, Homo sapiens
actctggcatgctaactagttacgcgacccccgagcggtcggcgtcc

SEQ ID NO: 15959 - DNA, 27 bp, Homo sapiens
ctctggcatgctaactagttacgcgac

SEQ ID NO: 15960 - DNA, 33 bp, Homo sapiens
ctctggcatgctaactagttacgcgacccccga

SEQ ID NO: 15961 - DNA, 22 bp, Homo sapiens
tctggcatgctaactagttacg

SEQ ID NO: 15962 - DNA, 26 bp, Homo sapiens
tctggcatgctaactagttacgcgac

SEQ ID NO: 15963 - DNA, 27 bp, Homo sapiens
tctggcatgctaactagttacgcgacc

SEQ ID NO: 15964 - DNA, 28 bp, Homo sapiens
tctggcatgctaactagttacgcgaccc

SEQ ID NO: 15965 - DNA, 29 bp, Homo sapiens
tctggcatgctaactagttacgcgacccc

SEQ ID NO: 15966 - DNA, 30 bp, Homo sapiens
tctggcatgctaactagttacgcgaccccc

SEQ ID NO: 15967 - DNA, 31 bp, Homo sapiens
tctggcatgctaactagttacgcgacccccg

SEQ ID NO: 15968 - DNA, 33 bp, Homo sapiens
tctggcatgctaactagttacgcgacccccgag

SEQ ID NO: 15969 - DNA, 25 bp, Homo sapiens
ctggcatgctaactagttacgcgac

SEQ ID NO: 15970 - DNA, 26 bp, Homo sapiens
ctggcatgctaactagttacgcgacc

SEQ ID NO: 15971 - DNA, 27 bp, Homo sapiens
ctggcatgctaactagttacgcgaccc

SEQ ID NO: 15972 - DNA, 28 bp, Homo sapiens
ctggcatgctaactagttacgcgacccc

SEQ ID NO: 15973 - DNA, 32 bp, Homo sapiens
ctggcatgctaactagttacgcgacccccgag

SEQ ID NO: 15974 - DNA, 33 bp, Homo sapiens
ctggcatgctaactagttacgcgacccccgagc

SEQ ID NO: 15975 - DNA, 18 bp, Homo sapiens
gcatgctaactagttacg

SEQ ID NO: 15976 - DNA, 23 bp, Homo sapiens
gcatgctaactagttacgcgacc

SEQ ID NO: 15977 - DNA, 24 bp, Homo sapiens
gcatgctaactagttacgcgaccc

SEQ ID NO: 15978 - DNA, 25 bp, Homo sapiens
gcatgctaactagttacgcgacccc

SEQ ID NO: 15979 - DNA, 26 bp, Homo sapiens
gcatgctaactagttacgcgaccccc

SEQ ID NO: 15980 - DNA, 27 bp, Homo sapiens
gcatgctaactagttacgcgacccccg

SEQ ID NO: 15981 - DNA, 28 bp, Homo sapiens
gcatgctaactagttacgcgacccccga

SEQ ID NO: 15982 - DNA, 29 bp, Homo sapiens
gcatgctaactagttacgcgacccccgag

SEQ ID NO: 15983 - DNA, 30 bp, Homo sapiens; identical to SEQ ID NO: 3210

SEQ ID NO: 15984 - DNA, 31 bp, Homo sapiens; identical to SEQ ID NO: 3211

SEQ ID NO: 15985 - DNA, 33 bp, Homo sapiens
gcatgctaactagttacgcgacccccgagcggt

SEQ ID NO: 15986 - DNA, 26 bp, Homo sapiens
catgctaactagttacgcgacccccg

SEQ ID NO: 15987 - DNA, 28 bp, Homo sapiens
catgctaactagttacgcgacccccgag

SEQ ID NO: 15988 - DNA, 29 bp, Homo sapiens
catgctaactagttacgcgacccccgagc

SEQ ID NO: 15989 - DNA, 20 bp, Homo sapiens
tgctaactagttacgcgacc

SEQ ID NO: 15990 - DNA, 25 bp, Homo sapiens
tgctaactagttacgcgacccccga

SEQ ID NO: 15991 - DNA, 26 bp, Homo sapiens
tgctaactagttacgcgacccccgag

SEQ ID NO: 15992 - DNA, 27 bp, Homo sapiens
tgctaactagttacgcgacccccgagc

SEQ ID NO: 15993 - DNA, 19 bp, Homo sapiens
gctaactagttacgcgacc

SEQ ID NO: 15994 - DNA, 21 bp, Homo sapiens
gctaactagttacgcgacccc

SEQ ID NO: 15995 - DNA, 25 bp, Homo sapiens
gctaactagttacgcgacccccgag

SEQ ID NO: 15996 - DNA, 27 bp, Homo sapiens
gctaactagttacgcgacccccgagcg

SEQ ID NO: 15997 - DNA, 20 bp, Homo sapiens
ctaactagttacgcgacccc

SEQ ID NO: 15998 - DNA, 17 bp, Homo sapiens
taactagttacgcgacc

SEQ ID NO: 15999 - DNA, 16 bp, Homo sapiens
aactagttacgcgacc

SEQ ID NO: 16000 - DNA, 17 bp, Homo sapiens
aactagttacgcgaccc

SEQ ID NO: 16001 - DNA, 20 bp, Homo sapiens
aactagttacgcgacccccg

SEQ ID NO: 16002 - DNA, 23 bp, Homo sapiens
aactagttacgcgacccccgagc

SEQ ID NO: 16003 - DNA, 16 bp, Homo sapiens
actagttacgcgaccc

SEQ ID NO: 16004 - DNA, 17 bp, Homo sapiens
actagttacgcgacccc

SEQ ID NO: 16005 - DNA, 19 bp, Homo sapiens
actagttacgcgacccccg

SEQ ID NO: 16006 - DNA, 20 bp, Homo sapiens
actagttacgcgacccccga

SEQ ID NO: 16007 - DNA, 18 bp, Homo sapiens
ctagttacgcgacccccg

SEQ ID NO: 16008 - DNA, 19 bp, Homo sapiens
ctagttacgcgacccccga

SEQ ID NO: 16009 - DNA, 21 bp, Homo sapiens
ctagttacgcgacccccgagc

SEQ ID NO: 16010 - DNA, 27 bp, Homo sapiens
tagttacgcgacccccgagcggtcggc

SEQ ID NO: 16011 - DNA, 16 bp, Homo sapiens
agttacgcgacccccg

SEQ ID NO: 16012 - DNA, 26 bp, Homo sapiens
agttacgcgacccccgagcggtcggc

SEQ ID NO: 16013 - DNA, 27 bp, Homo sapiens
agttacgcgacccccgagcggtcggcg

SEQ ID NO: 16014 - DNA, 16 bp, Homo sapiens
gttacgcgacccccga

SEQ ID NO: 16015 - DNA, 25 bp, Homo sapiens
gttacgcgacccccgagcggtcggc

SEQ ID NO: 16016 - DNA, 26 bp, Homo sapiens
gttacgcgacccccgagcggtcggcg

SEQ ID NO: 16017 - DNA, 29 bp, Homo sapiens
gttacgcgacccccgagcggtcggcgtcc

SEQ ID NO: 16018 - DNA, 24 bp, Homo sapiens
ttacgcgacccccgagcggtcggc

SEQ ID NO: 16019 - DNA, 23 bp, Homo sapiens
tacgcgacccccgagcggtcggc

SEQ ID NO: 16020 - DNA, 22 bp, Homo sapiens
acgcgacccccgagcggtcggc

SEQ ID NO: 16021 - DNA, 23 bp, Homo sapiens
acgcgacccccgagcggtcggcg

SEQ ID NO: 16022 - DNA, 21 bp, Homo sapiens
cgcgacccccgagcggtcggc

SEQ ID NO: 16023 - DNA, 24 bp, Homo sapiens
cgcgacccccgagcggtcggcgtc

SEQ ID NO: 16024 - DNA, 26 bp, Homo sapiens
cgcgacccccgagcggtcggcgtccc

SEQ ID NO: 16025 - DNA, 27 bp, Homo sapiens
cgcgacccccgagcggtcggcgtcccc

SEQ ID NO: 16026 - DNA, 20 bp, Homo sapiens
gcgacccccgagcggtcggc

SEQ ID NO: 16027 - DNA, 21 bp, Homo sapiens
gcgacccccgagcggtcggcg

SEQ ID NO: 16028 - DNA, 23 bp, Homo sapiens
gcgacccccgagcggtcggcgtc

SEQ ID NO: 16029 - DNA, 24 bp, Homo sapiens
gcgacccccgagcggtcggcgtcc

SEQ ID NO: 16030 - DNA, 25 bp, Homo sapiens
gcgacccccgagcggtcggcgtccc

SEQ ID NO: 16031 - DNA, 26 bp, Homo sapiens
gcgacccccgagcggtcggcgtcccc

SEQ ID NO: 16032 - DNA, 27 bp, Homo sapiens
gcgacccccgagcggtcggcgtccccc

SEQ ID NO: 16033 - DNA, 19 bp, Homo sapiens
cgacccccgagcggtcggc

SEQ ID NO: 16034 - DNA, 22 bp, Homo sapiens
cgacccccgagcggtcggcgtc

SEQ ID NO: 16035 - DNA, 23 bp, Homo sapiens
cgacccccgagcggtcggcgtcc

SEQ ID NO: 16036 - DNA, 24 bp, Homo sapiens
cgacccccgagcggtcggcgtccc

SEQ ID NO: 16037 - DNA, 25 bp, Homo sapiens
cgacccccgagcggtcggcgtcccc

SEQ ID NO: 16038 - DNA, 33 bp, Homo sapiens
cgacccccgagcggtcggcgtcccccaacttct

SEQ ID NO: 16039 - DNA, 21 bp, Homo sapiens
gacccccgagcggtcggcgtc

SEQ ID NO: 16040 - DNA, 22 bp, Homo sapiens
gacccccgagcggtcggcgtcc

SEQ ID NO: 16041 - DNA, 23 bp, Homo sapiens
gacccccgagcggtcggcgtccc

SEQ ID NO: 16042 - DNA, 32 bp, Homo sapiens
gacccccgagcggtcggcgtcccccaacttct

SEQ ID NO: 16043 - DNA, 16 bp, Homo sapiens
acccccgagcggtcgg

SEQ ID NO: 16044 - DNA, 17 bp, Homo sapiens
acccccgagcggtcggc

SEQ ID NO: 16045 - DNA, 18 bp, Homo sapiens
acccccgagcggtcggcg

SEQ ID NO: 16046 - DNA, 20 bp, Homo sapiens
acccccgagcggtcggcgtc

SEQ ID NO: 16047 - DNA, 21 bp, Homo sapiens
acccccgagcggtcggcgtcc

SEQ ID NO: 16048 - DNA, 22 bp, Homo sapiens
acccccgagcggtcggcgtccc

SEQ ID NO: 16049 - DNA, 23 bp, Homo sapiens
acccccgagcggtcggcgtcccc

SEQ ID NO: 16050 - DNA, 31 bp, Homo sapiens
acccccgagcggtcggcgtcccccaacttct

SEQ ID NO: 16051 - DNA, 16 bp, Homo sapiens
cccccgagcggtcggc

SEQ ID NO: 16052 - DNA, 17 bp, Homo sapiens
cccccgagcggtcggcg

SEQ ID NO: 16053 - DNA, 18 bp, Homo sapiens
cccccgagcggtcggcgt

SEQ ID NO: 16054 - DNA, 19 bp, Homo sapiens
cccccgagcggtcggcgtc

SEQ ID NO: 16055 - DNA, 20 bp, Homo sapiens
cccccgagcggtcggcgtcc

SEQ ID NO: 16056 - DNA, 21 bp, Homo sapiens
cccccgagcggtcggcgtccc

SEQ ID NO: 16057 - DNA, 22 bp, Homo sapiens
cccccgagcggtcggcgtcccc

SEQ ID NO: 16058 - DNA, 32 bp, Homo sapiens
cccccgagcggtcggcgtcccccaacttctta

SEQ ID NO: 16059 - DNA, 16 bp, Homo sapiens
ccccgagcggtcggcg

SEQ ID NO: 16060 - DNA, 18 bp, Homo sapiens
ccccgagcggtcggcgtc

SEQ ID NO: 16061 - DNA, 19 bp, Homo sapiens
ccccgagcggtcggcgtcc

SEQ ID NO: 16062 - DNA, 20 bp, Homo sapiens
ccccgagcggtcggcgtccc

SEQ ID NO: 16063 - DNA, 21 bp, Homo sapiens
ccccgagcggtcggcgtcccc

SEQ ID NO: 16064 - DNA, 22 bp, Homo sapiens
ccccgagcggtcggcgtccccc

SEQ ID NO: 16065 - DNA, 28 bp, Homo sapiens
ccccgagcggtcggcgtcccccaacttc

SEQ ID NO: 16066 - DNA, 29 bp, Homo sapiens
ccccgagcggtcggcgtcccccaacttct

SEQ ID NO: 16067 - DNA, 17 bp, Homo sapiens
cccgagcggtcggcgtc

SEQ ID NO: 16068 - DNA, 18 bp, Homo sapiens
cccgagcggtcggcgtcc

SEQ ID NO: 16069 - DNA, 19 bp, Homo sapiens
cccgagcggtcggcgtccc

SEQ ID NO: 16070 - DNA, 20 bp, Homo sapiens
cccgagcggtcggcgtcccc

SEQ ID NO: 16071 - DNA, 21 bp, Homo sapiens
cccgagcggtcggcgtccccc

SEQ ID NO: 16072 - DNA, 27 bp, Homo sapiens
cccgagcggtcggcgtcccccaacttc

SEQ ID NO: 16073 - DNA, 28 bp, Homo sapiens
cccgagcggtcggcgtcccccaacttct

SEQ ID NO: 16074 - DNA, 16 bp, Homo sapiens
ccgagcggtcggcgtc

SEQ ID NO: 16075 - DNA, 17 bp, Homo sapiens
ccgagcggtcggcgtcc

SEQ ID NO: 16076 - DNA, 18 bp, Homo sapiens
ccgagcggtcggcgtccc

SEQ ID NO: 16077 - DNA, 19 bp, Homo sapiens
ccgagcggtcggcgtcccc

SEQ ID NO: 16078 - DNA, 20 bp, Homo sapiens
ccgagcggtcggcgtccccc

SEQ ID NO: 16079 - DNA, 27 bp, Homo sapiens
ccgagcggtcggcgtcccccaacttct

SEQ ID NO: 16080 - DNA, 16 bp, Homo sapiens
cgagcggtcggcgtcc

SEQ ID NO: 16081 - DNA, 17 bp, Homo sapiens
cgagcggtcggcgtccc

SEQ ID NO: 16082 - DNA, 18 bp, Homo sapiens
cgagcggtcggcgtcccc

SEQ ID NO: 16083 - DNA, 19 bp, Homo sapiens
cgagcggtcggcgtccccc

SEQ ID NO: 16084 - DNA, 22 bp, Homo sapiens
cgagcggtcggcgtcccccaac

SEQ ID NO: 16085 - DNA, 26 bp, Homo sapiens
cgagcggtcggcgtcccccaacttct

SEQ ID NO: 16086 - DNA, 28 bp, Homo sapiens
cgagcggtcggcgtcccccaacttctta

SEQ ID NO: 16087 - DNA, 16 bp, Homo sapiens
gagcggtcggcgtccc

SEQ ID NO: 16088 - DNA, 17 bp, Homo sapiens
gagcggtcggcgtcccc

SEQ ID NO: 16089 - DNA, 18 bp, Homo sapiens
gagcggtcggcgtccccc

SEQ ID NO: 16090 - DNA, 22 bp, Homo sapiens
gagcggtcggcgtcccccaact

SEQ ID NO: 16091 - DNA, 25 bp, Homo sapiens
gagcggtcggcgtcccccaacttct

SEQ ID NO: 16092 - DNA, 33 bp, Homo sapiens
gagcggtcggcgtcccccaacttcttagaggga

SEQ ID NO: 16093 - DNA, 41 bp, Homo sapiens
gagcggtcggcgtcccccaacttcttagagggacaagtggc

SEQ ID NO: 16094 - DNA, 16 bp, Homo sapiens
agcggtcggcgtcccc

SEQ ID NO: 16095 - DNA, 17 bp, Homo sapiens
agcggtcggcgtccccc

SEQ ID NO: 16096 - DNA, 18 bp, Homo sapiens
agcggtcggcgtccccca

SEQ ID NO: 16097 - DNA, 20 bp, Homo sapiens
agcggtcggcgtcccccaac

SEQ ID NO: 16098 - DNA, 21 bp, Homo sapiens
agcggtcggcgtcccccaact

SEQ ID NO: 16099 - DNA, 23 bp, Homo sapiens
agcggtcggcgtcccccaacttc

SEQ ID NO: 16100 - DNA, 24 bp, Homo sapiens
agcggtcggcgtcccccaacttct

SEQ ID NO: 16101 - DNA, 28 bp, Homo sapiens
agcggtcggcgtcccccaacttcttaga

SEQ ID NO: 16102 - DNA, 29 bp, Homo sapiens
agcggtcggcgtcccccaacttcttagag

SEQ ID NO: 16103 - DNA, 30 bp, Homo sapiens; identical to SEQ ID NO: 3256

SEQ ID NO: 16104 - DNA, 31 bp, Homo sapiens; identical to SEQ ID NO: 3257

SEQ ID NO: 16105 - DNA, 32 bp, Homo sapiens
agcggtcggcgtcccccaacttcttagaggga

SEQ ID NO: 16106 - DNA, 40 bp, Homo sapiens
agcggtcggcgtcccccaacttcttagagggacaagtggc

SEQ ID NO: 16107 - DNA, 16 bp, Homo sapiens
gcggtcggcgtccccc

SEQ ID NO: 16108 - DNA, 17 bp, Homo sapiens
gcggtcggcgtccccca

SEQ ID NO: 16109 - DNA, 18 bp, Homo sapiens
gcggtcggcgtcccccaa

SEQ ID NO: 16110 - DNA, 20 bp, Homo sapiens
gcggtcggcgtcccccaact

SEQ ID NO: 16111 - DNA, 23 bp, Homo sapiens
gcggtcggcgtcccccaacttct

SEQ ID NO: 16112 - DNA, 25 bp, Homo sapiens
gcggtcggcgtcccccaacttctta

SEQ ID NO: 16113 - DNA, 27 bp, Homo sapiens
gcggtcggcgtcccccaacttcttaga

SEQ ID NO: 16114 - DNA, 28 bp, Homo sapiens
gcggtcggcgtcccccaacttcttagag

SEQ ID NO: 16115 - DNA, 29 bp, Homo sapiens
gcggtcggcgtcccccaacttcttagagg

SEQ ID NO: 16116 - DNA, 31 bp, Homo sapiens
gcggtcggcgtcccccaacttcttagaggga

SEQ ID NO: 16117 - DNA, 33 bp, Homo sapiens
gcggtcggcgtcccccaacttcttagagggaca

SEQ ID NO: 16118 - DNA, 16 bp, Homo sapiens
cggtcggcgtccccca

SEQ ID NO: 16119 - DNA, 18 bp, Homo sapiens
cggtcggcgtcccccaac

SEQ ID NO: 16120 - DNA, 22 bp, Homo sapiens
cggtcggcgtcccccaacttct

SEQ ID NO: 16121 - DNA, 26 bp, Homo sapiens
cggtcggcgtcccccaacttcttaga

SEQ ID NO: 16122 - DNA, 27 bp, Homo sapiens
cggtcggcgtcccccaacttcttagag

SEQ ID NO: 16123 - DNA, 28 bp, Homo sapiens
cggtcggcgtcccccaacttcttagagg

SEQ ID NO: 16124 - DNA, 29 bp, Homo sapiens
cggtcggcgtcccccaacttcttagaggg

SEQ ID NO: 16125 - DNA, 32 bp, Homo sapiens
cggtcggcgtcccccaacttcttagagggaca

SEQ ID NO: 16126 - DNA, 38 bp, Homo sapiens
cggtcggcgtcccccaacttcttagagggacaagtggc

SEQ ID NO: 16127 - DNA, 33 bp, Homo sapiens
ggtcggcgtcccccaacttcttagagggacaag

SEQ ID NO: 16128 - DNA, 20 bp, Homo sapiens
gtcggcgtcccccaacttct

SEQ ID NO: 16129 - DNA, 24 bp, Homo sapiens
gtcggcgtcccccaacttcttaga

SEQ ID NO: 16130 - DNA, 25 bp, Homo sapiens
gtcggcgtcccccaacttcttagag

SEQ ID NO: 16131 - DNA, 26 bp, Homo sapiens
gtcggcgtcccccaacttcttagagg

SEQ ID NO: 16132 - DNA, 27 bp, Homo sapiens
gtcggcgtcccccaacttcttagaggg

SEQ ID NO: 16133 - DNA, 28 bp, Homo sapiens
gtcggcgtcccccaacttcttagaggga

SEQ ID NO: 16134 - DNA, 30 bp, Homo sapiens
gtcggcgtcccccaacttcttagagggaca

SEQ ID NO: 16135 - DNA, 16 bp, Homo sapiens
tcggcgtcccccaact

SEQ ID NO: 16136 - DNA, 23 bp, Homo sapiens
tcggcgtcccccaacttcttaga

SEQ ID NO: 16137 - DNA, 27 bp, Homo sapiens
tcggcgtcccccaacttcttagaggga

SEQ ID NO: 16138 - DNA, 29 bp, Homo sapiens
tcggcgtcccccaacttcttagagggaca

SEQ ID NO: 16139 - DNA, 20 bp, Homo sapiens
gcgtcccccaacttcttaga

SEQ ID NO: 16140 - DNA, 19 bp, Homo sapiens
cccaacttcttagagggac

SEQ ID NO: 16141 - DNA, 30 bp, Homo sapiens
cccaacttcttagagggacaagtggcgttc

SEQ ID NO: 16142 - DNA, 18 bp, Homo sapiens
ccaacttcttagagggac

SEQ ID NO: 16143 - DNA, 19 bp, Homo sapiens
ccaacttcttagagggaca

SEQ ID NO: 16144 - DNA, 22 bp, Homo sapiens
ccaacttcttagagggacaagt

SEQ ID NO: 16145 - DNA, 28 bp, Homo sapiens
ccaacttcttagagggacaagtggcgtt

SEQ ID NO: 16146 - DNA, 29 bp, Homo sapiens
ccaacttcttagagggacaagtggcgttc

SEQ ID NO: 16147 - DNA, 21 bp, Homo sapiens
caacttcttagagggacaagt

SEQ ID NO: 16148 - DNA, 24 bp, Homo sapiens
caacttcttagagggacaagtggc

SEQ ID NO: 16149 - DNA, 41 bp, Homo sapiens
caacttcttagagggacaagtggcgttcagccacccgagat

SEQ ID NO: 16150 - DNA, 27 bp, Homo sapiens
aacttcttagagggacaagtggcgttc

SEQ ID NO: 16151 - DNA, 26 bp, Homo sapiens
ttagagggacaagtggcgttcagcca

SEQ ID NO: 16152 - DNA, 33 bp, Homo sapiens
ttagagggacaagtggcgttcagccacccgaga

SEQ ID NO: 16153 - DNA, 16 bp, Homo sapiens
tagagggacaagtggc

SEQ ID NO: 16154 - DNA, 23 bp, Homo sapiens
tagagggacaagtggcgttcagc

SEQ ID NO: 16155 - DNA, 24 bp, Homo sapiens
tagagggacaagtggcgttcagcc

SEQ ID NO: 16156 - DNA, 25 bp, Homo sapiens
tagagggacaagtggcgttcagcca

SEQ ID NO: 16157 - DNA, 26 bp, Homo sapiens
tagagggacaagtggcgttcagccac

SEQ ID NO: 16158 - DNA, 27 bp, Homo sapiens
tagagggacaagtggcgttcagccacc

SEQ ID NO: 16159 - DNA, 28 bp, Homo sapiens
tagagggacaagtggcgttcagccaccc

SEQ ID NO: 16160 - DNA, 31 bp, Homo sapiens; identical to SEQ ID NO: 3263

SEQ ID NO: 16161 - DNA, 32 bp, Homo sapiens; identical to SEQ ID NO: 3264

SEQ ID NO: 16162 - DNA, 33 bp, Homo sapiens; identical to SEQ ID NO: 3265

SEQ ID NO: 16163 - DNA, 34 bp, Homo sapiens
tagagggacaagtggcgttcagccacccgagatt

SEQ ID NO: 16164 - DNA, 35 bp, Homo sapiens
tagagggacaagtggcgttcagccacccgagattg

SEQ ID NO: 16165 - DNA, 36 bp, Homo sapiens
tagagggacaagtggcgttcagccacccgagattga

SEQ ID NO: 16166 - DNA, 37 bp, Homo sapiens
tagagggacaagtggcgttcagccacccgagattgag

SEQ ID NO: 16167 - DNA, 38 bp, Homo sapiens
tagagggacaagtggcgttcagccacccgagattgagc

SEQ ID NO: 16168 - DNA, 39 bp, Homo sapiens
tagagggacaagtggcgttcagccacccgagattgagca

SEQ ID NO: 16169 - DNA, 40 bp, Homo sapiens
tagagggacaagtggcgttcagccacccgagattgagcaa

SEQ ID NO: 16170 - DNA, 41 bp, Homo sapiens
tagagggacaagtggcgttcagccacccgagattgagcaat

SEQ ID NO: 16171 - DNA, 42 bp, Homo sapiens
tagagggacaagtggcgttcagccacccgagattgagcaata

SEQ ID NO: 16172 - DNA, 43 bp, Homo sapiens
tagagggacaagtggcgttcagccacccgagattgagcaataa

SEQ ID NO: 16173 - DNA, 44 bp, Homo sapiens
tagagggacaagtggcgttcagccacccgagattgagcaataac

SEQ ID NO: 16174 - DNA, 31 bp, Homo sapiens
agagggacaagtggcgttcagccacccgaga

SEQ ID NO: 16175 - DNA, 32 bp, Homo sapiens; identical to SEQ ID NO: 3266

SEQ ID NO: 16176 - DNA, 33 bp, Homo sapiens; identical to SEQ ID NO: 3267

SEQ ID NO: 16177 - DNA, 36 bp, Homo sapiens
agagggacaagtggcgttcagccacccgagattgag

SEQ ID NO: 16178 - DNA, 37 bp, Homo sapiens
agagggacaagtggcgttcagccacccgagattgagc

SEQ ID NO: 16179 - DNA, 38 bp, Homo sapiens
agagggacaagtggcgttcagccacccgagattgagca

SEQ ID NO: 16180 - DNA, 39 bp, Homo sapiens
agagggacaagtggcgttcagccacccgagattgagcaa

SEQ ID NO: 16181 - DNA, 40 bp, Homo sapiens
agagggacaagtggcgttcagccacccgagattgagcaat

SEQ ID NO: 16182 - DNA, 30 bp, Homo sapiens
gagggacaagtggcgttcagccacccgaga

SEQ ID NO: 16183 - DNA, 31 bp, Homo sapiens
gagggacaagtggcgttcagccacccgagat

SEQ ID NO: 16184 - DNA, 32 bp, Homo sapiens
gagggacaagtggcgttcagccacccgagatt

SEQ ID NO: 16185 - DNA, 33 bp, Homo sapiens
gagggacaagtggcgttcagccacccgagattg

SEQ ID NO: 16186 - DNA, 35 bp, Homo sapiens
gagggacaagtggcgttcagccacccgagattgag

SEQ ID NO: 16187 - DNA, 36 bp, Homo sapiens
gagggacaagtggcgttcagccacccgagattgagc

SEQ ID NO: 16188 - DNA, 37 bp, Homo sapiens
gagggacaagtggcgttcagccacccgagattgagca

SEQ ID NO: 16189 - DNA, 38 bp, Homo sapiens
gagggacaagtggcgttcagccacccgagattgagcaa

SEQ ID NO: 16190 - DNA, 39 bp, Homo sapiens
gagggacaagtggcgttcagccacccgagattgagcaat

SEQ ID NO: 16191 - DNA, 29 bp, Homo sapiens
agggacaagtggcgttcagccacccgaga

SEQ ID NO: 16192 - DNA, 30 bp, Homo sapiens
agggacaagtggcgttcagccacccgagat

SEQ ID NO: 16193 - DNA, 31 bp, Homo sapiens
agggacaagtggcgttcagccacccgagatt

SEQ ID NO: 16194 - DNA, 32 bp, Homo sapiens
agggacaagtggcgttcagccacccgagattg

SEQ ID NO: 16195 - DNA, 34 bp, Homo sapiens
agggacaagtggcgttcagccacccgagattgag

SEQ ID NO: 16196 - DNA, 35 bp, Homo sapiens
agggacaagtggcgttcagccacccgagattgagc

SEQ ID NO: 16197 - DNA, 36 bp, Homo sapiens
agggacaagtggcgttcagccacccgagattgagca

SEQ ID NO: 16198 - DNA, 37 bp, Homo sapiens
agggacaagtggcgttcagccacccgagattgagcaa

SEQ ID NO: 16199 - DNA, 38 bp, Homo sapiens
agggacaagtggcgttcagccacccgagattgagcaat

SEQ ID NO: 16200 - DNA, 39 bp, Homo sapiens
agggacaagtggcgttcagccacccgagattgagcaata

SEQ ID NO: 16201 - DNA, 30 bp, Homo sapiens
ggacaagtggcgttcagccacccgagattg

SEQ ID NO: 16202 - DNA, 33 bp, Homo sapiens
ggacaagtggcgttcagccacccgagattgagc

SEQ ID NO: 16203 - DNA, 46 bp, Homo sapiens
ggacaagtggcgttcagccacccgagattgagcaataacaggtctg

SEQ ID NO: 16204 - DNA, 17 bp, Homo sapiens
gacaagtggcgttcagc

SEQ ID NO: 16205 - DNA, 29 bp, Homo sapiens
gacaagtggcgttcagccacccgagattg

SEQ ID NO: 16206 - DNA, 32 bp, Homo sapiens
gacaagtggcgttcagccacccgagattgagc

SEQ ID NO: 16207 - DNA, 33 bp, Homo sapiens
gacaagtggcgttcagccacccgagattgagca

SEQ ID NO: 16208 - DNA, 45 bp, Homo sapiens
gacaagtggcgttcagccacccgagattgagcaataacaggtctg

SEQ ID NO: 16209 - DNA, 46 bp, Homo sapiens
gacaagtggcgttcagccacccgagattgagcaataacaggtctgt

SEQ ID NO: 16210 - DNA, 44 bp, Homo sapiens
acaagtggcgttcagccacccgagattgagcaataacaggtctg

SEQ ID NO: 16211 - DNA, 22 bp, Homo sapiens
cgttcagccacccgagattgag

SEQ ID NO: 16212 - DNA, 24 bp, Homo sapiens
cgttcagccacccgagattgagca

SEQ ID NO: 16213 - DNA, 16 bp, Homo sapiens
gttcagccacccgaga

SEQ ID NO: 16214 - DNA, 17 bp, Homo sapiens
gttcagccacccgagat

SEQ ID NO: 16215 - DNA, 18 bp, Homo sapiens
gttcagccacccgagatt

SEQ ID NO: 16216 - DNA, 19 bp, Homo sapiens
gttcagccacccgagattg

SEQ ID NO: 16217 - DNA, 20 bp, Homo sapiens
gttcagccacccgagattga

SEQ ID NO: 16218 - DNA, 21 bp, Homo sapiens
gttcagccacccgagattgag

SEQ ID NO: 16219 - DNA, 22 bp, Homo sapiens
gttcagccacccgagattgagc

SEQ ID NO: 16220 - DNA, 23 bp, Homo sapiens
gttcagccacccgagattgagca

SEQ ID NO: 16221 - DNA, 24 bp, Homo sapiens
gttcagccacccgagattgagcaa

SEQ ID NO: 16222 - DNA, 25 bp, Homo sapiens
gttcagccacccgagattgagcaat

SEQ ID NO: 16223 - DNA, 26 bp, Homo sapiens
gttcagccacccgagattgagcaata

SEQ ID NO: 16224 - DNA, 27 bp, Homo sapiens
gttcagccacccgagattgagcaataa

SEQ ID NO: 16225 - DNA, 28 bp, Homo sapiens
gttcagccacccgagattgagcaataac

SEQ ID NO: 16226 - DNA, 29 bp, Homo sapiens
gttcagccacccgagattgagcaataaca

SEQ ID NO: 16227 - DNA, 32 bp, Homo sapiens
gttcagccacccgagattgagcaataacaggt

SEQ ID NO: 16228 - DNA, 33 bp, Homo sapiens
gttcagccacccgagattgagcaataacaggtc

SEQ ID NO: 16229 - DNA, 35 bp, Homo sapiens
gttcagccacccgagattgagcaataacaggtctg

SEQ ID NO: 16230 - DNA, 16 bp, Homo sapiens
ccacccgagattgagc

SEQ ID NO: 16231 - DNA, 17 bp, Homo sapiens
ccacccgagattgagca

SEQ ID NO: 16232 - DNA, 20 bp, Homo sapiens
ccacccgagattgagcaata

SEQ ID NO: 16233 - DNA, 22 bp, Homo sapiens
ccacccgagattgagcaataac

SEQ ID NO: 16234 - DNA, 21 bp, Homo sapiens
cacccgagattgagcaataac

SEQ ID NO: 16235 - DNA, 20 bp, Homo sapiens
acccgagattgagcaataac

SEQ ID NO: 16236 - DNA, 19 bp, Homo sapiens
cccgagattgagcaataac

SEQ ID NO: 16237 - DNA, 20 bp, Homo sapiens
cccgagattgagcaataaca

SEQ ID NO: 16238 - DNA, 26 bp, Homo sapiens
cccgagattgagcaataacaggtctg

SEQ ID NO: 16239 - DNA, 29 bp, Homo sapiens
cccgagattgagcaataacaggtctgtga

SEQ ID NO: 16240 - DNA, 18 bp, Homo sapiens
ccgagattgagcaataac

SEQ ID NO: 16241 - DNA, 25 bp, Homo sapiens
ccgagattgagcaataacaggtctg

SEQ ID NO: 16242 - DNA, 27 bp, Homo sapiens
ccgagattgagcaataacaggtctgtg

SEQ ID NO: 16243 - DNA, 28 bp, Homo sapiens
ccgagattgagcaataacaggtctgtga

SEQ ID NO: 16244 - DNA, 17 bp, Homo sapiens
cgagattgagcaataac

SEQ ID NO: 16245 - DNA, 22 bp, Homo sapiens
cgagattgagcaataacaggtc

SEQ ID NO: 16246 - DNA, 24 bp, Homo sapiens
cgagattgagcaataacaggtctg

SEQ ID NO: 16247 - DNA, 25 bp, Homo sapiens
cgagattgagcaataacaggtctgt

SEQ ID NO: 16248 - DNA, 26 bp, Homo sapiens
cgagattgagcaataacaggtctgtg

SEQ ID NO: 16249 - DNA, 27 bp, Homo sapiens
cgagattgagcaataacaggtctgtga

SEQ ID NO: 16250 - DNA, 28 bp, Homo sapiens
cgagattgagcaataacaggtctgtgat

SEQ ID NO: 16251 - DNA, 29 bp, Homo sapiens
cgagattgagcaataacaggtctgtgatg

SEQ ID NO: 16252 - DNA, 31 bp, Homo sapiens
cgagattgagcaataacaggtctgtgatgcc

SEQ ID NO: 16253 - DNA, 33 bp, Homo sapiens
cgagattgagcaataacaggtctgtgatgccct

SEQ ID NO: 16254 - DNA, 21 bp, Homo sapiens
gagattgagcaataacaggtc

SEQ ID NO: 16255 - DNA, 23 bp, Homo sapiens
gagattgagcaataacaggtctg

SEQ ID NO: 16256 - DNA, 24 bp, Homo sapiens
gagattgagcaataacaggtctgt

SEQ ID NO: 16257 - DNA, 25 bp, Homo sapiens
gagattgagcaataacaggtctgtg

SEQ ID NO: 16258 - DNA, 26 bp, Homo sapiens
gagattgagcaataacaggtctgtga

SEQ ID NO: 16259 - DNA, 27 bp, Homo sapiens
gagattgagcaataacaggtctgtgat

SEQ ID NO: 16260 - DNA, 28 bp, Homo sapiens
gagattgagcaataacaggtctgtgatg

SEQ ID NO: 16261 - DNA, 30 bp, Homo sapiens
gagattgagcaataacaggtctgtgatgcc

SEQ ID NO: 16262 - DNA, 20 bp, Homo sapiens
agattgagcaataacaggtc

SEQ ID NO: 16263 - DNA, 22 bp, Homo sapiens
agattgagcaataacaggtctg

SEQ ID NO: 16264 - DNA, 23 bp, Homo sapiens
agattgagcaataacaggtctgt

SEQ ID NO: 16265 - DNA, 24 bp, Homo sapiens
agattgagcaataacaggtctgtg

SEQ ID NO: 16266 - DNA, 25 bp, Homo sapiens
agattgagcaataacaggtctgtga

SEQ ID NO: 16267 - DNA, 28 bp, Homo sapiens
agattgagcaataacaggtctgtgatgc

SEQ ID NO: 16268 - DNA, 19 bp, Homo sapiens
gattgagcaataacaggtc

SEQ ID NO: 16269 - DNA, 21 bp, Homo sapiens
gattgagcaataacaggtctg

SEQ ID NO: 16270 - DNA, 22 bp, Homo sapiens
gattgagcaataacaggtctgt

SEQ ID NO: 16271 - DNA, 23 bp, Homo sapiens
gattgagcaataacaggtctgtg

SEQ ID NO: 16272 - DNA, 24 bp, Homo sapiens
gattgagcaataacaggtctgtga

SEQ ID NO: 16273 - DNA, 25 bp, Homo sapiens
gattgagcaataacaggtctgtgat

SEQ ID NO: 16274 - DNA, 26 bp, Homo sapiens
gattgagcaataacaggtctgtgatg

SEQ ID NO: 16275 - DNA, 31 bp, Homo sapiens
gattgagcaataacaggtctgtgatgccctt

SEQ ID NO: 16276 - DNA, 20 bp, Homo sapiens
attgagcaataacaggtctg

SEQ ID NO: 16277 - DNA, 21 bp, Homo sapiens
attgagcaataacaggtctgt

SEQ ID NO: 16278 - DNA, 24 bp, Homo sapiens
attgagcaataacaggtctgtgat

SEQ ID NO: 16279 - DNA, 17 bp, Homo sapiens
ttgagcaataacaggtc

SEQ ID NO: 16280 - DNA, 19 bp, Homo sapiens
ttgagcaataacaggtctg

SEQ ID NO: 16281 - DNA, 20 bp, Homo sapiens
ttgagcaataacaggtctgt

SEQ ID NO: 16282 - DNA, 21 bp, Homo sapiens
ttgagcaataacaggtctgtg

SEQ ID NO: 16283 - DNA, 22 bp, Homo sapiens
ttgagcaataacaggtctgtga

SEQ ID NO: 16284 - DNA, 23 bp, Homo sapiens
ttgagcaataacaggtctgtgat

SEQ ID NO: 16285 - DNA, 24 bp, Homo sapiens
ttgagcaataacaggtctgtgatg

SEQ ID NO: 16286 - DNA, 30 bp, Homo sapiens
ttgagcaataacaggtctgtgatgccctta

SEQ ID NO: 16287 - DNA, 32 bp, Homo sapiens
ttgagcaataacaggtctgtgatgcccttaga

SEQ ID NO: 16288 - DNA, 22 bp, Homo sapiens
tgagcaataacaggtctgtgat

SEQ ID NO: 16289 - DNA, 23 bp, Homo sapiens
tgagcaataacaggtctgtgatg

SEQ ID NO: 16290 - DNA, 24 bp, Homo sapiens
tgagcaataacaggtctgtgatgc

SEQ ID NO: 16291 - DNA, 18 bp, Homo sapiens
gagcaataacaggtctgt

SEQ ID NO: 16292 - DNA, 21 bp, Homo sapiens
gagcaataacaggtctgtgat

SEQ ID NO: 16293 - DNA, 22 bp, Homo sapiens
gagcaataacaggtctgtgatg

SEQ ID NO: 16294 - DNA, 20 bp, Homo sapiens
agcaataacaggtctgtgat

SEQ ID NO: 16295 - DNA, 21 bp, Homo sapiens
agcaataacaggtctgtgatg

SEQ ID NO: 16296 - DNA, 22 bp, Homo sapiens
agcaataacaggtctgtgatgc

SEQ ID NO: 16297 - DNA, 23 bp, Homo sapiens
agcaataacaggtctgtgatgcc

SEQ ID NO: 16298 - DNA, 24 bp, Homo sapiens
agcaataacaggtctgtgatgccc

SEQ ID NO: 16299 - DNA, 16 bp, Homo sapiens
gcaataacaggtctgt

SEQ ID NO: 16300 - DNA, 19 bp, Homo sapiens
gcaataacaggtctgtgat

SEQ ID NO: 16301 - DNA, 22 bp, Homo sapiens
gcaataacaggtctgtgatgcc

SEQ ID NO: 16302 - DNA, 18 bp, Homo sapiens
caataacaggtctgtgat

SEQ ID NO: 16303 - DNA, 21 bp, Homo sapiens
caataacaggtctgtgatgcc

SEQ ID NO: 16304 - DNA, 22 bp, Homo sapiens
caataacaggtctgtgatgccc

SEQ ID NO: 16305 - DNA, 32 bp, Homo sapiens
caataacaggtctgtgatgcccttagatgtcc

SEQ ID NO: 16306 - DNA, 19 bp, Homo sapiens
aataacaggtctgtgatgc

SEQ ID NO: 16307 - DNA, 20 bp, Homo sapiens
aataacaggtctgtgatgcc

SEQ ID NO: 16308 - DNA, 21 bp, Homo sapiens
aataacaggtctgtgatgccc

SEQ ID NO: 16309 - DNA, 22 bp, Homo sapiens
aataacaggtctgtgatgccct

SEQ ID NO: 16310 - DNA, 30 bp, Homo sapiens
aataacaggtctgtgatgcccttagatgtc

SEQ ID NO: 16311 - DNA, 31 bp, Homo sapiens
aataacaggtctgtgatgcccttagatgtcc

SEQ ID NO: 16312 - DNA, 32 bp, Homo sapiens
aataacaggtctgtgatgcccttagatgtccg

SEQ ID NO: 16313 - DNA, 40 bp, Homo sapiens
aataacaggtctgtgatgcccttagatgtccggggctgca

SEQ ID NO: 16314 - DNA, 16 bp, Homo sapiens
ataacaggtctgtgat

SEQ ID NO: 16315 - DNA, 18 bp, Homo sapiens
ataacaggtctgtgatgc

SEQ ID NO: 16316 - DNA, 19 bp, Homo sapiens
ataacaggtctgtgatgcc

SEQ ID NO: 16317 - DNA, 20 bp, Homo sapiens
ataacaggtctgtgatgccc

SEQ ID NO: 16318 - DNA, 21 bp, Homo sapiens
ataacaggtctgtgatgccct

SEQ ID NO: 16319 - DNA, 23 bp, Homo sapiens
ataacaggtctgtgatgccctta

SEQ ID NO: 16320 - DNA, 25 bp, Homo sapiens
ataacaggtctgtgatgcccttaga

SEQ ID NO: 16321 - DNA, 26 bp, Homo sapiens
ataacaggtctgtgatgcccttagat

SEQ ID NO: 16322 - DNA, 29 bp, Homo sapiens
ataacaggtctgtgatgcccttagatgtc

SEQ ID NO: 16323 - DNA, 30 bp, Homo sapiens; identical to SEQ ID NO: 3285

SEQ ID NO: 16324 - DNA, 31 bp, Homo sapiens
ataacaggtctgtgatgcccttagatgtccg

SEQ ID NO: 16325 - DNA, 32 bp, Homo sapiens
ataacaggtctgtgatgcccttagatgtccgg

SEQ ID NO: 16326 - DNA, 33 bp, Homo sapiens; identical to SEQ ID NO: 3286

SEQ ID NO: 16327 - DNA, 39 bp, Homo sapiens
ataacaggtctgtgatgcccttagatgtccggggctgca

SEQ ID NO: 16328 - DNA, 17 bp, Homo sapiens
taacaggtctgtgatgc

SEQ ID NO: 16329 - DNA, 18 bp, Homo sapiens
taacaggtctgtgatgcc

SEQ ID NO: 16330 - DNA, 19 bp, Homo sapiens
taacaggtctgtgatgccc

SEQ ID NO: 16331 - DNA, 24 bp, Homo sapiens
taacaggtctgtgatgcccttaga

SEQ ID NO: 16332 - DNA, 29 bp, Homo sapiens
taacaggtctgtgatgcccttagatgtcc

SEQ ID NO: 16333 - DNA, 30 bp, Homo sapiens
taacaggtctgtgatgcccttagatgtccg

SEQ ID NO: 16334 - DNA, 32 bp, Homo sapiens
taacaggtctgtgatgcccttagatgtccggg

SEQ ID NO: 16335 - DNA, 16 bp, Homo sapiens
aacaggtctgtgatgc

SEQ ID NO: 16336 - DNA, 17 bp, Homo sapiens
aacaggtctgtgatgcc

SEQ ID NO: 16337 - DNA, 18 bp, Homo sapiens
aacaggtctgtgatgccc

SEQ ID NO: 16338 - DNA, 19 bp, Homo sapiens
aacaggtctgtgatgccct

SEQ ID NO: 16339 - DNA, 28 bp, Homo sapiens
aacaggtctgtgatgcccttagatgtcc

SEQ ID NO: 16340 - DNA, 31 bp, Homo sapiens
aacaggtctgtgatgcccttagatgtccggg

SEQ ID NO: 16341 - DNA, 32 bp, Homo sapiens
aacaggtctgtgatgcccttagatgtccgggg

SEQ ID NO: 16342 - DNA, 33 bp, Homo sapiens
aacaggtctgtgatgcccttagatgtccggggc

SEQ ID NO: 16343 - DNA, 16 bp, Homo sapiens
acaggtctgtgatgcc

SEQ ID NO: 16344 - DNA, 17 bp, Homo sapiens
acaggtctgtgatgccc

SEQ ID NO: 16345 - DNA, 18 bp, Homo sapiens
acaggtctgtgatgccct

SEQ ID NO: 16346 - DNA, 22 bp, Homo sapiens
acaggtctgtgatgcccttaga

SEQ ID NO: 16347 - DNA, 27 bp, Homo sapiens
acaggtctgtgatgcccttagatgtcc

SEQ ID NO: 16348 - DNA, 28 bp, Homo sapiens
acaggtctgtgatgcccttagatgtccg

SEQ ID NO: 16349 - DNA, 30 bp, Homo sapiens
acaggtctgtgatgcccttagatgtccggg

SEQ ID NO: 16350 - DNA, 31 bp, Homo sapiens
acaggtctgtgatgcccttagatgtccgggg

SEQ ID NO: 16351 - DNA, 32 bp, Homo sapiens
acaggtctgtgatgcccttagatgtccggggc

SEQ ID NO: 16352 - DNA, 33 bp, Homo sapiens
acaggtctgtgatgcccttagatgtccggggct

SEQ ID NO: 16353 - DNA, 36 bp, Homo sapiens
acaggtctgtgatgcccttagatgtccggggctgca

SEQ ID NO: 16354 - DNA, 16 bp, Homo sapiens
caggtctgtgatgccc

SEQ ID NO: 16355 - DNA, 21 bp, Homo sapiens
caggtctgtgatgcccttaga

SEQ ID NO: 16356 - DNA, 26 bp, Homo sapiens
caggtctgtgatgcccttagatgtcc

SEQ ID NO: 16357 - DNA, 27 bp, Homo sapiens
caggtctgtgatgcccttagatgtccg

SEQ ID NO: 16358 - DNA, 31 bp, Homo sapiens
caggtctgtgatgcccttagatgtccggggc

SEQ ID NO: 16359 - DNA, 32 bp, Homo sapiens
caggtctgtgatgcccttagatgtccggggct

SEQ ID NO: 16360 - DNA, 25 bp, Homo sapiens
aggtctgtgatgcccttagatgtcc

SEQ ID NO: 16361 - DNA, 30 bp, Homo sapiens
aggtctgtgatgcccttagatgtccggggc

SEQ ID NO: 16362 - DNA, 31 bp, Homo sapiens
aggtctgtgatgcccttagatgtccggggct

SEQ ID NO: 16363 - DNA, 33 bp, Homo sapiens
aggtctgtgatgcccttagatgtccggggctgc

SEQ ID NO: 16364 - DNA, 19 bp, Homo sapiens
ggtctgtgatgcccttaga

SEQ ID NO: 16365 - DNA, 33 bp, Homo sapiens
ggtctgtgatgcccttagatgtccggggctgca

SEQ ID NO: 16366 - DNA, 18 bp, Homo sapiens
cccttagatgtccggggc

SEQ ID NO: 16367 - DNA, 19 bp, Homo sapiens
cccttagatgtccggggct

SEQ ID NO: 16368 - DNA, 22 bp, Homo sapiens
cccttagatgtccggggctgca

SEQ ID NO: 16369 - DNA, 17 bp, Homo sapiens
ccttagatgtccggggc

SEQ ID NO: 16370 - DNA, 18 bp, Homo sapiens
ccttagatgtccggggct

SEQ ID NO: 16371 - DNA, 21 bp, Homo sapiens
ccttagatgtccggggctgca

SEQ ID NO: 16372 - DNA, 16 bp, Homo sapiens
cttagatgtccggggc

SEQ ID NO: 16373 - DNA, 17 bp, Homo sapiens
cttagatgtccggggct

SEQ ID NO: 16374 - DNA, 18 bp, Homo sapiens
cttagatgtccggggctg

SEQ ID NO: 16375 - DNA, 19 bp, Homo sapiens
cttagatgtccggggctgc

SEQ ID NO: 16376 - DNA, 20 bp, Homo sapiens
cttagatgtccggggctgca

SEQ ID NO: 16377 - DNA, 21 bp, Homo sapiens
cttagatgtccggggctgcac

SEQ ID NO: 16378 - DNA, 22 bp, Homo sapiens
cttagatgtccggggctgcacg

SEQ ID NO: 16379 - DNA, 24 bp, Homo sapiens
cttagatgtccggggctgcacgcg

SEQ ID NO: 16380 - DNA, 25 bp, Homo sapiens
cttagatgtccggggctgcacgcgc

SEQ ID NO: 16381 - DNA, 26 bp, Homo sapiens
cttagatgtccggggctgcacgcgcg

SEQ ID NO: 16382 - DNA, 28 bp, Homo sapiens
cttagatgtccggggctgcacgcgcgct

SEQ ID NO: 16383 - DNA, 29 bp, Homo sapiens
cttagatgtccggggctgcacgcgcgcta

SEQ ID NO: 16384 - DNA, 30 bp, Homo sapiens
cttagatgtccggggctgcacgcgcgctac

SEQ ID NO: 16385 - DNA, 31 bp, Homo sapiens; identical to SEQ ID NO: 3303

SEQ ID NO: 16386 - DNA, 32 bp, Homo sapiens
cttagatgtccggggctgcacgcgcgctacac

SEQ ID NO: 16387 - DNA, 33 bp, Homo sapiens; identical to SEQ ID NO: 3304

SEQ ID NO: 16388 - DNA, 37 bp, Homo sapiens
cttagatgtccggggctgcacgcgcgctacactgact

SEQ ID NO: 16389 - DNA, 41 bp, Homo sapiens
cttagatgtccggggctgcacgcgcgctacactgactggct

SEQ ID NO: 16390 - DNA, 16 bp, Homo sapiens
ttagatgtccggggct

SEQ ID NO: 16391 - DNA, 18 bp, Homo sapiens
ttagatgtccggggctgc

SEQ ID NO: 16392 - DNA, 19 bp, Homo sapiens
ttagatgtccggggctgca

SEQ ID NO: 16393 - DNA, 20 bp, Homo sapiens
ttagatgtccggggctgcac

SEQ ID NO: 16394 - DNA, 24 bp, Homo sapiens
ttagatgtccggggctgcacgcgc

SEQ ID NO: 16395 - DNA, 26 bp, Homo sapiens
ttagatgtccggggctgcacgcgcgc

SEQ ID NO: 16396 - DNA, 27 bp, Homo sapiens
ttagatgtccggggctgcacgcgcgct

SEQ ID NO: 16397 - DNA, 30 bp, Homo sapiens
ttagatgtccggggctgcacgcgcgctaca

SEQ ID NO: 16398 - DNA, 32 bp, Homo sapiens; identical to SEQ ID NO: 3306

SEQ ID NO: 16399 - DNA, 47 bp, Homo sapiens
ttagatgtccggggctgcacgcgcgctacactgactggctcagcgtg

SEQ ID NO: 16400 - DNA, 17 bp, Homo sapiens
tagatgtccggggctgc

SEQ ID NO: 16401 - DNA, 18 bp, Homo sapiens
tagatgtccggggctgca

SEQ ID NO: 16402 - DNA, 19 bp, Homo sapiens
tagatgtccggggctgcac

SEQ ID NO: 16403 - DNA, 25 bp, Homo sapiens
tagatgtccggggctgcacgcgcgc

SEQ ID NO: 16404 - DNA, 26 bp, Homo sapiens
tagatgtccggggctgcacgcgcgct

SEQ ID NO: 16405 - DNA, 29 bp, Homo sapiens
tagatgtccggggctgcacgcgcgctaca

SEQ ID NO: 16406 - DNA, 31 bp, Homo sapiens; identical to SEQ ID NO: 3307

SEQ ID NO: 16407 - DNA, 16 bp, Homo sapiens
agatgtccggggctgc

SEQ ID NO: 16408 - DNA, 17 bp, Homo sapiens
agatgtccggggctgca

SEQ ID NO: 16409 - DNA, 18 bp, Homo sapiens
agatgtccggggctgcac

SEQ ID NO: 16410 - DNA, 25 bp, Homo sapiens
agatgtccggggctgcacgcgcgct

SEQ ID NO: 16411 - DNA, 26 bp, Homo sapiens
agatgtccggggctgcacgcgcgcta

SEQ ID NO: 16412 - DNA, 30 bp, Homo sapiens
agatgtccggggctgcacgcgcgctacact

SEQ ID NO: 16413 - DNA, 33 bp, Homo sapiens; identical to SEQ ID NO: 3308

SEQ ID NO: 16414 - DNA, 16 bp, Homo sapiens
gatgtccggggctgca

SEQ ID NO: 16415 - DNA, 17 bp, Homo sapiens
gatgtccggggctgcac

SEQ ID NO: 16416 - DNA, 19 bp, Homo sapiens
gatgtccggggctgcacgc

SEQ ID NO: 16417 - DNA, 21 bp, Homo sapiens
gatgtccggggctgcacgcgc

SEQ ID NO: 16418 - DNA, 23 bp, Homo sapiens
gatgtccggggctgcacgcgcgc

SEQ ID NO: 16419 - DNA, 24 bp, Homo sapiens
gatgtccggggctgcacgcgcgct

SEQ ID NO: 16420 - DNA, 25 bp, Homo sapiens
gatgtccggggctgcacgcgcgcta

SEQ ID NO: 16421 - DNA, 27 bp, Homo sapiens
gatgtccggggctgcacgcgcgctaca

SEQ ID NO: 16422 - DNA, 28 bp, Homo sapiens
gatgtccggggctgcacgcgcgctacac

SEQ ID NO: 16423 - DNA, 29 bp, Homo sapiens
gatgtccggggctgcacgcgcgctacact

SEQ ID NO: 16424 - DNA, 31 bp, Homo sapiens
gatgtccggggctgcacgcgcgctacactga

SEQ ID NO: 16425 - DNA, 32 bp, Homo sapiens
gatgtccggggctgcacgcgcgctacactgac

SEQ ID NO: 16426 - DNA, 33 bp, Homo sapiens; identical to SEQ ID NO: 3311

SEQ ID NO: 16427 - DNA, 37 bp, Homo sapiens
gatgtccggggctgcacgcgcgctacactgactggct

SEQ ID NO: 16428 - DNA, 46 bp, Homo sapiens
gatgtccggggctgcacgcgcgctacactgactggctcagcgtgtg

SEQ ID NO: 16429 - DNA, 23 bp, Homo sapiens
atgtccggggctgcacgcgcgct

SEQ ID NO: 16430 - DNA, 24 bp, Homo sapiens
atgtccggggctgcacgcgcgcta

SEQ ID NO: 16431 - DNA, 26 bp, Homo sapiens
atgtccggggctgcacgcgcgctaca

SEQ ID NO: 16432 - DNA, 28 bp, Homo sapiens
atgtccggggctgcacgcgcgctacact

SEQ ID NO: 16433 - DNA, 31 bp, Homo sapiens
atgtccggggctgcacgcgcgctacactgac

SEQ ID NO: 16434 - DNA, 32 bp, Homo sapiens
atgtccggggctgcacgcgcgctacactgact

SEQ ID NO: 16435 - DNA, 17 bp, Homo sapiens
tgtccggggctgcacgc

SEQ ID NO: 16436 - DNA, 19 bp, Homo sapiens
tgtccggggctgcacgcgc

SEQ ID NO: 16437 - DNA, 21 bp, Homo sapiens
tgtccggggctgcacgcgcgc

SEQ ID NO: 16438 - DNA, 22 bp, Homo sapiens
tgtccggggctgcacgcgcgct

SEQ ID NO: 16439 - DNA, 23 bp, Homo sapiens
tgtccggggctgcacgcgcgcta

SEQ ID NO: 16440 - DNA, 25 bp, Homo sapiens
tgtccggggctgcacgcgcgctaca

SEQ ID NO: 16441 - DNA, 27 bp, Homo sapiens
tgtccggggctgcacgcgcgctacact

SEQ ID NO: 16442 - DNA, 29 bp, Homo sapiens
tgtccggggctgcacgcgcgctacactga

SEQ ID NO: 16443 - DNA, 30 bp, Homo sapiens
tgtccggggctgcacgcgcgctacactgac

SEQ ID NO: 16444 - DNA, 31 bp, Homo sapiens
tgtccggggctgcacgcgcgctacactgact

SEQ ID NO: 16445 - DNA, 16 bp, Homo sapiens
gtccggggctgcacgc

SEQ ID NO: 16446 - DNA, 21 bp, Homo sapiens
gtccggggctgcacgcgcgct

SEQ ID NO: 16447 - DNA, 26 bp, Homo sapiens
gtccggggctgcacgcgcgctacact

SEQ ID NO: 16448 - DNA, 30 bp, Homo sapiens
gtccggggctgcacgcgcgctacactgact

SEQ ID NO: 16449 - DNA, 19 bp, Homo sapiens
tccggggctgcacgcgcgc

SEQ ID NO: 16450 - DNA, 20 bp, Homo sapiens
tccggggctgcacgcgcgct

SEQ ID NO: 16451 - DNA, 27 bp, Homo sapiens
tccggggctgcacgcgcgctacactga

SEQ ID NO: 16452 - DNA, 29 bp, Homo sapiens
tccggggctgcacgcgcgctacactgact

SEQ ID NO: 16453 - DNA, 18 bp, Homo sapiens
ccggggctgcacgcgcgc

SEQ ID NO: 16454 - DNA, 32 bp, Homo sapiens
ccggggctgcacgcgcgctacactgactggct

SEQ ID NO: 16455 - DNA, 18 bp, Homo sapiens
cggggctgcacgcgcgct

SEQ ID NO: 16456 - DNA, 27 bp, Homo sapiens
cggggctgcacgcgcgctacactgact

SEQ ID NO: 16457 - DNA, 26 bp, Homo sapiens
ggggctgcacgcgcgctacactgact

SEQ ID NO: 16458 - DNA, 23 bp, Homo sapiens
ctgcacgcgcgctacactgactg

SEQ ID NO: 16459 - DNA, 28 bp, Homo sapiens
ctgcacgcgcgctacactgactggctca

SEQ ID NO: 16460 - DNA, 22 bp, Homo sapiens
tgcacgcgcgctacactgactg

SEQ ID NO: 16461 - DNA, 25 bp, Homo sapiens
tgcacgcgcgctacactgactggct

SEQ ID NO: 16462 - DNA, 27 bp, Homo sapiens
tgcacgcgcgctacactgactggctca

SEQ ID NO: 16463 - DNA, 17 bp, Homo sapiens
gcacgcgcgctacactg

SEQ ID NO: 16464 - DNA, 21 bp, Homo sapiens
gcacgcgcgctacactgactg

SEQ ID NO: 16465 - DNA, 24 bp, Homo sapiens
gcacgcgcgctacactgactggct

SEQ ID NO: 16466 - DNA, 25 bp, Homo sapiens
gcacgcgcgctacactgactggctc

SEQ ID NO: 16467 - DNA, 26 bp, Homo sapiens
gcacgcgcgctacactgactggctca

SEQ ID NO: 16468 - DNA, 25 bp, Homo sapiens
cacgcgcgctacactgactggctca

SEQ ID NO: 16469 - DNA, 24 bp, Homo sapiens
acgcgcgctacactgactggctca

SEQ ID NO: 16470 - DNA, 31 bp, Homo sapiens
acgcgcgctacactgactggctcagcgtgtg

SEQ ID NO: 16471 - DNA, 17 bp, Homo sapiens
cgcgcgctacactgact

SEQ ID NO: 16472 - DNA, 18 bp, Homo sapiens
cgcgcgctacactgactg

SEQ ID NO: 16473 - DNA, 20 bp, Homo sapiens
cgcgcgctacactgactggc

SEQ ID NO: 16474 - DNA, 21 bp, Homo sapiens
cgcgcgctacactgactggct

SEQ ID NO: 16475 - DNA, 22 bp, Homo sapiens
cgcgcgctacactgactggctc

SEQ ID NO: 16476 - DNA, 23 bp, Homo sapiens
cgcgcgctacactgactggctca

SEQ ID NO: 16477 - DNA, 28 bp, Homo sapiens
cgcgcgctacactgactggctcagcgtg

SEQ ID NO: 16478 - DNA, 30 bp, Homo sapiens; identical to SEQ ID NO: 3313

SEQ ID NO: 16479 - DNA, 29 bp, Homo sapiens
gcgcgctacactgactggctcagcgtgtg

SEQ ID NO: 16480 - DNA, 28 bp, Homo sapiens
cgcgctacactgactggctcagcgtgtg

SEQ ID NO: 16481 - DNA, 28 bp, Homo sapiens
gctacactgactggctcagcgtgtgcct

SEQ ID NO: 16482 - DNA, 16 bp, Homo sapiens
ctacactgactggctc

SEQ ID NO: 16483 - DNA, 26 bp, Homo sapiens
ctacactgactggctcagcgtgtgcc

SEQ ID NO: 16484 - DNA, 27 bp, Homo sapiens
ctacactgactggctcagcgtgtgcct

SEQ ID NO: 16485 - DNA, 30 bp, Homo sapiens
ctacactgactggctcagcgtgtgcctacc

SEQ ID NO: 16486 - DNA, 31 bp, Homo sapiens
ctacactgactggctcagcgtgtgcctaccc

SEQ ID NO: 16487 - DNA, 32 bp, Homo sapiens
ctacactgactggctcagcgtgtgcctaccct

SEQ ID NO: 16488 - DNA, 33 bp, Homo sapiens
ctacactgactggctcagcgtgtgcctacccta

SEQ ID NO: 16489 - DNA, 16 bp, Homo sapiens
tacactgactggctca

SEQ ID NO: 16490 - DNA, 23 bp, Homo sapiens
cactgactggctcagcgtgtgcc

SEQ ID NO: 16491 - DNA, 24 bp, Homo sapiens
cactgactggctcagcgtgtgcct

SEQ ID NO: 16492 - DNA, 25 bp, Homo sapiens
cactgactggctcagcgtgtgccta

SEQ ID NO: 16493 - DNA, 27 bp, Homo sapiens
cactgactggctcagcgtgtgcctacc

SEQ ID NO: 16494 - DNA, 28 bp, Homo sapiens
cactgactggctcagcgtgtgcctaccc

SEQ ID NO: 16495 - DNA, 29 bp, Homo sapiens
cactgactggctcagcgtgtgcctaccct

SEQ ID NO: 16496 - DNA, 30 bp, Homo sapiens
cactgactggctcagcgtgtgcctacccta

SEQ ID NO: 16497 - DNA, 33 bp, Homo sapiens
cactgactggctcagcgtgtgcctaccctacgc

SEQ ID NO: 16498 - DNA, 22 bp, Homo sapiens
actgactggctcagcgtgtgcc

SEQ ID NO: 16499 - DNA, 23 bp, Homo sapiens
actgactggctcagcgtgtgcct

SEQ ID NO: 16500 - DNA, 26 bp, Homo sapiens
actgactggctcagcgtgtgcctacc

SEQ ID NO: 16501 - DNA, 27 bp, Homo sapiens
actgactggctcagcgtgtgcctaccc

SEQ ID NO: 16502 - DNA, 28 bp, Homo sapiens
actgactggctcagcgtgtgcctaccct

SEQ ID NO: 16503 - DNA, 32 bp, Homo sapiens
actgactggctcagcgtgtgcctaccctacgc

SEQ ID NO: 16504 - DNA, 20 bp, Homo sapiens
ctgactggctcagcgtgtgc

SEQ ID NO: 16505 - DNA, 21 bp, Homo sapiens
ctgactggctcagcgtgtgcc

SEQ ID NO: 16506 - DNA, 22 bp, Homo sapiens
ctgactggctcagcgtgtgcct

SEQ ID NO: 16507 - DNA, 23 bp, Homo sapiens
ctgactggctcagcgtgtgccta

SEQ ID NO: 16508 - DNA, 25 bp, Homo sapiens
ctgactggctcagcgtgtgcctacc

SEQ ID NO: 16509 - DNA, 26 bp, Homo sapiens
ctgactggctcagcgtgtgcctaccc

SEQ ID NO: 16510 - DNA, 27 bp, Homo sapiens
ctgactggctcagcgtgtgcctaccct

SEQ ID NO: 16511 - DNA, 28 bp, Homo sapiens
ctgactggctcagcgtgtgcctacccta

SEQ ID NO: 16512 - DNA, 31 bp, Homo sapiens; identical to SEQ ID NO: 3327

SEQ ID NO: 16513 - DNA, 32 bp, Homo sapiens
ctgactggctcagcgtgtgcctaccctacgcc

SEQ ID NO: 16514 - DNA, 20 bp, Homo sapiens
tgactggctcagcgtgtgcc

SEQ ID NO: 16515 - DNA, 21 bp, Homo sapiens
tgactggctcagcgtgtgcct

SEQ ID NO: 16516 - DNA, 31 bp, Homo sapiens
ctggctcagcgtgtgcctaccctacgccggc

SEQ ID NO: 16517 - DNA, 32 bp, Homo sapiens
ctggctcagcgtgtgcctaccctacgccggca

SEQ ID NO: 16518 - DNA, 24 bp, Homo sapiens
gcgtgtgcctaccctacgccggca

SEQ ID NO: 16519 - DNA, 23 bp, Homo sapiens
cgtgtgcctaccctacgccggca

SEQ ID NO: 16520 - DNA, 16 bp, Homo sapiens
cctaccctacgccggc

SEQ ID NO: 16521 - DNA, 17 bp, Homo sapiens
cctaccctacgccggca

SEQ ID NO: 16522 - DNA, 16 bp, Homo sapiens
taccctacgccggcag

SEQ ID NO: 16523 - DNA, 17 bp, Homo sapiens
taccctacgccggcagg

SEQ ID NO: 16524 - DNA, 36 bp, Homo sapiens
taccctacgccggcaggcgcgggtaacccgttgaac

SEQ ID NO: 16525 - DNA, 37 bp, Homo sapiens
taccctacgccggcaggcgcgggtaacccgttgaacc

SEQ ID NO: 16526 - DNA, 38 bp, Homo sapiens
taccctacgccggcaggcgcgggtaacccgttgaaccc

SEQ ID NO: 16527 - DNA, 16 bp, Homo sapiens
accctacgccggcagg

SEQ ID NO: 16528 - DNA, 35 bp, Homo sapiens
accctacgccggcaggcgcgggtaacccgttgaac

SEQ ID NO: 16529 - DNA, 31 bp, Homo sapiens
cgccggcaggcgcgggtaacccgttgaaccc

SEQ ID NO: 16530 - DNA, 29 bp, Homo sapiens
gccggcaggcgcgggtaacccgttgaacc

SEQ ID NO: 16531 - DNA, 30 bp, Homo sapiens
gccggcaggcgcgggtaacccgttgaaccc

SEQ ID NO: 16532 - DNA, 27 bp, Homo sapiens
ccggcaggcgcgggtaacccgttgaac

SEQ ID NO: 16533 - DNA, 28 bp, Homo sapiens
ccggcaggcgcgggtaacccgttgaacc

SEQ ID NO: 16534 - DNA, 29 bp, Homo sapiens
ccggcaggcgcgggtaacccgttgaaccc

SEQ ID NO: 16535 - DNA, 30 bp, Homo sapiens; identical to SEQ ID NO: 3333

SEQ ID NO: 16536 - DNA, 17 bp, Homo sapiens
cggcaggcgcgggtaac

SEQ ID NO: 16537 - DNA, 18 bp, Homo sapiens
cggcaggcgcgggtaacc

SEQ ID NO: 16538 - DNA, 26 bp, Homo sapiens
cggcaggcgcgggtaacccgttgaac

SEQ ID NO: 16539 - DNA, 27 bp, Homo sapiens
cggcaggcgcgggtaacccgttgaacc

SEQ ID NO: 16540 - DNA, 28 bp, Homo sapiens
cggcaggcgcgggtaacccgttgaaccc

SEQ ID NO: 16541 - DNA, 29 bp, Homo sapiens
cggcaggcgcgggtaacccgttgaacccc

SEQ ID NO: 16542 - DNA, 27 bp, Homo sapiens
ggcaggcgcgggtaacccgttgaaccc

SEQ ID NO: 16543 - DNA, 21 bp, Homo sapiens
cgcgggtaacccgttgaaccc

SEQ ID NO: 16544 - DNA, 22 bp, Homo sapiens
cgcgggtaacccgttgaacccc

SEQ ID NO: 16545 - DNA, 32 bp, Homo sapiens
cgcgggtaacccgttgaaccccattcgtgatg

SEQ ID NO: 16546 - DNA, 33 bp, Homo sapiens; identical to SEQ ID NO: 3338

SEQ ID NO: 16547 - DNA, 20 bp, Homo sapiens
gcgggtaacccgttgaaccc

SEQ ID NO: 16548 - DNA, 18 bp, Homo sapiens
cgggtaacccgttgaacc

SEQ ID NO: 16549 - DNA, 19 bp, Homo sapiens
cgggtaacccgttgaaccc

SEQ ID NO: 16550 - DNA, 28 bp, Homo sapiens
cgggtaacccgttgaaccccattcgtga

SEQ ID NO: 16551 - DNA, 29 bp, Homo sapiens
cgggtaacccgttgaaccccattcgtgat

SEQ ID NO: 16552 - DNA, 30 bp, Homo sapiens
cgggtaacccgttgaaccccattcgtgatg

SEQ ID NO: 16553 - DNA, 31 bp, Homo sapiens
cgggtaacccgttgaaccccattcgtgatgg

SEQ ID NO: 16554 - DNA, 16 bp, Homo sapiens
ggtaacccgttgaacc

SEQ ID NO: 16555 - DNA, 17 bp, Homo sapiens
ggtaacccgttgaaccc

SEQ ID NO: 16556 - DNA, 18 bp, Homo sapiens
ggtaacccgttgaacccc

SEQ ID NO: 16557 - DNA, 16 bp, Homo sapiens
gtaacccgttgaaccc

SEQ ID NO: 16558 - DNA, 24 bp, Homo sapiens
taacccgttgaaccccattcgtga

SEQ ID NO: 16559 - DNA, 22 bp, Homo sapiens
acccgttgaaccccattcgtga

SEQ ID NO: 16560 - DNA, 21 bp, Homo sapiens
cccgttgaaccccattcgtga

SEQ ID NO: 16561 - DNA, 22 bp, Homo sapiens
cccgttgaaccccattcgtgat

SEQ ID NO: 16562 - DNA, 23 bp, Homo sapiens
cccgttgaaccccattcgtgatg

SEQ ID NO: 16563 - DNA, 20 bp, Homo sapiens
ccgttgaaccccattcgtga

SEQ ID NO: 16564 - DNA, 22 bp, Homo sapiens
ccgttgaaccccattcgtgatg

SEQ ID NO: 16565 - DNA, 17 bp, Homo sapiens
cgttgaaccccattcgt

SEQ ID NO: 16566 - DNA, 21 bp, Homo sapiens
cgttgaaccccattcgtgatg

SEQ ID NO: 16567 - DNA, 22 bp, Homo sapiens
cgttgaaccccattcgtgatgg

SEQ ID NO: 16568 - DNA, 16 bp, Homo sapiens
gttgaaccccattcgt

SEQ ID NO: 16569 - DNA, 32 bp, Homo sapiens
gttgaaccccattcgtgatggggatcggggat

SEQ ID NO: 16570 - DNA, 17 bp, Homo sapiens
gaaccccattcgtgatg

SEQ ID NO: 16571 - DNA, 29 bp, Homo sapiens
gaaccccattcgtgatggggatcggggat

SEQ ID NO: 16572 - DNA, 32 bp, Homo sapiens
gaaccccattcgtgatggggatcggggattgc

SEQ ID NO: 16573 - DNA, 33 bp, Homo sapiens; identical to SEQ ID NO: 3343

SEQ ID NO: 16574 - DNA, 16 bp, Homo sapiens
aaccccattcgtgatg

SEQ ID NO: 16575 - DNA, 32 bp, Homo sapiens
aaccccattcgtgatggggatcggggattgca

SEQ ID NO: 16576 - DNA, 16 bp, Homo sapiens
accccattcgtgatgg

SEQ ID NO: 16577 - DNA, 31 bp, Homo sapiens
accccattcgtgatggggatcggggattgca

SEQ ID NO: 16578 - DNA, 32 bp, Homo sapiens
accccattcgtgatggggatcggggattgcaa

SEQ ID NO: 16579 - DNA, 25 bp, Homo sapiens
ccccattcgtgatggggatcgggga

SEQ ID NO: 16580 - DNA, 26 bp, Homo sapiens
ccccattcgtgatggggatcggggat

SEQ ID NO: 16581 - DNA, 27 bp, Homo sapiens
ccccattcgtgatggggatcggggatt

SEQ ID NO: 16582 - DNA, 30 bp, Homo sapiens; identical to SEQ ID NO: 3344

SEQ ID NO: 16583 - DNA, 31 bp, Homo sapiens
ccccattcgtgatggggatcggggattgcaa

SEQ ID NO: 16584 - DNA, 24 bp, Homo sapiens
cccattcgtgatggggatcgggga

SEQ ID NO: 16585 - DNA, 25 bp, Homo sapiens
cccattcgtgatggggatcggggat

SEQ ID NO: 16586 - DNA, 29 bp, Homo sapiens
cccattcgtgatggggatcggggattgca

SEQ ID NO: 16587 - DNA, 30 bp, Homo sapiens
cccattcgtgatggggatcggggattgcaa

SEQ ID NO: 16588 - DNA, 23 bp, Homo sapiens
ccattcgtgatggggatcgggga

SEQ ID NO: 16589 - DNA, 24 bp, Homo sapiens
ccattcgtgatggggatcggggat

SEQ ID NO: 16590 - DNA, 25 bp, Homo sapiens
ccattcgtgatggggatcggggatt

SEQ ID NO: 16591 - DNA, 26 bp, Homo sapiens
ccattcgtgatggggatcggggattg

SEQ ID NO: 16592 - DNA, 27 bp, Homo sapiens
ccattcgtgatggggatcggggattgc

SEQ ID NO: 16593 - DNA, 28 bp, Homo sapiens
ccattcgtgatggggatcggggattgca

SEQ ID NO: 16594 - DNA, 29 bp, Homo sapiens
ccattcgtgatggggatcggggattgcaa

SEQ ID NO: 16595 - DNA, 30 bp, Homo sapiens
ccattcgtgatggggatcggggattgcaat

SEQ ID NO: 16596 - DNA, 33 bp, Homo sapiens
ccattcgtgatggggatcggggattgcaattat

SEQ ID NO: 16597 - DNA, 25 bp, Homo sapiens
cattcgtgatggggatcggggattg

SEQ ID NO: 16598 - DNA, 26 bp, Homo sapiens
cattcgtgatggggatcggggattgc

SEQ ID NO: 16599 - DNA, 27 bp, Homo sapiens
cattcgtgatggggatcggggattgca

SEQ ID NO: 16600 - DNA, 16 bp, Homo sapiens
attcgtgatggggatc

SEQ ID NO: 16601 - DNA, 17 bp, Homo sapiens
attcgtgatggggatcg

SEQ ID NO: 16602 - DNA, 22 bp, Homo sapiens
attcgtgatggggatcggggat

SEQ ID NO: 16603 - DNA, 23 bp, Homo sapiens
attcgtgatggggatcggggatt

SEQ ID NO: 16604 - DNA, 24 bp, Homo sapiens
attcgtgatggggatcggggattg

SEQ ID NO: 16605 - DNA, 25 bp, Homo sapiens
attcgtgatggggatcggggattgc

SEQ ID NO: 16606 - DNA, 26 bp, Homo sapiens
attcgtgatggggatcggggattgca

SEQ ID NO: 16607 - DNA, 20 bp, Homo sapiens
ttcgtgatggggatcgggga

SEQ ID NO: 16608 - DNA, 21 bp, Homo sapiens
ttcgtgatggggatcggggat

SEQ ID NO: 16609 - DNA, 22 bp, Homo sapiens
ttcgtgatggggatcggggatt

SEQ ID NO: 16610 - DNA, 23 bp, Homo sapiens
ttcgtgatggggatcggggattg

SEQ ID NO: 16611 - DNA, 24 bp, Homo sapiens
ttcgtgatggggatcggggattgc

SEQ ID NO: 16612 - DNA, 25 bp, Homo sapiens
ttcgtgatggggatcggggattgca

SEQ ID NO: 16613 - DNA, 26 bp, Homo sapiens
ttcgtgatggggatcggggattgcaa

SEQ ID NO: 16614 - DNA, 29 bp, Homo sapiens
ttcgtgatggggatcggggattgcaatta

SEQ ID NO: 16615 - DNA, 33 bp, Homo sapiens
ttcgtgatggggatcggggattgcaattattcc

SEQ ID NO: 16616 - DNA, 22 bp, Homo sapiens
tcgtgatggggatcggggattg

SEQ ID NO: 16617 - DNA, 24 bp, Homo sapiens
tcgtgatggggatcggggattgca

SEQ ID NO: 16618 - DNA, 23 bp, Homo sapiens
cgtgatggggatcggggattgca

SEQ ID NO: 16619 - DNA, 20 bp, Homo sapiens
gtgatggggatcggggattg

SEQ ID NO: 16620 - DNA, 22 bp, Homo sapiens
gtgatggggatcggggattgca

SEQ ID NO: 16621 - DNA, 23 bp, Homo sapiens
gtgatggggatcggggattgcaa

SEQ ID NO: 16622 - DNA, 29 bp, Homo sapiens
gtgatggggatcggggattgcaattattc

SEQ ID NO: 16623 - DNA, 19 bp, Homo sapiens
tgatggggatcggggattg

SEQ ID NO: 16624 - DNA, 20 bp, Homo sapiens
tgatggggatcggggattgc

SEQ ID NO: 16625 - DNA, 21 bp, Homo sapiens
tgatggggatcggggattgca

SEQ ID NO: 16626 - DNA, 27 bp, Homo sapiens
tgatggggatcggggattgcaattatt

SEQ ID NO: 16627 - DNA, 28 bp, Homo sapiens
tgatggggatcggggattgcaattattc

SEQ ID NO: 16628 - DNA, 16 bp, Homo sapiens
gatggggatcggggat

SEQ ID NO: 16629 - DNA, 17 bp, Homo sapiens
gatggggatcggggatt

SEQ ID NO: 16630 - DNA, 27 bp, Homo sapiens
gatggggatcggggattgcaattattc

SEQ ID NO: 16631 - DNA, 16 bp, Homo sapiens
atggggatcggggatt

SEQ ID NO: 16632 - DNA, 17 bp, Homo sapiens
atggggatcggggattg

SEQ ID NO: 16633 - DNA, 18 bp, Homo sapiens
atggggatcggggattgc

SEQ ID NO: 16634 - DNA, 19 bp, Homo sapiens
atggggatcggggattgca

SEQ ID NO: 16635 - DNA, 20 bp, Homo sapiens
atggggatcggggattgcaa

SEQ ID NO: 16636 - DNA, 21 bp, Homo sapiens
atggggatcggggattgcaat

SEQ ID NO: 16637 - DNA, 22 bp, Homo sapiens
atggggatcggggattgcaatt

SEQ ID NO: 16638 - DNA, 23 bp, Homo sapiens
atggggatcggggattgcaatta

SEQ ID NO: 16639 - DNA, 24 bp, Homo sapiens
atggggatcggggattgcaattat

SEQ ID NO: 16640 - DNA, 25 bp, Homo sapiens
atggggatcggggattgcaattatt

SEQ ID NO: 16641 - DNA, 26 bp, Homo sapiens
atggggatcggggattgcaattattc

SEQ ID NO: 16642 - DNA, 27 bp, Homo sapiens
atggggatcggggattgcaattattcc

SEQ ID NO: 16643 - DNA, 28 bp, Homo sapiens
atggggatcggggattgcaattattccc

SEQ ID NO: 16644 - DNA, 18 bp, Homo sapiens
tggggatcggggattgca

SEQ ID NO: 16645 - DNA, 19 bp, Homo sapiens
tggggatcggggattgcaa

SEQ ID NO: 16646 - DNA, 22 bp, Homo sapiens
tggggatcggggattgcaatta

SEQ ID NO: 16647 - DNA, 25 bp, Homo sapiens
tggggatcggggattgcaattattc

SEQ ID NO: 16648 - DNA, 17 bp, Homo sapiens
ggggatcggggattgca

SEQ ID NO: 16649 - DNA, 20 bp, Homo sapiens
ggggatcggggattgcaatt

SEQ ID NO: 16650 - DNA, 21 bp, Homo sapiens
ggggatcggggattgcaatta

SEQ ID NO: 16651 - DNA, 22 bp, Homo sapiens
ggggatcggggattgcaattat

SEQ ID NO: 16652 - DNA, 23 bp, Homo sapiens
ggggatcggggattgcaattatt

SEQ ID NO: 16653 - DNA, 24 bp, Homo sapiens
ggggatcggggattgcaattattc

SEQ ID NO: 16654 - DNA, 25 bp, Homo sapiens
ggggatcggggattgcaattattcc

SEQ ID NO: 16655 - DNA, 20 bp, Homo sapiens
atcggggattgcaattattc

SEQ ID NO: 16656 - DNA, 16 bp, Homo sapiens
tcggggattgcaatta

SEQ ID NO: 16657 - DNA, 19 bp, Homo sapiens
tcggggattgcaattattc

SEQ ID NO: 16658 - DNA, 18 bp, Homo sapiens
cggggattgcaattattc

SEQ ID NO: 16659 - DNA, 17 bp, Homo sapiens
ggggattgcaattattc

SEQ ID NO: 16660 - DNA, 16 bp, Homo sapiens
gggattgcaattattc

SEQ ID NO: 16661 - DNA, 16 bp, Homo sapiens
attattccccatgaac

SEQ ID NO: 16662 - DNA, 17 bp, Homo sapiens
attattccccatgaacg

SEQ ID NO: 16663 - DNA, 25 bp, Homo sapiens
ccccatgaacgaggaattcccagta

SEQ ID NO: 16664 - DNA, 31 bp, Homo sapiens
ccccatgaacgaggaattcccagtaagtgcg

SEQ ID NO: 16665 - DNA, 28 bp, Homo sapiens
catgaacgaggaattcccagtaagtgcg

SEQ ID NO: 16666 - DNA, 32 bp, Homo sapiens
catgaacgaggaattcccagtaagtgcgggtc

SEQ ID NO: 16667 - DNA, 31 bp, Homo sapiens
atgaacgaggaattcccagtaagtgcgggtc

SEQ ID NO: 16668 - DNA, 20 bp, Homo sapiens
tgaacgaggaattcccagta

SEQ ID NO: 16669 - DNA, 33 bp, Homo sapiens
tgaacgaggaattcccagtaagtgcgggtcata

SEQ ID NO: 16670 - DNA, 28 bp, Homo sapiens
aacgaggaattcccagtaagtgcgggtc

SEQ ID NO: 16671 - DNA, 23 bp, Homo sapiens
cgaggaattcccagtaagtgcgg

SEQ ID NO: 16672 - DNA, 26 bp, Homo sapiens
cgaggaattcccagtaagtgcgggtc

SEQ ID NO: 16673 - DNA, 29 bp, Homo sapiens
cgaggaattcccagtaagtgcgggtcata

SEQ ID NO: 16674 - DNA, 21 bp, Homo sapiens
aattcccagtaagtgcgggtc

SEQ ID NO: 16675 - DNA, 20 bp, Homo sapiens
attcccagtaagtgcgggtc

SEQ ID NO: 16676 - DNA, 19 bp, Homo sapiens
ttcccagtaagtgcgggtc

SEQ ID NO: 16677 - DNA, 18 bp, Homo sapiens
tcccagtaagtgcgggtc

SEQ ID NO: 16678 - DNA, 17 bp, Homo sapiens
cccagtaagtgcgggtc

SEQ ID NO: 16679 - DNA, 24 bp, Homo sapiens
cccagtaagtgcgggtcataagct

SEQ ID NO: 16680 - DNA, 16 bp, Homo sapiens
ccagtaagtgcgggtc

SEQ ID NO: 16681 - DNA, 23 bp, Homo sapiens
ccagtaagtgcgggtcataagct

SEQ ID NO: 16682 - DNA, 18 bp, Homo sapiens
cagtaagtgcgggtcata

SEQ ID NO: 16683 - DNA, 21 bp, Homo sapiens
cagtaagtgcgggtcataagc

SEQ ID NO: 16684 - DNA, 22 bp, Homo sapiens
cagtaagtgcgggtcataagct

SEQ ID NO: 16685 - DNA, 21 bp, Homo sapiens
agtaagtgcgggtcataagct

SEQ ID NO: 16686 - DNA, 16 bp, Homo sapiens
gtaagtgcgggtcata

SEQ ID NO: 16687 - DNA, 20 bp, Homo sapiens
gtaagtgcgggtcataagct

SEQ ID NO: 16688 - DNA, 17 bp, Homo sapiens
agtgcgggtcataagct

SEQ ID NO: 16689 - DNA, 33 bp, Homo sapiens
agtgcgggtcataagcttgcgttgattaagtcc

SEQ ID NO: 16690 - DNA, 16 bp, Homo sapiens
gtgcgggtcataagct

SEQ ID NO: 16691 - DNA, 31 bp, Homo sapiens
cataagcttgcgttgattaagtccctgccct

SEQ ID NO: 16692 - DNA, 29 bp, Homo sapiens
ataagcttgcgttgattaagtccctgccc

SEQ ID NO: 16693 - DNA, 30 bp, Homo sapiens; identical to SEQ ID NO: 3368

SEQ ID NO: 16694 - DNA, 18 bp, Homo sapiens
taagcttgcgttgattaa

SEQ ID NO: 16695 - DNA, 19 bp, Homo sapiens
taagcttgcgttgattaag

SEQ ID NO: 16696 - DNA, 29 bp, Homo sapiens
taagcttgcgttgattaagtccctgccct

SEQ ID NO: 16697 - DNA, 16 bp, Homo sapiens
agcttgcgttgattaa

SEQ ID NO: 16698 - DNA, 17 bp, Homo sapiens
agcttgcgttgattaag

SEQ ID NO: 16699 - DNA, 18 bp, Homo sapiens
agcttgcgttgattaagt

SEQ ID NO: 16700 - DNA, 27 bp, Homo sapiens
agcttgcgttgattaagtccctgccct

SEQ ID NO: 16701 - DNA, 32 bp, Homo sapiens
agcttgcgttgattaagtccctgccctttgta

SEQ ID NO: 16702 - DNA, 16 bp, Homo sapiens
gcttgcgttgattaag

SEQ ID NO: 16703 - DNA, 26 bp, Homo sapiens
gcttgcgttgattaagtccctgccct

SEQ ID NO: 16704 - DNA, 31 bp, Homo sapiens
gcttgcgttgattaagtccctgccctttgta

SEQ ID NO: 16705 - DNA, 33 bp, Homo sapiens
gcttgcgttgattaagtccctgccctttgtaca

SEQ ID NO: 16706 - DNA, 37 bp, Homo sapiens
gcttgcgttgattaagtccctgccctttgtacacacc

SEQ ID NO: 16707 - DNA, 23 bp, Homo sapiens
cttgcgttgattaagtccctgcc

SEQ ID NO: 16708 - DNA, 24 bp, Homo sapiens
cttgcgttgattaagtccctgccc

SEQ ID NO: 16709 - DNA, 25 bp, Homo sapiens
cttgcgttgattaagtccctgccct

SEQ ID NO: 16710 - DNA, 31 bp, Homo sapiens
cttgcgttgattaagtccctgccctttgtac

SEQ ID NO: 16711 - DNA, 32 bp, Homo sapiens
cttgcgttgattaagtccctgccctttgtaca

SEQ ID NO: 16712 - DNA, 23 bp, Homo sapiens
ttgcgttgattaagtccctgccc

SEQ ID NO: 16713 - DNA, 24 bp, Homo sapiens
ttgcgttgattaagtccctgccct

SEQ ID NO: 16714 - DNA, 31 bp, Homo sapiens
ttgcgttgattaagtccctgccctttgtaca

SEQ ID NO: 16715 - DNA, 21 bp, Homo sapiens
tgcgttgattaagtccctgcc

SEQ ID NO: 16716 - DNA, 22 bp, Homo sapiens
tgcgttgattaagtccctgccc

SEQ ID NO: 16717 - DNA, 23 bp, Homo sapiens
tgcgttgattaagtccctgccct

SEQ ID NO: 16718 - DNA, 28 bp, Homo sapiens
tgcgttgattaagtccctgccctttgta

SEQ ID NO: 16719 - DNA, 29 bp, Homo sapiens
tgcgttgattaagtccctgccctttgtac

SEQ ID NO: 16720 - DNA, 30 bp, Homo sapiens; identical to SEQ ID NO: 3372

SEQ ID NO: 16721 - DNA, 31 bp, Homo sapiens; identical to SEQ ID NO: 3373

SEQ ID NO: 16722 - DNA, 32 bp, Homo sapiens; identical to SEQ ID NO: 3374

SEQ ID NO: 16723 - DNA, 34 bp, Homo sapiens
tgcgttgattaagtccctgccctttgtacacacc

SEQ ID NO: 16724 - DNA, 44 bp, Homo sapiens
tgcgttgattaagtccctgccctttgtacacaccgcccgtcgct

SEQ ID NO: 16725 - DNA, 28 bp, Homo sapiens
gcgttgattaagtccctgccctttgtac

SEQ ID NO: 16726 - DNA, 29 bp, Homo sapiens
gcgttgattaagtccctgccctttgtaca

SEQ ID NO: 16727 - DNA, 31 bp, Homo sapiens
gcgttgattaagtccctgccctttgtacaca

SEQ ID NO: 16728 - DNA, 33 bp, Homo sapiens; identical to SEQ ID NO: 3376

SEQ ID NO: 16729 - DNA, 19 bp, Homo sapiens
cgttgattaagtccctgcc

SEQ ID NO: 16730 - DNA, 21 bp, Homo sapiens
cgttgattaagtccctgccct

SEQ ID NO: 16731 - DNA, 32 bp, Homo sapiens
cgttgattaagtccctgccctttgtacacacc

SEQ ID NO: 16732 - DNA, 18 bp, Homo sapiens
gttgattaagtccctgcc

SEQ ID NO: 16733 - DNA, 31 bp, Homo sapiens
gttgattaagtccctgccctttgtacacacc

SEQ ID NO: 16734 - DNA, 17 bp, Homo sapiens
ttgattaagtccctgcc

SEQ ID NO: 16735 - DNA, 18 bp, Homo sapiens
ttgattaagtccctgccc

SEQ ID NO: 16736 - DNA, 19 bp, Homo sapiens
ttgattaagtccctgccct

SEQ ID NO: 16737 - DNA, 26 bp, Homo sapiens
ttgattaagtccctgccctttgtaca

SEQ ID NO: 16738 - DNA, 28 bp, Homo sapiens
ttgattaagtccctgccctttgtacaca

SEQ ID NO: 16739 - DNA, 30 bp, Homo sapiens; identical to SEQ ID NO: 3378

SEQ ID NO: 16740 - DNA, 33 bp, Homo sapiens
ttgattaagtccctgccctttgtacacaccgcc

SEQ ID NO: 16741 - DNA, 34 bp, Homo sapiens
ttgattaagtccctgccctttgtacacaccgccc

SEQ ID NO: 16742 - DNA, 37 bp, Homo sapiens
ttgattaagtccctgccctttgtacacaccgcccgtc

SEQ ID NO: 16743 - DNA, 40 bp, Homo sapiens
ttgattaagtccctgccctttgtacacaccgcccgtcgct

SEQ ID NO: 16744 - DNA, 25 bp, Homo sapiens
tgattaagtccctgccctttgtaca

SEQ ID NO: 16745 - DNA, 27 bp, Homo sapiens
tgattaagtccctgccctttgtacaca

SEQ ID NO: 16746 - DNA, 29 bp, Homo sapiens
tgattaagtccctgccctttgtacacacc

SEQ ID NO: 16747 - DNA, 33 bp, Homo sapiens
tgattaagtccctgccctttgtacacaccgccc

SEQ ID NO: 16748 - DNA, 24 bp, Homo sapiens
gattaagtccctgccctttgtaca

SEQ ID NO: 16749 - DNA, 26 bp, Homo sapiens
gattaagtccctgccctttgtacaca

SEQ ID NO: 16750 - DNA, 27 bp, Homo sapiens
gattaagtccctgccctttgtacacac

SEQ ID NO: 16751 - DNA, 28 bp, Homo sapiens
gattaagtccctgccctttgtacacacc

SEQ ID NO: 16752 - DNA, 31 bp, Homo sapiens
gattaagtccctgccctttgtacacaccgcc

SEQ ID NO: 16753 - DNA, 32 bp, Homo sapiens; identical to SEQ ID NO: 3381

SEQ ID NO: 16754 - DNA, 33 bp, Homo sapiens; identical to SEQ ID NO: 3382

SEQ ID NO: 16755 - DNA, 35 bp, Homo sapiens
gattaagtccctgccctttgtacacaccgcccgtc

SEQ ID NO: 16756 - DNA, 38 bp, Homo sapiens
gattaagtccctgccctttgtacacaccgcccgtcgct

SEQ ID NO: 16757 - DNA, 16 bp, Homo sapiens
attaagtccctgccct

SEQ ID NO: 16758 - DNA, 23 bp, Homo sapiens
attaagtccctgccctttgtaca

SEQ ID NO: 16759 - DNA, 25 bp, Homo sapiens
attaagtccctgccctttgtacaca

SEQ ID NO: 16760 - DNA, 27 bp, Homo sapiens
attaagtccctgccctttgtacacacc

SEQ ID NO: 16761 - DNA, 30 bp, Homo sapiens
attaagtccctgccctttgtacacaccgcc

SEQ ID NO: 16762 - DNA, 31 bp, Homo sapiens; identical to SEQ ID NO: 3385

SEQ ID NO: 16763 - DNA, 32 bp, Homo sapiens; identical to SEQ ID NO: 3386

SEQ ID NO: 16764 - DNA, 33 bp, Homo sapiens
attaagtccctgccctttgtacacaccgcccgt

SEQ ID NO: 16765 - DNA, 34 bp, Homo sapiens
attaagtccctgccctttgtacacaccgcccgtc

SEQ ID NO: 16766 - DNA, 35 bp, Homo sapiens
attaagtccctgccctttgtacacaccgcccgtcg

SEQ ID NO: 16767 - DNA, 37 bp, Homo sapiens
attaagtccctgccctttgtacacaccgcccgtcgct

SEQ ID NO: 16768 - DNA, 40 bp, Homo sapiens
attaagtccctgccctttgtacacaccgcccgtcgctact

SEQ ID NO: 16769 - DNA, 20 bp, Homo sapiens
ttaagtccctgccctttgta

SEQ ID NO: 16770 - DNA, 22 bp, Homo sapiens
ttaagtccctgccctttgtaca

SEQ ID NO: 16771 - DNA, 24 bp, Homo sapiens
ttaagtccctgccctttgtacaca

SEQ ID NO: 16772 - DNA, 26 bp, Homo sapiens
ttaagtccctgccctttgtacacacc

SEQ ID NO: 16773 - DNA, 29 bp, Homo sapiens
ttaagtccctgccctttgtacacaccgcc

SEQ ID NO: 16774 - DNA, 30 bp, Homo sapiens
ttaagtccctgccctttgtacacaccgccc

SEQ ID NO: 16775 - DNA, 31 bp, Homo sapiens
ttaagtccctgccctttgtacacaccgcccg

SEQ ID NO: 16776 - DNA, 32 bp, Homo sapiens
ttaagtccctgccctttgtacacaccgcccgt

SEQ ID NO: 16777 - DNA, 33 bp, Homo sapiens
ttaagtccctgccctttgtacacaccgcccgtc

SEQ ID NO: 16778 - DNA, 21 bp, Homo sapiens
taagtccctgccctttgtaca

SEQ ID NO: 16779 - DNA, 23 bp, Homo sapiens
taagtccctgccctttgtacaca

SEQ ID NO: 16780 - DNA, 25 bp, Homo sapiens
taagtccctgccctttgtacacacc

SEQ ID NO: 16781 - DNA, 28 bp, Homo sapiens
taagtccctgccctttgtacacaccgcc

SEQ ID NO: 16782 - DNA, 29 bp, Homo sapiens
taagtccctgccctttgtacacaccgccc

SEQ ID NO: 16783 - DNA, 30 bp, Homo sapiens; identical to SEQ ID NO: 3391

SEQ ID NO: 16784 - DNA, 31 bp, Homo sapiens
taagtccctgccctttgtacacaccgcccgt

SEQ ID NO: 16785 - DNA, 32 bp, Homo sapiens; identical to SEQ ID NO: 3392

SEQ ID NO: 16786 - DNA, 33 bp, Homo sapiens
taagtccctgccctttgtacacaccgcccgtcg

SEQ ID NO: 16787 - DNA, 35 bp, Homo sapiens
taagtccctgccctttgtacacaccgcccgtcgct

SEQ ID NO: 16788 - DNA, 20 bp, Homo sapiens
aagtccctgccctttgtaca

SEQ ID NO: 16789 - DNA, 27 bp, Homo sapiens
aagtccctgccctttgtacacaccgcc

SEQ ID NO: 16790 - DNA, 18 bp, Homo sapiens
gtccctgccctttgtaca

SEQ ID NO: 16791 - DNA, 20 bp, Homo sapiens
gtccctgccctttgtacaca

SEQ ID NO: 16792 - DNA, 27 bp, Homo sapiens
tccctgccctttgtacacaccgcccgt

SEQ ID NO: 16793 - DNA, 19 bp, Homo sapiens
cctgccctttgtacacacc

SEQ ID NO: 16794 - DNA, 23 bp, Homo sapiens
cctgccctttgtacacaccgccc

SEQ ID NO: 16795 - DNA, 24 bp, Homo sapiens
cctgccctttgtacacaccgcccg

SEQ ID NO: 16796 - DNA, 26 bp, Homo sapiens
cctgccctttgtacacaccgcccgtc

SEQ ID NO: 16797 - DNA, 29 bp, Homo sapiens
cctgccctttgtacacaccgcccgtcgct

SEQ ID NO: 16798 - DNA, 32 bp, Homo sapiens; identical to SEQ ID NO: 3394

SEQ ID NO: 16799 - DNA, 33 bp, Homo sapiens; identical to SEQ ID NO: 3395

SEQ ID NO: 16800 - DNA, 18 bp, Homo sapiens
ctgccctttgtacacacc

SEQ ID NO: 16801 - DNA, 22 bp, Homo sapiens
ctgccctttgtacacaccgccc

SEQ ID NO: 16802 - DNA, 23 bp, Homo sapiens
ctgccctttgtacacaccgcccg

SEQ ID NO: 16803 - DNA, 25 bp, Homo sapiens
ctgccctttgtacacaccgcccgtc

SEQ ID NO: 16804 - DNA, 28 bp, Homo sapiens
ctgccctttgtacacaccgcccgtcgct

SEQ ID NO: 16805 - DNA, 31 bp, Homo sapiens
ctgccctttgtacacaccgcccgtcgctact

SEQ ID NO: 16806 - DNA, 32 bp, Homo sapiens
ctgccctttgtacacaccgcccgtcgctacta

SEQ ID NO: 16807 - DNA, 27 bp, Homo sapiens
tgccctttgtacacaccgcccgtcgct

SEQ ID NO: 16808 - DNA, 30 bp, Homo sapiens
tgccctttgtacacaccgcccgtcgctact

SEQ ID NO: 16809 - DNA, 26 bp, Homo sapiens
gccctttgtacacaccgcccgtcgct

SEQ ID NO: 16810 - DNA, 29 bp, Homo sapiens
gccctttgtacacaccgcccgtcgctact

SEQ ID NO: 16811 - DNA, 30 bp, Homo sapiens
gccctttgtacacaccgcccgtcgctacta

SEQ ID NO: 16812 - DNA, 33 bp, Homo sapiens
cctttgtacacaccgcccgtcgctactaccgat

SEQ ID NO: 16813 - DNA, 23 bp, Homo sapiens
ctttgtacacaccgcccgtcgct

SEQ ID NO: 16814 - DNA, 26 bp, Homo sapiens
ctttgtacacaccgcccgtcgctact

SEQ ID NO: 16815 - DNA, 32 bp, Homo sapiens
ctttgtacacaccgcccgtcgctactaccgat

SEQ ID NO: 16816 - DNA, 22 bp, Homo sapiens
tttgtacacaccgcccgtcgct

SEQ ID NO: 16817 - DNA, 25 bp, Homo sapiens
tttgtacacaccgcccgtcgctact

SEQ ID NO: 16818 - DNA, 24 bp, Homo sapiens
ttgtacacaccgcccgtcgctact

SEQ ID NO: 16819 - DNA, 24 bp, Homo sapiens
tgtacacaccgcccgtcgctacta

SEQ ID NO: 16820 - DNA, 33 bp, Homo sapiens
tgtacacaccgcccgtcgctactaccgattgga

SEQ ID NO: 16821 - DNA, 18 bp, Homo sapiens
tacacaccgcccgtcgct

SEQ ID NO: 16822 - DNA, 21 bp, Homo sapiens
tacacaccgcccgtcgctact

SEQ ID NO: 16823 - DNA, 24 bp, Homo sapiens
tacacaccgcccgtcgctactacc

SEQ ID NO: 16824 - DNA, 17 bp, Homo sapiens
acacaccgcccgtcgct

SEQ ID NO: 16825 - DNA, 20 bp, Homo sapiens
acacaccgcccgtcgctact

SEQ ID NO: 16826 - DNA, 16 bp, Homo sapiens
cacaccgcccgtcgct

SEQ ID NO: 16827 - DNA, 17 bp, Homo sapiens
cacaccgcccgtcgcta

SEQ ID NO: 16828 - DNA, 19 bp, Homo sapiens
cacaccgcccgtcgctact

SEQ ID NO: 16829 - DNA, 20 bp, Homo sapiens
cacaccgcccgtcgctacta

SEQ ID NO: 16830 - DNA, 22 bp, Homo sapiens
cacaccgcccgtcgctactacc

SEQ ID NO: 16831 - DNA, 23 bp, Homo sapiens
cacaccgcccgtcgctactaccg

SEQ ID NO: 16832 - DNA, 24 bp, Homo sapiens
cacaccgcccgtcgctactaccga

SEQ ID NO: 16833 - DNA, 26 bp, Homo sapiens
cacaccgcccgtcgctactaccgatt

SEQ ID NO: 16834 - DNA, 27 bp, Homo sapiens
cacaccgcccgtcgctactaccgattg

SEQ ID NO: 16835 - DNA, 29 bp, Homo sapiens
cacaccgcccgtcgctactaccgattgga

SEQ ID NO: 16836 - DNA, 16 bp, Homo sapiens
acaccgcccgtcgcta

SEQ ID NO: 16837 - DNA, 17 bp, Homo sapiens
acaccgcccgtcgctac

SEQ ID NO: 16838 - DNA, 18 bp, Homo sapiens
acaccgcccgtcgctact

SEQ ID NO: 16839 - DNA, 21 bp, Homo sapiens
acaccgcccgtcgctactacc

SEQ ID NO: 16840 - DNA, 24 bp, Homo sapiens
acaccgcccgtcgctactaccgat

SEQ ID NO: 16841 - DNA, 17 bp, Homo sapiens
caccgcccgtcgctact

SEQ ID NO: 16842 - DNA, 18 bp, Homo sapiens
caccgcccgtcgctacta

SEQ ID NO: 16843 - DNA, 19 bp, Homo sapiens
caccgcccgtcgctactac

SEQ ID NO: 16844 - DNA, 20 bp, Homo sapiens
caccgcccgtcgctactacc

SEQ ID NO: 16845 - DNA, 21 bp, Homo sapiens
caccgcccgtcgctactaccg

SEQ ID NO: 16846 - DNA, 22 bp, Homo sapiens
caccgcccgtcgctactaccga

SEQ ID NO: 16847 - DNA, 23 bp, Homo sapiens
caccgcccgtcgctactaccgat

SEQ ID NO: 16848 - DNA, 24 bp, Homo sapiens
caccgcccgtcgctactaccgatt

SEQ ID NO: 16849 - DNA, 25 bp, Homo sapiens
caccgcccgtcgctactaccgattg

SEQ ID NO: 16850 - DNA, 27 bp, Homo sapiens
caccgcccgtcgctactaccgattgga

SEQ ID NO: 16851 - DNA, 16 bp, Homo sapiens
accgcccgtcgctact

SEQ ID NO: 16852 - DNA, 19 bp, Homo sapiens
accgcccgtcgctactacc

SEQ ID NO: 16853 - DNA, 20 bp, Homo sapiens
accgcccgtcgctactaccg

SEQ ID NO: 16854 - DNA, 16 bp, Homo sapiens
ccgcccgtcgctacta

SEQ ID NO: 16855 - DNA, 17 bp, Homo sapiens
ccgcccgtcgctactac

SEQ ID NO: 16856 - DNA, 18 bp, Homo sapiens
ccgcccgtcgctactacc

SEQ ID NO: 16857 - DNA, 19 bp, Homo sapiens
ccgcccgtcgctactaccg

SEQ ID NO: 16858 - DNA, 20 bp, Homo sapiens
ccgcccgtcgctactaccga

SEQ ID NO: 16859 - DNA, 23 bp, Homo sapiens
ccgcccgtcgctactaccgattg

SEQ ID NO: 16860 - DNA, 25 bp, Homo sapiens
ccgcccgtcgctactaccgattgga

SEQ ID NO: 16861 - DNA, 16 bp, Homo sapiens
cgcccgtcgctactac

SEQ ID NO: 16862 - DNA, 17 bp, Homo sapiens
cgcccgtcgctactacc

SEQ ID NO: 16863 - DNA, 18 bp, Homo sapiens
cgcccgtcgctactaccg

SEQ ID NO: 16864 - DNA, 19 bp, Homo sapiens
cgcccgtcgctactaccga

SEQ ID NO: 16865 - DNA, 22 bp, Homo sapiens
cgcccgtcgctactaccgattg

SEQ ID NO: 16866 - DNA, 16 bp, Homo sapiens
gcccgtcgctactacc

SEQ ID NO: 16867 - DNA, 17 bp, Homo sapiens
gcccgtcgctactaccg

SEQ ID NO: 16868 - DNA, 32 bp, Homo sapiens
cccgtcgctactaccgattggatggtttagtg

SEQ ID NO: 16869 - DNA, 44 bp, Homo sapiens
cccgtcgctactaccgattggatggtttagtgaggccctcggat

SEQ ID NO: 16870 - DNA, 16 bp, Homo sapiens
gtcgctactaccgatt

SEQ ID NO: 16871 - DNA, 41 bp, Homo sapiens
gtcgctactaccgattggatggtttagtgaggccctcggat

SEQ ID NO: 16872 - DNA, 40 bp, Homo sapiens
tcgctactaccgattggatggtttagtgaggccctcggat

SEQ ID NO: 16873 - DNA, 39 bp, Homo sapiens
cgctactaccgattggatggtttagtgaggccctcggat

SEQ ID NO: 16874 - DNA, 38 bp, Homo sapiens
gctactaccgattggatggtttagtgaggccctcggat

SEQ ID NO: 16875 - DNA, 37 bp, Homo sapiens
ctactaccgattggatggtttagtgaggccctcggat

SEQ ID NO: 16876 - DNA, 17 bp, Homo sapiens
actaccgattggatggt

SEQ ID NO: 16877 - DNA, 35 bp, Homo sapiens
actaccgattggatggtttagtgaggccctcggat

SEQ ID NO: 16878 - DNA, 16 bp, Homo sapiens
ctaccgattggatggt

SEQ ID NO: 16879 - DNA, 21 bp, Homo sapiens
ctaccgattggatggtttagt

SEQ ID NO: 16880 - DNA, 28 bp, Homo sapiens
ctaccgattggatggtttagtgaggccc

SEQ ID NO: 16881 - DNA, 30 bp, Homo sapiens
ctaccgattggatggtttagtgaggccctc

SEQ ID NO: 16882 - DNA, 33 bp, Homo sapiens
ctaccgattggatggtttagtgaggccctcgga

SEQ ID NO: 16883 - DNA, 33 bp, Homo sapiens; identical to SEQ ID NO: 3408

SEQ ID NO: 16884 - DNA, 32 bp, Homo sapiens; identical to SEQ ID NO: 3409

SEQ ID NO: 16885 - DNA, 20 bp, Homo sapiens
ccgattggatggtttagtga

SEQ ID NO: 16886 - DNA, 31 bp, Homo sapiens
ccgattggatggtttagtgaggccctcggat

SEQ ID NO: 16887 - DNA, 30 bp, Homo sapiens; identical to SEQ ID NO: 3410

SEQ ID NO: 16888 - DNA, 29 bp, Homo sapiens
gattggatggtttagtgaggccctcggat

SEQ ID NO: 16889 - DNA, 28 bp, Homo sapiens
attggatggtttagtgaggccctcggat

SEQ ID NO: 16890 - DNA, 16 bp, Homo sapiens
ttggatggtttagtga

SEQ ID NO: 16891 - DNA, 23 bp, Homo sapiens
ttggatggtttagtgaggccctc

SEQ ID NO: 16892 - DNA, 26 bp, Homo sapiens
ttggatggtttagtgaggccctcgga

SEQ ID NO: 16893 - DNA, 27 bp, Homo sapiens
ttggatggtttagtgaggccctcggat

SEQ ID NO: 16894 - DNA, 26 bp, Homo sapiens
tggatggtttagtgaggccctcggat

SEQ ID NO: 16895 - DNA, 25 bp, Homo sapiens
ggatggtttagtgaggccctcggat

SEQ ID NO: 16896 - DNA, 30 bp, Homo sapiens
ggatggtttagtgaggccctcggatcggcc

SEQ ID NO: 16897 - DNA, 24 bp, Homo sapiens
gatggtttagtgaggccctcggat

SEQ ID NO: 16898 - DNA, 23 bp, Homo sapiens
atggtttagtgaggccctcggat

SEQ ID NO: 16899 - DNA, 22 bp, Homo sapiens
tggtttagtgaggccctcggat

SEQ ID NO: 16900 - DNA, 21 bp, Homo sapiens
ggtttagtgaggccctcggat

SEQ ID NO: 16901 - DNA, 19 bp, Homo sapiens
gtttagtgaggccctcgga

SEQ ID NO: 16902 - DNA, 20 bp, Homo sapiens
gtttagtgaggccctcggat

SEQ ID NO: 16903 - DNA, 18 bp, Homo sapiens
tttagtgaggccctcgga

SEQ ID NO: 16904 - DNA, 19 bp, Homo sapiens
tttagtgaggccctcggat

SEQ ID NO: 16905 - DNA, 17 bp, Homo sapiens
ttagtgaggccctcgga

SEQ ID NO: 16906 - DNA, 18 bp, Homo sapiens
ttagtgaggccctcggat

SEQ ID NO: 16907 - DNA, 17 bp, Homo sapiens
tagtgaggccctcggat

SEQ ID NO: 16908 - DNA, 16 bp, Homo sapiens
agtgaggccctcggat

SEQ ID NO: 16909 - DNA, 35 bp, Homo sapiens
agtgaggccctcggatcggccccgccggggtcggc

SEQ ID NO: 16910 - DNA, 36 bp, Homo sapiens
agtgaggccctcggatcggccccgccggggtcggcc

SEQ ID NO: 16911 - DNA, 16 bp, Homo sapiens
gtgaggccctcggatc

SEQ ID NO: 16912 - DNA, 19 bp, Homo sapiens
gtgaggccctcggatcggc

SEQ ID NO: 16913 - DNA, 30 bp, Homo sapiens
aggccctcggatcggccccgccggggtcgg

SEQ ID NO: 16914 - DNA, 21 bp, Homo sapiens
ggccctcggatcggccccgcc

SEQ ID NO: 16915 - DNA, 22 bp, Homo sapiens
ggccctcggatcggccccgccg

SEQ ID NO: 16916 - DNA, 28 bp, Homo sapiens
ggccctcggatcggccccgccggggtcg

SEQ ID NO: 16917 - DNA, 19 bp, Homo sapiens
ccctcggatcggccccgcc

SEQ ID NO: 16918 - DNA, 27 bp, Homo sapiens
ccctcggatcggccccgccggggtcgg

SEQ ID NO: 16919 - DNA, 28 bp, Homo sapiens
ccctcggatcggccccgccggggtcggc

SEQ ID NO: 16920 - DNA, 29 bp, Homo sapiens
ccctcggatcggccccgccggggtcggcc

SEQ ID NO: 16921 - DNA, 24 bp, Homo sapiens
cctcggatcggccccgccggggtc

SEQ ID NO: 16922 - DNA, 27 bp, Homo sapiens
cctcggatcggccccgccggggtcggc

SEQ ID NO: 16923 - DNA, 28 bp, Homo sapiens
cctcggatcggccccgccggggtcggcc

SEQ ID NO: 16924 - DNA, 20 bp, Homo sapiens
ctcggatcggccccgccggg

SEQ ID NO: 16925 - DNA, 21 bp, Homo sapiens
ctcggatcggccccgccgggg

SEQ ID NO: 16926 - DNA, 22 bp, Homo sapiens
ctcggatcggccccgccggggt

SEQ ID NO: 16927 - DNA, 23 bp, Homo sapiens
ctcggatcggccccgccggggtc

SEQ ID NO: 16928 - DNA, 25 bp, Homo sapiens
ctcggatcggccccgccggggtcgg

SEQ ID NO: 16929 - DNA, 26 bp, Homo sapiens
ctcggatcggccccgccggggtcggc

SEQ ID NO: 16930 - DNA, 27 bp, Homo sapiens
ctcggatcggccccgccggggtcggcc

SEQ ID NO: 16931 - DNA, 21 bp, Homo sapiens
tcggatcggccccgccggggt

SEQ ID NO: 16932 - DNA, 22 bp, Homo sapiens
tcggatcggccccgccggggtc

SEQ ID NO: 16933 - DNA, 25 bp, Homo sapiens
tcggatcggccccgccggggtcggc

SEQ ID NO: 16934 - DNA, 24 bp, Homo sapiens
cggatcggccccgccggggtcggc

SEQ ID NO: 16935 - DNA, 33 bp, Homo sapiens
cggatcggccccgccggggtcggcccacggccc

SEQ ID NO: 16936 - DNA, 22 bp, Homo sapiens
gatcggccccgccggggtcggc

SEQ ID NO: 16937 - DNA, 20 bp, Homo sapiens
tcggccccgccggggtcggc

SEQ ID NO: 16938 - DNA, 16 bp, Homo sapiens
cggccccgccggggtc

SEQ ID NO: 16939 - DNA, 19 bp, Homo sapiens
cggccccgccggggtcggc

SEQ ID NO: 16940 - DNA, 20 bp, Homo sapiens
cggccccgccggggtcggcc

SEQ ID NO: 16941 - DNA, 21 bp, Homo sapiens
cggccccgccggggtcggccc

SEQ ID NO: 16942 - DNA, 22 bp, Homo sapiens
cggccccgccggggtcggccca

SEQ ID NO: 16943 - DNA, 17 bp, Homo sapiens
gccccgccggggtcggc

SEQ ID NO: 16944 - DNA, 18 bp, Homo sapiens
gccccgccggggtcggcc

SEQ ID NO: 16945 - DNA, 19 bp, Homo sapiens
gccccgccggggtcggccc

SEQ ID NO: 16946 - DNA, 20 bp, Homo sapiens
gccccgccggggtcggccca

SEQ ID NO: 16947 - DNA, 16 bp, Homo sapiens
ccccgccggggtcggc

SEQ ID NO: 16948 - DNA, 17 bp, Homo sapiens
ccccgccggggtcggcc

SEQ ID NO: 16949 - DNA, 18 bp, Homo sapiens
ccccgccggggtcggccc

SEQ ID NO: 16950 - DNA, 19 bp, Homo sapiens
ccccgccggggtcggccca

SEQ ID NO: 16951 - DNA, 16 bp, Homo sapiens
cccgccggggtcggcc

SEQ ID NO: 16952 - DNA, 17 bp, Homo sapiens
cccgccggggtcggccc

SEQ ID NO: 16953 - DNA, 18 bp, Homo sapiens
cccgccggggtcggccca

SEQ ID NO: 16954 - DNA, 16 bp, Homo sapiens
ccgccggggtcggccc

SEQ ID NO: 16955 - DNA, 29 bp, Homo sapiens
cccacggccctggcggagcgctgagaaga

SEQ ID NO: 16956 - DNA, 19 bp, Homo sapiens
cacggccctggcggagcgc

SEQ ID NO: 16957 - DNA, 25 bp, Homo sapiens
cacggccctggcggagcgctgagaa

SEQ ID NO: 16958 - DNA, 27 bp, Homo sapiens
cacggccctggcggagcgctgagaaga

SEQ ID NO: 16959 - DNA, 29 bp, Homo sapiens
cacggccctggcggagcgctgagaagacg

SEQ ID NO: 16960 - DNA, 16 bp, Homo sapiens
acggccctggcggagc

SEQ ID NO: 16961 - DNA, 17 bp, Homo sapiens
acggccctggcggagcg

SEQ ID NO: 16962 - DNA, 18 bp, Homo sapiens
acggccctggcggagcgc

SEQ ID NO: 16963 - DNA, 19 bp, Homo sapiens
acggccctggcggagcgct

SEQ ID NO: 16964 - DNA, 23 bp, Homo sapiens
acggccctggcggagcgctgaga

SEQ ID NO: 16965 - DNA, 24 bp, Homo sapiens
acggccctggcggagcgctgagaa

SEQ ID NO: 16966 - DNA, 25 bp, Homo sapiens
acggccctggcggagcgctgagaag

SEQ ID NO: 16967 - DNA, 26 bp, Homo sapiens
acggccctggcggagcgctgagaaga

SEQ ID NO: 16968 - DNA, 27 bp, Homo sapiens
acggccctggcggagcgctgagaagac

SEQ ID NO: 16969 - DNA, 28 bp, Homo sapiens
acggccctggcggagcgctgagaagacg

SEQ ID NO: 16970 - DNA, 29 bp, Homo sapiens
acggccctggcggagcgctgagaagacgg

SEQ ID NO: 16971 - DNA, 30 bp, Homo sapiens
acggccctggcggagcgctgagaagacggt

SEQ ID NO: 16972 - DNA, 31 bp, Homo sapiens; identical to SEQ ID NO: 3448

SEQ ID NO: 16973 - DNA, 32 bp, Homo sapiens; identical to SEQ ID NO: 3449

SEQ ID NO: 16974 - DNA, 33 bp, Homo sapiens
acggccctggcggagcgctgagaagacggtcga

SEQ ID NO: 16975 - DNA, 34 bp, Homo sapiens
acggccctggcggagcgctgagaagacggtcgaa

SEQ ID NO: 16976 - DNA, 35 bp, Homo sapiens
acggccctggcggagcgctgagaagacggtcgaac

SEQ ID NO: 16977 - DNA, 36 bp, Homo sapiens
acggccctggcggagcgctgagaagacggtcgaact

SEQ ID NO: 16978 - DNA, 39 bp, Homo sapiens
acggccctggcggagcgctgagaagacggtcgaacttga

SEQ ID NO: 16979 - DNA, 40 bp, Homo sapiens
acggccctggcggagcgctgagaagacggtcgaacttgac

SEQ ID NO: 16980 - DNA, 41 bp, Homo sapiens
acggccctggcggagcgctgagaagacggtcgaacttgact

SEQ ID NO: 16981 - DNA, 42 bp, Homo sapiens
acggccctggcggagcgctgagaagacggtcgaacttgacta

SEQ ID NO: 16982 - DNA, 43 bp, Homo sapiens
acggccctggcggagcgctgagaagacggtcgaacttgactat

SEQ ID NO: 16983 - DNA, 44 bp, Homo sapiens
acggccctggcggagcgctgagaagacggtcgaacttgactatc

SEQ ID NO: 16984 - DNA, 45 bp, Homo sapiens
acggccctggcggagcgctgagaagacggtcgaacttgactatct

SEQ ID NO: 16985 - DNA, 47 bp, Homo sapiens
acggccctggcggagcgctgagaagacggtcgaacttgactatctag

SEQ ID NO: 16986 - DNA, 16 bp, Homo sapiens
cggccctggcggagcg

SEQ ID NO: 16987 - DNA, 17 bp, Homo sapiens
cggccctggcggagcgc

SEQ ID NO: 16988 - DNA, 18 bp, Homo sapiens
cggccctggcggagcgct

SEQ ID NO: 16989 - DNA, 20 bp, Homo sapiens
cggccctggcggagcgctga

SEQ ID NO: 16990 - DNA, 22 bp, Homo sapiens
cggccctggcggagcgctgaga

SEQ ID NO: 16991 - DNA, 23 bp, Homo sapiens
cggccctggcggagcgctgagaa

SEQ ID NO: 16992 - DNA, 24 bp, Homo sapiens
cggccctggcggagcgctgagaag

SEQ ID NO: 16993 - DNA, 25 bp, Homo sapiens
cggccctggcggagcgctgagaaga

SEQ ID NO: 16994 - DNA, 26 bp, Homo sapiens
cggccctggcggagcgctgagaagac

SEQ ID NO: 16995 - DNA, 27 bp, Homo sapiens
cggccctggcggagcgctgagaagacg

SEQ ID NO: 16996 - DNA, 28 bp, Homo sapiens
cggccctggcggagcgctgagaagacgg

SEQ ID NO: 16997 - DNA, 29 bp, Homo sapiens
cggccctggcggagcgctgagaagacggt

SEQ ID NO: 16998 - DNA, 30 bp, Homo sapiens
cggccctggcggagcgctgagaagacggtc

SEQ ID NO: 16999 - DNA, 31 bp, Homo sapiens
cggccctggcggagcgctgagaagacggtcg

SEQ ID NO: 17000 - DNA, 32 bp, Homo sapiens
cggccctggcggagcgctgagaagacggtcga

SEQ ID NO: 17001 - DNA, 33 bp, Homo sapiens; identical to SEQ ID NO: 3458

SEQ ID NO: 17002 - DNA, 40 bp, Homo sapiens
cggccctggcggagcgctgagaagacggtcgaacttgact

SEQ ID NO: 17003 - DNA, 41 bp, Homo sapiens
cggccctggcggagcgctgagaagacggtcgaacttgacta

SEQ ID NO: 17004 - DNA, 42 bp, Homo sapiens
cggccctggcggagcgctgagaagacggtcgaacttgactat

SEQ ID NO: 17005 - DNA, 43 bp, Homo sapiens
cggccctggcggagcgctgagaagacggtcgaacttgactatc

SEQ ID NO: 17006 - DNA, 44 bp, Homo sapiens
cggccctggcggagcgctgagaagacggtcgaacttgactatct

SEQ ID NO: 17007 - DNA, 23 bp, Homo sapiens
ggccctggcggagcgctgagaag

SEQ ID NO: 17008 - DNA, 25 bp, Homo sapiens
ggccctggcggagcgctgagaagac

SEQ ID NO: 17009 - DNA, 26 bp, Homo sapiens
ggccctggcggagcgctgagaagacg

SEQ ID NO: 17010 - DNA, 29 bp, Homo sapiens
ggccctggcggagcgctgagaagacggtc

SEQ ID NO: 17011 - DNA, 30 bp, Homo sapiens
ggccctggcggagcgctgagaagacggtcg

SEQ ID NO: 17012 - DNA, 31 bp, Homo sapiens
ggccctggcggagcgctgagaagacggtcga

SEQ ID NO: 17013 - DNA, 32 bp, Homo sapiens
ggccctggcggagcgctgagaagacggtcgaa

SEQ ID NO: 17014 - DNA, 33 bp, Homo sapiens
ggccctggcggagcgctgagaagacggtcgaac

SEQ ID NO: 17015 - DNA, 39 bp, Homo sapiens
ggccctggcggagcgctgagaagacggtcgaacttgact

SEQ ID NO: 17016 - DNA, 43 bp, Homo sapiens
ggccctggcggagcgctgagaagacggtcgaacttgactatct

SEQ ID NO: 17017 - DNA, 29 bp, Homo sapiens
gccctggcggagcgctgagaagacggtcg

SEQ ID NO: 17018 - DNA, 33 bp, Homo sapiens
gccctggcggagcgctgagaagacggtcgaact

SEQ ID NO: 17019 - DNA, 22 bp, Homo sapiens
ccctggcggagcgctgagaaga

SEQ ID NO: 17020 - DNA, 29 bp, Homo sapiens
ccctggcggagcgctgagaagacggtcga

SEQ ID NO: 17021 - DNA, 30 bp, Homo sapiens
ccctggcggagcgctgagaagacggtcgaa

SEQ ID NO: 17022 - DNA, 31 bp, Homo sapiens
ccctggcggagcgctgagaagacggtcgaac

SEQ ID NO: 17023 - DNA, 21 bp, Homo sapiens
cctggcggagcgctgagaaga

SEQ ID NO: 17024 - DNA, 23 bp, Homo sapiens
cctggcggagcgctgagaagacg

SEQ ID NO: 17025 - DNA, 29 bp, Homo sapiens
cctggcggagcgctgagaagacggtcgaa

SEQ ID NO: 17026 - DNA, 30 bp, Homo sapiens
cctggcggagcgctgagaagacggtcgaac

SEQ ID NO: 17027 - DNA, 36 bp, Homo sapiens
cctggcggagcgctgagaagacggtcgaacttgact

SEQ ID NO: 17028 - DNA, 33 bp, Homo sapiens
ctggcggagcgctgagaagacggtcgaacttga

SEQ ID NO: 17029 - DNA, 35 bp, Homo sapiens
ctggcggagcgctgagaagacggtcgaacttgact

SEQ ID NO: 17030 - DNA, 27 bp, Homo sapiens
tggcggagcgctgagaagacggtcgaa

SEQ ID NO: 17031 - DNA, 28 bp, Homo sapiens
tggcggagcgctgagaagacggtcgaac

SEQ ID NO: 17032 - DNA, 32 bp, Homo sapiens; identical to SEQ ID NO: 3461

SEQ ID NO: 17033 - DNA, 34 bp, Homo sapiens
tggcggagcgctgagaagacggtcgaacttgact

SEQ ID NO: 17034 - DNA, 31 bp, Homo sapiens
ggcggagcgctgagaagacggtcgaacttga

SEQ ID NO: 17035 - DNA, 32 bp, Homo sapiens
ggcggagcgctgagaagacggtcgaacttgac

SEQ ID NO: 17036 - DNA, 33 bp, Homo sapiens; identical to SEQ ID NO: 3462

SEQ ID NO: 17037 - DNA, 30 bp, Homo sapiens
gcggagcgctgagaagacggtcgaacttga

SEQ ID NO: 17038 - DNA, 32 bp, Homo sapiens
gcggagcgctgagaagacggtcgaacttgact

SEQ ID NO: 17039 - DNA, 33 bp, Homo sapiens
gcggagcgctgagaagacggtcgaacttgacta

SEQ ID NO: 17040 - DNA, 24 bp, Homo sapiens
cggagcgctgagaagacggtcgaa

SEQ ID NO: 17041 - DNA, 26 bp, Homo sapiens
cggagcgctgagaagacggtcgaact

SEQ ID NO: 17042 - DNA, 29 bp, Homo sapiens
cggagcgctgagaagacggtcgaacttga

SEQ ID NO: 17043 - DNA, 31 bp, Homo sapiens; identical to SEQ ID NO: 3463

SEQ ID NO: 17044 - DNA, 32 bp, Homo sapiens
cggagcgctgagaagacggtcgaacttgacta

SEQ ID NO: 17045 - DNA, 33 bp, Homo sapiens
cggagcgctgagaagacggtcgaacttgactat

SEQ ID NO: 17046 - DNA, 35 bp, Homo sapiens
cggagcgctgagaagacggtcgaacttgactatct

SEQ ID NO: 17047 - DNA, 27 bp, Homo sapiens
gagcgctgagaagacggtcgaacttga

SEQ ID NO: 17048 - DNA, 29 bp, Homo sapiens
gagcgctgagaagacggtcgaacttgact

SEQ ID NO: 17049 - DNA, 33 bp, Homo sapiens
gagcgctgagaagacggtcgaacttgactatct

SEQ ID NO: 17050 - DNA, 23 bp, Homo sapiens
agcgctgagaagacggtcgaact

SEQ ID NO: 17051 - DNA, 26 bp, Homo sapiens
agcgctgagaagacggtcgaacttga

SEQ ID NO: 17052 - DNA, 30 bp, Homo sapiens
agcgctgagaagacggtcgaacttgactat

SEQ ID NO: 17053 - DNA, 31 bp, Homo sapiens
agcgctgagaagacggtcgaacttgactatc

SEQ ID NO: 17054 - DNA, 32 bp, Homo sapiens; identical to SEQ ID NO: 3464

SEQ ID NO: 17055 - DNA, 19 bp, Homo sapiens
gcgctgagaagacggtcga

SEQ ID NO: 17056 - DNA, 22 bp, Homo sapiens
gcgctgagaagacggtcgaact

SEQ ID NO: 17057 - DNA, 24 bp, Homo sapiens
gcgctgagaagacggtcgaacttg

SEQ ID NO: 17058 - DNA, 25 bp, Homo sapiens
gcgctgagaagacggtcgaacttga

SEQ ID NO: 17059 - DNA, 28 bp, Homo sapiens
gcgctgagaagacggtcgaacttgacta

SEQ ID NO: 17060 - DNA, 29 bp, Homo sapiens
gcgctgagaagacggtcgaacttgactat

SEQ ID NO: 17061 - DNA, 30 bp, Homo sapiens
gcgctgagaagacggtcgaacttgactatc

SEQ ID NO: 17062 - DNA, 31 bp, Homo sapiens; identical to SEQ ID NO: 3465

SEQ ID NO: 17063 - DNA, 32 bp, Homo sapiens
gcgctgagaagacggtcgaacttgactatcta

SEQ ID NO: 17064 - DNA, 33 bp, Homo sapiens
gcgctgagaagacggtcgaacttgactatctag

SEQ ID NO: 17065 - DNA, 24 bp, Homo sapiens
cgctgagaagacggtcgaacttga

SEQ ID NO: 17066 - DNA, 26 bp, Homo sapiens
cgctgagaagacggtcgaacttgact

SEQ ID NO: 17067 - DNA, 27 bp, Homo sapiens
cgctgagaagacggtcgaacttgacta

SEQ ID NO: 17068 - DNA, 28 bp, Homo sapiens
cgctgagaagacggtcgaacttgactat

SEQ ID NO: 17069 - DNA, 29 bp, Homo sapiens
cgctgagaagacggtcgaacttgactatc

SEQ ID NO: 17070 - DNA, 30 bp, Homo sapiens; identical to SEQ ID NO: 3466

SEQ ID NO: 17071 - DNA, 32 bp, Homo sapiens
cgctgagaagacggtcgaacttgactatctag

SEQ ID NO: 17072 - DNA, 23 bp, Homo sapiens
gctgagaagacggtcgaacttga

SEQ ID NO: 17073 - DNA, 24 bp, Homo sapiens
gctgagaagacggtcgaacttgac

SEQ ID NO: 17074 - DNA, 25 bp, Homo sapiens
gctgagaagacggtcgaacttgact

SEQ ID NO: 17075 - DNA, 26 bp, Homo sapiens
gctgagaagacggtcgaacttgacta

SEQ ID NO: 17076 - DNA, 27 bp, Homo sapiens
gctgagaagacggtcgaacttgactat

SEQ ID NO: 17077 - DNA, 28 bp, Homo sapiens
gctgagaagacggtcgaacttgactatc

SEQ ID NO: 17078 - DNA, 29 bp, Homo sapiens
gctgagaagacggtcgaacttgactatct

SEQ ID NO: 17079 - DNA, 31 bp, Homo sapiens
gctgagaagacggtcgaacttgactatctag

SEQ ID NO: 17080 - DNA, 33 bp, Homo sapiens
gctgagaagacggtcgaacttgactatctagag

SEQ ID NO: 17081 - DNA, 17 bp, Homo sapiens
ctgagaagacggtcgaa

SEQ ID NO: 17082 - DNA, 18 bp, Homo sapiens
ctgagaagacggtcgaac

SEQ ID NO: 17083 - DNA, 19 bp, Homo sapiens
ctgagaagacggtcgaact

SEQ ID NO: 17084 - DNA, 22 bp, Homo sapiens
ctgagaagacggtcgaacttga

SEQ ID NO: 17085 - DNA, 23 bp, Homo sapiens
ctgagaagacggtcgaacttgac

SEQ ID NO: 17086 - DNA, 24 bp, Homo sapiens
ctgagaagacggtcgaacttgact

SEQ ID NO: 17087 - DNA, 25 bp, Homo sapiens
ctgagaagacggtcgaacttgacta

SEQ ID NO: 17088 - DNA, 26 bp, Homo sapiens
ctgagaagacggtcgaacttgactat

SEQ ID NO: 17089 - DNA, 27 bp, Homo sapiens
ctgagaagacggtcgaacttgactatc

SEQ ID NO: 17090 - DNA, 28 bp, Homo sapiens
ctgagaagacggtcgaacttgactatct

SEQ ID NO: 17091 - DNA, 30 bp, Homo sapiens; identical to SEQ ID NO: 3481

SEQ ID NO: 17092 - DNA, 32 bp, Homo sapiens
ctgagaagacggtcgaacttgactatctagag

SEQ ID NO: 17093 - DNA, 33 bp, Homo sapiens; identical to SEQ ID NO: 3482

SEQ ID NO: 17094 - DNA, 16 bp, Homo sapiens
tgagaagacggtcgaa

SEQ ID NO: 17095 - DNA, 17 bp, Homo sapiens
tgagaagacggtcgaac

SEQ ID NO: 17096 - DNA, 18 bp, Homo sapiens
tgagaagacggtcgaact

SEQ ID NO: 17097 - DNA, 21 bp, Homo sapiens
tgagaagacggtcgaacttga

SEQ ID NO: 17098 - DNA, 22 bp, Homo sapiens
tgagaagacggtcgaacttgac

SEQ ID NO: 17099 - DNA, 23 bp, Homo sapiens
tgagaagacggtcgaacttgact

SEQ ID NO: 17100 - DNA, 24 bp, Homo sapiens
tgagaagacggtcgaacttgacta

SEQ ID NO: 17101 - DNA, 25 bp, Homo sapiens
tgagaagacggtcgaacttgactat

SEQ ID NO: 17102 - DNA, 26 bp, Homo sapiens
tgagaagacggtcgaacttgactatc

SEQ ID NO: 17103 - DNA, 27 bp, Homo sapiens
tgagaagacggtcgaacttgactatct

SEQ ID NO: 17104 - DNA, 29 bp, Homo sapiens
tgagaagacggtcgaacttgactatctag

SEQ ID NO: 17105 - DNA, 32 bp, Homo sapiens
tgagaagacggtcgaacttgactatctagagg

SEQ ID NO: 17106 - DNA, 33 bp, Homo sapiens; identical to SEQ ID NO: 3492

SEQ ID NO: 17107 - DNA, 36 bp, Homo sapiens
tgagaagacggtcgaacttgactatctagaggaagt

SEQ ID NO: 17108 - DNA, 43 bp, Homo sapiens
tgagaagacggtcgaacttgactatctagaggaagtaaaagtc

SEQ ID NO: 17109 - DNA, 44 bp, Homo sapiens
tgagaagacggtcgaacttgactatctagaggaagtaaaagtcg

SEQ ID NO: 17110 - DNA, 16 bp, Homo sapiens
gagaagacggtcgaac

SEQ ID NO: 17111 - DNA, 17 bp, Homo sapiens
gagaagacggtcgaact

SEQ ID NO: 17112 - DNA, 20 bp, Homo sapiens
gagaagacggtcgaacttga

SEQ ID NO: 17113 - DNA, 21 bp, Homo sapiens
gagaagacggtcgaacttgac

SEQ ID NO: 17114 - DNA, 22 bp, Homo sapiens
gagaagacggtcgaacttgact

SEQ ID NO: 17115 - DNA, 23 bp, Homo sapiens
gagaagacggtcgaacttgacta

SEQ ID NO: 17116 - DNA, 24 bp, Homo sapiens
gagaagacggtcgaacttgactat

SEQ ID NO: 17117 - DNA, 25 bp, Homo sapiens
gagaagacggtcgaacttgactatc

SEQ ID NO: 17118 - DNA, 26 bp, Homo sapiens
gagaagacggtcgaacttgactatct

SEQ ID NO: 17119 - DNA, 28 bp, Homo sapiens
gagaagacggtcgaacttgactatctag

SEQ ID NO: 17120 - DNA, 31 bp, Homo sapiens
gagaagacggtcgaacttgactatctagagg

SEQ ID NO: 17121 - DNA, 32 bp, Homo sapiens; identical to SEQ ID NO: 3502

SEQ ID NO: 17122 - DNA, 33 bp, Homo sapiens
gagaagacggtcgaacttgactatctagaggaa

SEQ ID NO: 17123 - DNA, 35 bp, Homo sapiens
gagaagacggtcgaacttgactatctagaggaagt

SEQ ID NO: 17124 - DNA, 16 bp, Homo sapiens
agaagacggtcgaact

SEQ ID NO: 17125 - DNA, 20 bp, Homo sapiens
agaagacggtcgaacttgac

SEQ ID NO: 17126 - DNA, 21 bp, Homo sapiens
agaagacggtcgaacttgact

SEQ ID NO: 17127 - DNA, 22 bp, Homo sapiens
agaagacggtcgaacttgacta

SEQ ID NO: 17128 - DNA, 24 bp, Homo sapiens
agaagacggtcgaacttgactatc

SEQ ID NO: 17129 - DNA, 25 bp, Homo sapiens
agaagacggtcgaacttgactatct

SEQ ID NO: 17130 - DNA, 27 bp, Homo sapiens
agaagacggtcgaacttgactatctag

SEQ ID NO: 17131 - DNA, 31 bp, Homo sapiens
agaagacggtcgaacttgactatctagagga

SEQ ID NO: 17132 - DNA, 33 bp, Homo sapiens
agaagacggtcgaacttgactatctagaggaag

SEQ ID NO: 17133 - DNA, 18 bp, Homo sapiens
gaagacggtcgaacttga

SEQ ID NO: 17134 - DNA, 19 bp, Homo sapiens
gaagacggtcgaacttgac

SEQ ID NO: 17135 - DNA, 20 bp, Homo sapiens
gaagacggtcgaacttgact

SEQ ID NO: 17136 - DNA, 21 bp, Homo sapiens
gaagacggtcgaacttgacta

SEQ ID NO: 17137 - DNA, 22 bp, Homo sapiens
gaagacggtcgaacttgactat

SEQ ID NO: 17138 - DNA, 23 bp, Homo sapiens
gaagacggtcgaacttgactatc

SEQ ID NO: 17139 - DNA, 24 bp, Homo sapiens
gaagacggtcgaacttgactatct

SEQ ID NO: 17140 - DNA, 30 bp, Homo sapiens
gaagacggtcgaacttgactatctagagga

SEQ ID NO: 17141 - DNA, 31 bp, Homo sapiens
gaagacggtcgaacttgactatctagaggaa

SEQ ID NO: 17142 - DNA, 17 bp, Homo sapiens
aagacggtcgaacttga

SEQ ID NO: 17143 - DNA, 18 bp, Homo sapiens
aagacggtcgaacttgac

SEQ ID NO: 17144 - DNA, 19 bp, Homo sapiens
aagacggtcgaacttgact

SEQ ID NO: 17145 - DNA, 20 bp, Homo sapiens
aagacggtcgaacttgacta

SEQ ID NO: 17146 - DNA, 21 bp, Homo sapiens
aagacggtcgaacttgactat

SEQ ID NO: 17147 - DNA, 22 bp, Homo sapiens
aagacggtcgaacttgactatc

SEQ ID NO: 17148 - DNA, 23 bp, Homo sapiens
aagacggtcgaacttgactatct

SEQ ID NO: 17149 - DNA, 29 bp, Homo sapiens
aagacggtcgaacttgactatctagagga

SEQ ID NO: 17150 - DNA, 16 bp, Homo sapiens
agacggtcgaacttga

SEQ ID NO: 17151 - DNA, 17 bp, Homo sapiens
agacggtcgaacttgac

SEQ ID NO: 17152 - DNA, 18 bp, Homo sapiens
agacggtcgaacttgact

SEQ ID NO: 17153 - DNA, 19 bp, Homo sapiens
agacggtcgaacttgacta

SEQ ID NO: 17154 - DNA, 20 bp, Homo sapiens
agacggtcgaacttgactat

SEQ ID NO: 17155 - DNA, 21 bp, Homo sapiens
agacggtcgaacttgactatc

SEQ ID NO: 17156 - DNA, 22 bp, Homo sapiens
agacggtcgaacttgactatct

SEQ ID NO: 17157 - DNA, 28 bp, Homo sapiens
agacggtcgaacttgactatctagagga

SEQ ID NO: 17158 - DNA, 31 bp, Homo sapiens
agacggtcgaacttgactatctagaggaagt

SEQ ID NO: 17159 - DNA, 16 bp, Homo sapiens
gacggtcgaacttgac

SEQ ID NO: 17160 - DNA, 17 bp, Homo sapiens
gacggtcgaacttgact

SEQ ID NO: 17161 - DNA, 18 bp, Homo sapiens
gacggtcgaacttgacta

SEQ ID NO: 17162 - DNA, 20 bp, Homo sapiens
gacggtcgaacttgactatc

SEQ ID NO: 17163 - DNA, 21 bp, Homo sapiens
gacggtcgaacttgactatct

SEQ ID NO: 17164 - DNA, 27 bp, Homo sapiens
gacggtcgaacttgactatctagagga

SEQ ID NO: 17165 - DNA, 28 bp, Homo sapiens
gacggtcgaacttgactatctagaggaa

SEQ ID NO: 17166 - DNA, 30 bp, Homo sapiens
gacggtcgaacttgactatctagaggaagt

SEQ ID NO: 17167 - DNA, 16 bp, Homo sapiens
acggtcgaacttgact

SEQ ID NO: 17168 - DNA, 20 bp, Homo sapiens
acggtcgaacttgactatct

SEQ ID NO: 17169 - DNA, 23 bp, Homo sapiens
acggtcgaacttgactatctaga

SEQ ID NO: 17170 - DNA, 26 bp, Homo sapiens
acggtcgaacttgactatctagagga

SEQ ID NO: 17171 - DNA, 16 bp, Homo sapiens
cggtcgaacttgacta

SEQ ID NO: 17172 - DNA, 19 bp, Homo sapiens
cggtcgaacttgactatct

SEQ ID NO: 17173 - DNA, 22 bp, Homo sapiens
cggtcgaacttgactatctaga

SEQ ID NO: 17174 - DNA, 25 bp, Homo sapiens
cggtcgaacttgactatctagagga

SEQ ID NO: 17175 - DNA, 26 bp, Homo sapiens
cggtcgaacttgactatctagaggaa

SEQ ID NO: 17176 - DNA, 29 bp, Homo sapiens
cggtcgaacttgactatctagaggaagta

SEQ ID NO: 17177 - DNA, 31 bp, Homo sapiens
cggtcgaacttgactatctagaggaagtaaa

SEQ ID NO: 17178 - DNA, 32 bp, Homo sapiens
cggtcgaacttgactatctagaggaagtaaaa

SEQ ID NO: 17179 - DNA, 17 bp, Homo sapiens
gtcgaacttgactatct

SEQ ID NO: 17180 - DNA, 21 bp, Homo sapiens
gtcgaacttgactatctagag

SEQ ID NO: 17181 - DNA, 22 bp, Homo sapiens
gtcgaacttgactatctagagg

SEQ ID NO: 17182 - DNA, 23 bp, Homo sapiens
gtcgaacttgactatctagagga

SEQ ID NO: 17183 - DNA, 25 bp, Homo sapiens
gtcgaacttgactatctagaggaag

SEQ ID NO: 17184 - DNA, 26 bp, Homo sapiens
gtcgaacttgactatctagaggaagt

SEQ ID NO: 17185 - DNA, 31 bp, Homo sapiens
gtcgaacttgactatctagaggaagtaaaag

SEQ ID NO: 17186 - DNA, 32 bp, Homo sapiens
gtcgaacttgactatctagaggaagtaaaagt

SEQ ID NO: 17187 - DNA, 33 bp, Homo sapiens; identical to SEQ ID NO: 3519

SEQ ID NO: 17188 - DNA, 20 bp, Homo sapiens
acttgactatctagaggaag

SEQ ID NO: 17189 - DNA, 20 bp, Homo sapiens
cttgactatctagaggaagt

SEQ ID NO: 17190 - DNA, 25 bp, Homo sapiens
tgactatctagaggaagtaaaagtc

SEQ ID NO: 17191 - DNA, 22 bp, Homo sapiens
ctatctagaggaagtaaaagtc

SEQ ID NO: 17192 - DNA, 28 bp, Homo sapiens
ctatctagaggaagtaaaagtcgtaaca

SEQ ID NO: 17193 - DNA, 21 bp, Homo sapiens
tatctagaggaagtaaaagtc

SEQ ID NO: 17194 - DNA, 26 bp, Homo sapiens
tatctagaggaagtaaaagtcgtaac

SEQ ID NO: 17195 - DNA, 27 bp, Homo sapiens
tatctagaggaagtaaaagtcgtaaca

SEQ ID NO: 17196 - DNA, 32 bp, Homo sapiens
tatctagaggaagtaaaagtcgtaacaaggtt

SEQ ID NO: 17197 - DNA, 20 bp, Homo sapiens
atctagaggaagtaaaagtc

SEQ ID NO: 17198 - DNA, 25 bp, Homo sapiens
atctagaggaagtaaaagtcgtaac

SEQ ID NO: 17199 - DNA, 26 bp, Homo sapiens
atctagaggaagtaaaagtcgtaaca

SEQ ID NO: 17200 - DNA, 31 bp, Homo sapiens
atctagaggaagtaaaagtcgtaacaaggtt

SEQ ID NO: 17201 - DNA, 19 bp, Homo sapiens
tctagaggaagtaaaagtc

SEQ ID NO: 17202 - DNA, 18 bp, Homo sapiens
ctagaggaagtaaaagtc

SEQ ID NO: 17203 - DNA, 17 bp, Homo sapiens
tagaggaagtaaaagtc

SEQ ID NO: 17204 - DNA, 16 bp, Homo sapiens
agaggaagtaaaagtc

SEQ ID NO: 17205 - DNA, 27 bp, Homo sapiens
agtaaaagtcgtaacaaggtttccgta

SEQ ID NO: 17206 - DNA, 26 bp, Homo sapiens
gtaaaagtcgtaacaaggtttccgta

SEQ ID NO: 17207 - DNA, 18 bp, Homo sapiens
acaaggtttccgtaggtg

SEQ ID NO: 17208 - DNA, 45 bp, Homo sapiens
acaaggtttccgtaggtgaacctgcggaaggatcattaacggagc

SEQ ID NO: 17209 - DNA, 43 bp, Homo sapiens
aaggtttccgtaggtgaacctgcggaaggatcattaacggagc

SEQ ID NO: 17210 - DNA, 30 bp, Homo sapiens
aggtttccgtaggtgaacctgcggaaggat

SEQ ID NO: 17211 - DNA, 31 bp, Homo sapiens
aggtttccgtaggtgaacctgcggaaggatc

SEQ ID NO: 17212 - DNA, 42 bp, Homo sapiens
aggtttccgtaggtgaacctgcggaaggatcattaacggagc

SEQ ID NO: 17213 - DNA, 43 bp, Homo sapiens
aggtttccgtaggtgaacctgcggaaggatcattaacggagcc

SEQ ID NO: 17214 - DNA, 20 bp, Homo sapiens
ggtttccgtaggtgaacctg

SEQ ID NO: 17215 - DNA, 30 bp, Homo sapiens
ggtttccgtaggtgaacctgcggaaggatc

SEQ ID NO: 17216 - DNA, 33 bp, Homo sapiens
gtttccgtaggtgaacctgcggaaggatcatta

SEQ ID NO: 17217 - DNA, 32 bp, Homo sapiens; identical to SEQ ID NO: 3525

SEQ ID NO: 17218 - DNA, 17 bp, Homo sapiens
ttccgtaggtgaacctg

SEQ ID NO: 17219 - DNA, 16 bp, Homo sapiens
tccgtaggtgaacctg

SEQ ID NO: 17220 - DNA, 28 bp, Homo sapiens
cgtaggtgaacctgcggaaggatcatta

SEQ ID NO: 17221 - DNA, 22 bp, Homo sapiens
gtaggtgaacctgcggaaggat

SEQ ID NO: 17222 - DNA, 26 bp, Homo sapiens
gtaggtgaacctgcggaaggatcatt

SEQ ID NO: 17223 - DNA, 27 bp, Homo sapiens
gtaggtgaacctgcggaaggatcatta

SEQ ID NO: 17224 - DNA, 21 bp, Homo sapiens
taggtgaacctgcggaaggat

SEQ ID NO: 17225 - DNA, 22 bp, Homo sapiens
taggtgaacctgcggaaggatc

SEQ ID NO: 17226 - DNA, 25 bp, Homo sapiens
taggtgaacctgcggaaggatcatt

SEQ ID NO: 17227 - DNA, 26 bp, Homo sapiens
taggtgaacctgcggaaggatcatta

SEQ ID NO: 17228 - DNA, 16 bp, Homo sapiens
aggtgaacctgcggaa

SEQ ID NO: 17229 - DNA, 19 bp, Homo sapiens
ggtgaacctgcggaaggat

SEQ ID NO: 17230 - DNA, 20 bp, Homo sapiens
ggtgaacctgcggaaggatc

SEQ ID NO: 17231 - DNA, 23 bp, Homo sapiens
ggtgaacctgcggaaggatcatt

SEQ ID NO: 17232 - DNA, 24 bp, Homo sapiens
ggtgaacctgcggaaggatcatta

SEQ ID NO: 17233 - DNA, 18 bp, Homo sapiens
gtgaacctgcggaaggat

SEQ ID NO: 17234 - DNA, 27 bp, Homo sapiens
acctgcggaaggatcattaacggagcc

SEQ ID NO: 17235 - DNA, 18 bp, Homo sapiens
cctgcggaaggatcatta

SEQ ID NO: 17236 - DNA, 26 bp, Homo sapiens
cctgcggaaggatcattaacggagcc

SEQ ID NO: 17237 - DNA, 16 bp, Homo sapiens
ctgcggaaggatcatt

SEQ ID NO: 17238 - DNA, 17 bp, Homo sapiens
ctgcggaaggatcatta

SEQ ID NO: 17239 - DNA, 23 bp, Homo sapiens
ctgcggaaggatcattaacggag

SEQ ID NO: 17240 - DNA, 25 bp, Homo sapiens
ctgcggaaggatcattaacggagcc

SEQ ID NO: 17241 - DNA, 16 bp, Homo sapiens
tgcggaaggatcatta

SEQ ID NO: 17242 - DNA, 21 bp, Homo sapiens
tgcggaaggatcattaacgga

SEQ ID NO: 17243 - DNA, 23 bp, Homo sapiens
tgcggaaggatcattaacggagc

SEQ ID NO: 17244 - DNA, 24 bp, Homo sapiens
tgcggaaggatcattaacggagcc

SEQ ID NO: 17245 - DNA, 21 bp, Homo sapiens
gcggaaggatcattaacggag

SEQ ID NO: 17246 - DNA, 22 bp, Homo sapiens
gcggaaggatcattaacggagc

SEQ ID NO: 17247 - DNA, 23 bp, Homo sapiens
gcggaaggatcattaacggagcc

SEQ ID NO: 17248 - DNA, 19 bp, Homo sapiens
cggaaggatcattaacgga

SEQ ID NO: 17249 - DNA, 22 bp, Homo sapiens
cggaaggatcattaacggagcc

SEQ ID NO: 17250 - DNA, 18 bp, Homo sapiens
ggaaggatcattaacgga

SEQ ID NO: 17251 - DNA, 19 bp, Homo sapiens
ggaaggatcattaacggag

SEQ ID NO: 17252 - DNA, 20 bp, Homo sapiens
ggaaggatcattaacggagc

SEQ ID NO: 17253 - DNA, 21 bp, Homo sapiens
ggaaggatcattaacggagcc

SEQ ID NO: 17254 - DNA, 17 bp, Homo sapiens
gaaggatcattaacgga

SEQ ID NO: 17255 - DNA, 18 bp, Homo sapiens
gaaggatcattaacggag

SEQ ID NO: 17256 - DNA, 19 bp, Homo sapiens
gaaggatcattaacggagc

SEQ ID NO: 17257 - DNA, 20 bp, Homo sapiens
gaaggatcattaacggagcc

SEQ ID NO: 17258 - DNA, 16 bp, Homo sapiens
aaggatcattaacgga

SEQ ID NO: 17259 - DNA, 17 bp, Homo sapiens
aaggatcattaacggag

SEQ ID NO: 17260 - DNA, 18 bp, Homo sapiens
aaggatcattaacggagc

SEQ ID NO: 17261 - DNA, 19 bp, Homo sapiens
aaggatcattaacggagcc

SEQ ID NO: 17262 - DNA, 17 bp, Homo sapiens
aggatcattaacggagc

SEQ ID NO: 17263 - DNA, 18 bp, Homo sapiens
aggatcattaacggagcc

SEQ ID NO: 17264 - DNA, 16 bp, Homo sapiens
ggatcattaacggagc

SEQ ID NO: 17265 - DNA, 17 bp, Homo sapiens
ggatcattaacggagcc

SEQ ID NO: 17266 - DNA, 16 bp, Homo sapiens
gatcattaacggagcc

SEQ ID NO: 17267 - DNA, 31 bp, Homo sapiens
acggagcccggagggcgaggcccgcggcggc

SEQ ID NO: 17268 - DNA, 27 bp, Homo sapiens
cggagcccggagggcgaggcccgcggc

SEQ ID NO: 17269 - DNA, 28 bp, Homo sapiens
cggagcccggagggcgaggcccgcggcg

SEQ ID NO: 17270 - DNA, 21 bp, Homo sapiens
cggagggcgaggcccgcggcg

SEQ ID NO: 17271 - DNA, 23 bp, Homo sapiens
cggagggcgaggcccgcggcggc

SEQ ID NO: 17272 - DNA, 21 bp, Homo sapiens
gagggcgaggcccgcggcggc

SEQ ID NO: 17273 - DNA, 18 bp, Homo sapiens
cgcgcggcggcggcggcg

SEQ ID NO: 17274 - DNA, 19 bp, Homo sapiens
gctcgctcgttcgttcgcc

SEQ ID NO: 17275 - DNA, 20 bp, Homo sapiens
gctcgctcgttcgttcgccg

SEQ ID NO: 17276 - DNA, 17 bp, Homo sapiens
cgttcgttcgccgcccg

SEQ ID NO: 17277 - DNA, 19 bp, Homo sapiens
agagagagagagagaaaga

SEQ ID NO: 17278 - DNA, 20 bp, Homo sapiens
gccgctccgcgccgccgggc

SEQ ID NO: 17279 - DNA, 24 bp, Homo sapiens
agggcgtctcgagggtcgggggcc

SEQ ID NO: 17280 - DNA, 30 bp, Homo sapiens
gttccggcgcggaggtttaaagaccccttg

SEQ ID NO: 17281 - DNA, 29 bp, Homo sapiens
ttccggcgcggaggtttaaagaccccttg

SEQ ID NO: 17282 - DNA, 20 bp, Homo sapiens
gtgggtcgggggcggtggtg

SEQ ID NO: 17283 - DNA, 19 bp, Homo sapiens
gtcccgtcgggaggggccc

SEQ ID NO: 17284 - DNA, 18 bp, Homo sapiens
tcccgtcgggaggggccc

SEQ ID NO: 17285 - DNA, 18 bp, Homo sapiens
gcggcggcggcggcggcg

SEQ ID NO: 17286 - DNA, 16 bp, Homo sapiens
cggcggcggcggcggc

SEQ ID NO: 17287 - DNA, 25 bp, Homo sapiens
gctttacccggcggccgtcgcgcgc

SEQ ID NO: 17288 - DNA, 21 bp, Homo sapiens
ttacccggcggccgtcgcgcg

SEQ ID NO: 17289 - DNA, 20 bp, Homo sapiens
tacccggcggccgtcgcgcg

SEQ ID NO: 17290 - DNA, 32 bp, Homo sapiens
gagtccggtcccgtttgctgtctcgtctggcc

SEQ ID NO: 17291 - DNA, 26 bp, Homo sapiens
ggtgcgtcgtcgggagcgccctcgcc

SEQ ID NO: 17292 - DNA, 27 bp, Homo sapiens
aaatcgacctcgtacgactcttagcgg

SEQ ID NO: 17293 - DNA, 26 bp, Homo sapiens
aatcgacctcgtacgactcttagcgg

SEQ ID NO: 17294 - DNA, 25 bp, Homo sapiens
atcgacctcgtacgactcttagcgg

SEQ ID NO: 17295 - DNA, 24 bp, Homo sapiens
tcgacctcgtacgactcttagcgg

SEQ ID NO: 17296 - DNA, 44 bp, Homo sapiens
tcgacctcgtacgactcttagcggtggatcactcggctcgtgcg

SEQ ID NO: 17297 - DNA, 43 bp, Homo sapiens
cgacctcgtacgactcttagcggtggatcactcggctcgtgcg

SEQ ID NO: 17298 - DNA, 42 bp, Homo sapiens
gacctcgtacgactcttagcggtggatcactcggctcgtgcg

SEQ ID NO: 17299 - DNA, 21 bp, Homo sapiens
acctcgtacgactcttagcgg

SEQ ID NO: 17300 - DNA, 41 bp, Homo sapiens
acctcgtacgactcttagcggtggatcactcggctcgtgcg

SEQ ID NO: 17301 - DNA, 19 bp, Homo sapiens
cctcgtacgactcttagcg

SEQ ID NO: 17302 - DNA, 20 bp, Homo sapiens
cctcgtacgactcttagcgg

SEQ ID NO: 17303 - DNA, 40 bp, Homo sapiens
cctcgtacgactcttagcggtggatcactcggctcgtgcg

SEQ ID NO: 17304 - DNA, 17 bp, Homo sapiens
ctcgtacgactcttagc

SEQ ID NO: 17305 - DNA, 18 bp, Homo sapiens
ctcgtacgactcttagcg

SEQ ID NO: 17306 - DNA, 19 bp, Homo sapiens
ctcgtacgactcttagcgg

SEQ ID NO: 17307 - DNA, 20 bp, Homo sapiens
ctcgtacgactcttagcggt

SEQ ID NO: 17308 - DNA, 21 bp, Homo sapiens
ctcgtacgactcttagcggtg

SEQ ID NO: 17309 - DNA, 22 bp, Homo sapiens
ctcgtacgactcttagcggtgg

SEQ ID NO: 17310 - DNA, 23 bp, Homo sapiens
ctcgtacgactcttagcggtgga

SEQ ID NO: 17311 - DNA, 24 bp, Homo sapiens
ctcgtacgactcttagcggtggat

SEQ ID NO: 17312 - DNA, 25 bp, Homo sapiens
ctcgtacgactcttagcggtggatc

SEQ ID NO: 17313 - DNA, 28 bp, Homo sapiens
ctcgtacgactcttagcggtggatcact

SEQ ID NO: 17314 - DNA, 32 bp, Homo sapiens
ctcgtacgactcttagcggtggatcactcggc

SEQ ID NO: 17315 - DNA, 33 bp, Homo sapiens; identical to SEQ ID NO: 3546

SEQ ID NO: 17316 - DNA, 37 bp, Homo sapiens
ctcgtacgactcttagcggtggatcactcggctcgtg

SEQ ID NO: 17317 - DNA, 39 bp, Homo sapiens
ctcgtacgactcttagcggtggatcactcggctcgtgcg

SEQ ID NO: 17318 - DNA, 16 bp, Homo sapiens
tcgtacgactcttagc

SEQ ID NO: 17319 - DNA, 17 bp, Homo sapiens
tcgtacgactcttagcg

SEQ ID NO: 17320 - DNA, 18 bp, Homo sapiens
tcgtacgactcttagcgg

SEQ ID NO: 17321 - DNA, 19 bp, Homo sapiens
tcgtacgactcttagcggt

SEQ ID NO: 17322 - DNA, 20 bp, Homo sapiens
tcgtacgactcttagcggtg

SEQ ID NO: 17323 - DNA, 21 bp, Homo sapiens
tcgtacgactcttagcggtgg

SEQ ID NO: 17324 - DNA, 22 bp, Homo sapiens
tcgtacgactcttagcggtgga

SEQ ID NO: 17325 - DNA, 23 bp, Homo sapiens
tcgtacgactcttagcggtggat

SEQ ID NO: 17326 - DNA, 24 bp, Homo sapiens
tcgtacgactcttagcggtggatc

SEQ ID NO: 17327 - DNA, 27 bp, Homo sapiens
tcgtacgactcttagcggtggatcact

SEQ ID NO: 17328 - DNA, 30 bp, Homo sapiens
tcgtacgactcttagcggtggatcactcgg

SEQ ID NO: 17329 - DNA, 31 bp, Homo sapiens
tcgtacgactcttagcggtggatcactcggc

SEQ ID NO: 17330 - DNA, 32 bp, Homo sapiens; identical to SEQ ID NO: 3555

SEQ ID NO: 17331 - DNA, 33 bp, Homo sapiens; identical to SEQ ID NO: 3556

SEQ ID NO: 17332 - DNA, 36 bp, Homo sapiens
tcgtacgactcttagcggtggatcactcggctcgtg

SEQ ID NO: 17333 - DNA, 37 bp, Homo sapiens
tcgtacgactcttagcggtggatcactcggctcgtgc

SEQ ID NO: 17334 - DNA, 38 bp, Homo sapiens
tcgtacgactcttagcggtggatcactcggctcgtgcg

SEQ ID NO: 17335 - DNA, 16 bp, Homo sapiens
cgtacgactcttagcg

SEQ ID NO: 17336 - DNA, 17 bp, Homo sapiens
cgtacgactcttagcgg

SEQ ID NO: 17337 - DNA, 18 bp, Homo sapiens
cgtacgactcttagcggt

SEQ ID NO: 17338 - DNA, 21 bp, Homo sapiens
cgtacgactcttagcggtgga

SEQ ID NO: 17339 - DNA, 22 bp, Homo sapiens
cgtacgactcttagcggtggat

SEQ ID NO: 17340 - DNA, 23 bp, Homo sapiens
cgtacgactcttagcggtggatc

SEQ ID NO: 17341 - DNA, 26 bp, Homo sapiens
cgtacgactcttagcggtggatcact

SEQ ID NO: 17342 - DNA, 30 bp, Homo sapiens
cgtacgactcttagcggtggatcactcggc

SEQ ID NO: 17343 - DNA, 31 bp, Homo sapiens; identical to SEQ ID NO: 3560

SEQ ID NO: 17344 - DNA, 32 bp, Homo sapiens
cgtacgactcttagcggtggatcactcggctc

SEQ ID NO: 17345 - DNA, 33 bp, Homo sapiens; identical to SEQ ID NO: 3561

SEQ ID NO: 17346 - DNA, 35 bp, Homo sapiens
cgtacgactcttagcggtggatcactcggctcgtg

SEQ ID NO: 17347 - DNA, 36 bp, Homo sapiens
cgtacgactcttagcggtggatcactcggctcgtgc

SEQ ID NO: 17348 - DNA, 37 bp, Homo sapiens
cgtacgactcttagcggtggatcactcggctcgtgcg

SEQ ID NO: 17349 - DNA, 16 bp, Homo sapiens
gtacgactcttagcgg

SEQ ID NO: 17350 - DNA, 17 bp, Homo sapiens
gtacgactcttagcggt

SEQ ID NO: 17351 - DNA, 18 bp, Homo sapiens
gtacgactcttagcggtg

SEQ ID NO: 17352 - DNA, 19 bp, Homo sapiens
gtacgactcttagcggtgg

SEQ ID NO: 17353 - DNA, 21 bp, Homo sapiens
gtacgactcttagcggtggat

SEQ ID NO: 17354 - DNA, 22 bp, Homo sapiens
gtacgactcttagcggtggatc

SEQ ID NO: 17355 - DNA, 25 bp, Homo sapiens
gtacgactcttagcggtggatcact

SEQ ID NO: 17356 - DNA, 28 bp, Homo sapiens
gtacgactcttagcggtggatcactcgg

SEQ ID NO: 17357 - DNA, 29 bp, Homo sapiens
gtacgactcttagcggtggatcactcggc

SEQ ID NO: 17358 - DNA, 30 bp, Homo sapiens; identical to SEQ ID NO: 3563

SEQ ID NO: 17359 - DNA, 31 bp, Homo sapiens; identical to SEQ ID NO: 3564

SEQ ID NO: 17360 - DNA, 32 bp, Homo sapiens; identical to SEQ ID NO: 3565

SEQ ID NO: 17361 - DNA, 33 bp, Homo sapiens; identical to SEQ ID NO: 3566

SEQ ID NO: 17362 - DNA, 20 bp, Homo sapiens
tacgactcttagcggtggat

SEQ ID NO: 17363 - DNA, 29 bp, Homo sapiens
tacgactcttagcggtggatcactcggct

SEQ ID NO: 17364 - DNA, 30 bp, Homo sapiens
tacgactcttagcggtggatcactcggctc

SEQ ID NO: 17365 - DNA, 31 bp, Homo sapiens
tacgactcttagcggtggatcactcggctcg

SEQ ID NO: 17366 - DNA, 32 bp, Homo sapiens
tacgactcttagcggtggatcactcggctcgt

SEQ ID NO: 17367 - DNA, 33 bp, Homo sapiens
tacgactcttagcggtggatcactcggctcgtg

SEQ ID NO: 17368 - DNA, 19 bp, Homo sapiens
acgactcttagcggtggat

SEQ ID NO: 17369 - DNA, 20 bp, Homo sapiens
acgactcttagcggtggatc

SEQ ID NO: 17370 - DNA, 27 bp, Homo sapiens
acgactcttagcggtggatcactcggc

SEQ ID NO: 17371 - DNA, 28 bp, Homo sapiens
acgactcttagcggtggatcactcggct

SEQ ID NO: 17372 - DNA, 29 bp, Homo sapiens
acgactcttagcggtggatcactcggctc

SEQ ID NO: 17373 - DNA, 30 bp, Homo sapiens
acgactcttagcggtggatcactcggctcg

SEQ ID NO: 17374 - DNA, 31 bp, Homo sapiens; identical to SEQ ID NO: 3569

SEQ ID NO: 17375 - DNA, 32 bp, Homo sapiens
acgactcttagcggtggatcactcggctcgtg

SEQ ID NO: 17376 - DNA, 33 bp, Homo sapiens
acgactcttagcggtggatcactcggctcgtgc

SEQ ID NO: 17377 - DNA, 36 bp, Homo sapiens
acgactcttagcggtggatcactcggctcgtgcgtc

SEQ ID NO: 17378 - DNA, 16 bp, Homo sapiens
cgactcttagcggtgg

SEQ ID NO: 17379 - DNA, 17 bp, Homo sapiens
cgactcttagcggtgga

SEQ ID NO: 17380 - DNA, 18 bp, Homo sapiens
cgactcttagcggtggat

SEQ ID NO: 17381 - DNA, 19 bp, Homo sapiens
cgactcttagcggtggatc

SEQ ID NO: 17382 - DNA, 20 bp, Homo sapiens
cgactcttagcggtggatca

SEQ ID NO: 17383 - DNA, 22 bp, Homo sapiens
cgactcttagcggtggatcact

SEQ ID NO: 17384 - DNA, 23 bp, Homo sapiens
cgactcttagcggtggatcactc

SEQ ID NO: 17385 - DNA, 24 bp, Homo sapiens
cgactcttagcggtggatcactcg

SEQ ID NO: 17386 - DNA, 25 bp, Homo sapiens
cgactcttagcggtggatcactcgg

SEQ ID NO: 17387 - DNA, 26 bp, Homo sapiens
cgactcttagcggtggatcactcggc

SEQ ID NO: 17388 - DNA, 27 bp, Homo sapiens
cgactcttagcggtggatcactcggct

SEQ ID NO: 17389 - DNA, 28 bp, Homo sapiens
cgactcttagcggtggatcactcggctc

SEQ ID NO: 17390 - DNA, 29 bp, Homo sapiens
cgactcttagcggtggatcactcggctcg

SEQ ID NO: 17391 - DNA, 30 bp, Homo sapiens; identical to SEQ ID NO: 3579

SEQ ID NO: 17392 - DNA, 31 bp, Homo sapiens; identical to SEQ ID NO: 3580

SEQ ID NO: 17393 - DNA, 32 bp, Homo sapiens; identical to SEQ ID NO: 3581

SEQ ID NO: 17394 - DNA, 33 bp, Homo sapiens; identical to SEQ ID NO: 3582

SEQ ID NO: 17395 - DNA, 34 bp, Homo sapiens
cgactcttagcggtggatcactcggctcgtgcgt

SEQ ID NO: 17396 - DNA, 35 bp, Homo sapiens
cgactcttagcggtggatcactcggctcgtgcgtc

SEQ ID NO: 17397 - DNA, 36 bp, Homo sapiens
cgactcttagcggtggatcactcggctcgtgcgtcg

SEQ ID NO: 17398 - DNA, 37 bp, Homo sapiens
cgactcttagcggtggatcactcggctcgtgcgtcga

SEQ ID NO: 17399 - DNA, 38 bp, Homo sapiens
cgactcttagcggtggatcactcggctcgtgcgtcgat

SEQ ID NO: 17400 - DNA, 39 bp, Homo sapiens
cgactcttagcggtggatcactcggctcgtgcgtcgatg

SEQ ID NO: 17401 - DNA, 42 bp, Homo sapiens
cgactcttagcggtggatcactcggctcgtgcgtcgatgaag

SEQ ID NO: 17402 - DNA, 43 bp, Homo sapiens
cgactcttagcggtggatcactcggctcgtgcgtcgatgaaga

SEQ ID NO: 17403 - DNA, 44 bp, Homo sapiens
cgactcttagcggtggatcactcggctcgtgcgtcgatgaagaa

SEQ ID NO: 17404 - DNA, 45 bp, Homo sapiens
cgactcttagcggtggatcactcggctcgtgcgtcgatgaagaac

SEQ ID NO: 17405 - DNA, 46 bp, Homo sapiens
cgactcttagcggtggatcactcggctcgtgcgtcgatgaagaacg

SEQ ID NO: 17406 - DNA, 47 bp, Homo sapiens
cgactcttagcggtggatcactcggctcgtgcgtcgatgaagaacgc

SEQ ID NO: 17407 - DNA, 16 bp, Homo sapiens
gactcttagcggtgga

SEQ ID NO: 17408 - DNA, 17 bp, Homo sapiens
gactcttagcggtggat

SEQ ID NO: 17409 - DNA, 18 bp, Homo sapiens
gactcttagcggtggatc

SEQ ID NO: 17410 - DNA, 21 bp, Homo sapiens
gactcttagcggtggatcact

SEQ ID NO: 17411 - DNA, 24 bp, Homo sapiens
gactcttagcggtggatcactcgg

SEQ ID NO: 17412 - DNA, 25 bp, Homo sapiens
gactcttagcggtggatcactcggc

SEQ ID NO: 17413 - DNA, 26 bp, Homo sapiens
gactcttagcggtggatcactcggct

SEQ ID NO: 17414 - DNA, 27 bp, Homo sapiens
gactcttagcggtggatcactcggctc

SEQ ID NO: 17415 - DNA, 28 bp, Homo sapiens
gactcttagcggtggatcactcggctcg

SEQ ID NO: 17416 - DNA, 29 bp, Homo sapiens
gactcttagcggtggatcactcggctcgt

SEQ ID NO: 17417 - DNA, 30 bp, Homo sapiens; identical to SEQ ID NO: 3590

SEQ ID NO: 17418 - DNA, 31 bp, Homo sapiens
gactcttagcggtggatcactcggctcgtgc

SEQ ID NO: 17419 - DNA, 32 bp, Homo sapiens; identical to SEQ ID NO: 3591

SEQ ID NO: 17420 - DNA, 33 bp, Homo sapiens
gactcttagcggtggatcactcggctcgtgcgt

SEQ ID NO: 17421 - DNA, 34 bp, Homo sapiens
gactcttagcggtggatcactcggctcgtgcgtc

SEQ ID NO: 17422 - DNA, 36 bp, Homo sapiens
gactcttagcggtggatcactcggctcgtgcgtcga

SEQ ID NO: 17423 - DNA, 37 bp, Homo sapiens
gactcttagcggtggatcactcggctcgtgcgtcgat

SEQ ID NO: 17424 - DNA, 44 bp, Homo sapiens
gactcttagcggtggatcactcggctcgtgcgtcgatgaagaac

SEQ ID NO: 17425 - DNA, 46 bp, Homo sapiens
gactcttagcggtggatcactcggctcgtgcgtcgatgaagaacgc

SEQ ID NO: 17426 - DNA, 47 bp, Homo sapiens
gactcttagcggtggatcactcggctcgtgcgtcgatgaagaacgca

SEQ ID NO: 17427 - DNA, 16 bp, Homo sapiens
actcttagcggtggat

SEQ ID NO: 17428 - DNA, 17 bp, Homo sapiens
actcttagcggtggatc

SEQ ID NO: 17429 - DNA, 24 bp, Homo sapiens
actcttagcggtggatcactcggc

SEQ ID NO: 17430 - DNA, 25 bp, Homo sapiens
actcttagcggtggatcactcggct

SEQ ID NO: 17431 - DNA, 27 bp, Homo sapiens
actcttagcggtggatcactcggctcg

SEQ ID NO: 17432 - DNA, 28 bp, Homo sapiens
actcttagcggtggatcactcggctcgt

SEQ ID NO: 17433 - DNA, 29 bp, Homo sapiens
actcttagcggtggatcactcggctcgtg

SEQ ID NO: 17434 - DNA, 31 bp, Homo sapiens
actcttagcggtggatcactcggctcgtgcg

SEQ ID NO: 17435 - DNA, 32 bp, Homo sapiens
actcttagcggtggatcactcggctcgtgcgt

SEQ ID NO: 17436 - DNA, 33 bp, Homo sapiens
actcttagcggtggatcactcggctcgtgcgtc

SEQ ID NO: 17437 - DNA, 36 bp, Homo sapiens
actcttagcggtggatcactcggctcgtgcgtcgat

SEQ ID NO: 17438 - DNA, 23 bp, Homo sapiens
ctcttagcggtggatcactcggc

SEQ ID NO: 17439 - DNA, 24 bp, Homo sapiens
ctcttagcggtggatcactcggct

SEQ ID NO: 17440 - DNA, 22 bp, Homo sapiens
tcttagcggtggatcactcggc

SEQ ID NO: 17441 - DNA, 33 bp, Homo sapiens; identical to SEQ ID NO: 3595

SEQ ID NO: 17442 - DNA, 33 bp, Homo sapiens
cttagcggtggatcactcggctcgtgcgtcgat

SEQ ID NO: 17443 - DNA, 32 bp, Homo sapiens
ttagcggtggatcactcggctcgtgcgtcgat

SEQ ID NO: 17444 - DNA, 31 bp, Homo sapiens
tagcggtggatcactcggctcgtgcgtcgat

SEQ ID NO: 17445 - DNA, 32 bp, Homo sapiens
tagcggtggatcactcggctcgtgcgtcgatg

SEQ ID NO: 17446 - DNA, 18 bp, Homo sapiens
agcggtggatcactcggc

SEQ ID NO: 17447 - DNA, 30 bp, Homo sapiens
agcggtggatcactcggctcgtgcgtcgat

SEQ ID NO: 17448 - DNA, 17 bp, Homo sapiens
gcggtggatcactcggc

SEQ ID NO: 17449 - DNA, 18 bp, Homo sapiens
gcggtggatcactcggct

SEQ ID NO: 17450 - DNA, 29 bp, Homo sapiens
gcggtggatcactcggctcgtgcgtcgat

SEQ ID NO: 17451 - DNA, 30 bp, Homo sapiens
gcggtggatcactcggctcgtgcgtcgatg

SEQ ID NO: 17452 - DNA, 16 bp, Homo sapiens
cggtggatcactcggc

SEQ ID NO: 17453 - DNA, 17 bp, Homo sapiens
cggtggatcactcggct

SEQ ID NO: 17454 - DNA, 21 bp, Homo sapiens
cggtggatcactcggctcgtg

SEQ ID NO: 17455 - DNA, 23 bp, Homo sapiens
cggtggatcactcggctcgtgcg

SEQ ID NO: 17456 - DNA, 26 bp, Homo sapiens
cggtggatcactcggctcgtgcgtcg

SEQ ID NO: 17457 - DNA, 27 bp, Homo sapiens
cggtggatcactcggctcgtgcgtcga

SEQ ID NO: 17458 - DNA, 28 bp, Homo sapiens
cggtggatcactcggctcgtgcgtcgat

SEQ ID NO: 17459 - DNA, 29 bp, Homo sapiens
cggtggatcactcggctcgtgcgtcgatg

SEQ ID NO: 17460 - DNA, 32 bp, Homo sapiens; identical to SEQ ID NO: 3600

SEQ ID NO: 17461 - DNA, 33 bp, Homo sapiens
cggtggatcactcggctcgtgcgtcgatgaaga

SEQ ID NO: 17462 - DNA, 35 bp, Homo sapiens
cggtggatcactcggctcgtgcgtcgatgaagaac

SEQ ID NO: 17463 - DNA, 36 bp, Homo sapiens
cggtggatcactcggctcgtgcgtcgatgaagaacg

SEQ ID NO: 17464 - DNA, 37 bp, Homo sapiens
cggtggatcactcggctcgtgcgtcgatgaagaacgc

SEQ ID NO: 17465 - DNA, 41 bp, Homo sapiens
cggtggatcactcggctcgtgcgtcgatgaagaacgcagct

SEQ ID NO: 17466 - DNA, 33 bp, Homo sapiens
gatcactcggctcgtgcgtcgatgaagaacgca

SEQ ID NO: 17467 - DNA, 32 bp, Homo sapiens
atcactcggctcgtgcgtcgatgaagaacgca

SEQ ID NO: 17468 - DNA, 20 bp, Homo sapiens
tcactcggctcgtgcgtcga

SEQ ID NO: 17469 - DNA, 31 bp, Homo sapiens
tcactcggctcgtgcgtcgatgaagaacgca

SEQ ID NO: 17470 - DNA, 33 bp, Homo sapiens
tcactcggctcgtgcgtcgatgaagaacgcagc

SEQ ID NO: 17471 - DNA, 17 bp, Homo sapiens
cactcggctcgtgcgtc

SEQ ID NO: 17472 - DNA, 21 bp, Homo sapiens
cactcggctcgtgcgtcgatg

SEQ ID NO: 17473 - DNA, 24 bp, Homo sapiens
cactcggctcgtgcgtcgatgaag

SEQ ID NO: 17474 - DNA, 27 bp, Homo sapiens
cactcggctcgtgcgtcgatgaagaac

SEQ ID NO: 17475 - DNA, 29 bp, Homo sapiens
cactcggctcgtgcgtcgatgaagaacgc

SEQ ID NO: 17476 - DNA, 30 bp, Homo sapiens; identical to SEQ ID NO: 3602

SEQ ID NO: 17477 - DNA, 32 bp, Homo sapiens
cactcggctcgtgcgtcgatgaagaacgcagc

SEQ ID NO: 17478 - DNA, 33 bp, Homo sapiens; identical to SEQ ID NO: 3603

SEQ ID NO: 17479 - DNA, 16 bp, Homo sapiens
actcggctcgtgcgtc

SEQ ID NO: 17480 - DNA, 17 bp, Homo sapiens
actcggctcgtgcgtcg

SEQ ID NO: 17481 - DNA, 18 bp, Homo sapiens
actcggctcgtgcgtcga

SEQ ID NO: 17482 - DNA, 19 bp, Homo sapiens
actcggctcgtgcgtcgat

SEQ ID NO: 17483 - DNA, 29 bp, Homo sapiens
actcggctcgtgcgtcgatgaagaacgca

SEQ ID NO: 17484 - DNA, 31 bp, Homo sapiens
actcggctcgtgcgtcgatgaagaacgcagc

SEQ ID NO: 17485 - DNA, 32 bp, Homo sapiens
actcggctcgtgcgtcgatgaagaacgcagct

SEQ ID NO: 17486 - DNA, 17 bp, Homo sapiens
ctcggctcgtgcgtcga

SEQ ID NO: 17487 - DNA, 18 bp, Homo sapiens
ctcggctcgtgcgtcgat

SEQ ID NO: 17488 - DNA, 28 bp, Homo sapiens
ctcggctcgtgcgtcgatgaagaacgca

SEQ ID NO: 17489 - DNA, 30 bp, Homo sapiens
ctcggctcgtgcgtcgatgaagaacgcagc

SEQ ID NO: 17490 - DNA, 31 bp, Homo sapiens
ctcggctcgtgcgtcgatgaagaacgcagct

SEQ ID NO: 17491 - DNA, 32 bp, Homo sapiens
ctcggctcgtgcgtcgatgaagaacgcagcta

SEQ ID NO: 17492 - DNA, 24 bp, Homo sapiens
cggctcgtgcgtcgatgaagaacg

SEQ ID NO: 17493 - DNA, 20 bp, Homo sapiens
ggctcgtgcgtcgatgaaga

SEQ ID NO: 17494 - DNA, 23 bp, Homo sapiens
ggctcgtgcgtcgatgaagaacg

SEQ ID NO: 17495 - DNA, 19 bp, Homo sapiens
gctcgtgcgtcgatgaaga

SEQ ID NO: 17496 - DNA, 24 bp, Homo sapiens
gctcgtgcgtcgatgaagaacgca

SEQ ID NO: 17497 - DNA, 32 bp, Homo sapiens
ctcgtgcgtcgatgaagaacgcagctagctgc

SEQ ID NO: 17498 - DNA, 19 bp, Homo sapiens
cgtgcgtcgatgaagaacg

SEQ ID NO: 17499 - DNA, 21 bp, Homo sapiens
cgtgcgtcgatgaagaacgca

SEQ ID NO: 17500 - DNA, 31 bp, Homo sapiens
cgtgcgtcgatgaagaacgcagctagctgcg

SEQ ID NO: 17501 - DNA, 32 bp, Homo sapiens
cgtgcgtcgatgaagaacgcagctagctgcga

SEQ ID NO: 17502 - DNA, 18 bp, Homo sapiens
gtgcgtcgatgaagaacg

SEQ ID NO: 17503 - DNA, 36 bp, Homo sapiens
gtgcgtcgatgaagaacgcagctagctgcgagaatt

SEQ ID NO: 17504 - DNA, 17 bp, Homo sapiens
tgcgtcgatgaagaacg

SEQ ID NO: 17505 - DNA, 30 bp, Homo sapiens
tgcgtcgatgaagaacgcagctagctgcga

SEQ ID NO: 17506 - DNA, 33 bp, Homo sapiens
tgcgtcgatgaagaacgcagctagctgcgagaa

SEQ ID NO: 17507 - DNA, 20 bp, Homo sapiens
cgatgaagaacgcagctagc

SEQ ID NO: 17508 - DNA, 21 bp, Homo sapiens
gatgaagaacgcagctagctg

SEQ ID NO: 17509 - DNA, 20 bp, Homo sapiens
atgaagaacgcagctagctg

SEQ ID NO: 17510 - DNA, 18 bp, Homo sapiens
gaagaacgcagctagctg

SEQ ID NO: 17511 - DNA, 24 bp, Homo sapiens
gaagaacgcagctagctgcgagaa

SEQ ID NO: 17512 - DNA, 25 bp, Homo sapiens
gaagaacgcagctagctgcgagaat

SEQ ID NO: 17513 - DNA, 26 bp, Homo sapiens
gaagaacgcagctagctgcgagaatt

SEQ ID NO: 17514 - DNA, 17 bp, Homo sapiens
aagaacgcagctagctg

SEQ ID NO: 17515 - DNA, 16 bp, Homo sapiens
agaacgcagctagctg

SEQ ID NO: 17516 - DNA, 32 bp, Homo sapiens
cgcagctagctgcgagaattaatgtgaattgc

SEQ ID NO: 17517 - DNA, 23 bp, Homo sapiens
gcagctagctgcgagaattaatg

SEQ ID NO: 17518 - DNA, 24 bp, Homo sapiens
gcagctagctgcgagaattaatgt

SEQ ID NO: 17519 - DNA, 25 bp, Homo sapiens
gcagctagctgcgagaattaatgtg

SEQ ID NO: 17520 - DNA, 26 bp, Homo sapiens
gcagctagctgcgagaattaatgtga

SEQ ID NO: 17521 - DNA, 27 bp, Homo sapiens
gcagctagctgcgagaattaatgtgaa

SEQ ID NO: 17522 - DNA, 28 bp, Homo sapiens
gcagctagctgcgagaattaatgtgaat

SEQ ID NO: 17523 - DNA, 29 bp, Homo sapiens
gcagctagctgcgagaattaatgtgaatt

SEQ ID NO: 17524 - DNA, 31 bp, Homo sapiens; identical to SEQ ID NO: 3612

SEQ ID NO: 17525 - DNA, 36 bp, Homo sapiens
gcagctagctgcgagaattaatgtgaattgcaggac

SEQ ID NO: 17526 - DNA, 37 bp, Homo sapiens
gcagctagctgcgagaattaatgtgaattgcaggaca

SEQ ID NO: 17527 - DNA, 38 bp, Homo sapiens
gcagctagctgcgagaattaatgtgaattgcaggacac

SEQ ID NO: 17528 - DNA, 22 bp, Homo sapiens
cagctagctgcgagaattaatg

SEQ ID NO: 17529 - DNA, 25 bp, Homo sapiens
cagctagctgcgagaattaatgtga

SEQ ID NO: 17530 - DNA, 26 bp, Homo sapiens
cagctagctgcgagaattaatgtgaa

SEQ ID NO: 17531 - DNA, 27 bp, Homo sapiens
cagctagctgcgagaattaatgtgaat

SEQ ID NO: 17532 - DNA, 21 bp, Homo sapiens
agctagctgcgagaattaatg

SEQ ID NO: 17533 - DNA, 24 bp, Homo sapiens
agctagctgcgagaattaatgtga

SEQ ID NO: 17534 - DNA, 25 bp, Homo sapiens
agctagctgcgagaattaatgtgaa

SEQ ID NO: 17535 - DNA, 26 bp, Homo sapiens
agctagctgcgagaattaatgtgaat

SEQ ID NO: 17536 - DNA, 23 bp, Homo sapiens
gctagctgcgagaattaatgtga

SEQ ID NO: 17537 - DNA, 24 bp, Homo sapiens
gctagctgcgagaattaatgtgaa

SEQ ID NO: 17538 - DNA, 25 bp, Homo sapiens
gctagctgcgagaattaatgtgaat

SEQ ID NO: 17539 - DNA, 33 bp, Homo sapiens
gctagctgcgagaattaatgtgaattgcaggac

SEQ ID NO: 17540 - DNA, 18 bp, Homo sapiens
ctagctgcgagaattaat

SEQ ID NO: 17541 - DNA, 19 bp, Homo sapiens
ctagctgcgagaattaatg

SEQ ID NO: 17542 - DNA, 20 bp, Homo sapiens
ctagctgcgagaattaatgt

SEQ ID NO: 17543 - DNA, 23 bp, Homo sapiens
ctagctgcgagaattaatgtgaa

SEQ ID NO: 17544 - DNA, 24 bp, Homo sapiens
ctagctgcgagaattaatgtgaat

SEQ ID NO: 17545 - DNA, 17 bp, Homo sapiens
tagctgcgagaattaat

SEQ ID NO: 17546 - DNA, 31 bp, Homo sapiens
tagctgcgagaattaatgtgaattgcaggac

SEQ ID NO: 17547 - DNA, 21 bp, Homo sapiens
agctgcgagaattaatgtgaa

SEQ ID NO: 17548 - DNA, 29 bp, Homo sapiens
gctgcgagaattaatgtgaattgcaggac

SEQ ID NO: 17549 - DNA, 27 bp, Homo sapiens
tgcgagaattaatgtgaattgcaggac

SEQ ID NO: 17550 - DNA, 26 bp, Homo sapiens
gcgagaattaatgtgaattgcaggac

SEQ ID NO: 17551 - DNA, 27 bp, Homo sapiens
gcgagaattaatgtgaattgcaggaca

SEQ ID NO: 17552 - DNA, 25 bp, Homo sapiens
cgagaattaatgtgaattgcaggac

SEQ ID NO: 17553 - DNA, 26 bp, Homo sapiens
cgagaattaatgtgaattgcaggaca

SEQ ID NO: 17554 - DNA, 24 bp, Homo sapiens
gagaattaatgtgaattgcaggac

SEQ ID NO: 17555 - DNA, 25 bp, Homo sapiens
gagaattaatgtgaattgcaggaca

SEQ ID NO: 17556 - DNA, 18 bp, Homo sapiens
agaattaatgtgaattgc

SEQ ID NO: 17557 - DNA, 23 bp, Homo sapiens
agaattaatgtgaattgcaggac

SEQ ID NO: 17558 - DNA, 24 bp, Homo sapiens
agaattaatgtgaattgcaggaca

SEQ ID NO: 17559 - DNA, 25 bp, Homo sapiens
agaattaatgtgaattgcaggacac

SEQ ID NO: 17560 - DNA, 22 bp, Homo sapiens
gaattaatgtgaattgcaggac

SEQ ID NO: 17561 - DNA, 23 bp, Homo sapiens
gaattaatgtgaattgcaggaca

SEQ ID NO: 17562 - DNA, 25 bp, Homo sapiens
gaattaatgtgaattgcaggacaca

SEQ ID NO: 17563 - DNA, 16 bp, Homo sapiens
aattaatgtgaattgc

SEQ ID NO: 17564 - DNA, 20 bp, Homo sapiens
aattaatgtgaattgcagga

SEQ ID NO: 17565 - DNA, 21 bp, Homo sapiens
aattaatgtgaattgcaggac

SEQ ID NO: 17566 - DNA, 22 bp, Homo sapiens
aattaatgtgaattgcaggaca

SEQ ID NO: 17567 - DNA, 23 bp, Homo sapiens
aattaatgtgaattgcaggacac

SEQ ID NO: 17568 - DNA, 24 bp, Homo sapiens
aattaatgtgaattgcaggacaca

SEQ ID NO: 17569 - DNA, 16 bp, Homo sapiens
attaatgtgaattgca

SEQ ID NO: 17570 - DNA, 19 bp, Homo sapiens
attaatgtgaattgcagga

SEQ ID NO: 17571 - DNA, 20 bp, Homo sapiens
attaatgtgaattgcaggac

SEQ ID NO: 17572 - DNA, 21 bp, Homo sapiens
attaatgtgaattgcaggaca

SEQ ID NO: 17573 - DNA, 22 bp, Homo sapiens
attaatgtgaattgcaggacac

SEQ ID NO: 17574 - DNA, 23 bp, Homo sapiens
attaatgtgaattgcaggacaca

SEQ ID NO: 17575 - DNA, 18 bp, Homo sapiens
ttaatgtgaattgcagga

SEQ ID NO: 17576 - DNA, 19 bp, Homo sapiens
ttaatgtgaattgcaggac

SEQ ID NO: 17577 - DNA, 20 bp, Homo sapiens
ttaatgtgaattgcaggaca

SEQ ID NO: 17578 - DNA, 21 bp, Homo sapiens
ttaatgtgaattgcaggacac

SEQ ID NO: 17579 - DNA, 22 bp, Homo sapiens
ttaatgtgaattgcaggacaca

SEQ ID NO: 17580 - DNA, 17 bp, Homo sapiens
taatgtgaattgcagga

SEQ ID NO: 17581 - DNA, 18 bp, Homo sapiens
taatgtgaattgcaggac

SEQ ID NO: 17582 - DNA, 19 bp, Homo sapiens
taatgtgaattgcaggaca

SEQ ID NO: 17583 - DNA, 20 bp, Homo sapiens
taatgtgaattgcaggacac

SEQ ID NO: 17584 - DNA, 21 bp, Homo sapiens
taatgtgaattgcaggacaca

SEQ ID NO: 17585 - DNA, 17 bp, Homo sapiens
aatgtgaattgcaggac

SEQ ID NO: 17586 - DNA, 18 bp, Homo sapiens
aatgtgaattgcaggaca

SEQ ID NO: 17587 - DNA, 20 bp, Homo sapiens
aatgtgaattgcaggacaca

SEQ ID NO: 17588 - DNA, 35 bp, Homo sapiens
aatgtgaattgcaggacacattgatcatcgacact

SEQ ID NO: 17589 - DNA, 39 bp, Homo sapiens
aatgtgaattgcaggacacattgatcatcgacacttcga

SEQ ID NO: 17590 - DNA, 17 bp, Homo sapiens
atgtgaattgcaggaca

SEQ ID NO: 17591 - DNA, 19 bp, Homo sapiens
atgtgaattgcaggacaca

SEQ ID NO: 17592 - DNA, 25 bp, Homo sapiens
tgtgaattgcaggacacattgatca

SEQ ID NO: 17593 - DNA, 33 bp, Homo sapiens
tgtgaattgcaggacacattgatcatcgacact

SEQ ID NO: 17594 - DNA, 17 bp, Homo sapiens
gtgaattgcaggacaca

SEQ ID NO: 17595 - DNA, 32 bp, Homo sapiens
gtgaattgcaggacacattgatcatcgacact

SEQ ID NO: 17596 - DNA, 16 bp, Homo sapiens
tgaattgcaggacaca

SEQ ID NO: 17597 - DNA, 22 bp, Homo sapiens
tgaattgcaggacacattgatc

SEQ ID NO: 17598 - DNA, 23 bp, Homo sapiens
tgaattgcaggacacattgatca

SEQ ID NO: 17599 - DNA, 25 bp, Homo sapiens
tgaattgcaggacacattgatcatc

SEQ ID NO: 17600 - DNA, 26 bp, Homo sapiens
tgaattgcaggacacattgatcatcg

SEQ ID NO: 17601 - DNA, 28 bp, Homo sapiens
tgaattgcaggacacattgatcatcgac

SEQ ID NO: 17602 - DNA, 30 bp, Homo sapiens
tgaattgcaggacacattgatcatcgacac

SEQ ID NO: 17603 - DNA, 31 bp, Homo sapiens; identical to SEQ ID NO: 3638

SEQ ID NO: 17604 - DNA, 33 bp, Homo sapiens; identical to SEQ ID NO: 3639

SEQ ID NO: 17605 - DNA, 24 bp, Homo sapiens
gaattgcaggacacattgatcatc

SEQ ID NO: 17606 - DNA, 27 bp, Homo sapiens
gaattgcaggacacattgatcatcgac

SEQ ID NO: 17607 - DNA, 30 bp, Homo sapiens; identical to SEQ ID NO: 3641

SEQ ID NO: 17608 - DNA, 32 bp, Homo sapiens
gaattgcaggacacattgatcatcgacacttc

SEQ ID NO: 17609 - DNA, 33 bp, Homo sapiens
gaattgcaggacacattgatcatcgacacttcg

SEQ ID NO: 17610 - DNA, 20 bp, Homo sapiens
aattgcaggacacattgatc

SEQ ID NO: 17611 - DNA, 21 bp, Homo sapiens
aattgcaggacacattgatca

SEQ ID NO: 17612 - DNA, 23 bp, Homo sapiens
aattgcaggacacattgatcatc

SEQ ID NO: 17613 - DNA, 24 bp, Homo sapiens
aattgcaggacacattgatcatcg

SEQ ID NO: 17614 - DNA, 25 bp, Homo sapiens
aattgcaggacacattgatcatcga

SEQ ID NO: 17615 - DNA, 27 bp, Homo sapiens
aattgcaggacacattgatcatcgaca

SEQ ID NO: 17616 - DNA, 29 bp, Homo sapiens
aattgcaggacacattgatcatcgacact

SEQ ID NO: 17617 - DNA, 30 bp, Homo sapiens
aattgcaggacacattgatcatcgacactt

SEQ ID NO: 17618 - DNA, 31 bp, Homo sapiens
aattgcaggacacattgatcatcgacacttc

SEQ ID NO: 17619 - DNA, 32 bp, Homo sapiens; identical to SEQ ID NO: 3644

SEQ ID NO: 17620 - DNA, 33 bp, Homo sapiens; identical to SEQ ID NO: 3645

SEQ ID NO: 17621 - DNA, 17 bp, Homo sapiens
attgcaggacacattga

SEQ ID NO: 17622 - DNA, 19 bp, Homo sapiens
attgcaggacacattgatc

SEQ ID NO: 17623 - DNA, 20 bp, Homo sapiens
attgcaggacacattgatca

SEQ ID NO: 17624 - DNA, 22 bp, Homo sapiens
attgcaggacacattgatcatc

SEQ ID NO: 17625 - DNA, 24 bp, Homo sapiens
attgcaggacacattgatcatcga

SEQ ID NO: 17626 - DNA, 25 bp, Homo sapiens
attgcaggacacattgatcatcgac

SEQ ID NO: 17627 - DNA, 26 bp, Homo sapiens
attgcaggacacattgatcatcgaca

SEQ ID NO: 17628 - DNA, 28 bp, Homo sapiens
attgcaggacacattgatcatcgacact

SEQ ID NO: 17629 - DNA, 29 bp, Homo sapiens
attgcaggacacattgatcatcgacactt

SEQ ID NO: 17630 - DNA, 31 bp, Homo sapiens
attgcaggacacattgatcatcgacacttcg

SEQ ID NO: 17631 - DNA, 32 bp, Homo sapiens; identical to SEQ ID NO: 3648

SEQ ID NO: 17632 - DNA, 33 bp, Homo sapiens
attgcaggacacattgatcatcgacacttcgaa

SEQ ID NO: 17633 - DNA, 47 bp, Homo sapiens
attgcaggacacattgatcatcgacacttcgaacgcacttgcggccc

SEQ ID NO: 17634 - DNA, 18 bp, Homo sapiens
ttgcaggacacattgatc

SEQ ID NO: 17635 - DNA, 19 bp, Homo sapiens
ttgcaggacacattgatca

SEQ ID NO: 17636 - DNA, 21 bp, Homo sapiens
ttgcaggacacattgatcatc

SEQ ID NO: 17637 - DNA, 23 bp, Homo sapiens
ttgcaggacacattgatcatcga

SEQ ID NO: 17638 - DNA, 25 bp, Homo sapiens
ttgcaggacacattgatcatcgaca

SEQ ID NO: 17639 - DNA, 27 bp, Homo sapiens
ttgcaggacacattgatcatcgacact

SEQ ID NO: 17640 - DNA, 29 bp, Homo sapiens
ttgcaggacacattgatcatcgacacttc

SEQ ID NO: 17641 - DNA, 30 bp, Homo sapiens
ttgcaggacacattgatcatcgacacttcg

SEQ ID NO: 17642 - DNA, 31 bp, Homo sapiens; identical to SEQ ID NO: 3650

SEQ ID NO: 17643 - DNA, 32 bp, Homo sapiens
ttgcaggacacattgatcatcgacacttcgaa

SEQ ID NO: 17644 - DNA, 33 bp, Homo sapiens
ttgcaggacacattgatcatcgacacttcgaac

SEQ ID NO: 17645 - DNA, 46 bp, Homo sapiens
ttgcaggacacattgatcatcgacacttcgaacgcacttgcggccc

SEQ ID NO: 17646 - DNA, 47 bp, Homo sapiens
ttgcaggacacattgatcatcgacacttcgaacgcacttgcggcccc

SEQ ID NO: 17647 - DNA, 20 bp, Homo sapiens
tgcaggacacattgatcatc

SEQ ID NO: 17648 - DNA, 26 bp, Homo sapiens
tgcaggacacattgatcatcgacact

SEQ ID NO: 17649 - DNA, 27 bp, Homo sapiens
tgcaggacacattgatcatcgacactt

SEQ ID NO: 17650 - DNA, 29 bp, Homo sapiens
tgcaggacacattgatcatcgacacttcg

SEQ ID NO: 17651 - DNA, 30 bp, Homo sapiens
tgcaggacacattgatcatcgacacttcga

SEQ ID NO: 17652 - DNA, 31 bp, Homo sapiens
tgcaggacacattgatcatcgacacttcgaa

SEQ ID NO: 17653 - DNA, 32 bp, Homo sapiens
tgcaggacacattgatcatcgacacttcgaac

SEQ ID NO: 17654 - DNA, 33 bp, Homo sapiens
tgcaggacacattgatcatcgacacttcgaacg

SEQ ID NO: 17655 - DNA, 45 bp, Homo sapiens
tgcaggacacattgatcatcgacacttcgaacgcacttgcggccc

SEQ ID NO: 17656 - DNA, 46 bp, Homo sapiens
tgcaggacacattgatcatcgacacttcgaacgcacttgcggcccc

SEQ ID NO: 17657 - DNA, 47 bp, Homo sapiens
tgcaggacacattgatcatcgacacttcgaacgcacttgcggccccg

SEQ ID NO: 17658 - DNA, 19 bp, Homo sapiens
gcaggacacattgatcatc

SEQ ID NO: 17659 - DNA, 21 bp, Homo sapiens
gcaggacacattgatcatcga

SEQ ID NO: 17660 - DNA, 25 bp, Homo sapiens
gcaggacacattgatcatcgacact

SEQ ID NO: 17661 - DNA, 26 bp, Homo sapiens
gcaggacacattgatcatcgacactt

SEQ ID NO: 17662 - DNA, 29 bp, Homo sapiens
gcaggacacattgatcatcgacacttcga

SEQ ID NO: 17663 - DNA, 31 bp, Homo sapiens
gcaggacacattgatcatcgacacttcgaac

SEQ ID NO: 17664 - DNA, 32 bp, Homo sapiens
gcaggacacattgatcatcgacacttcgaacg

SEQ ID NO: 17665 - DNA, 44 bp, Homo sapiens
gcaggacacattgatcatcgacacttcgaacgcacttgcggccc

SEQ ID NO: 17666 - DNA, 45 bp, Homo sapiens
gcaggacacattgatcatcgacacttcgaacgcacttgcggcccc

SEQ ID NO: 17667 - DNA, 46 bp, Homo sapiens
gcaggacacattgatcatcgacacttcgaacgcacttgcggccccg

SEQ ID NO: 17668 - DNA, 47 bp, Homo sapiens
gcaggacacattgatcatcgacacttcgaacgcacttgcggccccgg

SEQ ID NO: 17669 - DNA, 19 bp, Homo sapiens
aggacacattgatcatcga

SEQ ID NO: 17670 - DNA, 27 bp, Homo sapiens
aggacacattgatcatcgacacttcga

SEQ ID NO: 17671 - DNA, 17 bp, Homo sapiens
ggacacattgatcatcg

SEQ ID NO: 17672 - DNA, 18 bp, Homo sapiens
ggacacattgatcatcga

SEQ ID NO: 17673 - DNA, 19 bp, Homo sapiens
ggacacattgatcatcgac

SEQ ID NO: 17674 - DNA, 20 bp, Homo sapiens
ggacacattgatcatcgaca

SEQ ID NO: 17675 - DNA, 21 bp, Homo sapiens
ggacacattgatcatcgacac

SEQ ID NO: 17676 - DNA, 22 bp, Homo sapiens
ggacacattgatcatcgacact

SEQ ID NO: 17677 - DNA, 23 bp, Homo sapiens
ggacacattgatcatcgacactt

SEQ ID NO: 17678 - DNA, 24 bp, Homo sapiens
ggacacattgatcatcgacacttc

SEQ ID NO: 17679 - DNA, 25 bp, Homo sapiens
ggacacattgatcatcgacacttcg

SEQ ID NO: 17680 - DNA, 26 bp, Homo sapiens
ggacacattgatcatcgacacttcga

SEQ ID NO: 17681 - DNA, 27 bp, Homo sapiens
ggacacattgatcatcgacacttcgaa

SEQ ID NO: 17682 - DNA, 28 bp, Homo sapiens
ggacacattgatcatcgacacttcgaac

SEQ ID NO: 17683 - DNA, 29 bp, Homo sapiens
ggacacattgatcatcgacacttcgaacg

SEQ ID NO: 17684 - DNA, 30 bp, Homo sapiens
ggacacattgatcatcgacacttcgaacgc

SEQ ID NO: 17685 - DNA, 31 bp, Homo sapiens; identical to SEQ ID NO: 3659

SEQ ID NO: 17686 - DNA, 32 bp, Homo sapiens
ggacacattgatcatcgacacttcgaacgcac

SEQ ID NO: 17687 - DNA, 33 bp, Homo sapiens; identical to SEQ ID NO: 3660

SEQ ID NO: 17688 - DNA, 34 bp, Homo sapiens
ggacacattgatcatcgacacttcgaacgcactt

SEQ ID NO: 17689 - DNA, 35 bp, Homo sapiens
ggacacattgatcatcgacacttcgaacgcacttg

SEQ ID NO: 17690 - DNA, 40 bp, Homo sapiens
ggacacattgatcatcgacacttcgaacgcacttgcggcc

SEQ ID NO: 17691 - DNA, 41 bp, Homo sapiens
ggacacattgatcatcgacacttcgaacgcacttgcggccc

SEQ ID NO: 17692 - DNA, 42 bp, Homo sapiens
ggacacattgatcatcgacacttcgaacgcacttgcggcccc

SEQ ID NO: 17693 - DNA, 43 bp, Homo sapiens
ggacacattgatcatcgacacttcgaacgcacttgcggccccg

SEQ ID NO: 17694 - DNA, 44 bp, Homo sapiens
ggacacattgatcatcgacacttcgaacgcacttgcggccccgg

SEQ ID NO: 17695 - DNA, 45 bp, Homo sapiens
ggacacattgatcatcgacacttcgaacgcacttgcggccccggg

SEQ ID NO: 17696 - DNA, 46 bp, Homo sapiens
ggacacattgatcatcgacacttcgaacgcacttgcggccccgggt

SEQ ID NO: 17697 - DNA, 47 bp, Homo sapiens
ggacacattgatcatcgacacttcgaacgcacttgcggccccgggtt

SEQ ID NO: 17698 - DNA, 17 bp, Homo sapiens
gacacattgatcatcga

SEQ ID NO: 17699 - DNA, 19 bp, Homo sapiens
gacacattgatcatcgaca

SEQ ID NO: 17700 - DNA, 21 bp, Homo sapiens
gacacattgatcatcgacact

SEQ ID NO: 17701 - DNA, 22 bp, Homo sapiens
gacacattgatcatcgacactt

SEQ ID NO: 17702 - DNA, 24 bp, Homo sapiens
gacacattgatcatcgacacttcg

SEQ ID NO: 17703 - DNA, 25 bp, Homo sapiens
gacacattgatcatcgacacttcga

SEQ ID NO: 17704 - DNA, 28 bp, Homo sapiens
gacacattgatcatcgacacttcgaacg

SEQ ID NO: 17705 - DNA, 30 bp, Homo sapiens
gacacattgatcatcgacacttcgaacgca

SEQ ID NO: 17706 - DNA, 32 bp, Homo sapiens; identical to SEQ ID NO: 3663

SEQ ID NO: 17707 - DNA, 33 bp, Homo sapiens
gacacattgatcatcgacacttcgaacgcactt

SEQ ID NO: 17708 - DNA, 34 bp, Homo sapiens
gacacattgatcatcgacacttcgaacgcacttg

SEQ ID NO: 17709 - DNA, 39 bp, Homo sapiens
gacacattgatcatcgacacttcgaacgcacttgcggcc

SEQ ID NO: 17710 - DNA, 40 bp, Homo sapiens
gacacattgatcatcgacacttcgaacgcacttgcggccc

SEQ ID NO: 17711 - DNA, 41 bp, Homo sapiens
gacacattgatcatcgacacttcgaacgcacttgcggcccc

SEQ ID NO: 17712 - DNA, 42 bp, Homo sapiens
gacacattgatcatcgacacttcgaacgcacttgcggccccg

SEQ ID NO: 17713 - DNA, 43 bp, Homo sapiens
gacacattgatcatcgacacttcgaacgcacttgcggccccgg

SEQ ID NO: 17714 - DNA, 44 bp, Homo sapiens
gacacattgatcatcgacacttcgaacgcacttgcggccccggg

SEQ ID NO: 17715 - DNA, 45 bp, Homo sapiens
gacacattgatcatcgacacttcgaacgcacttgcggccccgggt

SEQ ID NO: 17716 - DNA, 46 bp, Homo sapiens
gacacattgatcatcgacacttcgaacgcacttgcggccccgggtt

SEQ ID NO: 17717 - DNA, 16 bp, Homo sapiens
acacattgatcatcga

SEQ ID NO: 17718 - DNA, 18 bp, Homo sapiens
acacattgatcatcgaca

SEQ ID NO: 17719 - DNA, 20 bp, Homo sapiens
acacattgatcatcgacact

SEQ ID NO: 17720 - DNA, 24 bp, Homo sapiens
acacattgatcatcgacacttcga

SEQ ID NO: 17721 - DNA, 27 bp, Homo sapiens
acacattgatcatcgacacttcgaacg

SEQ ID NO: 17722 - DNA, 29 bp, Homo sapiens
acacattgatcatcgacacttcgaacgca

SEQ ID NO: 17723 - DNA, 31 bp, Homo sapiens
acacattgatcatcgacacttcgaacgcact

SEQ ID NO: 17724 - DNA, 32 bp, Homo sapiens
acacattgatcatcgacacttcgaacgcactt

SEQ ID NO: 17725 - DNA, 33 bp, Homo sapiens; identical to SEQ ID NO: 3664

SEQ ID NO: 17726 - DNA, 41 bp, Homo sapiens
acacattgatcatcgacacttcgaacgcacttgcggccccg

SEQ ID NO: 17727 - DNA, 42 bp, Homo sapiens
acacattgatcatcgacacttcgaacgcacttgcggccccgg

SEQ ID NO: 17728 - DNA, 43 bp, Homo sapiens
acacattgatcatcgacacttcgaacgcacttgcggccccggg

SEQ ID NO: 17729 - DNA, 44 bp, Homo sapiens
acacattgatcatcgacacttcgaacgcacttgcggccccgggt

SEQ ID NO: 17730 - DNA, 45 bp, Homo sapiens
acacattgatcatcgacacttcgaacgcacttgcggccccgggtt

SEQ ID NO: 17731 - DNA, 17 bp, Homo sapiens
cacattgatcatcgaca

SEQ ID NO: 17732 - DNA, 19 bp, Homo sapiens
cacattgatcatcgacact

SEQ ID NO: 17733 - DNA, 23 bp, Homo sapiens
cacattgatcatcgacacttcga

SEQ ID NO: 17734 - DNA, 24 bp, Homo sapiens
cacattgatcatcgacacttcgaa

SEQ ID NO: 17735 - DNA, 28 bp, Homo sapiens
cacattgatcatcgacacttcgaacgca

SEQ ID NO: 17736 - DNA, 30 bp, Homo sapiens
cacattgatcatcgacacttcgaacgcact

SEQ ID NO: 17737 - DNA, 31 bp, Homo sapiens
cacattgatcatcgacacttcgaacgcactt

SEQ ID NO: 17738 - DNA, 32 bp, Homo sapiens
cacattgatcatcgacacttcgaacgcacttg

SEQ ID NO: 17739 - DNA, 40 bp, Homo sapiens
cacattgatcatcgacacttcgaacgcacttgcggccccg

SEQ ID NO: 17740 - DNA, 41 bp, Homo sapiens
cacattgatcatcgacacttcgaacgcacttgcggccccgg

SEQ ID NO: 17741 - DNA, 42 bp, Homo sapiens
cacattgatcatcgacacttcgaacgcacttgcggccccggg

SEQ ID NO: 17742 - DNA, 43 bp, Homo sapiens
cacattgatcatcgacacttcgaacgcacttgcggccccgggt

SEQ ID NO: 17743 - DNA, 44 bp, Homo sapiens
cacattgatcatcgacacttcgaacgcacttgcggccccgggtt

SEQ ID NO: 17744 - DNA, 16 bp, Homo sapiens
acattgatcatcgaca

SEQ ID NO: 17745 - DNA, 18 bp, Homo sapiens
acattgatcatcgacact

SEQ ID NO: 17746 - DNA, 19 bp, Homo sapiens
acattgatcatcgacactt

SEQ ID NO: 17747 - DNA, 21 bp, Homo sapiens
acattgatcatcgacacttcg

SEQ ID NO: 17748 - DNA, 22 bp, Homo sapiens
acattgatcatcgacacttcga

SEQ ID NO: 17749 - DNA, 24 bp, Homo sapiens
acattgatcatcgacacttcgaac

SEQ ID NO: 17750 - DNA, 25 bp, Homo sapiens
acattgatcatcgacacttcgaacg

SEQ ID NO: 17751 - DNA, 27 bp, Homo sapiens
acattgatcatcgacacttcgaacgca

SEQ ID NO: 17752 - DNA, 29 bp, Homo sapiens
acattgatcatcgacacttcgaacgcact

SEQ ID NO: 17753 - DNA, 30 bp, Homo sapiens; identical to SEQ ID NO: 3670

SEQ ID NO: 17754 - DNA, 32 bp, Homo sapiens
acattgatcatcgacacttcgaacgcacttgc

SEQ ID NO: 17755 - DNA, 36 bp, Homo sapiens
acattgatcatcgacacttcgaacgcacttgcggcc

SEQ ID NO: 17756 - DNA, 37 bp, Homo sapiens
acattgatcatcgacacttcgaacgcacttgcggccc

SEQ ID NO: 17757 - DNA, 38 bp, Homo sapiens
acattgatcatcgacacttcgaacgcacttgcggcccc

SEQ ID NO: 17758 - DNA, 39 bp, Homo sapiens
acattgatcatcgacacttcgaacgcacttgcggccccg

SEQ ID NO: 17759 - DNA, 40 bp, Homo sapiens
acattgatcatcgacacttcgaacgcacttgcggccccgg

SEQ ID NO: 17760 - DNA, 41 bp, Homo sapiens
acattgatcatcgacacttcgaacgcacttgcggccccggg

SEQ ID NO: 17761 - DNA, 42 bp, Homo sapiens
acattgatcatcgacacttcgaacgcacttgcggccccgggt

SEQ ID NO: 17762 - DNA, 43 bp, Homo sapiens
acattgatcatcgacacttcgaacgcacttgcggccccgggtt

SEQ ID NO: 17763 - DNA, 44 bp, Homo sapiens
acattgatcatcgacacttcgaacgcacttgcggccccgggttc

SEQ ID NO: 17764 - DNA, 45 bp, Homo sapiens
acattgatcatcgacacttcgaacgcacttgcggccccgggttcc

SEQ ID NO: 17765 - DNA, 46 bp, Homo sapiens
acattgatcatcgacacttcgaacgcacttgcggccccgggttcct

SEQ ID NO: 17766 - DNA, 17 bp, Homo sapiens
cattgatcatcgacact

SEQ ID NO: 17767 - DNA, 21 bp, Homo sapiens
cattgatcatcgacacttcga

SEQ ID NO: 17768 - DNA, 22 bp, Homo sapiens
cattgatcatcgacacttcgaa

SEQ ID NO: 17769 - DNA, 26 bp, Homo sapiens
cattgatcatcgacacttcgaacgca

SEQ ID NO: 17770 - DNA, 28 bp, Homo sapiens
cattgatcatcgacacttcgaacgcact

SEQ ID NO: 17771 - DNA, 29 bp, Homo sapiens
cattgatcatcgacacttcgaacgcactt

SEQ ID NO: 17772 - DNA, 30 bp, Homo sapiens
cattgatcatcgacacttcgaacgcacttg

SEQ ID NO: 17773 - DNA, 31 bp, Homo sapiens
cattgatcatcgacacttcgaacgcacttgc

SEQ ID NO: 17774 - DNA, 36 bp, Homo sapiens
cattgatcatcgacacttcgaacgcacttgcggccc

SEQ ID NO: 17775 - DNA, 37 bp, Homo sapiens
cattgatcatcgacacttcgaacgcacttgcggcccc

SEQ ID NO: 17776 - DNA, 38 bp, Homo sapiens
cattgatcatcgacacttcgaacgcacttgcggccccg

SEQ ID NO: 17777 - DNA, 39 bp, Homo sapiens
cattgatcatcgacacttcgaacgcacttgcggccccgg

SEQ ID NO: 17778 - DNA, 40 bp, Homo sapiens
cattgatcatcgacacttcgaacgcacttgcggccccggg

SEQ ID NO: 17779 - DNA, 41 bp, Homo sapiens
cattgatcatcgacacttcgaacgcacttgcggccccgggt

SEQ ID NO: 17780 - DNA, 42 bp, Homo sapiens
cattgatcatcgacacttcgaacgcacttgcggccccgggtt

SEQ ID NO: 17781 - DNA, 43 bp, Homo sapiens
cattgatcatcgacacttcgaacgcacttgcggccccgggttc

SEQ ID NO: 17782 - DNA, 44 bp, Homo sapiens
cattgatcatcgacacttcgaacgcacttgcggccccgggttcc

SEQ ID NO: 17783 - DNA, 45 bp, Homo sapiens
cattgatcatcgacacttcgaacgcacttgcggccccgggttcct

SEQ ID NO: 17784 - DNA, 47 bp, Homo sapiens
cattgatcatcgacacttcgaacgcacttgcggccccgggttcctcc

SEQ ID NO: 17785 - DNA, 16 bp, Homo sapiens
attgatcatcgacact

SEQ ID NO: 17786 - DNA, 20 bp, Homo sapiens
attgatcatcgacacttcga

SEQ ID NO: 17787 - DNA, 27 bp, Homo sapiens
attgatcatcgacacttcgaacgcact

SEQ ID NO: 17788 - DNA, 30 bp, Homo sapiens
attgatcatcgacacttcgaacgcacttgc

SEQ ID NO: 17789 - DNA, 35 bp, Homo sapiens
attgatcatcgacacttcgaacgcacttgcggccc

SEQ ID NO: 17790 - DNA, 36 bp, Homo sapiens
attgatcatcgacacttcgaacgcacttgcggcccc

SEQ ID NO: 17791 - DNA, 37 bp, Homo sapiens
attgatcatcgacacttcgaacgcacttgcggccccg

SEQ ID NO: 17792 - DNA, 38 bp, Homo sapiens
attgatcatcgacacttcgaacgcacttgcggccccgg

SEQ ID NO: 17793 - DNA, 39 bp, Homo sapiens
attgatcatcgacacttcgaacgcacttgcggccccggg

SEQ ID NO: 17794 - DNA, 40 bp, Homo sapiens
attgatcatcgacacttcgaacgcacttgcggccccgggt

SEQ ID NO: 17795 - DNA, 41 bp, Homo sapiens
attgatcatcgacacttcgaacgcacttgcggccccgggtt

SEQ ID NO: 17796 - DNA, 42 bp, Homo sapiens
attgatcatcgacacttcgaacgcacttgcggccccgggttc

SEQ ID NO: 17797 - DNA, 43 bp, Homo sapiens
attgatcatcgacacttcgaacgcacttgcggccccgggttcc

SEQ ID NO: 17798 - DNA, 44 bp, Homo sapiens
attgatcatcgacacttcgaacgcacttgcggccccgggttcct

SEQ ID NO: 17799 - DNA, 19 bp, Homo sapiens
ttgatcatcgacacttcga

SEQ ID NO: 17800 - DNA, 26 bp, Homo sapiens
ttgatcatcgacacttcgaacgcact

SEQ ID NO: 17801 - DNA, 29 bp, Homo sapiens
ttgatcatcgacacttcgaacgcacttgc

SEQ ID NO: 17802 - DNA, 33 bp, Homo sapiens
ttgatcatcgacacttcgaacgcacttgcggcc

SEQ ID NO: 17803 - DNA, 34 bp, Homo sapiens
ttgatcatcgacacttcgaacgcacttgcggccc

SEQ ID NO: 17804 - DNA, 35 bp, Homo sapiens
ttgatcatcgacacttcgaacgcacttgcggcccc

SEQ ID NO: 17805 - DNA, 36 bp, Homo sapiens
ttgatcatcgacacttcgaacgcacttgcggccccg

SEQ ID NO: 17806 - DNA, 37 bp, Homo sapiens
ttgatcatcgacacttcgaacgcacttgcggccccgg

SEQ ID NO: 17807 - DNA, 38 bp, Homo sapiens
ttgatcatcgacacttcgaacgcacttgcggccccggg

SEQ ID NO: 17808 - DNA, 40 bp, Homo sapiens
ttgatcatcgacacttcgaacgcacttgcggccccgggtt

SEQ ID NO: 17809 - DNA, 43 bp, Homo sapiens
ttgatcatcgacacttcgaacgcacttgcggccccgggttcct

SEQ ID NO: 17810 - DNA, 33 bp, Homo sapiens
tgatcatcgacacttcgaacgcacttgcggccc

SEQ ID NO: 17811 - DNA, 35 bp, Homo sapiens
tgatcatcgacacttcgaacgcacttgcggccccg

SEQ ID NO: 17812 - DNA, 33 bp, Homo sapiens
gatcatcgacacttcgaacgcacttgcggcccc

SEQ ID NO: 17813 - DNA, 34 bp, Homo sapiens
gatcatcgacacttcgaacgcacttgcggccccg

SEQ ID NO: 17814 - DNA, 23 bp, Homo sapiens
atcatcgacacttcgaacgcact

SEQ ID NO: 17815 - DNA, 30 bp, Homo sapiens
atcatcgacacttcgaacgcacttgcggcc

SEQ ID NO: 17816 - DNA, 31 bp, Homo sapiens; identical to SEQ ID NO: 3674

SEQ ID NO: 17817 - DNA, 32 bp, Homo sapiens; identical to SEQ ID NO: 3675

SEQ ID NO: 17818 - DNA, 33 bp, Homo sapiens; identical to SEQ ID NO: 3676

SEQ ID NO: 17819 - DNA, 34 bp, Homo sapiens
atcatcgacacttcgaacgcacttgcggccccgg

SEQ ID NO: 17820 - DNA, 35 bp, Homo sapiens
atcatcgacacttcgaacgcacttgcggccccggg

SEQ ID NO: 17821 - DNA, 36 bp, Homo sapiens
atcatcgacacttcgaacgcacttgcggccccgggt

SEQ ID NO: 17822 - DNA, 37 bp, Homo sapiens
atcatcgacacttcgaacgcacttgcggccccgggtt

SEQ ID NO: 17823 - DNA, 38 bp, Homo sapiens
atcatcgacacttcgaacgcacttgcggccccgggttc

SEQ ID NO: 17824 - DNA, 40 bp, Homo sapiens
atcatcgacacttcgaacgcacttgcggccccgggttcct

SEQ ID NO: 17825 - DNA, 22 bp, Homo sapiens
tcatcgacacttcgaacgcact

SEQ ID NO: 17826 - DNA, 25 bp, Homo sapiens
tcatcgacacttcgaacgcacttgc

SEQ ID NO: 17827 - DNA, 30 bp, Homo sapiens
tcatcgacacttcgaacgcacttgcggccc

SEQ ID NO: 17828 - DNA, 31 bp, Homo sapiens
tcatcgacacttcgaacgcacttgcggcccc

SEQ ID NO: 17829 - DNA, 32 bp, Homo sapiens; identical to SEQ ID NO: 3677

SEQ ID NO: 17830 - DNA, 33 bp, Homo sapiens; identical to SEQ ID NO: 3678

SEQ ID NO: 17831 - DNA, 34 bp, Homo sapiens
tcatcgacacttcgaacgcacttgcggccccggg

SEQ ID NO: 17832 - DNA, 36 bp, Homo sapiens
tcatcgacacttcgaacgcacttgcggccccgggtt

SEQ ID NO: 17833 - DNA, 21 bp, Homo sapiens
catcgacacttcgaacgcact

SEQ ID NO: 17834 - DNA, 29 bp, Homo sapiens
catcgacacttcgaacgcacttgcggccc

SEQ ID NO: 17835 - DNA, 30 bp, Homo sapiens; identical to SEQ ID NO: 3679

SEQ ID NO: 17836 - DNA, 31 bp, Homo sapiens; identical to SEQ ID NO: 3680

SEQ ID NO: 17837 - DNA, 32 bp, Homo sapiens; identical to SEQ ID NO: 3681

SEQ ID NO: 17838 - DNA, 33 bp, Homo sapiens; identical to SEQ ID NO: 3682

SEQ ID NO: 17839 - DNA, 34 bp, Homo sapiens
catcgacacttcgaacgcacttgcggccccgggt

SEQ ID NO: 17840 - DNA, 35 bp, Homo sapiens
catcgacacttcgaacgcacttgcggccccgggtt

SEQ ID NO: 17841 - DNA, 20 bp, Homo sapiens
atcgacacttcgaacgcact

SEQ ID NO: 17842 - DNA, 28 bp, Homo sapiens
atcgacacttcgaacgcacttgcggccc

SEQ ID NO: 17843 - DNA, 29 bp, Homo sapiens
atcgacacttcgaacgcacttgcggcccc

SEQ ID NO: 17844 - DNA, 30 bp, Homo sapiens; identical to SEQ ID NO: 3684

SEQ ID NO: 17845 - DNA, 31 bp, Homo sapiens; identical to SEQ ID NO: 3685

SEQ ID NO: 17846 - DNA, 32 bp, Homo sapiens; identical to SEQ ID NO: 3686

SEQ ID NO: 17847 - DNA, 33 bp, Homo sapiens; identical to SEQ ID NO: 3687

SEQ ID NO: 17848 - DNA, 34 bp, Homo sapiens
atcgacacttcgaacgcacttgcggccccgggtt

SEQ ID NO: 17849 - DNA, 19 bp, Homo sapiens
tcgacacttcgaacgcact

SEQ ID NO: 17850 - DNA, 22 bp, Homo sapiens
tcgacacttcgaacgcacttgc

SEQ ID NO: 17851 - DNA, 27 bp, Homo sapiens
tcgacacttcgaacgcacttgcggccc

SEQ ID NO: 17852 - DNA, 28 bp, Homo sapiens
tcgacacttcgaacgcacttgcggcccc

SEQ ID NO: 17853 - DNA, 29 bp, Homo sapiens
tcgacacttcgaacgcacttgcggccccg

SEQ ID NO: 17854 - DNA, 30 bp, Homo sapiens; identical to SEQ ID NO: 3690

SEQ ID NO: 17855 - DNA, 31 bp, Homo sapiens; identical to SEQ ID NO: 3691

SEQ ID NO: 17856 - DNA, 32 bp, Homo sapiens; identical to SEQ ID NO: 3692

SEQ ID NO: 17857 - DNA, 33 bp, Homo sapiens; identical to SEQ ID NO: 3693

SEQ ID NO: 17858 - DNA, 18 bp, Homo sapiens
cgacacttcgaacgcact

SEQ ID NO: 17859 - DNA, 26 bp, Homo sapiens
cgacacttcgaacgcacttgcggccc

SEQ ID NO: 17860 - DNA, 27 bp, Homo sapiens
cgacacttcgaacgcacttgcggcccc

SEQ ID NO: 17861 - DNA, 28 bp, Homo sapiens
cgacacttcgaacgcacttgcggccccg

SEQ ID NO: 17862 - DNA, 29 bp, Homo sapiens
cgacacttcgaacgcacttgcggccccgg

SEQ ID NO: 17863 - DNA, 30 bp, Homo sapiens; identical to SEQ ID NO: 3698

SEQ ID NO: 17864 - DNA, 31 bp, Homo sapiens; identical to SEQ ID NO: 3699

SEQ ID NO: 17865 - DNA, 32 bp, Homo sapiens; identical to SEQ ID NO: 3700

SEQ ID NO: 17866 - DNA, 33 bp, Homo sapiens; identical to SEQ ID NO: 3701

SEQ ID NO: 17867 - DNA, 37 bp, Homo sapiens
cgacacttcgaacgcacttgcggccccgggttcctcc

SEQ ID NO: 17868 - DNA, 38 bp, Homo sapiens
cgacacttcgaacgcacttgcggccccgggttcctccc

SEQ ID NO: 17869 - DNA, 25 bp, Homo sapiens
gacacttcgaacgcacttgcggccc

SEQ ID NO: 17870 - DNA, 26 bp, Homo sapiens
gacacttcgaacgcacttgcggcccc

SEQ ID NO: 17871 - DNA, 27 bp, Homo sapiens
gacacttcgaacgcacttgcggccccg

SEQ ID NO: 17872 - DNA, 28 bp, Homo sapiens
gacacttcgaacgcacttgcggccccgg

SEQ ID NO: 17873 - DNA, 29 bp, Homo sapiens
gacacttcgaacgcacttgcggccccggg

SEQ ID NO: 17874 - DNA, 30 bp, Homo sapiens; identical to SEQ ID NO: 3706

SEQ ID NO: 17875 - DNA, 31 bp, Homo sapiens; identical to SEQ ID NO: 3707

SEQ ID NO: 17876 - DNA, 32 bp, Homo sapiens
gacacttcgaacgcacttgcggccccgggttc

SEQ ID NO: 17877 - DNA, 33 bp, Homo sapiens
gacacttcgaacgcacttgcggccccgggttcc

SEQ ID NO: 17878 - DNA, 34 bp, Homo sapiens
gacacttcgaacgcacttgcggccccgggttcct

SEQ ID NO: 17879 - DNA, 16 bp, Homo sapiens
acacttcgaacgcact

SEQ ID NO: 17880 - DNA, 24 bp, Homo sapiens
acacttcgaacgcacttgcggccc

SEQ ID NO: 17881 - DNA, 25 bp, Homo sapiens
acacttcgaacgcacttgcggcccc

SEQ ID NO: 17882 - DNA, 26 bp, Homo sapiens
acacttcgaacgcacttgcggccccg

SEQ ID NO: 17883 - DNA, 27 bp, Homo sapiens
acacttcgaacgcacttgcggccccgg

SEQ ID NO: 17884 - DNA, 28 bp, Homo sapiens
acacttcgaacgcacttgcggccccggg

SEQ ID NO: 17885 - DNA, 29 bp, Homo sapiens
acacttcgaacgcacttgcggccccgggt

SEQ ID NO: 17886 - DNA, 30 bp, Homo sapiens; identical to SEQ ID NO: 3714

SEQ ID NO: 17887 - DNA, 31 bp, Homo sapiens
acacttcgaacgcacttgcggccccgggttc

SEQ ID NO: 17888 - DNA, 32 bp, Homo sapiens; identical to SEQ ID NO: 3715

SEQ ID NO: 17889 - DNA, 33 bp, Homo sapiens; identical to SEQ ID NO: 3716

SEQ ID NO: 17890 - DNA, 35 bp, Homo sapiens
acacttcgaacgcacttgcggccccgggttcctcc

SEQ ID NO: 17891 - DNA, 36 bp, Homo sapiens
acacttcgaacgcacttgcggccccgggttcctccc

SEQ ID NO: 17892 - DNA, 18 bp, Homo sapiens
cacttcgaacgcacttgc

SEQ ID NO: 17893 - DNA, 23 bp, Homo sapiens
cacttcgaacgcacttgcggccc

SEQ ID NO: 17894 - DNA, 24 bp, Homo sapiens
cacttcgaacgcacttgcggcccc

SEQ ID NO: 17895 - DNA, 25 bp, Homo sapiens
cacttcgaacgcacttgcggccccg

SEQ ID NO: 17896 - DNA, 26 bp, Homo sapiens
cacttcgaacgcacttgcggccccgg

SEQ ID NO: 17897 - DNA, 27 bp, Homo sapiens
cacttcgaacgcacttgcggccccggg

SEQ ID NO: 17898 - DNA, 28 bp, Homo sapiens
cacttcgaacgcacttgcggccccgggt

SEQ ID NO: 17899 - DNA, 29 bp, Homo sapiens
cacttcgaacgcacttgcggccccgggtt

SEQ ID NO: 17900 - DNA, 30 bp, Homo sapiens
cacttcgaacgcacttgcggccccgggttc

SEQ ID NO: 17901 - DNA, 31 bp, Homo sapiens
cacttcgaacgcacttgcggccccgggttcc

SEQ ID NO: 17902 - DNA, 32 bp, Homo sapiens; identical to SEQ ID NO: 3721

SEQ ID NO: 17903 - DNA, 33 bp, Homo sapiens
cacttcgaacgcacttgcggccccgggttcctc

SEQ ID NO: 17904 - DNA, 23 bp, Homo sapiens
acttcgaacgcacttgcggcccc

SEQ ID NO: 17905 - DNA, 24 bp, Homo sapiens
acttcgaacgcacttgcggccccg

SEQ ID NO: 17906 - DNA, 25 bp, Homo sapiens
acttcgaacgcacttgcggccccgg

SEQ ID NO: 17907 - DNA, 26 bp, Homo sapiens
acttcgaacgcacttgcggccccggg

SEQ ID NO: 17908 - DNA, 27 bp, Homo sapiens
acttcgaacgcacttgcggccccgggt

SEQ ID NO: 17909 - DNA, 28 bp, Homo sapiens
acttcgaacgcacttgcggccccgggtt

SEQ ID NO: 17910 - DNA, 30 bp, Homo sapiens
acttcgaacgcacttgcggccccgggttcc

SEQ ID NO: 17911 - DNA, 31 bp, Homo sapiens
acttcgaacgcacttgcggccccgggttcct

SEQ ID NO: 17912 - DNA, 21 bp, Homo sapiens
cttcgaacgcacttgcggccc

SEQ ID NO: 17913 - DNA, 22 bp, Homo sapiens
cttcgaacgcacttgcggcccc

SEQ ID NO: 17914 - DNA, 23 bp, Homo sapiens
cttcgaacgcacttgcggccccg

SEQ ID NO: 17915 - DNA, 24 bp, Homo sapiens
cttcgaacgcacttgcggccccgg

SEQ ID NO: 17916 - DNA, 25 bp, Homo sapiens
cttcgaacgcacttgcggccccggg

SEQ ID NO: 17917 - DNA, 26 bp, Homo sapiens
cttcgaacgcacttgcggccccgggt

SEQ ID NO: 17918 - DNA, 27 bp, Homo sapiens
cttcgaacgcacttgcggccccgggtt

SEQ ID NO: 17919 - DNA, 28 bp, Homo sapiens
cttcgaacgcacttgcggccccgggttc

SEQ ID NO: 17920 - DNA, 29 bp, Homo sapiens
cttcgaacgcacttgcggccccgggttcc

SEQ ID NO: 17921 - DNA, 30 bp, Homo sapiens
cttcgaacgcacttgcggccccgggttcct

SEQ ID NO: 17922 - DNA, 32 bp, Homo sapiens
cttcgaacgcacttgcggccccgggttcctcc

SEQ ID NO: 17923 - DNA, 33 bp, Homo sapiens
cttcgaacgcacttgcggccccgggttcctccc

SEQ ID NO: 17924 - DNA, 22 bp, Homo sapiens
ttcgaacgcacttgcggccccg

SEQ ID NO: 17925 - DNA, 23 bp, Homo sapiens
ttcgaacgcacttgcggccccgg

SEQ ID NO: 17926 - DNA, 24 bp, Homo sapiens
ttcgaacgcacttgcggccccggg

SEQ ID NO: 17927 - DNA, 26 bp, Homo sapiens
ttcgaacgcacttgcggccccgggtt

SEQ ID NO: 17928 - DNA, 27 bp, Homo sapiens
ttcgaacgcacttgcggccccgggttc

SEQ ID NO: 17929 - DNA, 28 bp, Homo sapiens
ttcgaacgcacttgcggccccgggttcc

SEQ ID NO: 17930 - DNA, 29 bp, Homo sapiens
ttcgaacgcacttgcggccccgggttcct

SEQ ID NO: 17931 - DNA, 19 bp, Homo sapiens
tcgaacgcacttgcggccc

SEQ ID NO: 17932 - DNA, 20 bp, Homo sapiens
tcgaacgcacttgcggcccc

SEQ ID NO: 17933 - DNA, 21 bp, Homo sapiens
tcgaacgcacttgcggccccg

SEQ ID NO: 17934 - DNA, 22 bp, Homo sapiens
tcgaacgcacttgcggccccgg

SEQ ID NO: 17935 - DNA, 23 bp, Homo sapiens
tcgaacgcacttgcggccccggg

SEQ ID NO: 17936 - DNA, 24 bp, Homo sapiens
tcgaacgcacttgcggccccgggt

SEQ ID NO: 17937 - DNA, 25 bp, Homo sapiens
tcgaacgcacttgcggccccgggtt

SEQ ID NO: 17938 - DNA, 26 bp, Homo sapiens
tcgaacgcacttgcggccccgggttc

SEQ ID NO: 17939 - DNA, 27 bp, Homo sapiens
tcgaacgcacttgcggccccgggttcc

SEQ ID NO: 17940 - DNA, 28 bp, Homo sapiens
tcgaacgcacttgcggccccgggttcct

SEQ ID NO: 17941 - DNA, 29 bp, Homo sapiens
tcgaacgcacttgcggccccgggttcctc

SEQ ID NO: 17942 - DNA, 30 bp, Homo sapiens
tcgaacgcacttgcggccccgggttcctcc

SEQ ID NO: 17943 - DNA, 31 bp, Homo sapiens
tcgaacgcacttgcggccccgggttcctccc

SEQ ID NO: 17944 - DNA, 32 bp, Homo sapiens
tcgaacgcacttgcggccccgggttcctcccg

SEQ ID NO: 17945 - DNA, 20 bp, Homo sapiens
cgaacgcacttgcggccccg

SEQ ID NO: 17946 - DNA, 21 bp, Homo sapiens
cgaacgcacttgcggccccgg

SEQ ID NO: 17947 - DNA, 22 bp, Homo sapiens
cgaacgcacttgcggccccggg

SEQ ID NO: 17948 - DNA, 24 bp, Homo sapiens
cgaacgcacttgcggccccgggtt

SEQ ID NO: 17949 - DNA, 25 bp, Homo sapiens
cgaacgcacttgcggccccgggttc

SEQ ID NO: 17950 - DNA, 26 bp, Homo sapiens
cgaacgcacttgcggccccgggttcc

SEQ ID NO: 17951 - DNA, 27 bp, Homo sapiens
cgaacgcacttgcggccccgggttcct

SEQ ID NO: 17952 - DNA, 19 bp, Homo sapiens
gaacgcacttgcggccccg

SEQ ID NO: 17953 - DNA, 23 bp, Homo sapiens
gaacgcacttgcggccccgggtt

SEQ ID NO: 17954 - DNA, 24 bp, Homo sapiens
gaacgcacttgcggccccgggttc

SEQ ID NO: 17955 - DNA, 25 bp, Homo sapiens
gaacgcacttgcggccccgggttcc

SEQ ID NO: 17956 - DNA, 26 bp, Homo sapiens
gaacgcacttgcggccccgggttcct

SEQ ID NO: 17957 - DNA, 18 bp, Homo sapiens
aacgcacttgcggccccg

SEQ ID NO: 17958 - DNA, 23 bp, Homo sapiens
aacgcacttgcggccccgggttc

SEQ ID NO: 17959 - DNA, 24 bp, Homo sapiens
aacgcacttgcggccccgggttcc

SEQ ID NO: 17960 - DNA, 25 bp, Homo sapiens
aacgcacttgcggccccgggttcct

SEQ ID NO: 17961 - DNA, 16 bp, Homo sapiens
cttgcggccccgggtt

SEQ ID NO: 17962 - DNA, 23 bp, Homo sapiens
cttgcggccccgggttcctcccg

SEQ ID NO: 17963 - DNA, 24 bp, Homo sapiens
cttgcggccccgggttcctcccgg

SEQ ID NO: 17964 - DNA, 25 bp, Homo sapiens
cttgcggccccgggttcctcccggg

SEQ ID NO: 17965 - DNA, 33 bp, Homo sapiens
cttgcggccccgggttcctcccggggctacgcc

SEQ ID NO: 17966 - DNA, 45 bp, Homo sapiens
cttgcggccccgggttcctcccggggctacgcctgtctgagcgtc

SEQ ID NO: 17967 - DNA, 47 bp, Homo sapiens
ttgcggccccgggttcctcccggggctacgcctgtctgagcgtcgct

SEQ ID NO: 17968 - DNA, 46 bp, Homo sapiens
tgcggccccgggttcctcccggggctacgcctgtctgagcgtcgct

SEQ ID NO: 17969 - DNA, 45 bp, Homo sapiens
gcggccccgggttcctcccggggctacgcctgtctgagcgtcgct

SEQ ID NO: 17970 - DNA, 44 bp, Homo sapiens
cggccccgggttcctcccggggctacgcctgtctgagcgtcgct

SEQ ID NO: 17971 - DNA, 31 bp, Homo sapiens
ccgggttcctcccggggctacgcctgtctga

SEQ ID NO: 17972 - DNA, 33 bp, Homo sapiens
ccgggttcctcccggggctacgcctgtctgagc

SEQ ID NO: 17973 - DNA, 18 bp, Homo sapiens
cgggttcctcccggggct

SEQ ID NO: 17974 - DNA, 32 bp, Homo sapiens
cgggttcctcccggggctacgcctgtctgagc

SEQ ID NO: 17975 - DNA, 33 bp, Homo sapiens
cgggttcctcccggggctacgcctgtctgagcg

SEQ ID NO: 17976 - DNA, 34 bp, Homo sapiens
cgggttcctcccggggctacgcctgtctgagcgt

SEQ ID NO: 17977 - DNA, 31 bp, Homo sapiens
gggttcctcccggggctacgcctgtctgagc

SEQ ID NO: 17978 - DNA, 30 bp, Homo sapiens
ggttcctcccggggctacgcctgtctgagc

SEQ ID NO: 17979 - DNA, 31 bp, Homo sapiens
ggttcctcccggggctacgcctgtctgagcg

SEQ ID NO: 17980 - DNA, 33 bp, Homo sapiens
ggttcctcccggggctacgcctgtctgagcgtc

SEQ ID NO: 17981 - DNA, 36 bp, Homo sapiens
ggttcctcccggggctacgcctgtctgagcgtcgct

SEQ ID NO: 17982 - DNA, 29 bp, Homo sapiens
gttcctcccggggctacgcctgtctgagc

SEQ ID NO: 17983 - DNA, 30 bp, Homo sapiens
gttcctcccggggctacgcctgtctgagcg

SEQ ID NO: 17984 - DNA, 31 bp, Homo sapiens; identical to SEQ ID NO: 3736

SEQ ID NO: 17985 - DNA, 32 bp, Homo sapiens
gttcctcccggggctacgcctgtctgagcgtc

SEQ ID NO: 17986 - DNA, 33 bp, Homo sapiens
gttcctcccggggctacgcctgtctgagcgtcg

SEQ ID NO: 17987 - DNA, 35 bp, Homo sapiens
gttcctcccggggctacgcctgtctgagcgtcgct

SEQ ID NO: 17988 - DNA, 28 bp, Homo sapiens
ttcctcccggggctacgcctgtctgagc

SEQ ID NO: 17989 - DNA, 30 bp, Homo sapiens
ttcctcccggggctacgcctgtctgagcgt

SEQ ID NO: 17990 - DNA, 31 bp, Homo sapiens; identical to SEQ ID NO: 3737

SEQ ID NO: 17991 - DNA, 32 bp, Homo sapiens
ttcctcccggggctacgcctgtctgagcgtcg

SEQ ID NO: 17992 - DNA, 33 bp, Homo sapiens
ttcctcccggggctacgcctgtctgagcgtcgc

SEQ ID NO: 17993 - DNA, 34 bp, Homo sapiens
ttcctcccggggctacgcctgtctgagcgtcgct

SEQ ID NO: 17994 - DNA, 25 bp, Homo sapiens
tcctcccggggctacgcctgtctga

SEQ ID NO: 17995 - DNA, 27 bp, Homo sapiens
tcctcccggggctacgcctgtctgagc

SEQ ID NO: 17996 - DNA, 28 bp, Homo sapiens
tcctcccggggctacgcctgtctgagcg

SEQ ID NO: 17997 - DNA, 29 bp, Homo sapiens
tcctcccggggctacgcctgtctgagcgt

SEQ ID NO: 17998 - DNA, 30 bp, Homo sapiens; identical to SEQ ID NO: 3739

SEQ ID NO: 17999 - DNA, 31 bp, Homo sapiens; identical to SEQ ID NO: 3740

SEQ ID NO: 18000 - DNA, 32 bp, Homo sapiens
tcctcccggggctacgcctgtctgagcgtcgc

SEQ ID NO: 18001 - DNA, 33 bp, Homo sapiens; identical to SEQ ID NO: 3741

SEQ ID NO: 18002 - DNA, 34 bp, Homo sapiens
tcctcccggggctacgcctgtctgagcgtcgctt

SEQ ID NO: 18003 - DNA, 26 bp, Homo sapiens
cctcccggggctacgcctgtctgagc

SEQ ID NO: 18004 - DNA, 28 bp, Homo sapiens
cctcccggggctacgcctgtctgagcgt

SEQ ID NO: 18005 - DNA, 29 bp, Homo sapiens
cctcccggggctacgcctgtctgagcgtc

SEQ ID NO: 18006 - DNA, 32 bp, Homo sapiens; identical to SEQ ID NO: 3743

SEQ ID NO: 18007 - DNA, 33 bp, Homo sapiens
cctcccggggctacgcctgtctgagcgtcgctt

SEQ ID NO: 18008 - DNA, 23 bp, Homo sapiens
ctcccggggctacgcctgtctga

SEQ ID NO: 18009 - DNA, 25 bp, Homo sapiens
ctcccggggctacgcctgtctgagc

SEQ ID NO: 18010 - DNA, 27 bp, Homo sapiens
ctcccggggctacgcctgtctgagcgt

SEQ ID NO: 18011 - DNA, 28 bp, Homo sapiens
ctcccggggctacgcctgtctgagcgtc

SEQ ID NO: 18012 - DNA, 29 bp, Homo sapiens
ctcccggggctacgcctgtctgagcgtcg

SEQ ID NO: 18013 - DNA, 30 bp, Homo sapiens
ctcccggggctacgcctgtctgagcgtcgc

SEQ ID NO: 18014 - DNA, 31 bp, Homo sapiens; identical to SEQ ID NO: 3747

SEQ ID NO: 18015 - DNA, 32 bp, Homo sapiens; identical to SEQ ID NO: 3748

SEQ ID NO: 18016 - DNA, 24 bp, Homo sapiens
tcccggggctacgcctgtctgagc

SEQ ID NO: 18017 - DNA, 26 bp, Homo sapiens
tcccggggctacgcctgtctgagcgt

SEQ ID NO: 18018 - DNA, 27 bp, Homo sapiens
tcccggggctacgcctgtctgagcgtc

SEQ ID NO: 18019 - DNA, 28 bp, Homo sapiens
tcccggggctacgcctgtctgagcgtcg

SEQ ID NO: 18020 - DNA, 29 bp, Homo sapiens
tcccggggctacgcctgtctgagcgtcgc

SEQ ID NO: 18021 - DNA, 30 bp, Homo sapiens; identical to SEQ ID NO: 3754

SEQ ID NO: 18022 - DNA, 31 bp, Homo sapiens; identical to SEQ ID NO: 3755

SEQ ID NO: 18023 - DNA, 20 bp, Homo sapiens
cccggggctacgcctgtctg

SEQ ID NO: 18024 - DNA, 21 bp, Homo sapiens
cccggggctacgcctgtctga

SEQ ID NO: 18025 - DNA, 22 bp, Homo sapiens
cccggggctacgcctgtctgag

SEQ ID NO: 18026 - DNA, 23 bp, Homo sapiens
cccggggctacgcctgtctgagc

SEQ ID NO: 18027 - DNA, 24 bp, Homo sapiens
cccggggctacgcctgtctgagcg

SEQ ID NO: 18028 - DNA, 25 bp, Homo sapiens
cccggggctacgcctgtctgagcgt

SEQ ID NO: 18029 - DNA, 26 bp, Homo sapiens
cccggggctacgcctgtctgagcgtc

SEQ ID NO: 18030 - DNA, 27 bp, Homo sapiens
cccggggctacgcctgtctgagcgtcg

SEQ ID NO: 18031 - DNA, 28 bp, Homo sapiens
cccggggctacgcctgtctgagcgtcgc

SEQ ID NO: 18032 - DNA, 29 bp, Homo sapiens
cccggggctacgcctgtctgagcgtcgct

SEQ ID NO: 18033 - DNA, 30 bp, Homo sapiens; identical to SEQ ID NO: 3762

SEQ ID NO: 18034 - DNA, 22 bp, Homo sapiens
ccggggctacgcctgtctgagc

SEQ ID NO: 18035 - DNA, 23 bp, Homo sapiens
ccggggctacgcctgtctgagcg

SEQ ID NO: 18036 - DNA, 24 bp, Homo sapiens
ccggggctacgcctgtctgagcgt

SEQ ID NO: 18037 - DNA, 25 bp, Homo sapiens
ccggggctacgcctgtctgagcgtc

SEQ ID NO: 18038 - DNA, 26 bp, Homo sapiens
ccggggctacgcctgtctgagcgtcg

SEQ ID NO: 18039 - DNA, 27 bp, Homo sapiens
ccggggctacgcctgtctgagcgtcgc

SEQ ID NO: 18040 - DNA, 28 bp, Homo sapiens
ccggggctacgcctgtctgagcgtcgct

SEQ ID NO: 18041 - DNA, 29 bp, Homo sapiens
ccggggctacgcctgtctgagcgtcgctt

SEQ ID NO: 18042 - DNA, 21 bp, Homo sapiens
cggggctacgcctgtctgagc

SEQ ID NO: 18043 - DNA, 22 bp, Homo sapiens
cggggctacgcctgtctgagcg

SEQ ID NO: 18044 - DNA, 23 bp, Homo sapiens
cggggctacgcctgtctgagcgt

SEQ ID NO: 18045 - DNA, 24 bp, Homo sapiens
cggggctacgcctgtctgagcgtc

SEQ ID NO: 18046 - DNA, 25 bp, Homo sapiens
cggggctacgcctgtctgagcgtcg

SEQ ID NO: 18047 - DNA, 26 bp, Homo sapiens
cggggctacgcctgtctgagcgtcgc

SEQ ID NO: 18048 - DNA, 27 bp, Homo sapiens
cggggctacgcctgtctgagcgtcgct

SEQ ID NO: 18049 - DNA, 28 bp, Homo sapiens
cggggctacgcctgtctgagcgtcgctt

SEQ ID NO: 18050 - DNA, 20 bp, Homo sapiens
ggggctacgcctgtctgagc

SEQ ID NO: 18051 - DNA, 21 bp, Homo sapiens
ggggctacgcctgtctgagcg

SEQ ID NO: 18052 - DNA, 22 bp, Homo sapiens
ggggctacgcctgtctgagcgt

SEQ ID NO: 18053 - DNA, 23 bp, Homo sapiens
ggggctacgcctgtctgagcgtc

SEQ ID NO: 18054 - DNA, 24 bp, Homo sapiens
ggggctacgcctgtctgagcgtcg

SEQ ID NO: 18055 - DNA, 25 bp, Homo sapiens
ggggctacgcctgtctgagcgtcgc

SEQ ID NO: 18056 - DNA, 26 bp, Homo sapiens
ggggctacgcctgtctgagcgtcgct

SEQ ID NO: 18057 - DNA, 27 bp, Homo sapiens
ggggctacgcctgtctgagcgtcgctt

SEQ ID NO: 18058 - DNA, 20 bp, Homo sapiens
gggctacgcctgtctgagcg

SEQ ID NO: 18059 - DNA, 21 bp, Homo sapiens
gggctacgcctgtctgagcgt

SEQ ID NO: 18060 - DNA, 22 bp, Homo sapiens
gggctacgcctgtctgagcgtc

SEQ ID NO: 18061 - DNA, 23 bp, Homo sapiens
gggctacgcctgtctgagcgtcg

SEQ ID NO: 18062 - DNA, 24 bp, Homo sapiens
gggctacgcctgtctgagcgtcgc

SEQ ID NO: 18063 - DNA, 25 bp, Homo sapiens
gggctacgcctgtctgagcgtcgct

SEQ ID NO: 18064 - DNA, 26 bp, Homo sapiens
gggctacgcctgtctgagcgtcgctt

SEQ ID NO: 18065 - DNA, 18 bp, Homo sapiens
ggctacgcctgtctgagc

SEQ ID NO: 18066 - DNA, 19 bp, Homo sapiens
ggctacgcctgtctgagcg

SEQ ID NO: 18067 - DNA, 21 bp, Homo sapiens
ggctacgcctgtctgagcgtc

SEQ ID NO: 18068 - DNA, 23 bp, Homo sapiens
ggctacgcctgtctgagcgtcgc

SEQ ID NO: 18069 - DNA, 24 bp, Homo sapiens
ggctacgcctgtctgagcgtcgct

SEQ ID NO: 18070 - DNA, 16 bp, Homo sapiens
gctacgcctgtctgag

SEQ ID NO: 18071 - DNA, 17 bp, Homo sapiens
gctacgcctgtctgagc

SEQ ID NO: 18072 - DNA, 18 bp, Homo sapiens
gctacgcctgtctgagcg

SEQ ID NO: 18073 - DNA, 19 bp, Homo sapiens
gctacgcctgtctgagcgt

SEQ ID NO: 18074 - DNA, 20 bp, Homo sapiens
gctacgcctgtctgagcgtc

SEQ ID NO: 18075 - DNA, 21 bp, Homo sapiens
gctacgcctgtctgagcgtcg

SEQ ID NO: 18076 - DNA, 23 bp, Homo sapiens
gctacgcctgtctgagcgtcgct

SEQ ID NO: 18077 - DNA, 24 bp, Homo sapiens
gctacgcctgtctgagcgtcgctt

SEQ ID NO: 18078 - DNA, 16 bp, Homo sapiens
ctacgcctgtctgagc

SEQ ID NO: 18079 - DNA, 17 bp, Homo sapiens
ctacgcctgtctgagcg

SEQ ID NO: 18080 - DNA, 18 bp, Homo sapiens
ctacgcctgtctgagcgt

SEQ ID NO: 18081 - DNA, 19 bp, Homo sapiens
ctacgcctgtctgagcgtc

SEQ ID NO: 18082 - DNA, 20 bp, Homo sapiens
ctacgcctgtctgagcgtcg

SEQ ID NO: 18083 - DNA, 21 bp, Homo sapiens
ctacgcctgtctgagcgtcgc

SEQ ID NO: 18084 - DNA, 22 bp, Homo sapiens
ctacgcctgtctgagcgtcgct

SEQ ID NO: 18085 - DNA, 23 bp, Homo sapiens
ctacgcctgtctgagcgtcgctt

SEQ ID NO: 18086 - DNA, 16 bp, Homo sapiens
tacgcctgtctgagcg

SEQ ID NO: 18087 - DNA, 17 bp, Homo sapiens
tacgcctgtctgagcgt

SEQ ID NO: 18088 - DNA, 18 bp, Homo sapiens
tacgcctgtctgagcgtc

SEQ ID NO: 18089 - DNA, 19 bp, Homo sapiens
tacgcctgtctgagcgtcg

SEQ ID NO: 18090 - DNA, 20 bp, Homo sapiens
tacgcctgtctgagcgtcgc

SEQ ID NO: 18091 - DNA, 21 bp, Homo sapiens
tacgcctgtctgagcgtcgct

SEQ ID NO: 18092 - DNA, 22 bp, Homo sapiens
tacgcctgtctgagcgtcgctt

SEQ ID NO: 18093 - DNA, 29 bp, Homo sapiens
tacgcctgtctgagcgtcgcttgccgatc

SEQ ID NO: 18094 - DNA, 16 bp, Homo sapiens
acgcctgtctgagcgt

SEQ ID NO: 18095 - DNA, 17 bp, Homo sapiens
acgcctgtctgagcgtc

SEQ ID NO: 18096 - DNA, 18 bp, Homo sapiens
acgcctgtctgagcgtcg

SEQ ID NO: 18097 - DNA, 19 bp, Homo sapiens
acgcctgtctgagcgtcgc

SEQ ID NO: 18098 - DNA, 20 bp, Homo sapiens
acgcctgtctgagcgtcgct

SEQ ID NO: 18099 - DNA, 21 bp, Homo sapiens
acgcctgtctgagcgtcgctt

SEQ ID NO: 18100 - DNA, 16 bp, Homo sapiens
cgcctgtctgagcgtc

SEQ ID NO: 18101 - DNA, 17 bp, Homo sapiens
cgcctgtctgagcgtcg

SEQ ID NO: 18102 - DNA, 18 bp, Homo sapiens
cgcctgtctgagcgtcgc

SEQ ID NO: 18103 - DNA, 19 bp, Homo sapiens
cgcctgtctgagcgtcgct

SEQ ID NO: 18104 - DNA, 20 bp, Homo sapiens
cgcctgtctgagcgtcgctt

SEQ ID NO: 18105 - DNA, 16 bp, Homo sapiens
gcctgtctgagcgtcg

SEQ ID NO: 18106 - DNA, 17 bp, Homo sapiens
gcctgtctgagcgtcgc

SEQ ID NO: 18107 - DNA, 18 bp, Homo sapiens
gcctgtctgagcgtcgct

SEQ ID NO: 18108 - DNA, 19 bp, Homo sapiens
gcctgtctgagcgtcgctt

SEQ ID NO: 18109 - DNA, 16 bp, Homo sapiens
cctgtctgagcgtcgc

SEQ ID NO: 18110 - DNA, 17 bp, Homo sapiens
cctgtctgagcgtcgct

SEQ ID NO: 18111 - DNA, 18 bp, Homo sapiens
cctgtctgagcgtcgctt

SEQ ID NO: 18112 - DNA, 16 bp, Homo sapiens
ctgtctgagcgtcgct

SEQ ID NO: 18113 - DNA, 17 bp, Homo sapiens
ctgtctgagcgtcgctt

SEQ ID NO: 18114 - DNA, 16 bp, Homo sapiens
tgtctgagcgtcgctt

SEQ ID NO: 18115 - DNA, 21 bp, Homo sapiens
tgtctgagcgtcgcttgccga

SEQ ID NO: 18116 - DNA, 20 bp, Homo sapiens
gtctgagcgtcgcttgccga

SEQ ID NO: 18117 - DNA, 25 bp, Homo sapiens
cctccgggctcctcggggtgcgcgg

SEQ ID NO: 18118 - DNA, 27 bp, Homo sapiens
cctccgggctcctcggggtgcgcggct

SEQ ID NO: 18119 - DNA, 26 bp, Homo sapiens
ctccgggctcctcggggtgcgcggct

SEQ ID NO: 18120 - DNA, 20 bp, Homo sapiens
tccgggctcctcggggtgcg

SEQ ID NO: 18121 - DNA, 27 bp, Homo sapiens
gcgcggctgggggttccctcgcagggc

SEQ ID NO: 18122 - DNA, 30 bp, Homo sapiens
gggggccctccgtccccctaagcgcagacc

SEQ ID NO: 18123 - DNA, 23 bp, Homo sapiens
ggtcccgtgcccgtcgtcgtcgt

SEQ ID NO: 18124 - DNA, 19 bp, Homo sapiens
cggcggcgacccgcgggac

SEQ ID NO: 18125 - DNA, 29 bp, Homo sapiens
acccgcgggacgccgcggtgtcgtccgcc

SEQ ID NO: 18126 - DNA, 19 bp, Homo sapiens
acgccgcggtgtcgtccgc

SEQ ID NO: 18127 - DNA, 22 bp, Homo sapiens
gcccctccctccggtcgtcccg

SEQ ID NO: 18128 - DNA, 33 bp, Homo sapiens
gtccccctccgagacgcgacctcagatcagacg

SEQ ID NO: 18129 - DNA, 33 bp, Homo sapiens
ccctccgagacgcgacctcagatcagacgtggc

SEQ ID NO: 18130 - DNA, 25 bp, Homo sapiens
ctccgagacgcgacctcagatcaga

SEQ ID NO: 18131 - DNA, 31 bp, Homo sapiens
ctccgagacgcgacctcagatcagacgtggc

SEQ ID NO: 18132 - DNA, 35 bp, Homo sapiens
ctccgagacgcgacctcagatcagacgtggcgacc

SEQ ID NO: 18133 - DNA, 21 bp, Homo sapiens
tccgagacgcgacctcagatc

SEQ ID NO: 18134 - DNA, 22 bp, Homo sapiens
tccgagacgcgacctcagatca

SEQ ID NO: 18135 - DNA, 23 bp, Homo sapiens
tccgagacgcgacctcagatcag

SEQ ID NO: 18136 - DNA, 24 bp, Homo sapiens
tccgagacgcgacctcagatcaga

SEQ ID NO: 18137 - DNA, 25 bp, Homo sapiens
tccgagacgcgacctcagatcagac

SEQ ID NO: 18138 - DNA, 30 bp, Homo sapiens; identical to SEQ ID NO: 3821

SEQ ID NO: 18139 - DNA, 31 bp, Homo sapiens
tccgagacgcgacctcagatcagacgtggcg

SEQ ID NO: 18140 - DNA, 32 bp, Homo sapiens
tccgagacgcgacctcagatcagacgtggcga

SEQ ID NO: 18141 - DNA, 33 bp, Homo sapiens
tccgagacgcgacctcagatcagacgtggcgac

SEQ ID NO: 18142 - DNA, 34 bp, Homo sapiens
tccgagacgcgacctcagatcagacgtggcgacc

SEQ ID NO: 18143 - DNA, 43 bp, Homo sapiens
tccgagacgcgacctcagatcagacgtggcgacccgctgaatt

SEQ ID NO: 18144 - DNA, 47 bp, Homo sapiens
tccgagacgcgacctcagatcagacgtggcgacccgctgaatttaag

SEQ ID NO: 18145 - DNA, 21 bp, Homo sapiens
ccgagacgcgacctcagatca

SEQ ID NO: 18146 - DNA, 22 bp, Homo sapiens
ccgagacgcgacctcagatcag

SEQ ID NO: 18147 - DNA, 23 bp, Homo sapiens
ccgagacgcgacctcagatcaga

SEQ ID NO: 18148 - DNA, 25 bp, Homo sapiens
ccgagacgcgacctcagatcagacg

SEQ ID NO: 18149 - DNA, 29 bp, Homo sapiens
ccgagacgcgacctcagatcagacgtggc

SEQ ID NO: 18150 - DNA, 33 bp, Homo sapiens; identical to SEQ ID NO: 3823

SEQ ID NO: 18151 - DNA, 42 bp, Homo sapiens
ccgagacgcgacctcagatcagacgtggcgacccgctgaatt

SEQ ID NO: 18152 - DNA, 46 bp, Homo sapiens
ccgagacgcgacctcagatcagacgtggcgacccgctgaatttaag

SEQ ID NO: 18153 - DNA, 47 bp, Homo sapiens
ccgagacgcgacctcagatcagacgtggcgacccgctgaatttaagc

SEQ ID NO: 18154 - DNA, 20 bp, Homo sapiens
cgagacgcgacctcagatca

SEQ ID NO: 18155 - DNA, 22 bp, Homo sapiens
cgagacgcgacctcagatcaga

SEQ ID NO: 18156 - DNA, 24 bp, Homo sapiens
cgagacgcgacctcagatcagacg

SEQ ID NO: 18157 - DNA, 25 bp, Homo sapiens
cgagacgcgacctcagatcagacgt

SEQ ID NO: 18158 - DNA, 28 bp, Homo sapiens
cgagacgcgacctcagatcagacgtggc

SEQ ID NO: 18159 - DNA, 29 bp, Homo sapiens
cgagacgcgacctcagatcagacgtggcg

SEQ ID NO: 18160 - DNA, 32 bp, Homo sapiens
cgagacgcgacctcagatcagacgtggcgacc

SEQ ID NO: 18161 - DNA, 36 bp, Homo sapiens
cgagacgcgacctcagatcagacgtggcgacccgct

SEQ ID NO: 18162 - DNA, 40 bp, Homo sapiens
cgagacgcgacctcagatcagacgtggcgacccgctgaat

SEQ ID NO: 18163 - DNA, 41 bp, Homo sapiens
cgagacgcgacctcagatcagacgtggcgacccgctgaatt

SEQ ID NO: 18164 - DNA, 46 bp, Homo sapiens
cgagacgcgacctcagatcagacgtggcgacccgctgaatttaagc

SEQ ID NO: 18165 - DNA, 23 bp, Homo sapiens
gagacgcgacctcagatcagacg

SEQ ID NO: 18166 - DNA, 24 bp, Homo sapiens
gagacgcgacctcagatcagacgt

SEQ ID NO: 18167 - DNA, 31 bp, Homo sapiens
gagacgcgacctcagatcagacgtggcgacc

SEQ ID NO: 18168 - DNA, 32 bp, Homo sapiens
gagacgcgacctcagatcagacgtggcgaccc

SEQ ID NO: 18169 - DNA, 33 bp, Homo sapiens
gagacgcgacctcagatcagacgtggcgacccg

SEQ ID NO: 18170 - DNA, 44 bp, Homo sapiens
gagacgcgacctcagatcagacgtggcgacccgctgaatttaag

SEQ ID NO: 18171 - DNA, 18 bp, Homo sapiens
agacgcgacctcagatca

SEQ ID NO: 18172 - DNA, 20 bp, Homo sapiens
agacgcgacctcagatcaga

SEQ ID NO: 18173 - DNA, 22 bp, Homo sapiens
agacgcgacctcagatcagacg

SEQ ID NO: 18174 - DNA, 23 bp, Homo sapiens
agacgcgacctcagatcagacgt

SEQ ID NO: 18175 - DNA, 30 bp, Homo sapiens
agacgcgacctcagatcagacgtggcgacc

SEQ ID NO: 18176 - DNA, 32 bp, Homo sapiens
agacgcgacctcagatcagacgtggcgacccg

SEQ ID NO: 18177 - DNA, 33 bp, Homo sapiens
agacgcgacctcagatcagacgtggcgacccgc

SEQ ID NO: 18178 - DNA, 37 bp, Homo sapiens
agacgcgacctcagatcagacgtggcgacccgctgaa

SEQ ID NO: 18179 - DNA, 38 bp, Homo sapiens
agacgcgacctcagatcagacgtggcgacccgctgaat

SEQ ID NO: 18180 - DNA, 39 bp, Homo sapiens
agacgcgacctcagatcagacgtggcgacccgctgaatt

SEQ ID NO: 18181 - DNA, 43 bp, Homo sapiens
agacgcgacctcagatcagacgtggcgacccgctgaatttaag

SEQ ID NO: 18182 - DNA, 44 bp, Homo sapiens
agacgcgacctcagatcagacgtggcgacccgctgaatttaagc

SEQ ID NO: 18183 - DNA, 16 bp, Homo sapiens
gacgcgacctcagatc

SEQ ID NO: 18184 - DNA, 17 bp, Homo sapiens
gacgcgacctcagatca

SEQ ID NO: 18185 - DNA, 19 bp, Homo sapiens
gacgcgacctcagatcaga

SEQ ID NO: 18186 - DNA, 20 bp, Homo sapiens
gacgcgacctcagatcagac

SEQ ID NO: 18187 - DNA, 21 bp, Homo sapiens
gacgcgacctcagatcagacg

SEQ ID NO: 18188 - DNA, 22 bp, Homo sapiens
gacgcgacctcagatcagacgt

SEQ ID NO: 18189 - DNA, 23 bp, Homo sapiens
gacgcgacctcagatcagacgtg

SEQ ID NO: 18190 - DNA, 25 bp, Homo sapiens
gacgcgacctcagatcagacgtggc

SEQ ID NO: 18191 - DNA, 26 bp, Homo sapiens
gacgcgacctcagatcagacgtggcg

SEQ ID NO: 18192 - DNA, 29 bp, Homo sapiens
gacgcgacctcagatcagacgtggcgacc

SEQ ID NO: 18193 - DNA, 30 bp, Homo sapiens; identical to SEQ ID NO: 3832

SEQ ID NO: 18194 - DNA, 31 bp, Homo sapiens; identical to SEQ ID NO: 3833

SEQ ID NO: 18195 - DNA, 32 bp, Homo sapiens; identical to SEQ ID NO: 3834

SEQ ID NO: 18196 - DNA, 33 bp, Homo sapiens; identical to SEQ ID NO: 3835

SEQ ID NO: 18197 - DNA, 35 bp, Homo sapiens
gacgcgacctcagatcagacgtggcgacccgctga

SEQ ID NO: 18198 - DNA, 36 bp, Homo sapiens
gacgcgacctcagatcagacgtggcgacccgctgaa

SEQ ID NO: 18199 - DNA, 37 bp, Homo sapiens
gacgcgacctcagatcagacgtggcgacccgctgaat

SEQ ID NO: 18200 - DNA, 38 bp, Homo sapiens
gacgcgacctcagatcagacgtggcgacccgctgaatt

SEQ ID NO: 18201 - DNA, 39 bp, Homo sapiens
gacgcgacctcagatcagacgtggcgacccgctgaattt

SEQ ID NO: 18202 - DNA, 40 bp, Homo sapiens
gacgcgacctcagatcagacgtggcgacccgctgaattta

SEQ ID NO: 18203 - DNA, 41 bp, Homo sapiens
gacgcgacctcagatcagacgtggcgacccgctgaatttaa

SEQ ID NO: 18204 - DNA, 42 bp, Homo sapiens
gacgcgacctcagatcagacgtggcgacccgctgaatttaag

SEQ ID NO: 18205 - DNA, 43 bp, Homo sapiens
gacgcgacctcagatcagacgtggcgacccgctgaatttaagc

SEQ ID NO: 18206 - DNA, 44 bp, Homo sapiens
gacgcgacctcagatcagacgtggcgacccgctgaatttaagca

SEQ ID NO: 18207 - DNA, 45 bp, Homo sapiens
gacgcgacctcagatcagacgtggcgacccgctgaatttaagcat

SEQ ID NO: 18208 - DNA, 46 bp, Homo sapiens
gacgcgacctcagatcagacgtggcgacccgctgaatttaagcata

SEQ ID NO: 18209 - DNA, 16 bp, Homo sapiens
acgcgacctcagatca

SEQ ID NO: 18210 - DNA, 17 bp, Homo sapiens
acgcgacctcagatcag

SEQ ID NO: 18211 - DNA, 18 bp, Homo sapiens
acgcgacctcagatcaga

SEQ ID NO: 18212 - DNA, 19 bp, Homo sapiens
acgcgacctcagatcagac

SEQ ID NO: 18213 - DNA, 20 bp, Homo sapiens
acgcgacctcagatcagacg

SEQ ID NO: 18214 - DNA, 21 bp, Homo sapiens
acgcgacctcagatcagacgt

SEQ ID NO: 18215 - DNA, 22 bp, Homo sapiens
acgcgacctcagatcagacgtg

SEQ ID NO: 18216 - DNA, 23 bp, Homo sapiens
acgcgacctcagatcagacgtgg

SEQ ID NO: 18217 - DNA, 24 bp, Homo sapiens
acgcgacctcagatcagacgtggc

SEQ ID NO: 18218 - DNA, 25 bp, Homo sapiens
acgcgacctcagatcagacgtggcg

SEQ ID NO: 18219 - DNA, 27 bp, Homo sapiens
acgcgacctcagatcagacgtggcgac

SEQ ID NO: 18220 - DNA, 28 bp, Homo sapiens
acgcgacctcagatcagacgtggcgacc

SEQ ID NO: 18221 - DNA, 29 bp, Homo sapiens
acgcgacctcagatcagacgtggcgaccc

SEQ ID NO: 18222 - DNA, 30 bp, Homo sapiens; identical to SEQ ID NO: 3848

SEQ ID NO: 18223 - DNA, 31 bp, Homo sapiens; identical to SEQ ID NO: 3849

SEQ ID NO: 18224 - DNA, 32 bp, Homo sapiens; identical to SEQ ID NO: 3850

SEQ ID NO: 18225 - DNA, 33 bp, Homo sapiens; identical to SEQ ID NO: 3851

SEQ ID NO: 18226 - DNA, 34 bp, Homo sapiens
acgcgacctcagatcagacgtggcgacccgctga

SEQ ID NO: 18227 - DNA, 35 bp, Homo sapiens
acgcgacctcagatcagacgtggcgacccgctgaa

SEQ ID NO: 18228 - DNA, 36 bp, Homo sapiens
acgcgacctcagatcagacgtggcgacccgctgaat

SEQ ID NO: 18229 - DNA, 37 bp, Homo sapiens
acgcgacctcagatcagacgtggcgacccgctgaatt

SEQ ID NO: 18230 - DNA, 38 bp, Homo sapiens
acgcgacctcagatcagacgtggcgacccgctgaattt

SEQ ID NO: 18231 - DNA, 39 bp, Homo sapiens
acgcgacctcagatcagacgtggcgacccgctgaattta

SEQ ID NO: 18232 - DNA, 40 bp, Homo sapiens
acgcgacctcagatcagacgtggcgacccgctgaatttaa

SEQ ID NO: 18233 - DNA, 41 bp, Homo sapiens
acgcgacctcagatcagacgtggcgacccgctgaatttaag

SEQ ID NO: 18234 - DNA, 42 bp, Homo sapiens
acgcgacctcagatcagacgtggcgacccgctgaatttaagc

SEQ ID NO: 18235 - DNA, 43 bp, Homo sapiens
acgcgacctcagatcagacgtggcgacccgctgaatttaagca

SEQ ID NO: 18236 - DNA, 44 bp, Homo sapiens
acgcgacctcagatcagacgtggcgacccgctgaatttaagcat

SEQ ID NO: 18237 - DNA, 45 bp, Homo sapiens
acgcgacctcagatcagacgtggcgacccgctgaatttaagcata

SEQ ID NO: 18238 - DNA, 46 bp, Homo sapiens
acgcgacctcagatcagacgtggcgacccgctgaatttaagcatat

SEQ ID NO: 18239 - DNA, 47 bp, Homo sapiens
acgcgacctcagatcagacgtggcgacccgctgaatttaagcatatt

SEQ ID NO: 18240 - DNA, 16 bp, Homo sapiens
cgcgacctcagatcag

SEQ ID NO: 18241 - DNA, 17 bp, Homo sapiens
cgcgacctcagatcaga

SEQ ID NO: 18242 - DNA, 18 bp, Homo sapiens
cgcgacctcagatcagac

SEQ ID NO: 18243 - DNA, 19 bp, Homo sapiens
cgcgacctcagatcagacg

SEQ ID NO: 18244 - DNA, 20 bp, Homo sapiens
cgcgacctcagatcagacgt

SEQ ID NO: 18245 - DNA, 21 bp, Homo sapiens
cgcgacctcagatcagacgtg

SEQ ID NO: 18246 - DNA, 22 bp, Homo sapiens
cgcgacctcagatcagacgtgg

SEQ ID NO: 18247 - DNA, 23 bp, Homo sapiens
cgcgacctcagatcagacgtggc

SEQ ID NO: 18248 - DNA, 24 bp, Homo sapiens
cgcgacctcagatcagacgtggcg

SEQ ID NO: 18249 - DNA, 25 bp, Homo sapiens
cgcgacctcagatcagacgtggcga

SEQ ID NO: 18250 - DNA, 26 bp, Homo sapiens
cgcgacctcagatcagacgtggcgac

SEQ ID NO: 18251 - DNA, 27 bp, Homo sapiens
cgcgacctcagatcagacgtggcgacc

SEQ ID NO: 18252 - DNA, 28 bp, Homo sapiens
cgcgacctcagatcagacgtggcgaccc

SEQ ID NO: 18253 - DNA, 29 bp, Homo sapiens
cgcgacctcagatcagacgtggcgacccg

SEQ ID NO: 18254 - DNA, 30 bp, Homo sapiens; identical to SEQ ID NO: 3865

SEQ ID NO: 18255 - DNA, 31 bp, Homo sapiens; identical to SEQ ID NO: 3866

SEQ ID NO: 18256 - DNA, 32 bp, Homo sapiens; identical to SEQ ID NO: 3867

SEQ ID NO: 18257 - DNA, 33 bp, Homo sapiens; identical to SEQ ID NO: 3868

SEQ ID NO: 18258 - DNA, 34 bp, Homo sapiens
cgcgacctcagatcagacgtggcgacccgctgaa

SEQ ID NO: 18259 - DNA, 35 bp, Homo sapiens
cgcgacctcagatcagacgtggcgacccgctgaat

SEQ ID NO: 18260 - DNA, 36 bp, Homo sapiens
cgcgacctcagatcagacgtggcgacccgctgaatt

SEQ ID NO: 18261 - DNA, 37 bp, Homo sapiens
cgcgacctcagatcagacgtggcgacccgctgaattt

SEQ ID NO: 18262 - DNA, 38 bp, Homo sapiens
cgcgacctcagatcagacgtggcgacccgctgaattta

SEQ ID NO: 18263 - DNA, 39 bp, Homo sapiens
cgcgacctcagatcagacgtggcgacccgctgaatttaa

SEQ ID NO: 18264 - DNA, 40 bp, Homo sapiens
cgcgacctcagatcagacgtggcgacccgctgaatttaag

SEQ ID NO: 18265 - DNA, 41 bp, Homo sapiens
cgcgacctcagatcagacgtggcgacccgctgaatttaagc

SEQ ID NO: 18266 - DNA, 42 bp, Homo sapiens
cgcgacctcagatcagacgtggcgacccgctgaatttaagca

SEQ ID NO: 18267 - DNA, 43 bp, Homo sapiens
cgcgacctcagatcagacgtggcgacccgctgaatttaagcat

SEQ ID NO: 18268 - DNA, 44 bp, Homo sapiens
cgcgacctcagatcagacgtggcgacccgctgaatttaagcata

SEQ ID NO: 18269 - DNA, 45 bp, Homo sapiens
cgcgacctcagatcagacgtggcgacccgctgaatttaagcatat

SEQ ID NO: 18270 - DNA, 46 bp, Homo sapiens
cgcgacctcagatcagacgtggcgacccgctgaatttaagcatatt

SEQ ID NO: 18271 - DNA, 47 bp, Homo sapiens
cgcgacctcagatcagacgtggcgacccgctgaatttaagcatatta

SEQ ID NO: 18272 - DNA, 16 bp, Homo sapiens
gcgacctcagatcaga

SEQ ID NO: 18273 - DNA, 17 bp, Homo sapiens
gcgacctcagatcagac

SEQ ID NO: 18274 - DNA, 18 bp, Homo sapiens
gcgacctcagatcagacg

SEQ ID NO: 18275 - DNA, 19 bp, Homo sapiens
gcgacctcagatcagacgt

SEQ ID NO: 18276 - DNA, 20 bp, Homo sapiens
gcgacctcagatcagacgtg

SEQ ID NO: 18277 - DNA, 22 bp, Homo sapiens
gcgacctcagatcagacgtggc

SEQ ID NO: 18278 - DNA, 23 bp, Homo sapiens
gcgacctcagatcagacgtggcg

SEQ ID NO: 18279 - DNA, 26 bp, Homo sapiens
gcgacctcagatcagacgtggcgacc

SEQ ID NO: 18280 - DNA, 27 bp, Homo sapiens
gcgacctcagatcagacgtggcgaccc

SEQ ID NO: 18281 - DNA, 28 bp, Homo sapiens
gcgacctcagatcagacgtggcgacccg

SEQ ID NO: 18282 - DNA, 29 bp, Homo sapiens
gcgacctcagatcagacgtggcgacccgc

SEQ ID NO: 18283 - DNA, 30 bp, Homo sapiens; identical to SEQ ID NO: 3876

SEQ ID NO: 18284 - DNA, 31 bp, Homo sapiens; identical to SEQ ID NO: 3877

SEQ ID NO: 18285 - DNA, 32 bp, Homo sapiens; identical to SEQ ID NO: 3878

SEQ ID NO: 18286 - DNA, 33 bp, Homo sapiens; identical to SEQ ID NO: 3879

SEQ ID NO: 18287 - DNA, 34 bp, Homo sapiens
gcgacctcagatcagacgtggcgacccgctgaat

SEQ ID NO: 18288 - DNA, 35 bp, Homo sapiens
gcgacctcagatcagacgtggcgacccgctgaatt

SEQ ID NO: 18289 - DNA, 36 bp, Homo sapiens
gcgacctcagatcagacgtggcgacccgctgaattt

SEQ ID NO: 18290 - DNA, 38 bp, Homo sapiens
gcgacctcagatcagacgtggcgacccgctgaatttaa

SEQ ID NO: 18291 - DNA, 39 bp, Homo sapiens
gcgacctcagatcagacgtggcgacccgctgaatttaag

SEQ ID NO: 18292 - DNA, 40 bp, Homo sapiens
gcgacctcagatcagacgtggcgacccgctgaatttaagc

SEQ ID NO: 18293 - DNA, 41 bp, Homo sapiens
gcgacctcagatcagacgtggcgacccgctgaatttaagca

SEQ ID NO: 18294 - DNA, 16 bp, Homo sapiens
cgacctcagatcagac

SEQ ID NO: 18295 - DNA, 17 bp, Homo sapiens
cgacctcagatcagacg

SEQ ID NO: 18296 - DNA, 18 bp, Homo sapiens
cgacctcagatcagacgt

SEQ ID NO: 18297 - DNA, 20 bp, Homo sapiens
cgacctcagatcagacgtgg

SEQ ID NO: 18298 - DNA, 24 bp, Homo sapiens
cgacctcagatcagacgtggcgac

SEQ ID NO: 18299 - DNA, 25 bp, Homo sapiens
cgacctcagatcagacgtggcgacc

SEQ ID NO: 18300 - DNA, 26 bp, Homo sapiens
cgacctcagatcagacgtggcgaccc

SEQ ID NO: 18301 - DNA, 27 bp, Homo sapiens
cgacctcagatcagacgtggcgacccg

SEQ ID NO: 18302 - DNA, 28 bp, Homo sapiens
cgacctcagatcagacgtggcgacccgc

SEQ ID NO: 18303 - DNA, 29 bp, Homo sapiens
cgacctcagatcagacgtggcgacccgct

SEQ ID NO: 18304 - DNA, 30 bp, Homo sapiens; identical to SEQ ID NO: 3888

SEQ ID NO: 18305 - DNA, 31 bp, Homo sapiens; identical to SEQ ID NO: 3889

SEQ ID NO: 18306 - DNA, 32 bp, Homo sapiens; identical to SEQ ID NO: 3890

SEQ ID NO: 18307 - DNA, 33 bp, Homo sapiens; identical to SEQ ID NO: 3891

SEQ ID NO: 18308 - DNA, 34 bp, Homo sapiens
cgacctcagatcagacgtggcgacccgctgaatt

SEQ ID NO: 18309 - DNA, 35 bp, Homo sapiens
cgacctcagatcagacgtggcgacccgctgaattt

SEQ ID NO: 18310 - DNA, 37 bp, Homo sapiens
cgacctcagatcagacgtggcgacccgctgaatttaa

SEQ ID NO: 18311 - DNA, 38 bp, Homo sapiens
cgacctcagatcagacgtggcgacccgctgaatttaag

SEQ ID NO: 18312 - DNA, 39 bp, Homo sapiens
cgacctcagatcagacgtggcgacccgctgaatttaagc

SEQ ID NO: 18313 - DNA, 40 bp, Homo sapiens
cgacctcagatcagacgtggcgacccgctgaatttaagca

SEQ ID NO: 18314 - DNA, 41 bp, Homo sapiens
cgacctcagatcagacgtggcgacccgctgaatttaagcat

SEQ ID NO: 18315 - DNA, 42 bp, Homo sapiens
cgacctcagatcagacgtggcgacccgctgaatttaagcata

SEQ ID NO: 18316 - DNA, 43 bp, Homo sapiens
cgacctcagatcagacgtggcgacccgctgaatttaagcatat

SEQ ID NO: 18317 - DNA, 16 bp, Homo sapiens
gacctcagatcagacg

SEQ ID NO: 18318 - DNA, 17 bp, Homo sapiens
gacctcagatcagacgt

SEQ ID NO: 18319 - DNA, 19 bp, Homo sapiens
gacctcagatcagacgtgg

SEQ ID NO: 18320 - DNA, 23 bp, Homo sapiens
gacctcagatcagacgtggcgac

SEQ ID NO: 18321 - DNA, 24 bp, Homo sapiens
gacctcagatcagacgtggcgacc

SEQ ID NO: 18322 - DNA, 25 bp, Homo sapiens
gacctcagatcagacgtggcgaccc

SEQ ID NO: 18323 - DNA, 26 bp, Homo sapiens
gacctcagatcagacgtggcgacccg

SEQ ID NO: 18324 - DNA, 29 bp, Homo sapiens
gacctcagatcagacgtggcgacccgctg

SEQ ID NO: 18325 - DNA, 31 bp, Homo sapiens
gacctcagatcagacgtggcgacccgctgaa

SEQ ID NO: 18326 - DNA, 32 bp, Homo sapiens
gacctcagatcagacgtggcgacccgctgaat

SEQ ID NO: 18327 - DNA, 33 bp, Homo sapiens
gacctcagatcagacgtggcgacccgctgaatt

SEQ ID NO: 18328 - DNA, 37 bp, Homo sapiens
gacctcagatcagacgtggcgacccgctgaatttaag

SEQ ID NO: 18329 - DNA, 38 bp, Homo sapiens
gacctcagatcagacgtggcgacccgctgaatttaagc

SEQ ID NO: 18330 - DNA, 39 bp, Homo sapiens
gacctcagatcagacgtggcgacccgctgaatttaagca

SEQ ID NO: 18331 - DNA, 16 bp, Homo sapiens
acctcagatcagacgt

SEQ ID NO: 18332 - DNA, 18 bp, Homo sapiens
acctcagatcagacgtgg

SEQ ID NO: 18333 - DNA, 22 bp, Homo sapiens
acctcagatcagacgtggcgac

SEQ ID NO: 18334 - DNA, 23 bp, Homo sapiens
acctcagatcagacgtggcgacc

SEQ ID NO: 18335 - DNA, 24 bp, Homo sapiens
acctcagatcagacgtggcgaccc

SEQ ID NO: 18336 - DNA, 25 bp, Homo sapiens
acctcagatcagacgtggcgacccg

SEQ ID NO: 18337 - DNA, 26 bp, Homo sapiens
acctcagatcagacgtggcgacccgc

SEQ ID NO: 18338 - DNA, 27 bp, Homo sapiens
acctcagatcagacgtggcgacccgct

SEQ ID NO: 18339 - DNA, 28 bp, Homo sapiens
acctcagatcagacgtggcgacccgctg

SEQ ID NO: 18340 - DNA, 30 bp, Homo sapiens
acctcagatcagacgtggcgacccgctgaa

SEQ ID NO: 18341 - DNA, 31 bp, Homo sapiens
acctcagatcagacgtggcgacccgctgaat

SEQ ID NO: 18342 - DNA, 32 bp, Homo sapiens; identical to SEQ ID NO: 3897

SEQ ID NO: 18343 - DNA, 33 bp, Homo sapiens
acctcagatcagacgtggcgacccgctgaattt

SEQ ID NO: 18344 - DNA, 36 bp, Homo sapiens
acctcagatcagacgtggcgacccgctgaatttaag

SEQ ID NO: 18345 - DNA, 38 bp, Homo sapiens
acctcagatcagacgtggcgacccgctgaatttaagca

SEQ ID NO: 18346 - DNA, 22 bp, Homo sapiens
cctcagatcagacgtggcgacc

SEQ ID NO: 18347 - DNA, 23 bp, Homo sapiens
cctcagatcagacgtggcgaccc

SEQ ID NO: 18348 - DNA, 24 bp, Homo sapiens
cctcagatcagacgtggcgacccg

SEQ ID NO: 18349 - DNA, 25 bp, Homo sapiens
cctcagatcagacgtggcgacccgc

SEQ ID NO: 18350 - DNA, 31 bp, Homo sapiens
cctcagatcagacgtggcgacccgctgaatt

SEQ ID NO: 18351 - DNA, 21 bp, Homo sapiens
ctcagatcagacgtggcgacc

SEQ ID NO: 18352 - DNA, 22 bp, Homo sapiens
ctcagatcagacgtggcgaccc

SEQ ID NO: 18353 - DNA, 23 bp, Homo sapiens
ctcagatcagacgtggcgacccg

SEQ ID NO: 18354 - DNA, 24 bp, Homo sapiens
ctcagatcagacgtggcgacccgc

SEQ ID NO: 18355 - DNA, 33 bp, Homo sapiens
ctcagatcagacgtggcgacccgctgaatttaa

SEQ ID NO: 18356 - DNA, 20 bp, Homo sapiens
tcagatcagacgtggcgacc

SEQ ID NO: 18357 - DNA, 21 bp, Homo sapiens
tcagatcagacgtggcgaccc

SEQ ID NO: 18358 - DNA, 24 bp, Homo sapiens
tcagatcagacgtggcgacccgct

SEQ ID NO: 18359 - DNA, 28 bp, Homo sapiens
tcagatcagacgtggcgacccgctgaat

SEQ ID NO: 18360 - DNA, 29 bp, Homo sapiens
tcagatcagacgtggcgacccgctgaatt

SEQ ID NO: 18361 - DNA, 33 bp, Homo sapiens; identical to SEQ ID NO: 3898

SEQ ID NO: 18362 - DNA, 32 bp, Homo sapiens
cagatcagacgtggcgacccgctgaatttaag

SEQ ID NO: 18363 - DNA, 33 bp, Homo sapiens
cagatcagacgtggcgacccgctgaatttaagc

SEQ ID NO: 18364 - DNA, 17 bp, Homo sapiens
agatcagacgtggcgac

SEQ ID NO: 18365 - DNA, 32 bp, Homo sapiens
agatcagacgtggcgacccgctgaatttaagc

SEQ ID NO: 18366 - DNA, 16 bp, Homo sapiens
gatcagacgtggcgac

SEQ ID NO: 18367 - DNA, 17 bp, Homo sapiens
gatcagacgtggcgacc

SEQ ID NO: 18368 - DNA, 31 bp, Homo sapiens
gatcagacgtggcgacccgctgaatttaagc

SEQ ID NO: 18369 - DNA, 16 bp, Homo sapiens
atcagacgtggcgacc

SEQ ID NO: 18370 - DNA, 29 bp, Homo sapiens
atcagacgtggcgacccgctgaatttaag

SEQ ID NO: 18371 - DNA, 31 bp, Homo sapiens
atcagacgtggcgacccgctgaatttaagca

SEQ ID NO: 18372 - DNA, 29 bp, Homo sapiens
cagacgtggcgacccgctgaatttaagca

SEQ ID NO: 18373 - DNA, 21 bp, Homo sapiens
agacgtggcgacccgctgaat

SEQ ID NO: 18374 - DNA, 19 bp, Homo sapiens
acgtggcgacccgctgaat

SEQ ID NO: 18375 - DNA, 18 bp, Homo sapiens
cgtggcgacccgctgaat

SEQ ID NO: 18376 - DNA, 19 bp, Homo sapiens
cgtggcgacccgctgaatt

SEQ ID NO: 18377 - DNA, 22 bp, Homo sapiens
cgtggcgacccgctgaatttaa

SEQ ID NO: 18378 - DNA, 23 bp, Homo sapiens
cgtggcgacccgctgaatttaag

SEQ ID NO: 18379 - DNA, 24 bp, Homo sapiens
cgtggcgacccgctgaatttaagc

SEQ ID NO: 18380 - DNA, 25 bp, Homo sapiens
cgtggcgacccgctgaatttaagca

SEQ ID NO: 18381 - DNA, 26 bp, Homo sapiens
cgtggcgacccgctgaatttaagcat

SEQ ID NO: 18382 - DNA, 27 bp, Homo sapiens
cgtggcgacccgctgaatttaagcata

SEQ ID NO: 18383 - DNA, 28 bp, Homo sapiens
cgtggcgacccgctgaatttaagcatat

SEQ ID NO: 18384 - DNA, 30 bp, Homo sapiens
cgtggcgacccgctgaatttaagcatatta

SEQ ID NO: 18385 - DNA, 23 bp, Homo sapiens
tggcgacccgctgaatttaagca

SEQ ID NO: 18386 - DNA, 23 bp, Homo sapiens
atttaagcatattagtcagcgga

SEQ ID NO: 18387 - DNA, 18 bp, Homo sapiens
ttaagcatattagtcagc

SEQ ID NO: 18388 - DNA, 33 bp, Homo sapiens
ttaagcatattagtcagcggaggagaagaaact

SEQ ID NO: 18389 - DNA, 31 bp, Homo sapiens
taagcatattagtcagcggaggagaagaaac

SEQ ID NO: 18390 - DNA, 32 bp, Homo sapiens; identical to SEQ ID NO: 3903

SEQ ID NO: 18391 - DNA, 16 bp, Homo sapiens
aagcatattagtcagc

SEQ ID NO: 18392 - DNA, 23 bp, Homo sapiens
aagcatattagtcagcggaggag

SEQ ID NO: 18393 - DNA, 24 bp, Homo sapiens
aagcatattagtcagcggaggaga

SEQ ID NO: 18394 - DNA, 25 bp, Homo sapiens
aagcatattagtcagcggaggagaa

SEQ ID NO: 18395 - DNA, 26 bp, Homo sapiens
aagcatattagtcagcggaggagaag

SEQ ID NO: 18396 - DNA, 30 bp, Homo sapiens; identical to SEQ ID NO: 3906

SEQ ID NO: 18397 - DNA, 31 bp, Homo sapiens; identical to SEQ ID NO: 3907

SEQ ID NO: 18398 - DNA, 32 bp, Homo sapiens
aagcatattagtcagcggaggagaagaaacta

SEQ ID NO: 18399 - DNA, 33 bp, Homo sapiens
aagcatattagtcagcggaggagaagaaactaa

SEQ ID NO: 18400 - DNA, 35 bp, Homo sapiens
aagcatattagtcagcggaggagaagaaactaacc

SEQ ID NO: 18401 - DNA, 22 bp, Homo sapiens
agcatattagtcagcggaggag

SEQ ID NO: 18402 - DNA, 23 bp, Homo sapiens
agcatattagtcagcggaggaga

SEQ ID NO: 18403 - DNA, 24 bp, Homo sapiens
agcatattagtcagcggaggagaa

SEQ ID NO: 18404 - DNA, 25 bp, Homo sapiens
agcatattagtcagcggaggagaag

SEQ ID NO: 18405 - DNA, 29 bp, Homo sapiens
agcatattagtcagcggaggagaagaaac

SEQ ID NO: 18406 - DNA, 30 bp, Homo sapiens; identical to SEQ ID NO: 3909

SEQ ID NO: 18407 - DNA, 31 bp, Homo sapiens
agcatattagtcagcggaggagaagaaacta

SEQ ID NO: 18408 - DNA, 32 bp, Homo sapiens
agcatattagtcagcggaggagaagaaactaa

SEQ ID NO: 18409 - DNA, 33 bp, Homo sapiens
agcatattagtcagcggaggagaagaaactaac

SEQ ID NO: 18410 - DNA, 34 bp, Homo sapiens
agcatattagtcagcggaggagaagaaactaacc

SEQ ID NO: 18411 - DNA, 17 bp, Homo sapiens
gcatattagtcagcgga

SEQ ID NO: 18412 - DNA, 23 bp, Homo sapiens
gcatattagtcagcggaggagaa

SEQ ID NO: 18413 - DNA, 28 bp, Homo sapiens
gcatattagtcagcggaggagaagaaac

SEQ ID NO: 18414 - DNA, 29 bp, Homo sapiens
gcatattagtcagcggaggagaagaaact

SEQ ID NO: 18415 - DNA, 32 bp, Homo sapiens
gcatattagtcagcggaggagaagaaactaac

SEQ ID NO: 18416 - DNA, 33 bp, Homo sapiens; identical to SEQ ID NO: 3911

SEQ ID NO: 18417 - DNA, 21 bp, Homo sapiens
catattagtcagcggaggaga

SEQ ID NO: 18418 - DNA, 22 bp, Homo sapiens
catattagtcagcggaggagaa

SEQ ID NO: 18419 - DNA, 27 bp, Homo sapiens
catattagtcagcggaggagaagaaac

SEQ ID NO: 18420 - DNA, 28 bp, Homo sapiens
catattagtcagcggaggagaagaaact

SEQ ID NO: 18421 - DNA, 32 bp, Homo sapiens; identical to SEQ ID NO: 3913

SEQ ID NO: 18422 - DNA, 21 bp, Homo sapiens
atattagtcagcggaggagaa

SEQ ID NO: 18423 - DNA, 26 bp, Homo sapiens
atattagtcagcggaggagaagaaac

SEQ ID NO: 18424 - DNA, 27 bp, Homo sapiens
atattagtcagcggaggagaagaaact

SEQ ID NO: 18425 - DNA, 31 bp, Homo sapiens
atattagtcagcggaggagaagaaactaacc

SEQ ID NO: 18426 - DNA, 16 bp, Homo sapiens
tattagtcagcggagg

SEQ ID NO: 18427 - DNA, 17 bp, Homo sapiens
tattagtcagcggagga

SEQ ID NO: 18428 - DNA, 18 bp, Homo sapiens
tattagtcagcggaggag

SEQ ID NO: 18429 - DNA, 19 bp, Homo sapiens
tattagtcagcggaggaga

SEQ ID NO: 18430 - DNA, 20 bp, Homo sapiens
tattagtcagcggaggagaa

SEQ ID NO: 18431 - DNA, 21 bp, Homo sapiens
tattagtcagcggaggagaag

SEQ ID NO: 18432 - DNA, 22 bp, Homo sapiens
tattagtcagcggaggagaaga

SEQ ID NO: 18433 - DNA, 23 bp, Homo sapiens
tattagtcagcggaggagaagaa

SEQ ID NO: 18434 - DNA, 24 bp, Homo sapiens
tattagtcagcggaggagaagaaa

SEQ ID NO: 18435 - DNA, 25 bp, Homo sapiens
tattagtcagcggaggagaagaaac

SEQ ID NO: 18436 - DNA, 26 bp, Homo sapiens
tattagtcagcggaggagaagaaact

SEQ ID NO: 18437 - DNA, 27 bp, Homo sapiens
tattagtcagcggaggagaagaaacta

SEQ ID NO: 18438 - DNA, 28 bp, Homo sapiens
tattagtcagcggaggagaagaaactaa

SEQ ID NO: 18439 - DNA, 29 bp, Homo sapiens
tattagtcagcggaggagaagaaactaac

SEQ ID NO: 18440 - DNA, 30 bp, Homo sapiens; identical to SEQ ID NO: 3927

SEQ ID NO: 18441 - DNA, 31 bp, Homo sapiens; identical to SEQ ID NO: 3928

SEQ ID NO: 18442 - DNA, 32 bp, Homo sapiens; identical to SEQ ID NO: 3929

SEQ ID NO: 18443 - DNA, 33 bp, Homo sapiens; identical to SEQ ID NO: 3930

SEQ ID NO: 18444 - DNA, 35 bp, Homo sapiens
tattagtcagcggaggagaagaaactaaccaggat

SEQ ID NO: 18445 - DNA, 41 bp, Homo sapiens
tattagtcagcggaggagaagaaactaaccaggattccctc

SEQ ID NO: 18446 - DNA, 45 bp, Homo sapiens
tattagtcagcggaggagaagaaactaaccaggattccctcagta

SEQ ID NO: 18447 - DNA, 16 bp, Homo sapiens
attagtcagcggagga

SEQ ID NO: 18448 - DNA, 17 bp, Homo sapiens
attagtcagcggaggag

SEQ ID NO: 18449 - DNA, 18 bp, Homo sapiens
attagtcagcggaggaga

SEQ ID NO: 18450 - DNA, 19 bp, Homo sapiens
attagtcagcggaggagaa

SEQ ID NO: 18451 - DNA, 20 bp, Homo sapiens
attagtcagcggaggagaag

SEQ ID NO: 18452 - DNA, 21 bp, Homo sapiens
attagtcagcggaggagaaga

SEQ ID NO: 18453 - DNA, 22 bp, Homo sapiens
attagtcagcggaggagaagaa

SEQ ID NO: 18454 - DNA, 23 bp, Homo sapiens
attagtcagcggaggagaagaaa

SEQ ID NO: 18455 - DNA, 24 bp, Homo sapiens
attagtcagcggaggagaagaaac

SEQ ID NO: 18456 - DNA, 25 bp, Homo sapiens
attagtcagcggaggagaagaaact

SEQ ID NO: 18457 - DNA, 26 bp, Homo sapiens
attagtcagcggaggagaagaaacta

SEQ ID NO: 18458 - DNA, 27 bp, Homo sapiens
attagtcagcggaggagaagaaactaa

SEQ ID NO: 18459 - DNA, 28 bp, Homo sapiens
attagtcagcggaggagaagaaactaac

SEQ ID NO: 18460 - DNA, 29 bp, Homo sapiens
attagtcagcggaggagaagaaactaacc

SEQ ID NO: 18461 - DNA, 30 bp, Homo sapiens
attagtcagcggaggagaagaaactaacca

SEQ ID NO: 18462 - DNA, 16 bp, Homo sapiens
ttagtcagcggaggag

SEQ ID NO: 18463 - DNA, 17 bp, Homo sapiens
ttagtcagcggaggaga

SEQ ID NO: 18464 - DNA, 18 bp, Homo sapiens
ttagtcagcggaggagaa

SEQ ID NO: 18465 - DNA, 19 bp, Homo sapiens
ttagtcagcggaggagaag

SEQ ID NO: 18466 - DNA, 20 bp, Homo sapiens
ttagtcagcggaggagaaga

SEQ ID NO: 18467 - DNA, 21 bp, Homo sapiens
ttagtcagcggaggagaagaa

SEQ ID NO: 18468 - DNA, 22 bp, Homo sapiens
ttagtcagcggaggagaagaaa

SEQ ID NO: 18469 - DNA, 23 bp, Homo sapiens
ttagtcagcggaggagaagaaac

SEQ ID NO: 18470 - DNA, 24 bp, Homo sapiens
ttagtcagcggaggagaagaaact

SEQ ID NO: 18471 - DNA, 25 bp, Homo sapiens
ttagtcagcggaggagaagaaacta

SEQ ID NO: 18472 - DNA, 26 bp, Homo sapiens
ttagtcagcggaggagaagaaactaa

SEQ ID NO: 18473 - DNA, 27 bp, Homo sapiens
ttagtcagcggaggagaagaaactaac

SEQ ID NO: 18474 - DNA, 28 bp, Homo sapiens
ttagtcagcggaggagaagaaactaacc

SEQ ID NO: 18475 - DNA, 29 bp, Homo sapiens
ttagtcagcggaggagaagaaactaacca

SEQ ID NO: 18476 - DNA, 31 bp, Homo sapiens
ttagtcagcggaggagaagaaactaaccagg

SEQ ID NO: 18477 - DNA, 32 bp, Homo sapiens
ttagtcagcggaggagaagaaactaaccagga

SEQ ID NO: 18478 - DNA, 33 bp, Homo sapiens
ttagtcagcggaggagaagaaactaaccaggat

SEQ ID NO: 18479 - DNA, 42 bp, Homo sapiens
ttagtcagcggaggagaagaaactaaccaggattccctcagt

SEQ ID NO: 18480 - DNA, 43 bp, Homo sapiens
ttagtcagcggaggagaagaaactaaccaggattccctcagta

SEQ ID NO: 18481 - DNA, 16 bp, Homo sapiens
tagtcagcggaggaga

SEQ ID NO: 18482 - DNA, 17 bp, Homo sapiens
tagtcagcggaggagaa

SEQ ID NO: 18483 - DNA, 18 bp, Homo sapiens
tagtcagcggaggagaag

SEQ ID NO: 18484 - DNA, 19 bp, Homo sapiens
tagtcagcggaggagaaga

SEQ ID NO: 18485 - DNA, 20 bp, Homo sapiens
tagtcagcggaggagaagaa

SEQ ID NO: 18486 - DNA, 21 bp, Homo sapiens
tagtcagcggaggagaagaaa

SEQ ID NO: 18487 - DNA, 22 bp, Homo sapiens
tagtcagcggaggagaagaaac

SEQ ID NO: 18488 - DNA, 23 bp, Homo sapiens
tagtcagcggaggagaagaaact

SEQ ID NO: 18489 - DNA, 24 bp, Homo sapiens
tagtcagcggaggagaagaaacta

SEQ ID NO: 18490 - DNA, 25 bp, Homo sapiens
tagtcagcggaggagaagaaactaa

SEQ ID NO: 18491 - DNA, 26 bp, Homo sapiens
tagtcagcggaggagaagaaactaac

SEQ ID NO: 18492 - DNA, 27 bp, Homo sapiens
tagtcagcggaggagaagaaactaacc

SEQ ID NO: 18493 - DNA, 28 bp, Homo sapiens
tagtcagcggaggagaagaaactaacca

SEQ ID NO: 18494 - DNA, 29 bp, Homo sapiens
tagtcagcggaggagaagaaactaaccag

SEQ ID NO: 18495 - DNA, 30 bp, Homo sapiens; identical to SEQ ID NO: 3957

SEQ ID NO: 18496 - DNA, 31 bp, Homo sapiens; identical to SEQ ID NO: 3958

SEQ ID NO: 18497 - DNA, 32 bp, Homo sapiens; identical to SEQ ID NO: 3959

SEQ ID NO: 18498 - DNA, 33 bp, Homo sapiens
tagtcagcggaggagaagaaactaaccaggatt

SEQ ID NO: 18499 - DNA, 34 bp, Homo sapiens
tagtcagcggaggagaagaaactaaccaggattc

SEQ ID NO: 18500 - DNA, 35 bp, Homo sapiens
tagtcagcggaggagaagaaactaaccaggattcc

SEQ ID NO: 18501 - DNA, 38 bp, Homo sapiens
tagtcagcggaggagaagaaactaaccaggattccctc

SEQ ID NO: 18502 - DNA, 41 bp, Homo sapiens
tagtcagcggaggagaagaaactaaccaggattccctcagt

SEQ ID NO: 18503 - DNA, 42 bp, Homo sapiens
tagtcagcggaggagaagaaactaaccaggattccctcagta

SEQ ID NO: 18504 - DNA, 43 bp, Homo sapiens
tagtcagcggaggagaagaaactaaccaggattccctcagtaa

SEQ ID NO: 18505 - DNA, 44 bp, Homo sapiens
tagtcagcggaggagaagaaactaaccaggattccctcagtaac

SEQ ID NO: 18506 - DNA, 16 bp, Homo sapiens
agtcagcggaggagaa

SEQ ID NO: 18507 - DNA, 17 bp, Homo sapiens
agtcagcggaggagaag

SEQ ID NO: 18508 - DNA, 21 bp, Homo sapiens
agtcagcggaggagaagaaac

SEQ ID NO: 18509 - DNA, 22 bp, Homo sapiens
agtcagcggaggagaagaaact

SEQ ID NO: 18510 - DNA, 23 bp, Homo sapiens
agtcagcggaggagaagaaacta

SEQ ID NO: 18511 - DNA, 25 bp, Homo sapiens
agtcagcggaggagaagaaactaac

SEQ ID NO: 18512 - DNA, 26 bp, Homo sapiens
agtcagcggaggagaagaaactaacc

SEQ ID NO: 18513 - DNA, 27 bp, Homo sapiens
agtcagcggaggagaagaaactaacca

SEQ ID NO: 18514 - DNA, 29 bp, Homo sapiens
agtcagcggaggagaagaaactaaccagg

SEQ ID NO: 18515 - DNA, 30 bp, Homo sapiens
agtcagcggaggagaagaaactaaccagga

SEQ ID NO: 18516 - DNA, 31 bp, Homo sapiens
agtcagcggaggagaagaaactaaccaggat

SEQ ID NO: 18517 - DNA, 32 bp, Homo sapiens
agtcagcggaggagaagaaactaaccaggatt

SEQ ID NO: 18518 - DNA, 33 bp, Homo sapiens
agtcagcggaggagaagaaactaaccaggattc

SEQ ID NO: 18519 - DNA, 40 bp, Homo sapiens
agtcagcggaggagaagaaactaaccaggattccctcagt

SEQ ID NO: 18520 - DNA, 41 bp, Homo sapiens
agtcagcggaggagaagaaactaaccaggattccctcagta

SEQ ID NO: 18521 - DNA, 20 bp, Homo sapiens
gtcagcggaggagaagaaac

SEQ ID NO: 18522 - DNA, 21 bp, Homo sapiens
gtcagcggaggagaagaaact

SEQ ID NO: 18523 - DNA, 24 bp, Homo sapiens
gtcagcggaggagaagaaactaac

SEQ ID NO: 18524 - DNA, 25 bp, Homo sapiens
gtcagcggaggagaagaaactaacc

SEQ ID NO: 18525 - DNA, 29 bp, Homo sapiens
gtcagcggaggagaagaaactaaccagga

SEQ ID NO: 18526 - DNA, 32 bp, Homo sapiens
gtcagcggaggagaagaaactaaccaggattc

SEQ ID NO: 18527 - DNA, 33 bp, Homo sapiens
gtcagcggaggagaagaaactaaccaggattcc

SEQ ID NO: 18528 - DNA, 19 bp, Homo sapiens
tcagcggaggagaagaaac

SEQ ID NO: 18529 - DNA, 20 bp, Homo sapiens
tcagcggaggagaagaaact

SEQ ID NO: 18530 - DNA, 23 bp, Homo sapiens
tcagcggaggagaagaaactaac

SEQ ID NO: 18531 - DNA, 24 bp, Homo sapiens
tcagcggaggagaagaaactaacc

SEQ ID NO: 18532 - DNA, 18 bp, Homo sapiens
cagcggaggagaagaaac

SEQ ID NO: 18533 - DNA, 19 bp, Homo sapiens
cagcggaggagaagaaact

SEQ ID NO: 18534 - DNA, 22 bp, Homo sapiens
cagcggaggagaagaaactaac

SEQ ID NO: 18535 - DNA, 23 bp, Homo sapiens
cagcggaggagaagaaactaacc

SEQ ID NO: 18536 - DNA, 34 bp, Homo sapiens
cagcggaggagaagaaactaaccaggattccctc

SEQ ID NO: 18537 - DNA, 17 bp, Homo sapiens
agcggaggagaagaaac

SEQ ID NO: 18538 - DNA, 18 bp, Homo sapiens
agcggaggagaagaaact

SEQ ID NO: 18539 - DNA, 21 bp, Homo sapiens
agcggaggagaagaaactaac

SEQ ID NO: 18540 - DNA, 22 bp, Homo sapiens
agcggaggagaagaaactaacc

SEQ ID NO: 18541 - DNA, 29 bp, Homo sapiens
agcggaggagaagaaactaaccaggattc

SEQ ID NO: 18542 - DNA, 30 bp, Homo sapiens
agcggaggagaagaaactaaccaggattcc

SEQ ID NO: 18543 - DNA, 31 bp, Homo sapiens
agcggaggagaagaaactaaccaggattccc

SEQ ID NO: 18544 - DNA, 33 bp, Homo sapiens; identical to SEQ ID NO: 3973

SEQ ID NO: 18545 - DNA, 16 bp, Homo sapiens
gcggaggagaagaaac

SEQ ID NO: 18546 - DNA, 17 bp, Homo sapiens
gcggaggagaagaaact

SEQ ID NO: 18547 - DNA, 20 bp, Homo sapiens
gcggaggagaagaaactaac

SEQ ID NO: 18548 - DNA, 21 bp, Homo sapiens
gcggaggagaagaaactaacc

SEQ ID NO: 18549 - DNA, 22 bp, Homo sapiens
gcggaggagaagaaactaacca

SEQ ID NO: 18550 - DNA, 25 bp, Homo sapiens
gcggaggagaagaaactaaccagga

SEQ ID NO: 18551 - DNA, 27 bp, Homo sapiens
gcggaggagaagaaactaaccaggatt

SEQ ID NO: 18552 - DNA, 29 bp, Homo sapiens
gcggaggagaagaaactaaccaggattcc

SEQ ID NO: 18553 - DNA, 30 bp, Homo sapiens
gcggaggagaagaaactaaccaggattccc

SEQ ID NO: 18554 - DNA, 32 bp, Homo sapiens; identical to SEQ ID NO: 3976

SEQ ID NO: 18555 - DNA, 16 bp, Homo sapiens
cggaggagaagaaact

SEQ ID NO: 18556 - DNA, 19 bp, Homo sapiens
cggaggagaagaaactaac

SEQ ID NO: 18557 - DNA, 20 bp, Homo sapiens
cggaggagaagaaactaacc

SEQ ID NO: 18558 - DNA, 27 bp, Homo sapiens
cggaggagaagaaactaaccaggattc

SEQ ID NO: 18559 - DNA, 28 bp, Homo sapiens
cggaggagaagaaactaaccaggattcc

SEQ ID NO: 18560 - DNA, 29 bp, Homo sapiens
cggaggagaagaaactaaccaggattccc

SEQ ID NO: 18561 - DNA, 31 bp, Homo sapiens; identical to SEQ ID NO: 3982

SEQ ID NO: 18562 - DNA, 19 bp, Homo sapiens
ggaggagaagaaactaacc

SEQ ID NO: 18563 - DNA, 18 bp, Homo sapiens
gaggagaagaaactaacc

SEQ ID NO: 18564 - DNA, 31 bp, Homo sapiens
aggagaagaaactaaccaggattccctcagt

SEQ ID NO: 18565 - DNA, 24 bp, Homo sapiens
actaaccaggattccctcagtaac

SEQ ID NO: 18566 - DNA, 28 bp, Homo sapiens
actaaccaggattccctcagtaacggcg

SEQ ID NO: 18567 - DNA, 23 bp, Homo sapiens
ctaaccaggattccctcagtaac

SEQ ID NO: 18568 - DNA, 32 bp, Homo sapiens
ctaaccaggattccctcagtaacggcgagtga

SEQ ID NO: 18569 - DNA, 33 bp, Homo sapiens
ctaaccaggattccctcagtaacggcgagtgaa

SEQ ID NO: 18570 - DNA, 22 bp, Homo sapiens
taaccaggattccctcagtaac

SEQ ID NO: 18571 - DNA, 32 bp, Homo sapiens
taaccaggattccctcagtaacggcgagtgaa

SEQ ID NO: 18572 - DNA, 21 bp, Homo sapiens
aaccaggattccctcagtaac

SEQ ID NO: 18573 - DNA, 25 bp, Homo sapiens
aaccaggattccctcagtaacggcg

SEQ ID NO: 18574 - DNA, 31 bp, Homo sapiens
aaccaggattccctcagtaacggcgagtgaa

SEQ ID NO: 18575 - DNA, 20 bp, Homo sapiens
accaggattccctcagtaac

SEQ ID NO: 18576 - DNA, 30 bp, Homo sapiens
accaggattccctcagtaacggcgagtgaa

SEQ ID NO: 18577 - DNA, 19 bp, Homo sapiens
ccaggattccctcagtaac

SEQ ID NO: 18578 - DNA, 23 bp, Homo sapiens
ccaggattccctcagtaacggcg

SEQ ID NO: 18579 - DNA, 24 bp, Homo sapiens
ccaggattccctcagtaacggcga

SEQ ID NO: 18580 - DNA, 28 bp, Homo sapiens
ccaggattccctcagtaacggcgagtga

SEQ ID NO: 18581 - DNA, 29 bp, Homo sapiens
ccaggattccctcagtaacggcgagtgaa

SEQ ID NO: 18582 - DNA, 18 bp, Homo sapiens
caggattccctcagtaac

SEQ ID NO: 18583 - DNA, 21 bp, Homo sapiens
caggattccctcagtaacggc

SEQ ID NO: 18584 - DNA, 22 bp, Homo sapiens
caggattccctcagtaacggcg

SEQ ID NO: 18585 - DNA, 23 bp, Homo sapiens
caggattccctcagtaacggcga

SEQ ID NO: 18586 - DNA, 24 bp, Homo sapiens
caggattccctcagtaacggcgag

SEQ ID NO: 18587 - DNA, 32 bp, Homo sapiens; identical to SEQ ID NO: 3986

SEQ ID NO: 18588 - DNA, 33 bp, Homo sapiens
caggattccctcagtaacggcgagtgaacaggg

SEQ ID NO: 18589 - DNA, 16 bp, Homo sapiens
aggattccctcagtaa

SEQ ID NO: 18590 - DNA, 17 bp, Homo sapiens
aggattccctcagtaac

SEQ ID NO: 18591 - DNA, 18 bp, Homo sapiens
aggattccctcagtaacg

SEQ ID NO: 18592 - DNA, 20 bp, Homo sapiens
aggattccctcagtaacggc

SEQ ID NO: 18593 - DNA, 21 bp, Homo sapiens
aggattccctcagtaacggcg

SEQ ID NO: 18594 - DNA, 22 bp, Homo sapiens
aggattccctcagtaacggcga

SEQ ID NO: 18595 - DNA, 27 bp, Homo sapiens
aggattccctcagtaacggcgagtgaa

SEQ ID NO: 18596 - DNA, 30 bp, Homo sapiens
aggattccctcagtaacggcgagtgaacag

SEQ ID NO: 18597 - DNA, 31 bp, Homo sapiens; identical to SEQ ID NO: 3990

SEQ ID NO: 18598 - DNA, 32 bp, Homo sapiens; identical to SEQ ID NO: 3991

SEQ ID NO: 18599 - DNA, 20 bp, Homo sapiens
ggattccctcagtaacggcg

SEQ ID NO: 18600 - DNA, 18 bp, Homo sapiens
gattccctcagtaacggc

SEQ ID NO: 18601 - DNA, 19 bp, Homo sapiens
gattccctcagtaacggcg

SEQ ID NO: 18602 - DNA, 18 bp, Homo sapiens
attccctcagtaacggcg

SEQ ID NO: 18603 - DNA, 16 bp, Homo sapiens
tccctcagtaacggcg

SEQ ID NO: 18604 - DNA, 25 bp, Homo sapiens
tccctcagtaacggcgagtgaacag

SEQ ID NO: 18605 - DNA, 23 bp, Homo sapiens
ccctcagtaacggcgagtgaaca

SEQ ID NO: 18606 - DNA, 21 bp, Homo sapiens
ctcagtaacggcgagtgaaca

SEQ ID NO: 18607 - DNA, 22 bp, Homo sapiens
ctcagtaacggcgagtgaacag

SEQ ID NO: 18608 - DNA, 17 bp, Homo sapiens
gtaacggcgagtgaaca

SEQ ID NO: 18609 - DNA, 21 bp, Homo sapiens
gtaacggcgagtgaacaggga

SEQ ID NO: 18610 - DNA, 22 bp, Homo sapiens
gtaacggcgagtgaacagggaa

SEQ ID NO: 18611 - DNA, 24 bp, Homo sapiens
gtaacggcgagtgaacagggaaga

SEQ ID NO: 18612 - DNA, 29 bp, Homo sapiens
gtaacggcgagtgaacagggaagagccca

SEQ ID NO: 18613 - DNA, 21 bp, Homo sapiens
taacggcgagtgaacagggaa

SEQ ID NO: 18614 - DNA, 20 bp, Homo sapiens
aacggcgagtgaacagggaa

SEQ ID NO: 18615 - DNA, 18 bp, Homo sapiens
acggcgagtgaacaggga

SEQ ID NO: 18616 - DNA, 19 bp, Homo sapiens
acggcgagtgaacagggaa

SEQ ID NO: 18617 - DNA, 21 bp, Homo sapiens
acggcgagtgaacagggaaga

SEQ ID NO: 18618 - DNA, 23 bp, Homo sapiens
acggcgagtgaacagggaagagc

SEQ ID NO: 18619 - DNA, 26 bp, Homo sapiens
acggcgagtgaacagggaagagccca

SEQ ID NO: 18620 - DNA, 17 bp, Homo sapiens
cggcgagtgaacaggga

SEQ ID NO: 18621 - DNA, 18 bp, Homo sapiens
cggcgagtgaacagggaa

SEQ ID NO: 18622 - DNA, 20 bp, Homo sapiens
cggcgagtgaacagggaaga

SEQ ID NO: 18623 - DNA, 21 bp, Homo sapiens
cggcgagtgaacagggaagag

SEQ ID NO: 18624 - DNA, 22 bp, Homo sapiens
cggcgagtgaacagggaagagc

SEQ ID NO: 18625 - DNA, 23 bp, Homo sapiens
cggcgagtgaacagggaagagcc

SEQ ID NO: 18626 - DNA, 25 bp, Homo sapiens
cggcgagtgaacagggaagagccca

SEQ ID NO: 18627 - DNA, 27 bp, Homo sapiens
cggcgagtgaacagggaagagcccagc

SEQ ID NO: 18628 - DNA, 28 bp, Homo sapiens
cggcgagtgaacagggaagagcccagcg

SEQ ID NO: 18629 - DNA, 29 bp, Homo sapiens
cggcgagtgaacagggaagagcccagcgc

SEQ ID NO: 18630 - DNA, 30 bp, Homo sapiens; identical to SEQ ID NO: 3998

SEQ ID NO: 18631 - DNA, 41 bp, Homo sapiens
cggcgagtgaacagggaagagcccagcgccgaatccccgcc

SEQ ID NO: 18632 - DNA, 18 bp, Homo sapiens
agtgaacagggaagagcc

SEQ ID NO: 18633 - DNA, 25 bp, Homo sapiens
agtgaacagggaagagcccagcgcc

SEQ ID NO: 18634 - DNA, 23 bp, Homo sapiens
tgaacagggaagagcccagcgcc

SEQ ID NO: 18635 - DNA, 22 bp, Homo sapiens
acagggaagagcccagcgccga

SEQ ID NO: 18636 - DNA, 21 bp, Homo sapiens
cagggaagagcccagcgccga

SEQ ID NO: 18637 - DNA, 18 bp, Homo sapiens
agggaagagcccagcgcc

SEQ ID NO: 18638 - DNA, 32 bp, Homo sapiens
agggaagagcccagcgccgaatccccgccccg

SEQ ID NO: 18639 - DNA, 33 bp, Homo sapiens
agggaagagcccagcgccgaatccccgccccgc

SEQ ID NO: 18640 - DNA, 31 bp, Homo sapiens
ggaagagcccagcgccgaatccccgccccgc

SEQ ID NO: 18641 - DNA, 24 bp, Homo sapiens
gaagagcccagcgccgaatccccg

SEQ ID NO: 18642 - DNA, 26 bp, Homo sapiens
gaagagcccagcgccgaatccccgcc

SEQ ID NO: 18643 - DNA, 27 bp, Homo sapiens
gaagagcccagcgccgaatccccgccc

SEQ ID NO: 18644 - DNA, 28 bp, Homo sapiens
gaagagcccagcgccgaatccccgcccc

SEQ ID NO: 18645 - DNA, 23 bp, Homo sapiens
aagagcccagcgccgaatccccg

SEQ ID NO: 18646 - DNA, 25 bp, Homo sapiens
aagagcccagcgccgaatccccgcc

SEQ ID NO: 18647 - DNA, 26 bp, Homo sapiens
aagagcccagcgccgaatccccgccc

SEQ ID NO: 18648 - DNA, 22 bp, Homo sapiens
agagcccagcgccgaatccccg

SEQ ID NO: 18649 - DNA, 24 bp, Homo sapiens
agagcccagcgccgaatccccgcc

SEQ ID NO: 18650 - DNA, 25 bp, Homo sapiens
agagcccagcgccgaatccccgccc

SEQ ID NO: 18651 - DNA, 19 bp, Homo sapiens
gagcccagcgccgaatccc

SEQ ID NO: 18652 - DNA, 20 bp, Homo sapiens
gagcccagcgccgaatcccc

SEQ ID NO: 18653 - DNA, 21 bp, Homo sapiens
gagcccagcgccgaatccccg

SEQ ID NO: 18654 - DNA, 22 bp, Homo sapiens
gagcccagcgccgaatccccgc

SEQ ID NO: 18655 - DNA, 23 bp, Homo sapiens
gagcccagcgccgaatccccgcc

SEQ ID NO: 18656 - DNA, 24 bp, Homo sapiens
gagcccagcgccgaatccccgccc

SEQ ID NO: 18657 - DNA, 25 bp, Homo sapiens
gagcccagcgccgaatccccgcccc

SEQ ID NO: 18658 - DNA, 26 bp, Homo sapiens
gagcccagcgccgaatccccgccccg

SEQ ID NO: 18659 - DNA, 27 bp, Homo sapiens
gagcccagcgccgaatccccgccccgc

SEQ ID NO: 18660 - DNA, 18 bp, Homo sapiens
agcccagcgccgaatccc

SEQ ID NO: 18661 - DNA, 19 bp, Homo sapiens
agcccagcgccgaatcccc

SEQ ID NO: 18662 - DNA, 20 bp, Homo sapiens
agcccagcgccgaatccccg

SEQ ID NO: 18663 - DNA, 21 bp, Homo sapiens
agcccagcgccgaatccccgc

SEQ ID NO: 18664 - DNA, 22 bp, Homo sapiens
agcccagcgccgaatccccgcc

SEQ ID NO: 18665 - DNA, 23 bp, Homo sapiens
agcccagcgccgaatccccgccc

SEQ ID NO: 18666 - DNA, 24 bp, Homo sapiens
agcccagcgccgaatccccgcccc

SEQ ID NO: 18667 - DNA, 25 bp, Homo sapiens
agcccagcgccgaatccccgccccg

SEQ ID NO: 18668 - DNA, 26 bp, Homo sapiens
agcccagcgccgaatccccgccccgc

SEQ ID NO: 18669 - DNA, 24 bp, Homo sapiens
gcccagcgccgaatccccgccccg

SEQ ID NO: 18670 - DNA, 25 bp, Homo sapiens
gcccagcgccgaatccccgccccgc

SEQ ID NO: 18671 - DNA, 20 bp, Homo sapiens
agcgccgaatccccgccccg

SEQ ID NO: 18672 - DNA, 17 bp, Homo sapiens
ccgaatccccgccccgc

SEQ ID NO: 18673 - DNA, 22 bp, Homo sapiens
ccgcggcggggcgcgggacatg

SEQ ID NO: 18674 - DNA, 29 bp, Homo sapiens
ccgcggcggggcgcgggacatgtggcgta

SEQ ID NO: 18675 - DNA, 31 bp, Homo sapiens
ccgcggcggggcgcgggacatgtggcgtacg

SEQ ID NO: 18676 - DNA, 32 bp, Homo sapiens
ccgcggcggggcgcgggacatgtggcgtacgg

SEQ ID NO: 18677 - DNA, 33 bp, Homo sapiens
ccgcggcggggcgcgggacatgtggcgtacgga

SEQ ID NO: 18678 - DNA, 21 bp, Homo sapiens
cgcggcggggcgcgggacatg

SEQ ID NO: 18679 - DNA, 28 bp, Homo sapiens
cgcggcggggcgcgggacatgtggcgta

SEQ ID NO: 18680 - DNA, 29 bp, Homo sapiens
cgcggcggggcgcgggacatgtggcgtac

SEQ ID NO: 18681 - DNA, 30 bp, Homo sapiens
cgcggcggggcgcgggacatgtggcgtacg

SEQ ID NO: 18682 - DNA, 31 bp, Homo sapiens
cgcggcggggcgcgggacatgtggcgtacgg

SEQ ID NO: 18683 - DNA, 32 bp, Homo sapiens
cgcggcggggcgcgggacatgtggcgtacgga

SEQ ID NO: 18684 - DNA, 33 bp, Homo sapiens; identical to SEQ ID NO: 4008

SEQ ID NO: 18685 - DNA, 27 bp, Homo sapiens
gcggcggggcgcgggacatgtggcgta

SEQ ID NO: 18686 - DNA, 31 bp, Homo sapiens
gcggcggggcgcgggacatgtggcgtacgga

SEQ ID NO: 18687 - DNA, 32 bp, Homo sapiens
gcggcggggcgcgggacatgtggcgtacggaa

SEQ ID NO: 18688 - DNA, 33 bp, Homo sapiens
gcggcggggcgcgggacatgtggcgtacggaag

SEQ ID NO: 18689 - DNA, 30 bp, Homo sapiens
cggcggggcgcgggacatgtggcgtacgga

SEQ ID NO: 18690 - DNA, 31 bp, Homo sapiens
cggcggggcgcgggacatgtggcgtacggaa

SEQ ID NO: 18691 - DNA, 32 bp, Homo sapiens
cggcggggcgcgggacatgtggcgtacggaag

SEQ ID NO: 18692 - DNA, 33 bp, Homo sapiens
cggcggggcgcgggacatgtggcgtacggaaga

SEQ ID NO: 18693 - DNA, 29 bp, Homo sapiens
gcggggcgcgggacatgtggcgtacggaa

SEQ ID NO: 18694 - DNA, 31 bp, Homo sapiens
gcggggcgcgggacatgtggcgtacggaaga

SEQ ID NO: 18695 - DNA, 28 bp, Homo sapiens
cggggcgcgggacatgtggcgtacggaa

SEQ ID NO: 18696 - DNA, 26 bp, Homo sapiens
gcgcgggacatgtggcgtacggaaga

SEQ ID NO: 18697 - DNA, 18 bp, Homo sapiens
cgcgggacatgtggcgta

SEQ ID NO: 18698 - DNA, 20 bp, Homo sapiens
cgcgggacatgtggcgtacg

SEQ ID NO: 18699 - DNA, 21 bp, Homo sapiens
cgcgggacatgtggcgtacgg

SEQ ID NO: 18700 - DNA, 22 bp, Homo sapiens
cgcgggacatgtggcgtacgga

SEQ ID NO: 18701 - DNA, 23 bp, Homo sapiens
cgcgggacatgtggcgtacggaa

SEQ ID NO: 18702 - DNA, 24 bp, Homo sapiens
cgcgggacatgtggcgtacggaag

SEQ ID NO: 18703 - DNA, 25 bp, Homo sapiens
cgcgggacatgtggcgtacggaaga

SEQ ID NO: 18704 - DNA, 26 bp, Homo sapiens
cgcgggacatgtggcgtacggaagac

SEQ ID NO: 18705 - DNA, 27 bp, Homo sapiens
cgcgggacatgtggcgtacggaagacc

SEQ ID NO: 18706 - DNA, 28 bp, Homo sapiens
cgcgggacatgtggcgtacggaagaccc

SEQ ID NO: 18707 - DNA, 29 bp, Homo sapiens
cgcgggacatgtggcgtacggaagacccg

SEQ ID NO: 18708 - DNA, 30 bp, Homo sapiens; identical to SEQ ID NO: 4015

SEQ ID NO: 18709 - DNA, 31 bp, Homo sapiens
cgcgggacatgtggcgtacggaagacccgct

SEQ ID NO: 18710 - DNA, 21 bp, Homo sapiens
gcgggacatgtggcgtacgga

SEQ ID NO: 18711 - DNA, 22 bp, Homo sapiens
gcgggacatgtggcgtacggaa

SEQ ID NO: 18712 - DNA, 23 bp, Homo sapiens
gcgggacatgtggcgtacggaag

SEQ ID NO: 18713 - DNA, 24 bp, Homo sapiens
gcgggacatgtggcgtacggaaga

SEQ ID NO: 18714 - DNA, 25 bp, Homo sapiens
gcgggacatgtggcgtacggaagac

SEQ ID NO: 18715 - DNA, 26 bp, Homo sapiens
gcgggacatgtggcgtacggaagacc

SEQ ID NO: 18716 - DNA, 28 bp, Homo sapiens
gcgggacatgtggcgtacggaagacccg

SEQ ID NO: 18717 - DNA, 29 bp, Homo sapiens
gcgggacatgtggcgtacggaagacccgc

SEQ ID NO: 18718 - DNA, 30 bp, Homo sapiens
gcgggacatgtggcgtacggaagacccgct

SEQ ID NO: 18719 - DNA, 16 bp, Homo sapiens
cgggacatgtggcgta

SEQ ID NO: 18720 - DNA, 19 bp, Homo sapiens
cgggacatgtggcgtacgg

SEQ ID NO: 18721 - DNA, 20 bp, Homo sapiens
cgggacatgtggcgtacgga

SEQ ID NO: 18722 - DNA, 21 bp, Homo sapiens
cgggacatgtggcgtacggaa

SEQ ID NO: 18723 - DNA, 22 bp, Homo sapiens
cgggacatgtggcgtacggaag

SEQ ID NO: 18724 - DNA, 23 bp, Homo sapiens
cgggacatgtggcgtacggaaga

SEQ ID NO: 18725 - DNA, 24 bp, Homo sapiens
cgggacatgtggcgtacggaagac

SEQ ID NO: 18726 - DNA, 25 bp, Homo sapiens
cgggacatgtggcgtacggaagacc

SEQ ID NO: 18727 - DNA, 26 bp, Homo sapiens
cgggacatgtggcgtacggaagaccc

SEQ ID NO: 18728 - DNA, 27 bp, Homo sapiens
cgggacatgtggcgtacggaagacccg

SEQ ID NO: 18729 - DNA, 28 bp, Homo sapiens
cgggacatgtggcgtacggaagacccgc

SEQ ID NO: 18730 - DNA, 29 bp, Homo sapiens
cgggacatgtggcgtacggaagacccgct

SEQ ID NO: 18731 - DNA, 31 bp, Homo sapiens
cgggacatgtggcgtacggaagacccgctcc

SEQ ID NO: 18732 - DNA, 32 bp, Homo sapiens
cgggacatgtggcgtacggaagacccgctccc

SEQ ID NO: 18733 - DNA, 17 bp, Homo sapiens
gacatgtggcgtacgga

SEQ ID NO: 18734 - DNA, 19 bp, Homo sapiens
gacatgtggcgtacggaag

SEQ ID NO: 18735 - DNA, 21 bp, Homo sapiens
gacatgtggcgtacggaagac

SEQ ID NO: 18736 - DNA, 22 bp, Homo sapiens
gacatgtggcgtacggaagacc

SEQ ID NO: 18737 - DNA, 27 bp, Homo sapiens
gacatgtggcgtacggaagacccgctc

SEQ ID NO: 18738 - DNA, 16 bp, Homo sapiens
acatgtggcgtacgga

SEQ ID NO: 18739 - DNA, 16 bp, Homo sapiens
catgtggcgtacggaa

SEQ ID NO: 18740 - DNA, 18 bp, Homo sapiens
catgtggcgtacggaaga

SEQ ID NO: 18741 - DNA, 19 bp, Homo sapiens
atgtggcgtacggaagacc

SEQ ID NO: 18742 - DNA, 24 bp, Homo sapiens
atgtggcgtacggaagacccgctc

SEQ ID NO: 18743 - DNA, 16 bp, Homo sapiens
tgtggcgtacggaaga

SEQ ID NO: 18744 - DNA, 18 bp, Homo sapiens
tgtggcgtacggaagacc

SEQ ID NO: 18745 - DNA, 33 bp, Homo sapiens
gcgtacggaagacccgctccccggcgccgctcg

SEQ ID NO: 18746 - DNA, 16 bp, Homo sapiens
cgtacggaagacccgc

SEQ ID NO: 18747 - DNA, 27 bp, Homo sapiens
cgtacggaagacccgctccccggcgcc

SEQ ID NO: 18748 - DNA, 30 bp, Homo sapiens
cgtacggaagacccgctccccggcgccgct

SEQ ID NO: 18749 - DNA, 26 bp, Homo sapiens
gtacggaagacccgctccccggcgcc

SEQ ID NO: 18750 - DNA, 27 bp, Homo sapiens
gtacggaagacccgctccccggcgccg

SEQ ID NO: 18751 - DNA, 29 bp, Homo sapiens
gtacggaagacccgctccccggcgccgct

SEQ ID NO: 18752 - DNA, 24 bp, Homo sapiens
tacggaagacccgctccccggcgc

SEQ ID NO: 18753 - DNA, 25 bp, Homo sapiens
tacggaagacccgctccccggcgcc

SEQ ID NO: 18754 - DNA, 26 bp, Homo sapiens
tacggaagacccgctccccggcgccg

SEQ ID NO: 18755 - DNA, 23 bp, Homo sapiens
acggaagacccgctccccggcgc

SEQ ID NO: 18756 - DNA, 24 bp, Homo sapiens
acggaagacccgctccccggcgcc

SEQ ID NO: 18757 - DNA, 25 bp, Homo sapiens
acggaagacccgctccccggcgccg

SEQ ID NO: 18758 - DNA, 27 bp, Homo sapiens
acggaagacccgctccccggcgccgct

SEQ ID NO: 18759 - DNA, 23 bp, Homo sapiens
cggaagacccgctccccggcgcc

SEQ ID NO: 18760 - DNA, 24 bp, Homo sapiens
cggaagacccgctccccggcgccg

SEQ ID NO: 18761 - DNA, 26 bp, Homo sapiens
cggaagacccgctccccggcgccgct

SEQ ID NO: 18762 - DNA, 31 bp, Homo sapiens
cggaagacccgctccccggcgccgctcgtgg

SEQ ID NO: 18763 - DNA, 19 bp, Homo sapiens
ggaagacccgctccccggc

SEQ ID NO: 18764 - DNA, 21 bp, Homo sapiens
ggaagacccgctccccggcgc

SEQ ID NO: 18765 - DNA, 22 bp, Homo sapiens
ggaagacccgctccccggcgcc

SEQ ID NO: 18766 - DNA, 24 bp, Homo sapiens
gacccgctccccggcgccgctcgt

SEQ ID NO: 18767 - DNA, 33 bp, Homo sapiens
cggcgccgctcgtggggggcccaagtccttctg

SEQ ID NO: 18768 - DNA, 31 bp, Homo sapiens
gcgccgctcgtggggggcccaagtccttctg

SEQ ID NO: 18769 - DNA, 32 bp, Homo sapiens
cgccgctcgtggggggcccaagtccttctgat

SEQ ID NO: 18770 - DNA, 33 bp, Homo sapiens
gccgctcgtggggggcccaagtccttctgatcg

SEQ ID NO: 18771 - DNA, 19 bp, Homo sapiens
gctcgtggggggcccaagt

SEQ ID NO: 18772 - DNA, 20 bp, Homo sapiens
gctcgtggggggcccaagtc

SEQ ID NO: 18773 - DNA, 21 bp, Homo sapiens
gctcgtggggggcccaagtcc

SEQ ID NO: 18774 - DNA, 22 bp, Homo sapiens
gctcgtggggggcccaagtcct

SEQ ID NO: 18775 - DNA, 25 bp, Homo sapiens
gctcgtggggggcccaagtccttct

SEQ ID NO: 18776 - DNA, 31 bp, Homo sapiens
gctcgtggggggcccaagtccttctgatcga

SEQ ID NO: 18777 - DNA, 47 bp, Homo sapiens
gctcgtggggggcccaagtccttctgatcgaggcccagcccgtggac

SEQ ID NO: 18778 - DNA, 30 bp, Homo sapiens
ctcgtggggggcccaagtccttctgatcga

SEQ ID NO: 18779 - DNA, 33 bp, Homo sapiens; identical to SEQ ID NO: 4023

SEQ ID NO: 18780 - DNA, 31 bp, Homo sapiens; identical to SEQ ID NO: 4024

SEQ ID NO: 18781 - DNA, 32 bp, Homo sapiens; identical to SEQ ID NO: 4025

SEQ ID NO: 18782 - DNA, 33 bp, Homo sapiens; identical to SEQ ID NO: 4026

SEQ ID NO: 18783 - DNA, 34 bp, Homo sapiens
tcgtggggggcccaagtccttctgatcgaggccc

SEQ ID NO: 18784 - DNA, 29 bp, Homo sapiens
cgtggggggcccaagtccttctgatcgag

SEQ ID NO: 18785 - DNA, 30 bp, Homo sapiens; identical to SEQ ID NO: 4027

SEQ ID NO: 18786 - DNA, 31 bp, Homo sapiens; identical to SEQ ID NO: 4028

SEQ ID NO: 18787 - DNA, 32 bp, Homo sapiens; identical to SEQ ID NO: 4029

SEQ ID NO: 18788 - DNA, 33 bp, Homo sapiens
cgtggggggcccaagtccttctgatcgaggccc

SEQ ID NO: 18789 - DNA, 25 bp, Homo sapiens
gtggggggcccaagtccttctgatc

SEQ ID NO: 18790 - DNA, 28 bp, Homo sapiens
gtggggggcccaagtccttctgatcgag

SEQ ID NO: 18791 - DNA, 29 bp, Homo sapiens
gtggggggcccaagtccttctgatcgagg

SEQ ID NO: 18792 - DNA, 30 bp, Homo sapiens; identical to SEQ ID NO: 4032

SEQ ID NO: 18793 - DNA, 31 bp, Homo sapiens; identical to SEQ ID NO: 4033

SEQ ID NO: 18794 - DNA, 32 bp, Homo sapiens; identical to SEQ ID NO: 4034

SEQ ID NO: 18795 - DNA, 27 bp, Homo sapiens
tggggggcccaagtccttctgatcgag

SEQ ID NO: 18796 - DNA, 28 bp, Homo sapiens
tggggggcccaagtccttctgatcgagg

SEQ ID NO: 18797 - DNA, 29 bp, Homo sapiens
tggggggcccaagtccttctgatcgaggc

SEQ ID NO: 18798 - DNA, 30 bp, Homo sapiens; identical to SEQ ID NO: 4038

SEQ ID NO: 18799 - DNA, 31 bp, Homo sapiens; identical to SEQ ID NO: 4039

SEQ ID NO: 18800 - DNA, 27 bp, Homo sapiens
ggggggcccaagtccttctgatcgagg

SEQ ID NO: 18801 - DNA, 28 bp, Homo sapiens
ggggggcccaagtccttctgatcgaggc

SEQ ID NO: 18802 - DNA, 29 bp, Homo sapiens
ggggggcccaagtccttctgatcgaggcc

SEQ ID NO: 18803 - DNA, 30 bp, Homo sapiens; identical to SEQ ID NO: 4041

SEQ ID NO: 18804 - DNA, 33 bp, Homo sapiens
ggggggcccaagtccttctgatcgaggcccagc

SEQ ID NO: 18805 - DNA, 25 bp, Homo sapiens
gggggcccaagtccttctgatcgag

SEQ ID NO: 18806 - DNA, 26 bp, Homo sapiens
gggggcccaagtccttctgatcgagg

SEQ ID NO: 18807 - DNA, 27 bp, Homo sapiens
gggggcccaagtccttctgatcgaggc

SEQ ID NO: 18808 - DNA, 28 bp, Homo sapiens
gggggcccaagtccttctgatcgaggcc

SEQ ID NO: 18809 - DNA, 29 bp, Homo sapiens
gggggcccaagtccttctgatcgaggccc

SEQ ID NO: 18810 - DNA, 32 bp, Homo sapiens
gggggcccaagtccttctgatcgaggcccagc

SEQ ID NO: 18811 - DNA, 33 bp, Homo sapiens
gggggcccaagtccttctgatcgaggcccagcc

SEQ ID NO: 18812 - DNA, 40 bp, Homo sapiens
gggggcccaagtccttctgatcgaggcccagcccgtggac

SEQ ID NO: 18813 - DNA, 24 bp, Homo sapiens
ggggcccaagtccttctgatcgag

SEQ ID NO: 18814 - DNA, 25 bp, Homo sapiens
ggggcccaagtccttctgatcgagg

SEQ ID NO: 18815 - DNA, 26 bp, Homo sapiens
ggggcccaagtccttctgatcgaggc

SEQ ID NO: 18816 - DNA, 27 bp, Homo sapiens
ggggcccaagtccttctgatcgaggcc

SEQ ID NO: 18817 - DNA, 39 bp, Homo sapiens
ggggcccaagtccttctgatcgaggcccagcccgtggac

SEQ ID NO: 18818 - DNA, 25 bp, Homo sapiens
gggcccaagtccttctgatcgaggc

SEQ ID NO: 18819 - DNA, 26 bp, Homo sapiens
gggcccaagtccttctgatcgaggcc

SEQ ID NO: 18820 - DNA, 33 bp, Homo sapiens
gggcccaagtccttctgatcgaggcccagcccg

SEQ ID NO: 18821 - DNA, 24 bp, Homo sapiens
ggcccaagtccttctgatcgaggc

SEQ ID NO: 18822 - DNA, 25 bp, Homo sapiens
ggcccaagtccttctgatcgaggcc

SEQ ID NO: 18823 - DNA, 32 bp, Homo sapiens
ggcccaagtccttctgatcgaggcccagcccg

SEQ ID NO: 18824 - DNA, 19 bp, Homo sapiens
gcccaagtccttctgatcg

SEQ ID NO: 18825 - DNA, 23 bp, Homo sapiens
gcccaagtccttctgatcgaggc

SEQ ID NO: 18826 - DNA, 24 bp, Homo sapiens
gcccaagtccttctgatcgaggcc

SEQ ID NO: 18827 - DNA, 25 bp, Homo sapiens
gcccaagtccttctgatcgaggccc

SEQ ID NO: 18828 - DNA, 29 bp, Homo sapiens
gcccaagtccttctgatcgaggcccagcc

SEQ ID NO: 18829 - DNA, 36 bp, Homo sapiens
gcccaagtccttctgatcgaggcccagcccgtggac

SEQ ID NO: 18830 - DNA, 17 bp, Homo sapiens
cccaagtccttctgatc

SEQ ID NO: 18831 - DNA, 20 bp, Homo sapiens
cccaagtccttctgatcgag

SEQ ID NO: 18832 - DNA, 22 bp, Homo sapiens
cccaagtccttctgatcgaggc

SEQ ID NO: 18833 - DNA, 23 bp, Homo sapiens
cccaagtccttctgatcgaggcc

SEQ ID NO: 18834 - DNA, 24 bp, Homo sapiens
cccaagtccttctgatcgaggccc

SEQ ID NO: 18835 - DNA, 28 bp, Homo sapiens
cccaagtccttctgatcgaggcccagcc

SEQ ID NO: 18836 - DNA, 35 bp, Homo sapiens
cccaagtccttctgatcgaggcccagcccgtggac

SEQ ID NO: 18837 - DNA, 16 bp, Homo sapiens
ccaagtccttctgatc

SEQ ID NO: 18838 - DNA, 17 bp, Homo sapiens
ccaagtccttctgatcg

SEQ ID NO: 18839 - DNA, 18 bp, Homo sapiens
ccaagtccttctgatcga

SEQ ID NO: 18840 - DNA, 19 bp, Homo sapiens
ccaagtccttctgatcgag

SEQ ID NO: 18841 - DNA, 20 bp, Homo sapiens
ccaagtccttctgatcgagg

SEQ ID NO: 18842 - DNA, 21 bp, Homo sapiens
ccaagtccttctgatcgaggc

SEQ ID NO: 18843 - DNA, 22 bp, Homo sapiens
ccaagtccttctgatcgaggcc

SEQ ID NO: 18844 - DNA, 23 bp, Homo sapiens
ccaagtccttctgatcgaggccc

SEQ ID NO: 18845 - DNA, 27 bp, Homo sapiens
ccaagtccttctgatcgaggcccagcc

SEQ ID NO: 18846 - DNA, 33 bp, Homo sapiens
ccaagtccttctgatcgaggcccagcccgtgga

SEQ ID NO: 18847 - DNA, 16 bp, Homo sapiens
caagtccttctgatcg

SEQ ID NO: 18848 - DNA, 17 bp, Homo sapiens
caagtccttctgatcga

SEQ ID NO: 18849 - DNA, 18 bp, Homo sapiens
caagtccttctgatcgag

SEQ ID NO: 18850 - DNA, 20 bp, Homo sapiens
caagtccttctgatcgaggc

SEQ ID NO: 18851 - DNA, 21 bp, Homo sapiens
caagtccttctgatcgaggcc

SEQ ID NO: 18852 - DNA, 22 bp, Homo sapiens
caagtccttctgatcgaggccc

SEQ ID NO: 18853 - DNA, 26 bp, Homo sapiens
caagtccttctgatcgaggcccagcc

SEQ ID NO: 18854 - DNA, 32 bp, Homo sapiens; identical to SEQ ID NO: 4064

SEQ ID NO: 18855 - DNA, 33 bp, Homo sapiens; identical to SEQ ID NO: 4065

SEQ ID NO: 18856 - DNA, 16 bp, Homo sapiens
aagtccttctgatcga

SEQ ID NO: 18857 - DNA, 17 bp, Homo sapiens
aagtccttctgatcgag

SEQ ID NO: 18858 - DNA, 19 bp, Homo sapiens
aagtccttctgatcgaggc

SEQ ID NO: 18859 - DNA, 20 bp, Homo sapiens
aagtccttctgatcgaggcc

SEQ ID NO: 18860 - DNA, 21 bp, Homo sapiens
aagtccttctgatcgaggccc

SEQ ID NO: 18861 - DNA, 25 bp, Homo sapiens
aagtccttctgatcgaggcccagcc

SEQ ID NO: 18862 - DNA, 31 bp, Homo sapiens; identical to SEQ ID NO: 4068

SEQ ID NO: 18863 - DNA, 32 bp, Homo sapiens; identical to SEQ ID NO: 4069

SEQ ID NO: 18864 - DNA, 33 bp, Homo sapiens
aagtccttctgatcgaggcccagcccgtggacg

SEQ ID NO: 18865 - DNA, 16 bp, Homo sapiens
agtccttctgatcgag

SEQ ID NO: 18866 - DNA, 18 bp, Homo sapiens
agtccttctgatcgaggc

SEQ ID NO: 18867 - DNA, 19 bp, Homo sapiens
agtccttctgatcgaggcc

SEQ ID NO: 18868 - DNA, 20 bp, Homo sapiens
agtccttctgatcgaggccc

SEQ ID NO: 18869 - DNA, 24 bp, Homo sapiens
agtccttctgatcgaggcccagcc

SEQ ID NO: 18870 - DNA, 30 bp, Homo sapiens
agtccttctgatcgaggcccagcccgtgga

SEQ ID NO: 18871 - DNA, 31 bp, Homo sapiens; identical to SEQ ID NO: 4070

SEQ ID NO: 18872 - DNA, 32 bp, Homo sapiens
agtccttctgatcgaggcccagcccgtggacg

SEQ ID NO: 18873 - DNA, 18 bp, Homo sapiens
gtccttctgatcgaggcc

SEQ ID NO: 18874 - DNA, 19 bp, Homo sapiens
gtccttctgatcgaggccc

SEQ ID NO: 18875 - DNA, 23 bp, Homo sapiens
gtccttctgatcgaggcccagcc

SEQ ID NO: 18876 - DNA, 29 bp, Homo sapiens
gtccttctgatcgaggcccagcccgtgga

SEQ ID NO: 18877 - DNA, 30 bp, Homo sapiens; identical to SEQ ID NO: 4071

SEQ ID NO: 18878 - DNA, 31 bp, Homo sapiens
gtccttctgatcgaggcccagcccgtggacg

SEQ ID NO: 18879 - DNA, 17 bp, Homo sapiens
tccttctgatcgaggcc

SEQ ID NO: 18880 - DNA, 18 bp, Homo sapiens
tccttctgatcgaggccc

SEQ ID NO: 18881 - DNA, 21 bp, Homo sapiens
tccttctgatcgaggcccagc

SEQ ID NO: 18882 - DNA, 22 bp, Homo sapiens
tccttctgatcgaggcccagcc

SEQ ID NO: 18883 - DNA, 28 bp, Homo sapiens
tccttctgatcgaggcccagcccgtgga

SEQ ID NO: 18884 - DNA, 29 bp, Homo sapiens
tccttctgatcgaggcccagcccgtggac

SEQ ID NO: 18885 - DNA, 30 bp, Homo sapiens; identical to SEQ ID NO: 4076

SEQ ID NO: 18886 - DNA, 16 bp, Homo sapiens
ccttctgatcgaggcc

SEQ ID NO: 18887 - DNA, 17 bp, Homo sapiens
ccttctgatcgaggccc

SEQ ID NO: 18888 - DNA, 20 bp, Homo sapiens
ccttctgatcgaggcccagc

SEQ ID NO: 18889 - DNA, 21 bp, Homo sapiens
ccttctgatcgaggcccagcc

SEQ ID NO: 18890 - DNA, 27 bp, Homo sapiens
ccttctgatcgaggcccagcccgtgga

SEQ ID NO: 18891 - DNA, 28 bp, Homo sapiens
ccttctgatcgaggcccagcccgtggac

SEQ ID NO: 18892 - DNA, 29 bp, Homo sapiens
ccttctgatcgaggcccagcccgtggacg

SEQ ID NO: 18893 - DNA, 16 bp, Homo sapiens
cttctgatcgaggccc

SEQ ID NO: 18894 - DNA, 18 bp, Homo sapiens
cttctgatcgaggcccag

SEQ ID NO: 18895 - DNA, 19 bp, Homo sapiens
cttctgatcgaggcccagc

SEQ ID NO: 18896 - DNA, 20 bp, Homo sapiens
cttctgatcgaggcccagcc

SEQ ID NO: 18897 - DNA, 21 bp, Homo sapiens
cttctgatcgaggcccagccc

SEQ ID NO: 18898 - DNA, 22 bp, Homo sapiens
cttctgatcgaggcccagcccg

SEQ ID NO: 18899 - DNA, 24 bp, Homo sapiens
cttctgatcgaggcccagcccgtg

SEQ ID NO: 18900 - DNA, 26 bp, Homo sapiens
cttctgatcgaggcccagcccgtgga

SEQ ID NO: 18901 - DNA, 27 bp, Homo sapiens
cttctgatcgaggcccagcccgtggac

SEQ ID NO: 18902 - DNA, 28 bp, Homo sapiens
cttctgatcgaggcccagcccgtggacg

SEQ ID NO: 18903 - DNA, 30 bp, Homo sapiens; identical to SEQ ID NO: 4091

SEQ ID NO: 18904 - DNA, 16 bp, Homo sapiens
ttctgatcgaggccca

SEQ ID NO: 18905 - DNA, 17 bp, Homo sapiens
ttctgatcgaggcccag

SEQ ID NO: 18906 - DNA, 18 bp, Homo sapiens
ttctgatcgaggcccagc

SEQ ID NO: 18907 - DNA, 19 bp, Homo sapiens
ttctgatcgaggcccagcc

SEQ ID NO: 18908 - DNA, 20 bp, Homo sapiens
ttctgatcgaggcccagccc

SEQ ID NO: 18909 - DNA, 23 bp, Homo sapiens
ttctgatcgaggcccagcccgtg

SEQ ID NO: 18910 - DNA, 24 bp, Homo sapiens
ttctgatcgaggcccagcccgtgg

SEQ ID NO: 18911 - DNA, 25 bp, Homo sapiens
ttctgatcgaggcccagcccgtgga

SEQ ID NO: 18912 - DNA, 26 bp, Homo sapiens
ttctgatcgaggcccagcccgtggac

SEQ ID NO: 18913 - DNA, 27 bp, Homo sapiens
ttctgatcgaggcccagcccgtggacg

SEQ ID NO: 18914 - DNA, 28 bp, Homo sapiens
ttctgatcgaggcccagcccgtggacgg

SEQ ID NO: 18915 - DNA, 29 bp, Homo sapiens
ttctgatcgaggcccagcccgtggacggt

SEQ ID NO: 18916 - DNA, 30 bp, Homo sapiens
ttctgatcgaggcccagcccgtggacggtg

SEQ ID NO: 18917 - DNA, 31 bp, Homo sapiens
ttctgatcgaggcccagcccgtggacggtgt

SEQ ID NO: 18918 - DNA, 32 bp, Homo sapiens; identical to SEQ ID NO: 4101

SEQ ID NO: 18919 - DNA, 33 bp, Homo sapiens
ttctgatcgaggcccagcccgtggacggtgtga

SEQ ID NO: 18920 - DNA, 16 bp, Homo sapiens
tctgatcgaggcccag

SEQ ID NO: 18921 - DNA, 17 bp, Homo sapiens
tctgatcgaggcccagc

SEQ ID NO: 18922 - DNA, 18 bp, Homo sapiens
tctgatcgaggcccagcc

SEQ ID NO: 18923 - DNA, 24 bp, Homo sapiens
tctgatcgaggcccagcccgtgga

SEQ ID NO: 18924 - DNA, 25 bp, Homo sapiens
tctgatcgaggcccagcccgtggac

SEQ ID NO: 18925 - DNA, 26 bp, Homo sapiens
tctgatcgaggcccagcccgtggacg

SEQ ID NO: 18926 - DNA, 28 bp, Homo sapiens
tctgatcgaggcccagcccgtggacggt

SEQ ID NO: 18927 - DNA, 17 bp, Homo sapiens
ctgatcgaggcccagcc

SEQ ID NO: 18928 - DNA, 24 bp, Homo sapiens
ctgatcgaggcccagcccgtggac

SEQ ID NO: 18929 - DNA, 16 bp, Homo sapiens
tgatcgaggcccagcc

SEQ ID NO: 18930 - DNA, 23 bp, Homo sapiens
tgatcgaggcccagcccgtggac

SEQ ID NO: 18931 - DNA, 24 bp, Homo sapiens
tgatcgaggcccagcccgtggacg

SEQ ID NO: 18932 - DNA, 25 bp, Homo sapiens
tgatcgaggcccagcccgtggacgg

SEQ ID NO: 18933 - DNA, 27 bp, Homo sapiens
tgatcgaggcccagcccgtggacggtg

SEQ ID NO: 18934 - DNA, 29 bp, Homo sapiens
tgatcgaggcccagcccgtggacggtgtg

SEQ ID NO: 18935 - DNA, 31 bp, Homo sapiens
tgatcgaggcccagcccgtggacggtgtgag

SEQ ID NO: 18936 - DNA, 22 bp, Homo sapiens
gatcgaggcccagcccgtggac

SEQ ID NO: 18937 - DNA, 23 bp, Homo sapiens
gatcgaggcccagcccgtggacg

SEQ ID NO: 18938 - DNA, 24 bp, Homo sapiens
gatcgaggcccagcccgtggacgg

SEQ ID NO: 18939 - DNA, 26 bp, Homo sapiens
gatcgaggcccagcccgtggacggtg

SEQ ID NO: 18940 - DNA, 30 bp, Homo sapiens
gatcgaggcccagcccgtggacggtgtgag

SEQ ID NO: 18941 - DNA, 31 bp, Homo sapiens
gatcgaggcccagcccgtggacggtgtgagg

SEQ ID NO: 18942 - DNA, 21 bp, Homo sapiens
atcgaggcccagcccgtggac

SEQ ID NO: 18943 - DNA, 22 bp, Homo sapiens
atcgaggcccagcccgtggacg

SEQ ID NO: 18944 - DNA, 23 bp, Homo sapiens
atcgaggcccagcccgtggacgg

SEQ ID NO: 18945 - DNA, 25 bp, Homo sapiens
atcgaggcccagcccgtggacggtg

SEQ ID NO: 18946 - DNA, 29 bp, Homo sapiens
atcgaggcccagcccgtggacggtgtgag

SEQ ID NO: 18947 - DNA, 30 bp, Homo sapiens
atcgaggcccagcccgtggacggtgtgagg

SEQ ID NO: 18948 - DNA, 20 bp, Homo sapiens
tcgaggcccagcccgtggac

SEQ ID NO: 18949 - DNA, 21 bp, Homo sapiens
tcgaggcccagcccgtggacg

SEQ ID NO: 18950 - DNA, 22 bp, Homo sapiens
tcgaggcccagcccgtggacgg

SEQ ID NO: 18951 - DNA, 27 bp, Homo sapiens
tcgaggcccagcccgtggacggtgtga

SEQ ID NO: 18952 - DNA, 19 bp, Homo sapiens
cgaggcccagcccgtggac

SEQ ID NO: 18953 - DNA, 20 bp, Homo sapiens
cgaggcccagcccgtggacg

SEQ ID NO: 18954 - DNA, 21 bp, Homo sapiens
cgaggcccagcccgtggacgg

SEQ ID NO: 18955 - DNA, 23 bp, Homo sapiens
cgaggcccagcccgtggacggtg

SEQ ID NO: 18956 - DNA, 25 bp, Homo sapiens
cgaggcccagcccgtggacggtgtg

SEQ ID NO: 18957 - DNA, 18 bp, Homo sapiens
gaggcccagcccgtggac

SEQ ID NO: 18958 - DNA, 19 bp, Homo sapiens
gaggcccagcccgtggacg

SEQ ID NO: 18959 - DNA, 20 bp, Homo sapiens
gaggcccagcccgtggacgg

SEQ ID NO: 18960 - DNA, 17 bp, Homo sapiens
aggcccagcccgtggac

SEQ ID NO: 18961 - DNA, 18 bp, Homo sapiens
aggcccagcccgtggacg

SEQ ID NO: 18962 - DNA, 19 bp, Homo sapiens
aggcccagcccgtggacgg

SEQ ID NO: 18963 - DNA, 20 bp, Homo sapiens
aggcccagcccgtggacggt

SEQ ID NO: 18964 - DNA, 26 bp, Homo sapiens
aggcccagcccgtggacggtgtgagg

SEQ ID NO: 18965 - DNA, 27 bp, Homo sapiens
aggcccagcccgtggacggtgtgaggc

SEQ ID NO: 18966 - DNA, 16 bp, Homo sapiens
ggcccagcccgtggac

SEQ ID NO: 18967 - DNA, 26 bp, Homo sapiens
ggcccagcccgtggacggtgtgaggc

SEQ ID NO: 18968 - DNA, 33 bp, Homo sapiens
ggcccagcccgtggacggtgtgaggccggtagc

SEQ ID NO: 18969 - DNA, 16 bp, Homo sapiens
gcccagcccgtggacg

SEQ ID NO: 18970 - DNA, 17 bp, Homo sapiens
gcccagcccgtggacgg

SEQ ID NO: 18971 - DNA, 32 bp, Homo sapiens
gcccagcccgtggacggtgtgaggccggtagc

SEQ ID NO: 18972 - DNA, 16 bp, Homo sapiens
cccagcccgtggacgg

SEQ ID NO: 18973 - DNA, 17 bp, Homo sapiens
cccagcccgtggacggt

SEQ ID NO: 18974 - DNA, 24 bp, Homo sapiens
cccagcccgtggacggtgtgaggc

SEQ ID NO: 18975 - DNA, 25 bp, Homo sapiens
cccagcccgtggacggtgtgaggcc

SEQ ID NO: 18976 - DNA, 31 bp, Homo sapiens
cccagcccgtggacggtgtgaggccggtagc

SEQ ID NO: 18977 - DNA, 24 bp, Homo sapiens
ccagcccgtggacggtgtgaggcc

SEQ ID NO: 18978 - DNA, 27 bp, Homo sapiens
ccagcccgtggacggtgtgaggccggt

SEQ ID NO: 18979 - DNA, 23 bp, Homo sapiens
cagcccgtggacggtgtgaggcc

SEQ ID NO: 18980 - DNA, 26 bp, Homo sapiens
cagcccgtggacggtgtgaggccggt

SEQ ID NO: 18981 - DNA, 29 bp, Homo sapiens
cagcccgtggacggtgtgaggccggtagc

SEQ ID NO: 18982 - DNA, 30 bp, Homo sapiens
cagcccgtggacggtgtgaggccggtagcg

SEQ ID NO: 18983 - DNA, 21 bp, Homo sapiens
agcccgtggacggtgtgaggc

SEQ ID NO: 18984 - DNA, 22 bp, Homo sapiens
agcccgtggacggtgtgaggcc

SEQ ID NO: 18985 - DNA, 25 bp, Homo sapiens
agcccgtggacggtgtgaggccggt

SEQ ID NO: 18986 - DNA, 29 bp, Homo sapiens
agcccgtggacggtgtgaggccggtagcg

SEQ ID NO: 18987 - DNA, 21 bp, Homo sapiens
gcccgtggacggtgtgaggcc

SEQ ID NO: 18988 - DNA, 19 bp, Homo sapiens
cccgtggacggtgtgaggc

SEQ ID NO: 18989 - DNA, 20 bp, Homo sapiens
cccgtggacggtgtgaggcc

SEQ ID NO: 18990 - DNA, 17 bp, Homo sapiens
ccgtggacggtgtgagg

SEQ ID NO: 18991 - DNA, 18 bp, Homo sapiens
ccgtggacggtgtgaggc

SEQ ID NO: 18992 - DNA, 19 bp, Homo sapiens
ccgtggacggtgtgaggcc

SEQ ID NO: 18993 - DNA, 21 bp, Homo sapiens
ccgtggacggtgtgaggccgg

SEQ ID NO: 18994 - DNA, 22 bp, Homo sapiens
ccgtggacggtgtgaggccggt

SEQ ID NO: 18995 - DNA, 25 bp, Homo sapiens
ccgtggacggtgtgaggccggtagc

SEQ ID NO: 18996 - DNA, 26 bp, Homo sapiens
ccgtggacggtgtgaggccggtagcg

SEQ ID NO: 18997 - DNA, 16 bp, Homo sapiens
cgtggacggtgtgagg

SEQ ID NO: 18998 - DNA, 17 bp, Homo sapiens
cgtggacggtgtgaggc

SEQ ID NO: 18999 - DNA, 18 bp, Homo sapiens
cgtggacggtgtgaggcc

SEQ ID NO: 19000 - DNA, 19 bp, Homo sapiens
cgtggacggtgtgaggccg

SEQ ID NO: 19001 - DNA, 20 bp, Homo sapiens
cgtggacggtgtgaggccgg

SEQ ID NO: 19002 - DNA, 21 bp, Homo sapiens
cgtggacggtgtgaggccggt

SEQ ID NO: 19003 - DNA, 22 bp, Homo sapiens
cgtggacggtgtgaggccggta

SEQ ID NO: 19004 - DNA, 23 bp, Homo sapiens
cgtggacggtgtgaggccggtag

SEQ ID NO: 19005 - DNA, 24 bp, Homo sapiens
cgtggacggtgtgaggccggtagc

SEQ ID NO: 19006 - DNA, 25 bp, Homo sapiens
cgtggacggtgtgaggccggtagcg

SEQ ID NO: 19007 - DNA, 27 bp, Homo sapiens
cgtggacggtgtgaggccggtagcggc

SEQ ID NO: 19008 - DNA, 28 bp, Homo sapiens
cgtggacggtgtgaggccggtagcggcc

SEQ ID NO: 19009 - DNA, 29 bp, Homo sapiens
cgtggacggtgtgaggccggtagcggccc

SEQ ID NO: 19010 - DNA, 30 bp, Homo sapiens; identical to SEQ ID NO: 4140

SEQ ID NO: 19011 - DNA, 31 bp, Homo sapiens; identical to SEQ ID NO: 4141

SEQ ID NO: 19012 - DNA, 44 bp, Homo sapiens
cgtggacggtgtgaggccggtagcggcccccggcgcgccgggcc

SEQ ID NO: 19013 - DNA, 45 bp, Homo sapiens
cgtggacggtgtgaggccggtagcggcccccggcgcgccgggccc

SEQ ID NO: 19014 - DNA, 16 bp, Homo sapiens
gtggacggtgtgaggc

SEQ ID NO: 19015 - DNA, 17 bp, Homo sapiens
gtggacggtgtgaggcc

SEQ ID NO: 19016 - DNA, 19 bp, Homo sapiens
gtggacggtgtgaggccgg

SEQ ID NO: 19017 - DNA, 20 bp, Homo sapiens
gtggacggtgtgaggccggt

SEQ ID NO: 19018 - DNA, 23 bp, Homo sapiens
gtggacggtgtgaggccggtagc

SEQ ID NO: 19019 - DNA, 27 bp, Homo sapiens
gtggacggtgtgaggccggtagcggcc

SEQ ID NO: 19020 - DNA, 16 bp, Homo sapiens
tggacggtgtgaggcc

SEQ ID NO: 19021 - DNA, 26 bp, Homo sapiens
tggacggtgtgaggccggtagcggcc

SEQ ID NO: 19022 - DNA, 17 bp, Homo sapiens
ggtgtgaggccggtagc

SEQ ID NO: 19023 - DNA, 16 bp, Homo sapiens
gtgtgaggccggtagc

SEQ ID NO: 19024 - DNA, 27 bp, Homo sapiens
cggtagcggcccccggcgcgccgggcc

SEQ ID NO: 19025 - DNA, 28 bp, Homo sapiens
cggtagcggcccccggcgcgccgggccc

SEQ ID NO: 19026 - DNA, 25 bp, Homo sapiens
ggtagcggcccccggcgcgccgggc

SEQ ID NO: 19027 - DNA, 26 bp, Homo sapiens
ggtagcggcccccggcgcgccgggcc

SEQ ID NO: 19028 - DNA, 27 bp, Homo sapiens
ggtagcggcccccggcgcgccgggccc

SEQ ID NO: 19029 - DNA, 24 bp, Homo sapiens
gtagcggcccccggcgcgccgggc

SEQ ID NO: 19030 - DNA, 25 bp, Homo sapiens
gtagcggcccccggcgcgccgggcc

SEQ ID NO: 19031 - DNA, 26 bp, Homo sapiens
gtagcggcccccggcgcgccgggccc

SEQ ID NO: 19032 - DNA, 23 bp, Homo sapiens
tagcggcccccggcgcgccgggc

SEQ ID NO: 19033 - DNA, 22 bp, Homo sapiens
agcggcccccggcgcgccgggc

SEQ ID NO: 19034 - DNA, 23 bp, Homo sapiens
agcggcccccggcgcgccgggcc

SEQ ID NO: 19035 - DNA, 21 bp, Homo sapiens
gcggcccccggcgcgccgggc

SEQ ID NO: 19036 - DNA, 22 bp, Homo sapiens
gcggcccccggcgcgccgggcc

SEQ ID NO: 19037 - DNA, 20 bp, Homo sapiens
cggcccccggcgcgccgggc

SEQ ID NO: 19038 - DNA, 21 bp, Homo sapiens
cggcccccggcgcgccgggcc

SEQ ID NO: 19039 - DNA, 19 bp, Homo sapiens
ggcccccggcgcgccgggc

SEQ ID NO: 19040 - DNA, 27 bp, Homo sapiens
ggcgcgccgggcccgggtcttcccgga

SEQ ID NO: 19041 - DNA, 26 bp, Homo sapiens
gcgcgccgggcccgggtcttcccgga

SEQ ID NO: 19042 - DNA, 17 bp, Homo sapiens
cgcgccgggcccgggtc

SEQ ID NO: 19043 - DNA, 21 bp, Homo sapiens
cgcgccgggcccgggtcttcc

SEQ ID NO: 19044 - DNA, 22 bp, Homo sapiens
cgcgccgggcccgggtcttccc

SEQ ID NO: 19045 - DNA, 23 bp, Homo sapiens
cgcgccgggcccgggtcttcccg

SEQ ID NO: 19046 - DNA, 25 bp, Homo sapiens
cgcgccgggcccgggtcttcccgga

SEQ ID NO: 19047 - DNA, 21 bp, Homo sapiens
gcgccgggcccgggtcttccc

SEQ ID NO: 19048 - DNA, 18 bp, Homo sapiens
cgccgggcccgggtcttc

SEQ ID NO: 19049 - DNA, 19 bp, Homo sapiens
cgccgggcccgggtcttcc

SEQ ID NO: 19050 - DNA, 20 bp, Homo sapiens
cgccgggcccgggtcttccc

SEQ ID NO: 19051 - DNA, 21 bp, Homo sapiens
cgccgggcccgggtcttcccg

SEQ ID NO: 19052 - DNA, 23 bp, Homo sapiens
cgccgggcccgggtcttcccgga

SEQ ID NO: 19053 - DNA, 19 bp, Homo sapiens
gccgggcccgggtcttccc

SEQ ID NO: 19054 - DNA, 22 bp, Homo sapiens
gccgggcccgggtcttcccgga

SEQ ID NO: 19055 - DNA, 16 bp, Homo sapiens
ccgggcccgggtcttc

SEQ ID NO: 19056 - DNA, 17 bp, Homo sapiens
ccgggcccgggtcttcc

SEQ ID NO: 19057 - DNA, 18 bp, Homo sapiens
ccgggcccgggtcttccc

SEQ ID NO: 19058 - DNA, 19 bp, Homo sapiens
ccgggcccgggtcttcccg

SEQ ID NO: 19059 - DNA, 21 bp, Homo sapiens
ccgggcccgggtcttcccgga

SEQ ID NO: 19060 - DNA, 16 bp, Homo sapiens
cgggcccgggtcttcc

SEQ ID NO: 19061 - DNA, 17 bp, Homo sapiens
cgggcccgggtcttccc

SEQ ID NO: 19062 - DNA, 28 bp, Homo sapiens
cgggcccgggtcttcccggagtcgggtt

SEQ ID NO: 19063 - DNA, 27 bp, Homo sapiens
gggcccgggtcttcccggagtcgggtt

SEQ ID NO: 19064 - DNA, 30 bp, Homo sapiens
gggcccgggtcttcccggagtcgggttgct

SEQ ID NO: 19065 - DNA, 29 bp, Homo sapiens
ggcccgggtcttcccggagtcgggttgct

SEQ ID NO: 19066 - DNA, 33 bp, Homo sapiens
gcccgggtcttcccggagtcgggttgcttggga

SEQ ID NO: 19067 - DNA, 23 bp, Homo sapiens
ccgggtcttcccggagtcgggtt

SEQ ID NO: 19068 - DNA, 20 bp, Homo sapiens
cgggtcttcccggagtcggg

SEQ ID NO: 19069 - DNA, 21 bp, Homo sapiens
cgggtcttcccggagtcgggt

SEQ ID NO: 19070 - DNA, 22 bp, Homo sapiens
cgggtcttcccggagtcgggtt

SEQ ID NO: 19071 - DNA, 23 bp, Homo sapiens
cgggtcttcccggagtcgggttg

SEQ ID NO: 19072 - DNA, 24 bp, Homo sapiens
cgggtcttcccggagtcgggttgc

SEQ ID NO: 19073 - DNA, 25 bp, Homo sapiens
cgggtcttcccggagtcgggttgct

SEQ ID NO: 19074 - DNA, 26 bp, Homo sapiens
cgggtcttcccggagtcgggttgctt

SEQ ID NO: 19075 - DNA, 30 bp, Homo sapiens
cgggtcttcccggagtcgggttgcttggga

SEQ ID NO: 19076 - DNA, 31 bp, Homo sapiens
cgggtcttcccggagtcgggttgcttgggaa

SEQ ID NO: 19077 - DNA, 32 bp, Homo sapiens
cgggtcttcccggagtcgggttgcttgggaat

SEQ ID NO: 19078 - DNA, 33 bp, Homo sapiens
cgggtcttcccggagtcgggttgcttgggaatg

SEQ ID NO: 19079 - DNA, 20 bp, Homo sapiens
gggtcttcccggagtcgggt

SEQ ID NO: 19080 - DNA, 21 bp, Homo sapiens
gggtcttcccggagtcgggtt

SEQ ID NO: 19081 - DNA, 22 bp, Homo sapiens
gggtcttcccggagtcgggttg

SEQ ID NO: 19082 - DNA, 23 bp, Homo sapiens
gggtcttcccggagtcgggttgc

SEQ ID NO: 19083 - DNA, 24 bp, Homo sapiens
gggtcttcccggagtcgggttgct

SEQ ID NO: 19084 - DNA, 29 bp, Homo sapiens
gggtcttcccggagtcgggttgcttggga

SEQ ID NO: 19085 - DNA, 30 bp, Homo sapiens
gggtcttcccggagtcgggttgcttgggaa

SEQ ID NO: 19086 - DNA, 31 bp, Homo sapiens
gggtcttcccggagtcgggttgcttgggaat

SEQ ID NO: 19087 - DNA, 32 bp, Homo sapiens
gggtcttcccggagtcgggttgcttgggaatg

SEQ ID NO: 19088 - DNA, 33 bp, Homo sapiens
gggtcttcccggagtcgggttgcttgggaatgc

SEQ ID NO: 19089 - DNA, 22 bp, Homo sapiens
ggtcttcccggagtcgggttgc

SEQ ID NO: 19090 - DNA, 32 bp, Homo sapiens
ggtcttcccggagtcgggttgcttgggaatgc

SEQ ID NO: 19091 - DNA, 17 bp, Homo sapiens
cttcccggagtcgggtt

SEQ ID NO: 19092 - DNA, 20 bp, Homo sapiens
cttcccggagtcgggttgct

SEQ ID NO: 19093 - DNA, 21 bp, Homo sapiens
cttcccggagtcgggttgctt

SEQ ID NO: 19094 - DNA, 16 bp, Homo sapiens
ttcccggagtcgggtt

SEQ ID NO: 19095 - DNA, 19 bp, Homo sapiens
ttcccggagtcgggttgct

SEQ ID NO: 19096 - DNA, 20 bp, Homo sapiens
ttcccggagtcgggttgctt

SEQ ID NO: 19097 - DNA, 18 bp, Homo sapiens
tcccggagtcgggttgct

SEQ ID NO: 19098 - DNA, 17 bp, Homo sapiens
cccggagtcgggttgct

SEQ ID NO: 19099 - DNA, 27 bp, Homo sapiens
cggagtcgggttgcttgggaatgcagc

SEQ ID NO: 19100 - DNA, 26 bp, Homo sapiens
ggagtcgggttgcttgggaatgcagc

SEQ ID NO: 19101 - DNA, 27 bp, Homo sapiens
ggagtcgggttgcttgggaatgcagcc

SEQ ID NO: 19102 - DNA, 17 bp, Homo sapiens
gtcgggttgcttgggaa

SEQ ID NO: 19103 - DNA, 18 bp, Homo sapiens
tcgggttgcttgggaatg

SEQ ID NO: 19104 - DNA, 29 bp, Homo sapiens
ttgcttgggaatgcagcccaaagcgggtg

SEQ ID NO: 19105 - DNA, 28 bp, Homo sapiens
tgcttgggaatgcagcccaaagcgggtg

SEQ ID NO: 19106 - DNA, 27 bp, Homo sapiens
gcttgggaatgcagcccaaagcgggtg

SEQ ID NO: 19107 - DNA, 25 bp, Homo sapiens
ttgggaatgcagcccaaagcgggtg

SEQ ID NO: 19108 - DNA, 24 bp, Homo sapiens
tgggaatgcagcccaaagcgggtg

SEQ ID NO: 19109 - DNA, 32 bp, Homo sapiens
tgggaatgcagcccaaagcgggtggtaaactc

SEQ ID NO: 19110 - DNA, 33 bp, Homo sapiens
tgggaatgcagcccaaagcgggtggtaaactcc

SEQ ID NO: 19111 - DNA, 17 bp, Homo sapiens
gcagcccaaagcgggtg

SEQ ID NO: 19112 - DNA, 19 bp, Homo sapiens
ccaaagcgggtggtaaact

SEQ ID NO: 19113 - DNA, 18 bp, Homo sapiens
caaagcgggtggtaaact

SEQ ID NO: 19114 - DNA, 30 bp, Homo sapiens
caaagcgggtggtaaactccatctaaggct

SEQ ID NO: 19115 - DNA, 17 bp, Homo sapiens
aaagcgggtggtaaact

SEQ ID NO: 19116 - DNA, 18 bp, Homo sapiens
aaagcgggtggtaaactc

SEQ ID NO: 19117 - DNA, 19 bp, Homo sapiens
aaagcgggtggtaaactcc

SEQ ID NO: 19118 - DNA, 22 bp, Homo sapiens
aaagcgggtggtaaactccatc

SEQ ID NO: 19119 - DNA, 16 bp, Homo sapiens
aagcgggtggtaaact

SEQ ID NO: 19120 - DNA, 17 bp, Homo sapiens
aagcgggtggtaaactc

SEQ ID NO: 19121 - DNA, 18 bp, Homo sapiens
aagcgggtggtaaactcc

SEQ ID NO: 19122 - DNA, 21 bp, Homo sapiens
aagcgggtggtaaactccatc

SEQ ID NO: 19123 - DNA, 23 bp, Homo sapiens
aagcgggtggtaaactccatcta

SEQ ID NO: 19124 - DNA, 27 bp, Homo sapiens
aagcgggtggtaaactccatctaaggc

SEQ ID NO: 19125 - DNA, 28 bp, Homo sapiens
aagcgggtggtaaactccatctaaggct

SEQ ID NO: 19126 - DNA, 16 bp, Homo sapiens
agcgggtggtaaactc

SEQ ID NO: 19127 - DNA, 17 bp, Homo sapiens
agcgggtggtaaactcc

SEQ ID NO: 19128 - DNA, 20 bp, Homo sapiens
agcgggtggtaaactccatc

SEQ ID NO: 19129 - DNA, 22 bp, Homo sapiens
agcgggtggtaaactccatcta

SEQ ID NO: 19130 - DNA, 16 bp, Homo sapiens
gcgggtggtaaactcc

SEQ ID NO: 19131 - DNA, 19 bp, Homo sapiens
gcgggtggtaaactccatc

SEQ ID NO: 19132 - DNA, 26 bp, Homo sapiens
gcgggtggtaaactccatctaaggct

SEQ ID NO: 19133 - DNA, 20 bp, Homo sapiens
ggtaaactccatctaaggct

SEQ ID NO: 19134 - DNA, 18 bp, Homo sapiens
gtaaactccatctaaggc

SEQ ID NO: 19135 - DNA, 19 bp, Homo sapiens
gtaaactccatctaaggct

SEQ ID NO: 19136 - DNA, 18 bp, Homo sapiens
taaactccatctaaggct

SEQ ID NO: 19137 - DNA, 16 bp, Homo sapiens
aaactccatctaaggc

SEQ ID NO: 19138 - DNA, 17 bp, Homo sapiens
aaactccatctaaggct

SEQ ID NO: 19139 - DNA, 33 bp, Homo sapiens
aaactccatctaaggctaaataccggcacgaga

SEQ ID NO: 19140 - DNA, 16 bp, Homo sapiens
aactccatctaaggct

SEQ ID NO: 19141 - DNA, 17 bp, Homo sapiens
aactccatctaaggcta

SEQ ID NO: 19142 - DNA, 18 bp, Homo sapiens
aactccatctaaggctaa

SEQ ID NO: 19143 - DNA, 19 bp, Homo sapiens
aactccatctaaggctaaa

SEQ ID NO: 19144 - DNA, 21 bp, Homo sapiens
aactccatctaaggctaaata

SEQ ID NO: 19145 - DNA, 32 bp, Homo sapiens
aactccatctaaggctaaataccggcacgaga

SEQ ID NO: 19146 - DNA, 16 bp, Homo sapiens
actccatctaaggcta

SEQ ID NO: 19147 - DNA, 17 bp, Homo sapiens
actccatctaaggctaa

SEQ ID NO: 19148 - DNA, 18 bp, Homo sapiens
actccatctaaggctaaa

SEQ ID NO: 19149 - DNA, 20 bp, Homo sapiens
actccatctaaggctaaata

SEQ ID NO: 19150 - DNA, 31 bp, Homo sapiens
actccatctaaggctaaataccggcacgaga

SEQ ID NO: 19151 - DNA, 32 bp, Homo sapiens
actccatctaaggctaaataccggcacgagac

SEQ ID NO: 19152 - DNA, 16 bp, Homo sapiens
ctccatctaaggctaa

SEQ ID NO: 19153 - DNA, 17 bp, Homo sapiens
ctccatctaaggctaaa

SEQ ID NO: 19154 - DNA, 19 bp, Homo sapiens
ctccatctaaggctaaata

SEQ ID NO: 19155 - DNA, 30 bp, Homo sapiens
ctccatctaaggctaaataccggcacgaga

SEQ ID NO: 19156 - DNA, 25 bp, Homo sapiens
ccatctaaggctaaataccggcacg

SEQ ID NO: 19157 - DNA, 27 bp, Homo sapiens
ccatctaaggctaaataccggcacgag

SEQ ID NO: 19158 - DNA, 28 bp, Homo sapiens
ccatctaaggctaaataccggcacgaga

SEQ ID NO: 19159 - DNA, 29 bp, Homo sapiens
ccatctaaggctaaataccggcacgagac

SEQ ID NO: 19160 - DNA, 16 bp, Homo sapiens
atctaaggctaaatac

SEQ ID NO: 19161 - DNA, 23 bp, Homo sapiens
atctaaggctaaataccggcacg

SEQ ID NO: 19162 - DNA, 28 bp, Homo sapiens
atctaaggctaaataccggcacgagacc

SEQ ID NO: 19163 - DNA, 29 bp, Homo sapiens
atctaaggctaaataccggcacgagaccg

SEQ ID NO: 19164 - DNA, 24 bp, Homo sapiens
aaggctaaataccggcacgagacc

SEQ ID NO: 19165 - DNA, 25 bp, Homo sapiens
aaggctaaataccggcacgagaccg

SEQ ID NO: 19166 - DNA, 40 bp, Homo sapiens
aaggctaaataccggcacgagaccgatagtcaacaagtac

SEQ ID NO: 19167 - DNA, 36 bp, Homo sapiens
ctaaataccggcacgagaccgatagtcaacaagtac

SEQ ID NO: 19168 - DNA, 17 bp, Homo sapiens
aaataccggcacgagac

SEQ ID NO: 19169 - DNA, 18 bp, Homo sapiens
aaataccggcacgagacc

SEQ ID NO: 19170 - DNA, 19 bp, Homo sapiens
aaataccggcacgagaccg

SEQ ID NO: 19171 - DNA, 31 bp, Homo sapiens
aaataccggcacgagaccgatagtcaacaag

SEQ ID NO: 19172 - DNA, 33 bp, Homo sapiens
aaataccggcacgagaccgatagtcaacaagta

SEQ ID NO: 19173 - DNA, 34 bp, Homo sapiens
aaataccggcacgagaccgatagtcaacaagtac

SEQ ID NO: 19174 - DNA, 16 bp, Homo sapiens
aataccggcacgagac

SEQ ID NO: 19175 - DNA, 17 bp, Homo sapiens
aataccggcacgagacc

SEQ ID NO: 19176 - DNA, 33 bp, Homo sapiens
aataccggcacgagaccgatagtcaacaagtac

SEQ ID NO: 19177 - DNA, 16 bp, Homo sapiens
ataccggcacgagacc

SEQ ID NO: 19178 - DNA, 29 bp, Homo sapiens
ataccggcacgagaccgatagtcaacaag

SEQ ID NO: 19179 - DNA, 31 bp, Homo sapiens
ataccggcacgagaccgatagtcaacaagta

SEQ ID NO: 19180 - DNA, 32 bp, Homo sapiens
ataccggcacgagaccgatagtcaacaagtac

SEQ ID NO: 19181 - DNA, 26 bp, Homo sapiens
ccggcacgagaccgatagtcaacaag

SEQ ID NO: 19182 - DNA, 28 bp, Homo sapiens
ccggcacgagaccgatagtcaacaagta

SEQ ID NO: 19183 - DNA, 29 bp, Homo sapiens
ccggcacgagaccgatagtcaacaagtac

SEQ ID NO: 19184 - DNA, 24 bp, Homo sapiens
ggcacgagaccgatagtcaacaag

SEQ ID NO: 19185 - DNA, 26 bp, Homo sapiens
ggcacgagaccgatagtcaacaagta

SEQ ID NO: 19186 - DNA, 27 bp, Homo sapiens
ggcacgagaccgatagtcaacaagtac

SEQ ID NO: 19187 - DNA, 25 bp, Homo sapiens
cacgagaccgatagtcaacaagtac

SEQ ID NO: 19188 - DNA, 17 bp, Homo sapiens
cgagaccgatagtcaac

SEQ ID NO: 19189 - DNA, 18 bp, Homo sapiens
cgagaccgatagtcaaca

SEQ ID NO: 19190 - DNA, 19 bp, Homo sapiens
cgagaccgatagtcaacaa

SEQ ID NO: 19191 - DNA, 22 bp, Homo sapiens
cgagaccgatagtcaacaagta

SEQ ID NO: 19192 - DNA, 23 bp, Homo sapiens
cgagaccgatagtcaacaagtac

SEQ ID NO: 19193 - DNA, 25 bp, Homo sapiens
cgagaccgatagtcaacaagtaccg

SEQ ID NO: 19194 - DNA, 27 bp, Homo sapiens
cgagaccgatagtcaacaagtaccgta

SEQ ID NO: 19195 - DNA, 28 bp, Homo sapiens
cgagaccgatagtcaacaagtaccgtaa

SEQ ID NO: 19196 - DNA, 30 bp, Homo sapiens
cgagaccgatagtcaacaagtaccgtaagg

SEQ ID NO: 19197 - DNA, 32 bp, Homo sapiens
cgagaccgatagtcaacaagtaccgtaaggga

SEQ ID NO: 19198 - DNA, 21 bp, Homo sapiens
agaccgatagtcaacaagtac

SEQ ID NO: 19199 - DNA, 20 bp, Homo sapiens
gaccgatagtcaacaagtac

SEQ ID NO: 19200 - DNA, 24 bp, Homo sapiens
gaccgatagtcaacaagtaccgta

SEQ ID NO: 19201 - DNA, 19 bp, Homo sapiens
accgatagtcaacaagtac

SEQ ID NO: 19202 - DNA, 16 bp, Homo sapiens
ccgatagtcaacaagt

SEQ ID NO: 19203 - DNA, 17 bp, Homo sapiens
ccgatagtcaacaagta

SEQ ID NO: 19204 - DNA, 18 bp, Homo sapiens
ccgatagtcaacaagtac

SEQ ID NO: 19205 - DNA, 22 bp, Homo sapiens
ccgatagtcaacaagtaccgta

SEQ ID NO: 19206 - DNA, 16 bp, Homo sapiens
gatagtcaacaagtac

SEQ ID NO: 19207 - DNA, 17 bp, Homo sapiens
gatagtcaacaagtacc

SEQ ID NO: 19208 - DNA, 23 bp, Homo sapiens
caacaagtaccgtaagggaaagt

SEQ ID NO: 19209 - DNA, 18 bp, Homo sapiens
cgtaagggaaagttgaaa

SEQ ID NO: 19210 - DNA, 20 bp, Homo sapiens
cgtaagggaaagttgaaaag

SEQ ID NO: 19211 - DNA, 21 bp, Homo sapiens
cgtaagggaaagttgaaaaga

SEQ ID NO: 19212 - DNA, 22 bp, Homo sapiens
cgtaagggaaagttgaaaagaa

SEQ ID NO: 19213 - DNA, 23 bp, Homo sapiens
cgtaagggaaagttgaaaagaac

SEQ ID NO: 19214 - DNA, 24 bp, Homo sapiens
cgtaagggaaagttgaaaagaact

SEQ ID NO: 19215 - DNA, 25 bp, Homo sapiens
cgtaagggaaagttgaaaagaactt

SEQ ID NO: 19216 - DNA, 26 bp, Homo sapiens
cgtaagggaaagttgaaaagaacttt

SEQ ID NO: 19217 - DNA, 35 bp, Homo sapiens
cgtaagggaaagttgaaaagaactttgaagagaga

SEQ ID NO: 19218 - DNA, 36 bp, Homo sapiens
cgtaagggaaagttgaaaagaactttgaagagagag

SEQ ID NO: 19219 - DNA, 37 bp, Homo sapiens
cgtaagggaaagttgaaaagaactttgaagagagagt

SEQ ID NO: 19220 - DNA, 38 bp, Homo sapiens
cgtaagggaaagttgaaaagaactttgaagagagagtt

SEQ ID NO: 19221 - DNA, 39 bp, Homo sapiens
cgtaagggaaagttgaaaagaactttgaagagagagttc

SEQ ID NO: 19222 - DNA, 40 bp, Homo sapiens
cgtaagggaaagttgaaaagaactttgaagagagagttca

SEQ ID NO: 19223 - DNA, 44 bp, Homo sapiens
cgtaagggaaagttgaaaagaactttgaagagagagttcaagag

SEQ ID NO: 19224 - DNA, 22 bp, Homo sapiens
gtaagggaaagttgaaaagaac

SEQ ID NO: 19225 - DNA, 23 bp, Homo sapiens
gtaagggaaagttgaaaagaact

SEQ ID NO: 19226 - DNA, 37 bp, Homo sapiens
gtaagggaaagttgaaaagaactttgaagagagagtt

SEQ ID NO: 19227 - DNA, 22 bp, Homo sapiens
taagggaaagttgaaaagaact

SEQ ID NO: 19228 - DNA, 21 bp, Homo sapiens
aagggaaagttgaaaagaact

SEQ ID NO: 19229 - DNA, 23 bp, Homo sapiens
aagggaaagttgaaaagaacttt

SEQ ID NO: 19230 - DNA, 20 bp, Homo sapiens
agggaaagttgaaaagaact

SEQ ID NO: 19231 - DNA, 31 bp, Homo sapiens
agggaaagttgaaaagaactttgaagagaga

SEQ ID NO: 19232 - DNA, 33 bp, Homo sapiens
agggaaagttgaaaagaactttgaagagagagt

SEQ ID NO: 19233 - DNA, 30 bp, Homo sapiens
gggaaagttgaaaagaactttgaagagaga

SEQ ID NO: 19234 - DNA, 32 bp, Homo sapiens
gggaaagttgaaaagaactttgaagagagagt

SEQ ID NO: 19235 - DNA, 33 bp, Homo sapiens; identical to SEQ ID NO: 4179

SEQ ID NO: 19236 - DNA, 32 bp, Homo sapiens; identical to SEQ ID NO: 4180

SEQ ID NO: 19237 - DNA, 26 bp, Homo sapiens
aagttgaaaagaactttgaagagaga

SEQ ID NO: 19238 - DNA, 25 bp, Homo sapiens
agttgaaaagaactttgaagagaga

SEQ ID NO: 19239 - DNA, 28 bp, Homo sapiens
agttgaaaagaactttgaagagagagtt

SEQ ID NO: 19240 - DNA, 30 bp, Homo sapiens
agttgaaaagaactttgaagagagagttca

SEQ ID NO: 19241 - DNA, 33 bp, Homo sapiens
agttgaaaagaactttgaagagagagttcaaga

SEQ ID NO: 19242 - DNA, 24 bp, Homo sapiens
gttgaaaagaactttgaagagaga

SEQ ID NO: 19243 - DNA, 29 bp, Homo sapiens
gttgaaaagaactttgaagagagagttca

SEQ ID NO: 19244 - DNA, 32 bp, Homo sapiens
gttgaaaagaactttgaagagagagttcaaga

SEQ ID NO: 19245 - DNA, 21 bp, Homo sapiens
tgaaaagaactttgaagagag

SEQ ID NO: 19246 - DNA, 22 bp, Homo sapiens
tgaaaagaactttgaagagaga

SEQ ID NO: 19247 - DNA, 23 bp, Homo sapiens
tgaaaagaactttgaagagagag

SEQ ID NO: 19248 - DNA, 24 bp, Homo sapiens
tgaaaagaactttgaagagagagt

SEQ ID NO: 19249 - DNA, 25 bp, Homo sapiens
tgaaaagaactttgaagagagagtt

SEQ ID NO: 19250 - DNA, 26 bp, Homo sapiens
tgaaaagaactttgaagagagagttc

SEQ ID NO: 19251 - DNA, 27 bp, Homo sapiens
tgaaaagaactttgaagagagagttca

SEQ ID NO: 19252 - DNA, 28 bp, Homo sapiens
tgaaaagaactttgaagagagagttcaa

SEQ ID NO: 19253 - DNA, 29 bp, Homo sapiens
tgaaaagaactttgaagagagagttcaag

SEQ ID NO: 19254 - DNA, 30 bp, Homo sapiens
tgaaaagaactttgaagagagagttcaaga

SEQ ID NO: 19255 - DNA, 31 bp, Homo sapiens
tgaaaagaactttgaagagagagttcaagag

SEQ ID NO: 19256 - DNA, 32 bp, Homo sapiens
tgaaaagaactttgaagagagagttcaagagg

SEQ ID NO: 19257 - DNA, 20 bp, Homo sapiens
gaaaagaactttgaagagag

SEQ ID NO: 19258 - DNA, 21 bp, Homo sapiens
gaaaagaactttgaagagaga

SEQ ID NO: 19259 - DNA, 22 bp, Homo sapiens
gaaaagaactttgaagagagag

SEQ ID NO: 19260 - DNA, 23 bp, Homo sapiens
gaaaagaactttgaagagagagt

SEQ ID NO: 19261 - DNA, 24 bp, Homo sapiens
gaaaagaactttgaagagagagtt

SEQ ID NO: 19262 - DNA, 25 bp, Homo sapiens
gaaaagaactttgaagagagagttc

SEQ ID NO: 19263 - DNA, 26 bp, Homo sapiens
gaaaagaactttgaagagagagttca

SEQ ID NO: 19264 - DNA, 28 bp, Homo sapiens
gaaaagaactttgaagagagagttcaag

SEQ ID NO: 19265 - DNA, 32 bp, Homo sapiens
gaaaagaactttgaagagagagttcaagaggg

SEQ ID NO: 19266 - DNA, 33 bp, Homo sapiens
gaaaagaactttgaagagagagttcaagagggc

SEQ ID NO: 19267 - DNA, 19 bp, Homo sapiens
aaaagaactttgaagagag

SEQ ID NO: 19268 - DNA, 20 bp, Homo sapiens
aaaagaactttgaagagaga

SEQ ID NO: 19269 - DNA, 21 bp, Homo sapiens
aaaagaactttgaagagagag

SEQ ID NO: 19270 - DNA, 22 bp, Homo sapiens
aaaagaactttgaagagagagt

SEQ ID NO: 19271 - DNA, 23 bp, Homo sapiens
aaaagaactttgaagagagagtt

SEQ ID NO: 19272 - DNA, 27 bp, Homo sapiens
aaaagaactttgaagagagagttcaag

SEQ ID NO: 19273 - DNA, 33 bp, Homo sapiens
aaaagaactttgaagagagagttcaagagggcg

SEQ ID NO: 19274 - DNA, 16 bp, Homo sapiens
aaagaactttgaagag

SEQ ID NO: 19275 - DNA, 18 bp, Homo sapiens
aaagaactttgaagagag

SEQ ID NO: 19276 - DNA, 19 bp, Homo sapiens
aaagaactttgaagagaga

SEQ ID NO: 19277 - DNA, 20 bp, Homo sapiens
aaagaactttgaagagagag

SEQ ID NO: 19278 - DNA, 21 bp, Homo sapiens
aaagaactttgaagagagagt

SEQ ID NO: 19279 - DNA, 22 bp, Homo sapiens
aaagaactttgaagagagagtt

SEQ ID NO: 19280 - DNA, 23 bp, Homo sapiens
aaagaactttgaagagagagttc

SEQ ID NO: 19281 - DNA, 24 bp, Homo sapiens
aaagaactttgaagagagagttca

SEQ ID NO: 19282 - DNA, 25 bp, Homo sapiens
aaagaactttgaagagagagttcaa

SEQ ID NO: 19283 - DNA, 26 bp, Homo sapiens
aaagaactttgaagagagagttcaag

SEQ ID NO: 19284 - DNA, 17 bp, Homo sapiens
aagaactttgaagagag

SEQ ID NO: 19285 - DNA, 18 bp, Homo sapiens
aagaactttgaagagaga

SEQ ID NO: 19286 - DNA, 20 bp, Homo sapiens
aagaactttgaagagagagt

SEQ ID NO: 19287 - DNA, 21 bp, Homo sapiens
aagaactttgaagagagagtt

SEQ ID NO: 19288 - DNA, 22 bp, Homo sapiens
aagaactttgaagagagagttc

SEQ ID NO: 19289 - DNA, 23 bp, Homo sapiens
aagaactttgaagagagagttca

SEQ ID NO: 19290 - DNA, 17 bp, Homo sapiens
agaactttgaagagaga

SEQ ID NO: 19291 - DNA, 23 bp, Homo sapiens
tgaagagagagttcaagagggcg

SEQ ID NO: 19292 - DNA, 24 bp, Homo sapiens
tgaagagagagttcaagagggcgt

SEQ ID NO: 19293 - DNA, 21 bp, Homo sapiens
gaagagagagttcaagagggc

SEQ ID NO: 19294 - DNA, 22 bp, Homo sapiens
gaagagagagttcaagagggcg

SEQ ID NO: 19295 - DNA, 23 bp, Homo sapiens
gaagagagagttcaagagggcgt

SEQ ID NO: 19296 - DNA, 19 bp, Homo sapiens
agagagagttcaagagggc

SEQ ID NO: 19297 - DNA, 18 bp, Homo sapiens
gagagagttcaagagggc

SEQ ID NO: 19298 - DNA, 19 bp, Homo sapiens
gagagagttcaagagggcg

SEQ ID NO: 19299 - DNA, 28 bp, Homo sapiens
tcaagagggcgtgaaaccgttaagaggt

SEQ ID NO: 19300 - DNA, 29 bp, Homo sapiens
tcaagagggcgtgaaaccgttaagaggta

SEQ ID NO: 19301 - DNA, 27 bp, Homo sapiens
caagagggcgtgaaaccgttaagaggt

SEQ ID NO: 19302 - DNA, 28 bp, Homo sapiens
caagagggcgtgaaaccgttaagaggta

SEQ ID NO: 19303 - DNA, 16 bp, Homo sapiens
aagagggcgtgaaacc

SEQ ID NO: 19304 - DNA, 26 bp, Homo sapiens
aagagggcgtgaaaccgttaagaggt

SEQ ID NO: 19305 - DNA, 27 bp, Homo sapiens
aagagggcgtgaaaccgttaagaggta

SEQ ID NO: 19306 - DNA, 33 bp, Homo sapiens
aagagggcgtgaaaccgttaagaggtaaacggg

SEQ ID NO: 19307 - DNA, 25 bp, Homo sapiens
agagggcgtgaaaccgttaagaggt

SEQ ID NO: 19308 - DNA, 26 bp, Homo sapiens
agagggcgtgaaaccgttaagaggta

SEQ ID NO: 19309 - DNA, 24 bp, Homo sapiens
gagggcgtgaaaccgttaagaggt

SEQ ID NO: 19310 - DNA, 23 bp, Homo sapiens
agggcgtgaaaccgttaagaggt

SEQ ID NO: 19311 - DNA, 17 bp, Homo sapiens
cgggtggggtccgcgca

SEQ ID NO: 19312 - DNA, 16 bp, Homo sapiens
gcgcagtccgcccgga

SEQ ID NO: 19313 - DNA, 20 bp, Homo sapiens
gcgcagtccgcccggaggat

SEQ ID NO: 19314 - DNA, 16 bp, Homo sapiens
cgcagtccgcccggag

SEQ ID NO: 19315 - DNA, 17 bp, Homo sapiens
cgcagtccgcccggagg

SEQ ID NO: 19316 - DNA, 19 bp, Homo sapiens
cgcagtccgcccggaggat

SEQ ID NO: 19317 - DNA, 27 bp, Homo sapiens
cgcagtccgcccggaggattcaacccg

SEQ ID NO: 19318 - DNA, 16 bp, Homo sapiens
agtccgcccggaggat

SEQ ID NO: 19319 - DNA, 29 bp, Homo sapiens
gaggattcaacccggcggcgggtccggcc

SEQ ID NO: 19320 - DNA, 17 bp, Homo sapiens
ggattcaacccggcggc

SEQ ID NO: 19321 - DNA, 16 bp, Homo sapiens
gattcaacccggcggc

SEQ ID NO: 19322 - DNA, 25 bp, Homo sapiens
gattcaacccggcggcgggtccggc

SEQ ID NO: 19323 - DNA, 29 bp, Homo sapiens
gattcaacccggcggcgggtccggccgtg

SEQ ID NO: 19324 - DNA, 24 bp, Homo sapiens
attcaacccggcggcgggtccggc

SEQ ID NO: 19325 - DNA, 26 bp, Homo sapiens
attcaacccggcggcgggtccggccg

SEQ ID NO: 19326 - DNA, 28 bp, Homo sapiens
attcaacccggcggcgggtccggccgtg

SEQ ID NO: 19327 - DNA, 32 bp, Homo sapiens
attcaacccggcggcgggtccggccgtgtcgg

SEQ ID NO: 19328 - DNA, 33 bp, Homo sapiens
attcaacccggcggcgggtccggccgtgtcggc

SEQ ID NO: 19329 - DNA, 25 bp, Homo sapiens
ttcaacccggcggcgggtccggccg

SEQ ID NO: 19330 - DNA, 24 bp, Homo sapiens
tcaacccggcggcgggtccggccg

SEQ ID NO: 19331 - DNA, 31 bp, Homo sapiens
tcaacccggcggcgggtccggccgtgtcggc

SEQ ID NO: 19332 - DNA, 32 bp, Homo sapiens; identical to SEQ ID NO: 4189

SEQ ID NO: 19333 - DNA, 33 bp, Homo sapiens; identical to SEQ ID NO: 4190

SEQ ID NO: 19334 - DNA, 23 bp, Homo sapiens
caacccggcggcgggtccggccg

SEQ ID NO: 19335 - DNA, 25 bp, Homo sapiens
caacccggcggcgggtccggccgtg

SEQ ID NO: 19336 - DNA, 30 bp, Homo sapiens
caacccggcggcgggtccggccgtgtcggc

SEQ ID NO: 19337 - DNA, 31 bp, Homo sapiens; identical to SEQ ID NO: 4191

SEQ ID NO: 19338 - DNA, 32 bp, Homo sapiens; identical to SEQ ID NO: 4192

SEQ ID NO: 19339 - DNA, 20 bp, Homo sapiens
aacccggcggcgggtccggc

SEQ ID NO: 19340 - DNA, 21 bp, Homo sapiens
aacccggcggcgggtccggcc

SEQ ID NO: 19341 - DNA, 22 bp, Homo sapiens
aacccggcggcgggtccggccg

SEQ ID NO: 19342 - DNA, 29 bp, Homo sapiens
aacccggcggcgggtccggccgtgtcggc

SEQ ID NO: 19343 - DNA, 30 bp, Homo sapiens
aacccggcggcgggtccggccgtgtcggcg

SEQ ID NO: 19344 - DNA, 29 bp, Homo sapiens
acccggcggcgggtccggccgtgtcggcg

SEQ ID NO: 19345 - DNA, 30 bp, Homo sapiens
acccggcggcgggtccggccgtgtcggcgg

SEQ ID NO: 19346 - DNA, 28 bp, Homo sapiens
cccggcggcgggtccggccgtgtcggcg

SEQ ID NO: 19347 - DNA, 27 bp, Homo sapiens
ccggcggcgggtccggccgtgtcggcg

SEQ ID NO: 19348 - DNA, 16 bp, Homo sapiens
cggcggcgggtccggc

SEQ ID NO: 19349 - DNA, 17 bp, Homo sapiens
cggcggcgggtccggcc

SEQ ID NO: 19350 - DNA, 26 bp, Homo sapiens
cggcggcgggtccggccgtgtcggcg

SEQ ID NO: 19351 - DNA, 26 bp, Homo sapiens
ggcggcgggtccggccgtgtcggcgg

SEQ ID NO: 19352 - DNA, 22 bp, Homo sapiens
ggcgggtccggccgtgtcggcg

SEQ ID NO: 19353 - DNA, 21 bp, Homo sapiens
gcgggtccggccgtgtcggcg

SEQ ID NO: 19354 - DNA, 20 bp, Homo sapiens
cgggtccggccgtgtcggcg

SEQ ID NO: 19355 - DNA, 19 bp, Homo sapiens
gggtccggccgtgtcggcg

SEQ ID NO: 19356 - DNA, 18 bp, Homo sapiens
ggtccggccgtgtcggcg

SEQ ID NO: 19357 - DNA, 19 bp, Homo sapiens
ggtccggccgtgtcggcgg

SEQ ID NO: 19358 - DNA, 17 bp, Homo sapiens
gtccggccgtgtcggcg

SEQ ID NO: 19359 - DNA, 18 bp, Homo sapiens
gtccggccgtgtcggcgg

SEQ ID NO: 19360 - DNA, 16 bp, Homo sapiens
tccggccgtgtcggcg

SEQ ID NO: 19361 - DNA, 17 bp, Homo sapiens
tccggccgtgtcggcgg

SEQ ID NO: 19362 - DNA, 27 bp, Homo sapiens
tccggccgtgtcggcggcccggcggat

SEQ ID NO: 19363 - DNA, 16 bp, Homo sapiens
ccggccgtgtcggcgg

SEQ ID NO: 19364 - DNA, 28 bp, Homo sapiens
ccggccgtgtcggcggcccggcggatct

SEQ ID NO: 19365 - DNA, 16 bp, Homo sapiens
cggccgtgtcggcggc

SEQ ID NO: 19366 - DNA, 24 bp, Homo sapiens
cggccgtgtcggcggcccggcgga

SEQ ID NO: 19367 - DNA, 27 bp, Homo sapiens
cggccgtgtcggcggcccggcggatct

SEQ ID NO: 19368 - DNA, 16 bp, Homo sapiens
cgtgtcggcggcccgg

SEQ ID NO: 19369 - DNA, 17 bp, Homo sapiens
cgtgtcggcggcccggc

SEQ ID NO: 19370 - DNA, 20 bp, Homo sapiens
cgtgtcggcggcccggcgga

SEQ ID NO: 19371 - DNA, 23 bp, Homo sapiens
cgtgtcggcggcccggcggatct

SEQ ID NO: 19372 - DNA, 17 bp, Homo sapiens
gtcggcggcccggcgga

SEQ ID NO: 19373 - DNA, 17 bp, Homo sapiens
tcggcggcccggcggat

SEQ ID NO: 19374 - DNA, 16 bp, Homo sapiens
cggcggcccggcggat

SEQ ID NO: 19375 - DNA, 16 bp, Homo sapiens
ggcggcccggcggatc

SEQ ID NO: 19376 - DNA, 19 bp, Homo sapiens
gcggcccggcggatctttc

SEQ ID NO: 19377 - DNA, 18 bp, Homo sapiens
cggcccggcggatctttc

SEQ ID NO: 19378 - DNA, 18 bp, Homo sapiens
cccggcggatctttcccg

SEQ ID NO: 19379 - DNA, 30 bp, Homo sapiens
cggatctttcccgccccccgttcctcccga

SEQ ID NO: 19380 - DNA, 25 bp, Homo sapiens
tctttcccgccccccgttcctcccg

SEQ ID NO: 19381 - DNA, 26 bp, Homo sapiens
tctttcccgccccccgttcctcccga

SEQ ID NO: 19382 - DNA, 23 bp, Homo sapiens
gttcctcccgacccctccacccg

SEQ ID NO: 19383 - DNA, 24 bp, Homo sapiens
gttcctcccgacccctccacccgc

SEQ ID NO: 19384 - DNA, 25 bp, Homo sapiens
gttcctcccgacccctccacccgcc

SEQ ID NO: 19385 - DNA, 22 bp, Homo sapiens
ttcctcccgacccctccacccg

SEQ ID NO: 19386 - DNA, 23 bp, Homo sapiens
ttcctcccgacccctccacccgc

SEQ ID NO: 19387 - DNA, 24 bp, Homo sapiens
ttcctcccgacccctccacccgcc

SEQ ID NO: 19388 - DNA, 20 bp, Homo sapiens
cctcccgacccctccacccg

SEQ ID NO: 19389 - DNA, 22 bp, Homo sapiens
cctcccgacccctccacccgcc

SEQ ID NO: 19390 - DNA, 19 bp, Homo sapiens
ctcccgacccctccacccg

SEQ ID NO: 19391 - DNA, 20 bp, Homo sapiens
ctcccgacccctccacccgc

SEQ ID NO: 19392 - DNA, 21 bp, Homo sapiens
ctcccgacccctccacccgcc

SEQ ID NO: 19393 - DNA, 23 bp, Homo sapiens
ctcccgacccctccacccgccct

SEQ ID NO: 19394 - DNA, 26 bp, Homo sapiens
ctcccgacccctccacccgccctccc

SEQ ID NO: 19395 - DNA, 18 bp, Homo sapiens
tcccgacccctccacccg

SEQ ID NO: 19396 - DNA, 19 bp, Homo sapiens
tcccgacccctccacccgc

SEQ ID NO: 19397 - DNA, 20 bp, Homo sapiens
tcccgacccctccacccgcc

SEQ ID NO: 19398 - DNA, 22 bp, Homo sapiens
tcccgacccctccacccgccct

SEQ ID NO: 19399 - DNA, 33 bp, Homo sapiens
tcccgacccctccacccgccctcccttcccccg

SEQ ID NO: 19400 - DNA, 17 bp, Homo sapiens
cccgacccctccacccg

SEQ ID NO: 19401 - DNA, 19 bp, Homo sapiens
cccgacccctccacccgcc

SEQ ID NO: 19402 - DNA, 32 bp, Homo sapiens
cccgacccctccacccgccctcccttcccccg

SEQ ID NO: 19403 - DNA, 29 bp, Homo sapiens
ccctccacccgccctcccttcccccgccg

SEQ ID NO: 19404 - DNA, 25 bp, Homo sapiens
cctccacccgccctcccttcccccg

SEQ ID NO: 19405 - DNA, 27 bp, Homo sapiens
cctccacccgccctcccttcccccgcc

SEQ ID NO: 19406 - DNA, 28 bp, Homo sapiens
cctccacccgccctcccttcccccgccg

SEQ ID NO: 19407 - DNA, 30 bp, Homo sapiens
cctccacccgccctcccttcccccgccgcc

SEQ ID NO: 19408 - DNA, 26 bp, Homo sapiens
ctccacccgccctcccttcccccgcc

SEQ ID NO: 19409 - DNA, 27 bp, Homo sapiens
ctccacccgccctcccttcccccgccg

SEQ ID NO: 19410 - DNA, 25 bp, Homo sapiens
cccttcccccgccgcccctcctcct

SEQ ID NO: 19411 - DNA, 28 bp, Homo sapiens
cccttcccccgccgcccctcctcctcct

SEQ ID NO: 19412 - DNA, 29 bp, Homo sapiens
cccttcccccgccgcccctcctcctcctc

SEQ ID NO: 19413 - DNA, 27 bp, Homo sapiens
ccttcccccgccgcccctcctcctcct

SEQ ID NO: 19414 - DNA, 21 bp, Homo sapiens
ccccgccgcccctcctcctcc

SEQ ID NO: 19415 - DNA, 23 bp, Homo sapiens
ccccgccgcccctcctcctcctc

SEQ ID NO: 19416 - DNA, 19 bp, Homo sapiens
cccgccgcccctcctcctc

SEQ ID NO: 19417 - DNA, 20 bp, Homo sapiens
cccgccgcccctcctcctcc

SEQ ID NO: 19418 - DNA, 18 bp, Homo sapiens
cgccgcccctcctcctcc

SEQ ID NO: 19419 - DNA, 25 bp, Homo sapiens
ctcctcctccccggagggggcgggc

SEQ ID NO: 19420 - DNA, 26 bp, Homo sapiens
ctcctcctccccggagggggcgggct

SEQ ID NO: 19421 - DNA, 25 bp, Homo sapiens
tcctcctccccggagggggcgggct

SEQ ID NO: 19422 - DNA, 23 bp, Homo sapiens
ctcctccccggagggggcgggct

SEQ ID NO: 19423 - DNA, 24 bp, Homo sapiens
ctcctccccggagggggcgggctc

SEQ ID NO: 19424 - DNA, 21 bp, Homo sapiens
tcctccccggagggggcgggc

SEQ ID NO: 19425 - DNA, 22 bp, Homo sapiens
tcctccccggagggggcgggct

SEQ ID NO: 19426 - DNA, 20 bp, Homo sapiens
cctccccggagggggcgggc

SEQ ID NO: 19427 - DNA, 21 bp, Homo sapiens
cctccccggagggggcgggct

SEQ ID NO: 19428 - DNA, 20 bp, Homo sapiens
ctccccggagggggcgggct

SEQ ID NO: 19429 - DNA, 30 bp, Homo sapiens
gagggggcgggctccggcgggtgcgggggt

SEQ ID NO: 19430 - DNA, 17 bp, Homo sapiens
ggggtcggcgggggacc

SEQ ID NO: 19431 - DNA, 27 bp, Homo sapiens
gcgggggaccgtcccccgaccggcgac

SEQ ID NO: 19432 - DNA, 22 bp, Homo sapiens
gggggaccgtcccccgaccggc

SEQ ID NO: 19433 - DNA, 25 bp, Homo sapiens
gggggaccgtcccccgaccggcgac

SEQ ID NO: 19434 - DNA, 26 bp, Homo sapiens
gggggaccgtcccccgaccggcgacc

SEQ ID NO: 19435 - DNA, 27 bp, Homo sapiens
gggggaccgtcccccgaccggcgaccg

SEQ ID NO: 19436 - DNA, 21 bp, Homo sapiens
ggggaccgtcccccgaccggc

SEQ ID NO: 19437 - DNA, 23 bp, Homo sapiens
ggggaccgtcccccgaccggcga

SEQ ID NO: 19438 - DNA, 24 bp, Homo sapiens
ggggaccgtcccccgaccggcgac

SEQ ID NO: 19439 - DNA, 25 bp, Homo sapiens
ggggaccgtcccccgaccggcgacc

SEQ ID NO: 19440 - DNA, 23 bp, Homo sapiens
gggaccgtcccccgaccggcgac

SEQ ID NO: 19441 - DNA, 24 bp, Homo sapiens
gggaccgtcccccgaccggcgacc

SEQ ID NO: 19442 - DNA, 16 bp, Homo sapiens
tcccccgaccggcgac

SEQ ID NO: 19443 - DNA, 17 bp, Homo sapiens
tcccccgaccggcgacc

SEQ ID NO: 19444 - DNA, 18 bp, Homo sapiens
tcccccgaccggcgaccg

SEQ ID NO: 19445 - DNA, 17 bp, Homo sapiens
cccccgaccggcgaccg

SEQ ID NO: 19446 - DNA, 31 bp, Homo sapiens
cccccgaccggcgaccggccgccgccgggcg

SEQ ID NO: 19447 - DNA, 16 bp, Homo sapiens
ccccgaccggcgaccg

SEQ ID NO: 19448 - DNA, 29 bp, Homo sapiens
cgaccggcgaccggccgccgccgggcgca

SEQ ID NO: 19449 - DNA, 22 bp, Homo sapiens
cggcgaccggccgccgccgggc

SEQ ID NO: 19450 - DNA, 23 bp, Homo sapiens
cggcgaccggccgccgccgggcg

SEQ ID NO: 19451 - DNA, 21 bp, Homo sapiens
ggcgaccggccgccgccgggc

SEQ ID NO: 19452 - DNA, 22 bp, Homo sapiens
ggcgaccggccgccgccgggcg

SEQ ID NO: 19453 - DNA, 20 bp, Homo sapiens
gcgaccggccgccgccgggc

SEQ ID NO: 19454 - DNA, 19 bp, Homo sapiens
cgaccggccgccgccgggc

SEQ ID NO: 19455 - DNA, 20 bp, Homo sapiens
cgaccggccgccgccgggcg

SEQ ID NO: 19456 - DNA, 18 bp, Homo sapiens
gaccggccgccgccgggc

SEQ ID NO: 19457 - DNA, 17 bp, Homo sapiens
accggccgccgccgggc

SEQ ID NO: 19458 - DNA, 16 bp, Homo sapiens
ccggccgccgccgggc

SEQ ID NO: 19459 - DNA, 16 bp, Homo sapiens
cggccgccgccgggcg

SEQ ID NO: 19460 - DNA, 16 bp, Homo sapiens
atttccaccgcggcgg

SEQ ID NO: 19461 - DNA, 17 bp, Homo sapiens
atttccaccgcggcggt

SEQ ID NO: 19462 - DNA, 16 bp, Homo sapiens
tttccaccgcggcggt

SEQ ID NO: 19463 - DNA, 21 bp, Homo sapiens
tttccaccgcggcggtgcgcc

SEQ ID NO: 19464 - DNA, 31 bp, Homo sapiens
tttccaccgcggcggtgcgccgcgaccggct

SEQ ID NO: 19465 - DNA, 18 bp, Homo sapiens
ccaccgcggcggtgcgcc

SEQ ID NO: 19466 - DNA, 28 bp, Homo sapiens
ccaccgcggcggtgcgccgcgaccggct

SEQ ID NO: 19467 - DNA, 27 bp, Homo sapiens
caccgcggcggtgcgccgcgaccggct

SEQ ID NO: 19468 - DNA, 26 bp, Homo sapiens
accgcggcggtgcgccgcgaccggct

SEQ ID NO: 19469 - DNA, 27 bp, Homo sapiens
accgcggcggtgcgccgcgaccggctc

SEQ ID NO: 19470 - DNA, 29 bp, Homo sapiens
accgcggcggtgcgccgcgaccggctccg

SEQ ID NO: 19471 - DNA, 25 bp, Homo sapiens
ccgcggcggtgcgccgcgaccggct

SEQ ID NO: 19472 - DNA, 26 bp, Homo sapiens
ccgcggcggtgcgccgcgaccggctc

SEQ ID NO: 19473 - DNA, 28 bp, Homo sapiens
ccgcggcggtgcgccgcgaccggctccg

SEQ ID NO: 19474 - DNA, 23 bp, Homo sapiens
gcggcggtgcgccgcgaccggct

SEQ ID NO: 19475 - DNA, 26 bp, Homo sapiens
gcggcggtgcgccgcgaccggctccg

SEQ ID NO: 19476 - DNA, 30 bp, Homo sapiens
gcggcggtgcgccgcgaccggctccgggac

SEQ ID NO: 19477 - DNA, 31 bp, Homo sapiens
gcggcggtgcgccgcgaccggctccgggacg

SEQ ID NO: 19478 - DNA, 33 bp, Homo sapiens
gcggcggtgcgccgcgaccggctccgggacggc

SEQ ID NO: 19479 - DNA, 20 bp, Homo sapiens
gcggtgcgccgcgaccggct

SEQ ID NO: 19480 - DNA, 23 bp, Homo sapiens
gcggtgcgccgcgaccggctccg

SEQ ID NO: 19481 - DNA, 27 bp, Homo sapiens
gcggtgcgccgcgaccggctccgggac

SEQ ID NO: 19482 - DNA, 25 bp, Homo sapiens
ggtgcgccgcgaccggctccgggac

SEQ ID NO: 19483 - DNA, 33 bp, Homo sapiens
ggtgcgccgcgaccggctccgggacggctggga

SEQ ID NO: 19484 - DNA, 22 bp, Homo sapiens
tgcgccgcgaccggctccggga

SEQ ID NO: 19485 - DNA, 23 bp, Homo sapiens
tgcgccgcgaccggctccgggac

SEQ ID NO: 19486 - DNA, 21 bp, Homo sapiens
gcgccgcgaccggctccggga

SEQ ID NO: 19487 - DNA, 22 bp, Homo sapiens
gcgccgcgaccggctccgggac

SEQ ID NO: 19488 - DNA, 24 bp, Homo sapiens
gcgccgcgaccggctccgggacgg

SEQ ID NO: 19489 - DNA, 20 bp, Homo sapiens
cgccgcgaccggctccggga

SEQ ID NO: 19490 - DNA, 21 bp, Homo sapiens
cgccgcgaccggctccgggac

SEQ ID NO: 19491 - DNA, 19 bp, Homo sapiens
gccgcgaccggctccggga

SEQ ID NO: 19492 - DNA, 18 bp, Homo sapiens
ccgcgaccggctccggga

SEQ ID NO: 19493 - DNA, 19 bp, Homo sapiens
ccgcgaccggctccgggac

SEQ ID NO: 19494 - DNA, 23 bp, Homo sapiens
ccgcgaccggctccgggacggct

SEQ ID NO: 19495 - DNA, 27 bp, Homo sapiens
ccgcgaccggctccgggacggctggga

SEQ ID NO: 19496 - DNA, 19 bp, Homo sapiens
cgcgaccggctccgggacg

SEQ ID NO: 19497 - DNA, 22 bp, Homo sapiens
cgcgaccggctccgggacggct

SEQ ID NO: 19498 - DNA, 23 bp, Homo sapiens
cgcgaccggctccgggacggctg

SEQ ID NO: 19499 - DNA, 26 bp, Homo sapiens
cgcgaccggctccgggacggctggga

SEQ ID NO: 19500 - DNA, 21 bp, Homo sapiens
gcgaccggctccgggacggct

SEQ ID NO: 19501 - DNA, 20 bp, Homo sapiens
cgaccggctccgggacggct

SEQ ID NO: 19502 - DNA, 16 bp, Homo sapiens
gaccggctccgggacg

SEQ ID NO: 19503 - DNA, 17 bp, Homo sapiens
gaccggctccgggacgg

SEQ ID NO: 19504 - DNA, 19 bp, Homo sapiens
gaccggctccgggacggct

SEQ ID NO: 19505 - DNA, 18 bp, Homo sapiens
accggctccgggacggct

SEQ ID NO: 19506 - DNA, 17 bp, Homo sapiens
ccggctccgggacggct

SEQ ID NO: 19507 - DNA, 21 bp, Homo sapiens
ccggctccgggacggctggga

SEQ ID NO: 19508 - DNA, 22 bp, Homo sapiens
ccggctccgggacggctgggaa

SEQ ID NO: 19509 - DNA, 16 bp, Homo sapiens
cggctccgggacggct

SEQ ID NO: 19510 - DNA, 20 bp, Homo sapiens
cggctccgggacggctggga

SEQ ID NO: 19511 - DNA, 16 bp, Homo sapiens
ggctccgggacggctg

SEQ ID NO: 19512 - DNA, 19 bp, Homo sapiens
ccgggacggctgggaaggc

SEQ ID NO: 19513 - DNA, 32 bp, Homo sapiens
ccgggacggctgggaaggcccggcggggaagg

SEQ ID NO: 19514 - DNA, 33 bp, Homo sapiens
ccgggacggctgggaaggcccggcggggaaggt

SEQ ID NO: 19515 - DNA, 23 bp, Homo sapiens
cgggacggctgggaaggcccggc

SEQ ID NO: 19516 - DNA, 23 bp, Homo sapiens
cggctgggaaggcccggcgggga

SEQ ID NO: 19517 - DNA, 19 bp, Homo sapiens
gggaaggcccggcggggaa

SEQ ID NO: 19518 - DNA, 21 bp, Homo sapiens
gggaaggcccggcggggaagg

SEQ ID NO: 19519 - DNA, 22 bp, Homo sapiens
gggaaggcccggcggggaaggt

SEQ ID NO: 19520 - DNA, 20 bp, Homo sapiens
gaaggcccggcggggaaggt

SEQ ID NO: 19521 - DNA, 22 bp, Homo sapiens
gggccccgtccgtccgtccgtc

SEQ ID NO: 19522 - DNA, 24 bp, Homo sapiens
gggccccgtccgtccgtccgtccg

SEQ ID NO: 19523 - DNA, 25 bp, Homo sapiens
gggccccgtccgtccgtccgtccgt

SEQ ID NO: 19524 - DNA, 21 bp, Homo sapiens
ggccccgtccgtccgtccgtc

SEQ ID NO: 19525 - DNA, 23 bp, Homo sapiens
ggccccgtccgtccgtccgtccg

SEQ ID NO: 19526 - DNA, 18 bp, Homo sapiens
gccccgtccgtccgtccg

SEQ ID NO: 19527 - DNA, 22 bp, Homo sapiens
gccccgtccgtccgtccgtccg

SEQ ID NO: 19528 - DNA, 18 bp, Homo sapiens
ccccgtccgtccgtccgt

SEQ ID NO: 19529 - DNA, 16 bp, Homo sapiens
cgtccgtccgtccgtc

SEQ ID NO: 19530 - DNA, 18 bp, Homo sapiens
cgtccgtccgtccgtccg

SEQ ID NO: 19531 - DNA, 20 bp, Homo sapiens
cgtccgtccgtccgtccgtc

SEQ ID NO: 19532 - DNA, 16 bp, Homo sapiens
gtccgtccgtccgtcc

SEQ ID NO: 19533 - DNA, 19 bp, Homo sapiens
gtccgtccgtccgtccgtc

SEQ ID NO: 19534 - DNA, 18 bp, Homo sapiens
tccgtccgtccgtccgtc

SEQ ID NO: 19535 - DNA, 20 bp, Homo sapiens
tccgtccgtccgtccgtcct

SEQ ID NO: 19536 - DNA, 16 bp, Homo sapiens
cgtccgtccgtccgtc

SEQ ID NO: 19537 - DNA, 16 bp, Homo sapiens
gtccgtccgtccgtcc

SEQ ID NO: 19538 - DNA, 17 bp, Homo sapiens
gtccgtccgtccgtcct

SEQ ID NO: 19539 - DNA, 33 bp, Homo sapiens
tcctcccccgtctccgccccccggccccgcgtc

SEQ ID NO: 19540 - DNA, 28 bp, Homo sapiens
cctcccccgtctccgccccccggccccg

SEQ ID NO: 19541 - DNA, 30 bp, Homo sapiens
cctcccccgtctccgccccccggccccgcg

SEQ ID NO: 19542 - DNA, 32 bp, Homo sapiens
cctcccccgtctccgccccccggccccgcgtc

SEQ ID NO: 19543 - DNA, 27 bp, Homo sapiens
ctcccccgtctccgccccccggccccg

SEQ ID NO: 19544 - DNA, 31 bp, Homo sapiens
ctcccccgtctccgccccccggccccgcgtc

SEQ ID NO: 19545 - DNA, 30 bp, Homo sapiens
tcccccgtctccgccccccggccccgcgtc

SEQ ID NO: 19546 - DNA, 29 bp, Homo sapiens
cccccgtctccgccccccggccccgcgtc

SEQ ID NO: 19547 - DNA, 33 bp, Homo sapiens
cccccgtctccgccccccggccccgcgtcctcc

SEQ ID NO: 19548 - DNA, 34 bp, Homo sapiens
cccccgtctccgccccccggccccgcgtcctccc

SEQ ID NO: 19549 - DNA, 32 bp, Homo sapiens
ccccgtctccgccccccggccccgcgtcctcc

SEQ ID NO: 19550 - DNA, 33 bp, Homo sapiens
ccccgtctccgccccccggccccgcgtcctccc

SEQ ID NO: 19551 - DNA, 29 bp, Homo sapiens
cccgtctccgccccccggccccgcgtcct

SEQ ID NO: 19552 - DNA, 31 bp, Homo sapiens
cccgtctccgccccccggccccgcgtcctcc

SEQ ID NO: 19553 - DNA, 32 bp, Homo sapiens; identical to SEQ ID NO: 4220

SEQ ID NO: 19554 - DNA, 33 bp, Homo sapiens
cccgtctccgccccccggccccgcgtcctccct

SEQ ID NO: 19555 - DNA, 18 bp, Homo sapiens
ccgtctccgccccccggc

SEQ ID NO: 19556 - DNA, 21 bp, Homo sapiens
ccgtctccgccccccggcccc

SEQ ID NO: 19557 - DNA, 26 bp, Homo sapiens
ccgtctccgccccccggccccgcgtc

SEQ ID NO: 19558 - DNA, 28 bp, Homo sapiens
ccgtctccgccccccggccccgcgtcct

SEQ ID NO: 19559 - DNA, 30 bp, Homo sapiens; identical to SEQ ID NO: 4221

SEQ ID NO: 19560 - DNA, 31 bp, Homo sapiens; identical to SEQ ID NO: 4222

SEQ ID NO: 19561 - DNA, 32 bp, Homo sapiens
ccgtctccgccccccggccccgcgtcctccct

SEQ ID NO: 19562 - DNA, 21 bp, Homo sapiens
cgtctccgccccccggccccg

SEQ ID NO: 19563 - DNA, 23 bp, Homo sapiens
cgtctccgccccccggccccgcg

SEQ ID NO: 19564 - DNA, 25 bp, Homo sapiens
cgtctccgccccccggccccgcgtc

SEQ ID NO: 19565 - DNA, 27 bp, Homo sapiens
cgtctccgccccccggccccgcgtcct

SEQ ID NO: 19566 - DNA, 29 bp, Homo sapiens
cgtctccgccccccggccccgcgtcctcc

SEQ ID NO: 19567 - DNA, 30 bp, Homo sapiens
cgtctccgccccccggccccgcgtcctccc

SEQ ID NO: 19568 - DNA, 16 bp, Homo sapiens
gtctccgccccccggc

SEQ ID NO: 19569 - DNA, 17 bp, Homo sapiens
gtctccgccccccggcc

SEQ ID NO: 19570 - DNA, 18 bp, Homo sapiens
gtctccgccccccggccc

SEQ ID NO: 19571 - DNA, 19 bp, Homo sapiens
gtctccgccccccggcccc

SEQ ID NO: 19572 - DNA, 20 bp, Homo sapiens
gtctccgccccccggccccg

SEQ ID NO: 19573 - DNA, 22 bp, Homo sapiens
gtctccgccccccggccccgcg

SEQ ID NO: 19574 - DNA, 24 bp, Homo sapiens
gtctccgccccccggccccgcgtc

SEQ ID NO: 19575 - DNA, 28 bp, Homo sapiens
gtctccgccccccggccccgcgtcctcc

SEQ ID NO: 19576 - DNA, 29 bp, Homo sapiens
gtctccgccccccggccccgcgtcctccc

SEQ ID NO: 19577 - DNA, 30 bp, Homo sapiens; identical to SEQ ID NO: 4225

SEQ ID NO: 19578 - DNA, 27 bp, Homo sapiens
tctccgccccccggccccgcgtcctcc

SEQ ID NO: 19579 - DNA, 28 bp, Homo sapiens
tctccgccccccggccccgcgtcctccc

SEQ ID NO: 19580 - DNA, 26 bp, Homo sapiens
ctccgccccccggccccgcgtcctcc

SEQ ID NO: 19581 - DNA, 27 bp, Homo sapiens
ctccgccccccggccccgcgtcctccc

SEQ ID NO: 19582 - DNA, 28 bp, Homo sapiens
ctccgccccccggccccgcgtcctccct

SEQ ID NO: 19583 - DNA, 25 bp, Homo sapiens
tccgccccccggccccgcgtcctcc

SEQ ID NO: 19584 - DNA, 26 bp, Homo sapiens
tccgccccccggccccgcgtcctccc

SEQ ID NO: 19585 - DNA, 27 bp, Homo sapiens
tccgccccccggccccgcgtcctccct

SEQ ID NO: 19586 - DNA, 28 bp, Homo sapiens
tccgccccccggccccgcgtcctccctc

SEQ ID NO: 19587 - DNA, 16 bp, Homo sapiens
ccgccccccggccccg

SEQ ID NO: 19588 - DNA, 20 bp, Homo sapiens
ccgccccccggccccgcgtc

SEQ ID NO: 19589 - DNA, 21 bp, Homo sapiens
ccgccccccggccccgcgtcc

SEQ ID NO: 19590 - DNA, 22 bp, Homo sapiens
ccgccccccggccccgcgtcct

SEQ ID NO: 19591 - DNA, 23 bp, Homo sapiens
ccgccccccggccccgcgtcctc

SEQ ID NO: 19592 - DNA, 24 bp, Homo sapiens
ccgccccccggccccgcgtcctcc

SEQ ID NO: 19593 - DNA, 25 bp, Homo sapiens
ccgccccccggccccgcgtcctccc

SEQ ID NO: 19594 - DNA, 26 bp, Homo sapiens
ccgccccccggccccgcgtcctccct

SEQ ID NO: 19595 - DNA, 27 bp, Homo sapiens
ccgccccccggccccgcgtcctccctc

SEQ ID NO: 19596 - DNA, 21 bp, Homo sapiens
cgccccccggccccgcgtcct

SEQ ID NO: 19597 - DNA, 23 bp, Homo sapiens
cgccccccggccccgcgtcctcc

SEQ ID NO: 19598 - DNA, 24 bp, Homo sapiens
cgccccccggccccgcgtcctccc

SEQ ID NO: 19599 - DNA, 25 bp, Homo sapiens
cgccccccggccccgcgtcctccct

SEQ ID NO: 19600 - DNA, 18 bp, Homo sapiens
gccccccggccccgcgtc

SEQ ID NO: 19601 - DNA, 22 bp, Homo sapiens
gccccccggccccgcgtcctcc

SEQ ID NO: 19602 - DNA, 23 bp, Homo sapiens
gccccccggccccgcgtcctccc

SEQ ID NO: 19603 - DNA, 24 bp, Homo sapiens
gccccccggccccgcgtcctccct

SEQ ID NO: 19604 - DNA, 21 bp, Homo sapiens
ccccccggccccgcgtcctcc

SEQ ID NO: 19605 - DNA, 22 bp, Homo sapiens
ccccccggccccgcgtcctccc

SEQ ID NO: 19606 - DNA, 20 bp, Homo sapiens
cccccggccccgcgtcctcc

SEQ ID NO: 19607 - DNA, 21 bp, Homo sapiens
cccccggccccgcgtcctccc

SEQ ID NO: 19608 - DNA, 18 bp, Homo sapiens
ccccggccccgcgtcctc

SEQ ID NO: 19609 - DNA, 19 bp, Homo sapiens
ccccggccccgcgtcctcc

SEQ ID NO: 19610 - DNA, 20 bp, Homo sapiens
ccccggccccgcgtcctccc

SEQ ID NO: 19611 - DNA, 18 bp, Homo sapiens
cccggccccgcgtcctcc

SEQ ID NO: 19612 - DNA, 19 bp, Homo sapiens
cccggccccgcgtcctccc

SEQ ID NO: 19613 - DNA, 17 bp, Homo sapiens
ccggccccgcgtcctcc

SEQ ID NO: 19614 - DNA, 18 bp, Homo sapiens
ccggccccgcgtcctccc

SEQ ID NO: 19615 - DNA, 17 bp, Homo sapiens
cggccccgcgtcctccc

SEQ ID NO: 19616 - DNA, 21 bp, Homo sapiens
ctccctcgggagggcgcgcgg

SEQ ID NO: 19617 - DNA, 22 bp, Homo sapiens
ctccctcgggagggcgcgcggg

SEQ ID NO: 19618 - DNA, 23 bp, Homo sapiens
ctccctcgggagggcgcgcgggt

SEQ ID NO: 19619 - DNA, 24 bp, Homo sapiens
ctccctcgggagggcgcgcgggtc

SEQ ID NO: 19620 - DNA, 25 bp, Homo sapiens
ctccctcgggagggcgcgcgggtcg

SEQ ID NO: 19621 - DNA, 26 bp, Homo sapiens
ctccctcgggagggcgcgcgggtcgg

SEQ ID NO: 19622 - DNA, 27 bp, Homo sapiens
ctccctcgggagggcgcgcgggtcggg

SEQ ID NO: 19623 - DNA, 28 bp, Homo sapiens
ctccctcgggagggcgcgcgggtcgggg

SEQ ID NO: 19624 - DNA, 29 bp, Homo sapiens
ctccctcgggagggcgcgcgggtcggggc

SEQ ID NO: 19625 - DNA, 30 bp, Homo sapiens
ctccctcgggagggcgcgcgggtcggggcg

SEQ ID NO: 19626 - DNA, 31 bp, Homo sapiens
ctccctcgggagggcgcgcgggtcggggcgg

SEQ ID NO: 19627 - DNA, 29 bp, Homo sapiens
tccctcgggagggcgcgcgggtcggggcg

SEQ ID NO: 19628 - DNA, 26 bp, Homo sapiens
ccctcgggagggcgcgcgggtcgggg

SEQ ID NO: 19629 - DNA, 18 bp, Homo sapiens
agggcgcgcgggtcgggg

SEQ ID NO: 19630 - DNA, 19 bp, Homo sapiens
agggcgcgcgggtcggggc

SEQ ID NO: 19631 - DNA, 20 bp, Homo sapiens
agggcgcgcgggtcggggcg

SEQ ID NO: 19632 - DNA, 25 bp, Homo sapiens
agggcgcgcgggtcggggcggcggc

SEQ ID NO: 19633 - DNA, 31 bp, Homo sapiens
agggcgcgcgggtcggggcggcggcggcggc

SEQ ID NO: 19634 - DNA, 32 bp, Homo sapiens
agggcgcgcgggtcggggcggcggcggcggcg

SEQ ID NO: 19635 - DNA, 18 bp, Homo sapiens
ggcgcgcgggtcggggcg

SEQ ID NO: 19636 - DNA, 17 bp, Homo sapiens
gcgcgcgggtcggggcg

SEQ ID NO: 19637 - DNA, 28 bp, Homo sapiens
gcgcgcgggtcggggcggcggcggcggc

SEQ ID NO: 19638 - DNA, 16 bp, Homo sapiens
cgcgcgggtcggggcg

SEQ ID NO: 19639 - DNA, 23 bp, Homo sapiens
cgggtcggggcggcggcggcggc

SEQ ID NO: 19640 - DNA, 24 bp, Homo sapiens
cgggtcggggcggcggcggcggcg

SEQ ID NO: 19641 - DNA, 17 bp, Homo sapiens
cggggcggcggcggcgg

SEQ ID NO: 19642 - DNA, 18 bp, Homo sapiens
gcggcggcggcggcggcg

SEQ ID NO: 19643 - DNA, 16 bp, Homo sapiens
cggcggcggcggcggc

SEQ ID NO: 19644 - DNA, 27 bp, Homo sapiens
gtggcggcggcggcggcggcggcggga

SEQ ID NO: 19645 - DNA, 18 bp, Homo sapiens
gcggcggcggcggcggcg

SEQ ID NO: 19646 - DNA, 21 bp, Homo sapiens
gcggcggcggcggcggcggcg

SEQ ID NO: 19647 - DNA, 16 bp, Homo sapiens
cggcggcggcggcggc

SEQ ID NO: 19648 - DNA, 25 bp, Homo sapiens
cggcggcggcggcggcggcgggacc

SEQ ID NO: 19649 - DNA, 18 bp, Homo sapiens
gcggcggcggcggcggcg

SEQ ID NO: 19650 - DNA, 16 bp, Homo sapiens
cggcggcggcggcggc

SEQ ID NO: 19651 - DNA, 22 bp, Homo sapiens
cggcggcggcggcggcgggacc

SEQ ID NO: 19652 - DNA, 20 bp, Homo sapiens
gcggcggcggcggcgggacc

SEQ ID NO: 19653 - DNA, 18 bp, Homo sapiens
cggcggcggcggcgggac

SEQ ID NO: 19654 - DNA, 19 bp, Homo sapiens
cggcggcggcggcgggacc

SEQ ID NO: 19655 - DNA, 16 bp, Homo sapiens
gcggcggcggcgggac

SEQ ID NO: 19656 - DNA, 17 bp, Homo sapiens
gcggcggcggcgggacc

SEQ ID NO: 19657 - DNA, 16 bp, Homo sapiens
cggcggcggcgggacc

SEQ ID NO: 19658 - DNA, 16 bp, Homo sapiens
ccgaaaccccccccga

SEQ ID NO: 19659 - DNA, 24 bp, Homo sapiens
ccgaaaccccccccgagtgttaca

SEQ ID NO: 19660 - DNA, 29 bp, Homo sapiens
aaaccccccccgagtgttacagccccccc

SEQ ID NO: 19661 - DNA, 30 bp, Homo sapiens
aaaccccccccgagtgttacagcccccccg

SEQ ID NO: 19662 - DNA, 28 bp, Homo sapiens
cccccccgagtgttacagcccccccggc

SEQ ID NO: 19663 - DNA, 18 bp, Homo sapiens
ccccccgagtgttacagc

SEQ ID NO: 19664 - DNA, 19 bp, Homo sapiens
ccccccgagtgttacagcc

SEQ ID NO: 19665 - DNA, 20 bp, Homo sapiens
ccccccgagtgttacagccc

SEQ ID NO: 19666 - DNA, 21 bp, Homo sapiens
ccccccgagtgttacagcccc

SEQ ID NO: 19667 - DNA, 22 bp, Homo sapiens
ccccccgagtgttacagccccc

SEQ ID NO: 19668 - DNA, 23 bp, Homo sapiens
ccccccgagtgttacagcccccc

SEQ ID NO: 19669 - DNA, 24 bp, Homo sapiens
ccccccgagtgttacagccccccc

SEQ ID NO: 19670 - DNA, 25 bp, Homo sapiens
ccccccgagtgttacagcccccccg

SEQ ID NO: 19671 - DNA, 26 bp, Homo sapiens
ccccccgagtgttacagcccccccgg

SEQ ID NO: 19672 - DNA, 27 bp, Homo sapiens
ccccccgagtgttacagcccccccggc

SEQ ID NO: 19673 - DNA, 28 bp, Homo sapiens
ccccccgagtgttacagcccccccggca

SEQ ID NO: 19674 - DNA, 29 bp, Homo sapiens
ccccccgagtgttacagcccccccggcag

SEQ ID NO: 19675 - DNA, 30 bp, Homo sapiens
ccccccgagtgttacagcccccccggcagc

SEQ ID NO: 19676 - DNA, 31 bp, Homo sapiens
ccccccgagtgttacagcccccccggcagca

SEQ ID NO: 19677 - DNA, 32 bp, Homo sapiens
ccccccgagtgttacagcccccccggcagcag

SEQ ID NO: 19678 - DNA, 33 bp, Homo sapiens
ccccccgagtgttacagcccccccggcagcagc

SEQ ID NO: 19679 - DNA, 34 bp, Homo sapiens
ccccccgagtgttacagcccccccggcagcagca

SEQ ID NO: 19680 - DNA, 22 bp, Homo sapiens
cccccgagtgttacagcccccc

SEQ ID NO: 19681 - DNA, 23 bp, Homo sapiens
cccccgagtgttacagccccccc

SEQ ID NO: 19682 - DNA, 26 bp, Homo sapiens
cccccgagtgttacagcccccccggc

SEQ ID NO: 19683 - DNA, 27 bp, Homo sapiens
cccccgagtgttacagcccccccggca

SEQ ID NO: 19684 - DNA, 30 bp, Homo sapiens
cccccgagtgttacagcccccccggcagca

SEQ ID NO: 19685 - DNA, 23 bp, Homo sapiens
gtgttacagcccccccggcagca

SEQ ID NO: 19686 - DNA, 27 bp, Homo sapiens
acagcccccccggcagcagcactcgcc

SEQ ID NO: 19687 - DNA, 23 bp, Homo sapiens
cagcccccccggcagcagcactc

SEQ ID NO: 19688 - DNA, 26 bp, Homo sapiens
cagcccccccggcagcagcactcgcc

SEQ ID NO: 19689 - DNA, 28 bp, Homo sapiens
cagcccccccggcagcagcactcgccga

SEQ ID NO: 19690 - DNA, 22 bp, Homo sapiens
agcccccccggcagcagcactc

SEQ ID NO: 19691 - DNA, 23 bp, Homo sapiens
agcccccccggcagcagcactcg

SEQ ID NO: 19692 - DNA, 25 bp, Homo sapiens
agcccccccggcagcagcactcgcc

SEQ ID NO: 19693 - DNA, 21 bp, Homo sapiens
gcccccccggcagcagcactc

SEQ ID NO: 19694 - DNA, 26 bp, Homo sapiens
gcccccccggcagcagcactcgccga

SEQ ID NO: 19695 - DNA, 33 bp, Homo sapiens
gcccccccggcagcagcactcgccgaatcccgg

SEQ ID NO: 19696 - DNA, 21 bp, Homo sapiens
cccccggcagcagcactcgcc

SEQ ID NO: 19697 - DNA, 19 bp, Homo sapiens
cccggcagcagcactcgcc

SEQ ID NO: 19698 - DNA, 16 bp, Homo sapiens
ccggcagcagcactcg

SEQ ID NO: 19699 - DNA, 18 bp, Homo sapiens
ccggcagcagcactcgcc

SEQ ID NO: 19700 - DNA, 29 bp, Homo sapiens
ccggcagcagcactcgccgaatcccgggg

SEQ ID NO: 19701 - DNA, 17 bp, Homo sapiens
cggcagcagcactcgcc

SEQ ID NO: 19702 - DNA, 28 bp, Homo sapiens
cggcagcagcactcgccgaatcccgggg

SEQ ID NO: 19703 - DNA, 29 bp, Homo sapiens
cggcagcagcactcgccgaatcccggggc

SEQ ID NO: 19704 - DNA, 32 bp, Homo sapiens
cggcagcagcactcgccgaatcccggggccga

SEQ ID NO: 19705 - DNA, 33 bp, Homo sapiens
cggcagcagcactcgccgaatcccggggccgag

SEQ ID NO: 19706 - DNA, 28 bp, Homo sapiens
ggcagcagcactcgccgaatcccggggc

SEQ ID NO: 19707 - DNA, 31 bp, Homo sapiens
gcagcagcactcgccgaatcccggggccgag

SEQ ID NO: 19708 - DNA, 24 bp, Homo sapiens
cagcagcactcgccgaatcccggg

SEQ ID NO: 19709 - DNA, 25 bp, Homo sapiens
cagcagcactcgccgaatcccgggg

SEQ ID NO: 19710 - DNA, 29 bp, Homo sapiens
cagcagcactcgccgaatcccggggccga

SEQ ID NO: 19711 - DNA, 30 bp, Homo sapiens
cagcagcactcgccgaatcccggggccgag

SEQ ID NO: 19712 - DNA, 21 bp, Homo sapiens
gcagcactcgccgaatcccgg

SEQ ID NO: 19713 - DNA, 22 bp, Homo sapiens
gcagcactcgccgaatcccggg

SEQ ID NO: 19714 - DNA, 23 bp, Homo sapiens
gcagcactcgccgaatcccgggg

SEQ ID NO: 19715 - DNA, 24 bp, Homo sapiens
gcagcactcgccgaatcccggggc

SEQ ID NO: 19716 - DNA, 25 bp, Homo sapiens
gcagcactcgccgaatcccggggcc

SEQ ID NO: 19717 - DNA, 26 bp, Homo sapiens
gcagcactcgccgaatcccggggccg

SEQ ID NO: 19718 - DNA, 27 bp, Homo sapiens
gcagcactcgccgaatcccggggccga

SEQ ID NO: 19719 - DNA, 28 bp, Homo sapiens
gcagcactcgccgaatcccggggccgag

SEQ ID NO: 19720 - DNA, 29 bp, Homo sapiens
gcagcactcgccgaatcccggggccgagg

SEQ ID NO: 19721 - DNA, 30 bp, Homo sapiens
gcagcactcgccgaatcccggggccgaggg

SEQ ID NO: 19722 - DNA, 31 bp, Homo sapiens
gcagcactcgccgaatcccggggccgaggga

SEQ ID NO: 19723 - DNA, 32 bp, Homo sapiens
gcagcactcgccgaatcccggggccgagggag

SEQ ID NO: 19724 - DNA, 33 bp, Homo sapiens
gcagcactcgccgaatcccggggccgagggagc

SEQ ID NO: 19725 - DNA, 22 bp, Homo sapiens
cagcactcgccgaatcccgggg

SEQ ID NO: 19726 - DNA, 23 bp, Homo sapiens
cagcactcgccgaatcccggggc

SEQ ID NO: 19727 - DNA, 25 bp, Homo sapiens
cagcactcgccgaatcccggggccg

SEQ ID NO: 19728 - DNA, 26 bp, Homo sapiens
cagcactcgccgaatcccggggccga

SEQ ID NO: 19729 - DNA, 27 bp, Homo sapiens
cagcactcgccgaatcccggggccgag

SEQ ID NO: 19730 - DNA, 28 bp, Homo sapiens
cagcactcgccgaatcccggggccgagg

SEQ ID NO: 19731 - DNA, 29 bp, Homo sapiens
cagcactcgccgaatcccggggccgaggg

SEQ ID NO: 19732 - DNA, 30 bp, Homo sapiens
cagcactcgccgaatcccggggccgaggga

SEQ ID NO: 19733 - DNA, 31 bp, Homo sapiens
cagcactcgccgaatcccggggccgagggag

SEQ ID NO: 19734 - DNA, 32 bp, Homo sapiens; identical to SEQ ID NO: 4245

SEQ ID NO: 19735 - DNA, 33 bp, Homo sapiens
cagcactcgccgaatcccggggccgagggagcg

SEQ ID NO: 19736 - DNA, 24 bp, Homo sapiens
agcactcgccgaatcccggggccg

SEQ ID NO: 19737 - DNA, 26 bp, Homo sapiens
agcactcgccgaatcccggggccgag

SEQ ID NO: 19738 - DNA, 27 bp, Homo sapiens
agcactcgccgaatcccggggccgagg

SEQ ID NO: 19739 - DNA, 30 bp, Homo sapiens
agcactcgccgaatcccggggccgagggag

SEQ ID NO: 19740 - DNA, 31 bp, Homo sapiens
agcactcgccgaatcccggggccgagggagc

SEQ ID NO: 19741 - DNA, 32 bp, Homo sapiens
agcactcgccgaatcccggggccgagggagcg

SEQ ID NO: 19742 - DNA, 21 bp, Homo sapiens
gcactcgccgaatcccggggc

SEQ ID NO: 19743 - DNA, 23 bp, Homo sapiens
gcactcgccgaatcccggggccg

SEQ ID NO: 19744 - DNA, 24 bp, Homo sapiens
gcactcgccgaatcccggggccga

SEQ ID NO: 19745 - DNA, 25 bp, Homo sapiens
gcactcgccgaatcccggggccgag

SEQ ID NO: 19746 - DNA, 26 bp, Homo sapiens
gcactcgccgaatcccggggccgagg

SEQ ID NO: 19747 - DNA, 27 bp, Homo sapiens
gcactcgccgaatcccggggccgaggg

SEQ ID NO: 19748 - DNA, 28 bp, Homo sapiens
gcactcgccgaatcccggggccgaggga

SEQ ID NO: 19749 - DNA, 29 bp, Homo sapiens
gcactcgccgaatcccggggccgagggag

SEQ ID NO: 19750 - DNA, 30 bp, Homo sapiens
gcactcgccgaatcccggggccgagggagc

SEQ ID NO: 19751 - DNA, 33 bp, Homo sapiens
gcactcgccgaatcccggggccgagggagcgag

SEQ ID NO: 19752 - DNA, 24 bp, Homo sapiens
cactcgccgaatcccggggccgag

SEQ ID NO: 19753 - DNA, 32 bp, Homo sapiens
cactcgccgaatcccggggccgagggagcgag

SEQ ID NO: 19754 - DNA, 19 bp, Homo sapiens
ctcgccgaatcccggggcc

SEQ ID NO: 19755 - DNA, 21 bp, Homo sapiens
ctcgccgaatcccggggccga

SEQ ID NO: 19756 - DNA, 32 bp, Homo sapiens
ctcgccgaatcccggggccgagggagcgagac

SEQ ID NO: 19757 - DNA, 22 bp, Homo sapiens
tcgccgaatcccggggccgagg

SEQ ID NO: 19758 - DNA, 26 bp, Homo sapiens
tcgccgaatcccggggccgagggagc

SEQ ID NO: 19759 - DNA, 30 bp, Homo sapiens
tcgccgaatcccggggccgagggagcgaga

SEQ ID NO: 19760 - DNA, 21 bp, Homo sapiens
cgccgaatcccggggccgagg

SEQ ID NO: 19761 - DNA, 22 bp, Homo sapiens
cgccgaatcccggggccgaggg

SEQ ID NO: 19762 - DNA, 23 bp, Homo sapiens
cgccgaatcccggggccgaggga

SEQ ID NO: 19763 - DNA, 24 bp, Homo sapiens
cgccgaatcccggggccgagggag

SEQ ID NO: 19764 - DNA, 25 bp, Homo sapiens
cgccgaatcccggggccgagggagc

SEQ ID NO: 19765 - DNA, 29 bp, Homo sapiens
cgccgaatcccggggccgagggagcgaga

SEQ ID NO: 19766 - DNA, 30 bp, Homo sapiens
cgccgaatcccggggccgagggagcgagac

SEQ ID NO: 19767 - DNA, 31 bp, Homo sapiens
cgccgaatcccggggccgagggagcgagacc

SEQ ID NO: 19768 - DNA, 33 bp, Homo sapiens
cgccgaatcccggggccgagggagcgagacccg

SEQ ID NO: 19769 - DNA, 34 bp, Homo sapiens
cgccgaatcccggggccgagggagcgagacccgt

SEQ ID NO: 19770 - DNA, 39 bp, Homo sapiens
cgccgaatcccggggccgagggagcgagacccgtcgccg

SEQ ID NO: 19771 - DNA, 21 bp, Homo sapiens
gccgaatcccggggccgaggg

SEQ ID NO: 19772 - DNA, 22 bp, Homo sapiens
gccgaatcccggggccgaggga

SEQ ID NO: 19773 - DNA, 23 bp, Homo sapiens
gccgaatcccggggccgagggag

SEQ ID NO: 19774 - DNA, 24 bp, Homo sapiens
gccgaatcccggggccgagggagc

SEQ ID NO: 19775 - DNA, 28 bp, Homo sapiens
gccgaatcccggggccgagggagcgaga

SEQ ID NO: 19776 - DNA, 29 bp, Homo sapiens
gccgaatcccggggccgagggagcgagac

SEQ ID NO: 19777 - DNA, 30 bp, Homo sapiens
gccgaatcccggggccgagggagcgagacc

SEQ ID NO: 19778 - DNA, 33 bp, Homo sapiens
gccgaatcccggggccgagggagcgagacccgt

SEQ ID NO: 19779 - DNA, 22 bp, Homo sapiens
cgaatcccggggccgagggagc

SEQ ID NO: 19780 - DNA, 21 bp, Homo sapiens
gaatcccggggccgagggagc

SEQ ID NO: 19781 - DNA, 25 bp, Homo sapiens
gaatcccggggccgagggagcgaga

SEQ ID NO: 19782 - DNA, 26 bp, Homo sapiens
gaatcccggggccgagggagcgagac

SEQ ID NO: 19783 - DNA, 23 bp, Homo sapiens
aatcccggggccgagggagcgag

SEQ ID NO: 19784 - DNA, 24 bp, Homo sapiens
aatcccggggccgagggagcgaga

SEQ ID NO: 19785 - DNA, 25 bp, Homo sapiens
aatcccggggccgagggagcgagac

SEQ ID NO: 19786 - DNA, 26 bp, Homo sapiens
aatcccggggccgagggagcgagacc

SEQ ID NO: 19787 - DNA, 28 bp, Homo sapiens
aatcccggggccgagggagcgagacccg

SEQ ID NO: 19788 - DNA, 30 bp, Homo sapiens
aatcccggggccgagggagcgagacccgtc

SEQ ID NO: 19789 - DNA, 31 bp, Homo sapiens
aatcccggggccgagggagcgagacccgtcg

SEQ ID NO: 19790 - DNA, 32 bp, Homo sapiens
aatcccggggccgagggagcgagacccgtcgc

SEQ ID NO: 19791 - DNA, 33 bp, Homo sapiens
aatcccggggccgagggagcgagacccgtcgcc

SEQ ID NO: 19792 - DNA, 19 bp, Homo sapiens
atcccggggccgagggagc

SEQ ID NO: 19793 - DNA, 21 bp, Homo sapiens
atcccggggccgagggagcga

SEQ ID NO: 19794 - DNA, 22 bp, Homo sapiens
atcccggggccgagggagcgag

SEQ ID NO: 19795 - DNA, 23 bp, Homo sapiens
atcccggggccgagggagcgaga

SEQ ID NO: 19796 - DNA, 24 bp, Homo sapiens
atcccggggccgagggagcgagac

SEQ ID NO: 19797 - DNA, 27 bp, Homo sapiens
atcccggggccgagggagcgagacccg

SEQ ID NO: 19798 - DNA, 30 bp, Homo sapiens
atcccggggccgagggagcgagacccgtcg

SEQ ID NO: 19799 - DNA, 32 bp, Homo sapiens
atcccggggccgagggagcgagacccgtcgcc

SEQ ID NO: 19800 - DNA, 33 bp, Homo sapiens
atcccggggccgagggagcgagacccgtcgccg

SEQ ID NO: 19801 - DNA, 18 bp, Homo sapiens
tcccggggccgagggagc

SEQ ID NO: 19802 - DNA, 19 bp, Homo sapiens
tcccggggccgagggagcg

SEQ ID NO: 19803 - DNA, 20 bp, Homo sapiens
tcccggggccgagggagcga

SEQ ID NO: 19804 - DNA, 22 bp, Homo sapiens
tcccggggccgagggagcgaga

SEQ ID NO: 19805 - DNA, 23 bp, Homo sapiens
tcccggggccgagggagcgagac

SEQ ID NO: 19806 - DNA, 29 bp, Homo sapiens
tcccggggccgagggagcgagacccgtcg

SEQ ID NO: 19807 - DNA, 31 bp, Homo sapiens
tcccggggccgagggagcgagacccgtcgcc

SEQ ID NO: 19808 - DNA, 32 bp, Homo sapiens
tcccggggccgagggagcgagacccgtcgccg

SEQ ID NO: 19809 - DNA, 17 bp, Homo sapiens
cccggggccgagggagc

SEQ ID NO: 19810 - DNA, 21 bp, Homo sapiens
cccggggccgagggagcgaga

SEQ ID NO: 19811 - DNA, 22 bp, Homo sapiens
cccggggccgagggagcgagac

SEQ ID NO: 19812 - DNA, 16 bp, Homo sapiens
ccggggccgagggagc

SEQ ID NO: 19813 - DNA, 17 bp, Homo sapiens
ccggggccgagggagcg

SEQ ID NO: 19814 - DNA, 20 bp, Homo sapiens
ccggggccgagggagcgaga

SEQ ID NO: 19815 - DNA, 21 bp, Homo sapiens
ccggggccgagggagcgagac

SEQ ID NO: 19816 - DNA, 20 bp, Homo sapiens
cggggccgagggagcgagac

SEQ ID NO: 19817 - DNA, 23 bp, Homo sapiens
cggggccgagggagcgagacccg

SEQ ID NO: 19818 - DNA, 24 bp, Homo sapiens
cggggccgagggagcgagacccgt

SEQ ID NO: 19819 - DNA, 28 bp, Homo sapiens
cggggccgagggagcgagacccgtcgcc

SEQ ID NO: 19820 - DNA, 29 bp, Homo sapiens
cggggccgagggagcgagacccgtcgccg

SEQ ID NO: 19821 - DNA, 30 bp, Homo sapiens
cggggccgagggagcgagacccgtcgccgc

SEQ ID NO: 19822 - DNA, 31 bp, Homo sapiens; identical to SEQ ID NO: 4254

SEQ ID NO: 19823 - DNA, 32 bp, Homo sapiens; identical to SEQ ID NO: 4255

SEQ ID NO: 19824 - DNA, 19 bp, Homo sapiens
ggggccgagggagcgagac

SEQ ID NO: 19825 - DNA, 21 bp, Homo sapiens
ggggccgagggagcgagaccc

SEQ ID NO: 19826 - DNA, 22 bp, Homo sapiens
ggggccgagggagcgagacccg

SEQ ID NO: 19827 - DNA, 23 bp, Homo sapiens
ggggccgagggagcgagacccgt

SEQ ID NO: 19828 - DNA, 27 bp, Homo sapiens
ggggccgagggagcgagacccgtcgcc

SEQ ID NO: 19829 - DNA, 25 bp, Homo sapiens
gagggagcgagacccgtcgccgcgc

SEQ ID NO: 19830 - DNA, 17 bp, Homo sapiens
cgagacccgtcgccgcg

SEQ ID NO: 19831 - DNA, 18 bp, Homo sapiens
cgagacccgtcgccgcgc

SEQ ID NO: 19832 - DNA, 16 bp, Homo sapiens
gagacccgtcgccgcg

SEQ ID NO: 19833 - DNA, 17 bp, Homo sapiens
gagacccgtcgccgcgc

SEQ ID NO: 19834 - DNA, 18 bp, Homo sapiens
gagacccgtcgccgcgct

SEQ ID NO: 19835 - DNA, 23 bp, Homo sapiens
gagacccgtcgccgcgctctccc

SEQ ID NO: 19836 - DNA, 24 bp, Homo sapiens
gagacccgtcgccgcgctctcccc

SEQ ID NO: 19837 - DNA, 25 bp, Homo sapiens
gagacccgtcgccgcgctctccccc

SEQ ID NO: 19838 - DNA, 26 bp, Homo sapiens
gagacccgtcgccgcgctctcccccc

SEQ ID NO: 19839 - DNA, 27 bp, Homo sapiens
gagacccgtcgccgcgctctcccccct

SEQ ID NO: 19840 - DNA, 16 bp, Homo sapiens
agacccgtcgccgcgc

SEQ ID NO: 19841 - DNA, 17 bp, Homo sapiens
agacccgtcgccgcgct

SEQ ID NO: 19842 - DNA, 22 bp, Homo sapiens
agacccgtcgccgcgctctccc

SEQ ID NO: 19843 - DNA, 23 bp, Homo sapiens
agacccgtcgccgcgctctcccc

SEQ ID NO: 19844 - DNA, 26 bp, Homo sapiens
agacccgtcgccgcgctctcccccct

SEQ ID NO: 19845 - DNA, 16 bp, Homo sapiens
gacccgtcgccgcgct

SEQ ID NO: 19846 - DNA, 17 bp, Homo sapiens
gacccgtcgccgcgctc

SEQ ID NO: 19847 - DNA, 18 bp, Homo sapiens
gacccgtcgccgcgctct

SEQ ID NO: 19848 - DNA, 19 bp, Homo sapiens
gacccgtcgccgcgctctc

SEQ ID NO: 19849 - DNA, 20 bp, Homo sapiens
gacccgtcgccgcgctctcc

SEQ ID NO: 19850 - DNA, 21 bp, Homo sapiens
gacccgtcgccgcgctctccc

SEQ ID NO: 19851 - DNA, 22 bp, Homo sapiens
gacccgtcgccgcgctctcccc

SEQ ID NO: 19852 - DNA, 23 bp, Homo sapiens
gacccgtcgccgcgctctccccc

SEQ ID NO: 19853 - DNA, 25 bp, Homo sapiens
gacccgtcgccgcgctctcccccct

SEQ ID NO: 19854 - DNA, 29 bp, Homo sapiens
gacccgtcgccgcgctctcccccctcccg

SEQ ID NO: 19855 - DNA, 30 bp, Homo sapiens
gacccgtcgccgcgctctcccccctcccgg

SEQ ID NO: 19856 - DNA, 22 bp, Homo sapiens
acccgtcgccgcgctctccccc

SEQ ID NO: 19857 - DNA, 23 bp, Homo sapiens
acccgtcgccgcgctctcccccc

SEQ ID NO: 19858 - DNA, 21 bp, Homo sapiens
cccgtcgccgcgctctccccc

SEQ ID NO: 19859 - DNA, 22 bp, Homo sapiens
cccgtcgccgcgctctcccccc

SEQ ID NO: 19860 - DNA, 27 bp, Homo sapiens
cccgtcgccgcgctctcccccctcccg

SEQ ID NO: 19861 - DNA, 28 bp, Homo sapiens
cccgtcgccgcgctctcccccctcccgg

SEQ ID NO: 19862 - DNA, 29 bp, Homo sapiens
cccgtcgccgcgctctcccccctcccggc

SEQ ID NO: 19863 - DNA, 33 bp, Homo sapiens
cccgtcgccgcgctctcccccctcccggcgccc

SEQ ID NO: 19864 - DNA, 22 bp, Homo sapiens
ccgtcgccgcgctctcccccct

SEQ ID NO: 19865 - DNA, 23 bp, Homo sapiens
cgctctcccccctcccggcgccc

SEQ ID NO: 19866 - DNA, 19 bp, Homo sapiens
ctcccccctcccggcgccc

SEQ ID NO: 19867 - DNA, 18 bp, Homo sapiens
tcccccctcccggcgccc

SEQ ID NO: 19868 - DNA, 16 bp, Homo sapiens
cccccctcccggcgcc

SEQ ID NO: 19869 - DNA, 17 bp, Homo sapiens
cccccctcccggcgccc

SEQ ID NO: 19870 - DNA, 30 bp, Homo sapiens
cccccctcccggcgcccacccccgcgggga

SEQ ID NO: 19871 - DNA, 16 bp, Homo sapiens
ccccctcccggcgccc

SEQ ID NO: 19872 - DNA, 23 bp, Homo sapiens
cccggcgcccacccccgcgggga

SEQ ID NO: 19873 - DNA, 22 bp, Homo sapiens
ccggcgcccacccccgcgggga

SEQ ID NO: 19874 - DNA, 16 bp, Homo sapiens
cgcccacccccgcggg

SEQ ID NO: 19875 - DNA, 17 bp, Homo sapiens
cgcccacccccgcgggg

SEQ ID NO: 19876 - DNA, 18 bp, Homo sapiens
cgcccacccccgcgggga

SEQ ID NO: 19877 - DNA, 19 bp, Homo sapiens
cgcccacccccgcggggaa

SEQ ID NO: 19878 - DNA, 17 bp, Homo sapiens
ccccgcgaggggggtct

SEQ ID NO: 19879 - DNA, 23 bp, Homo sapiens
ccccgcgaggggggtctcccccg

SEQ ID NO: 19880 - DNA, 37 bp, Homo sapiens
cccgcgaggggggtctcccccgcgggggcgcgccggc

SEQ ID NO: 19881 - DNA, 24 bp, Homo sapiens
tctcccccgcgggggcgcgccggc

SEQ ID NO: 19882 - DNA, 23 bp, Homo sapiens
ctcccccgcgggggcgcgccggc

SEQ ID NO: 19883 - DNA, 22 bp, Homo sapiens
tcccccgcgggggcgcgccggc

SEQ ID NO: 19884 - DNA, 27 bp, Homo sapiens
tcccccgcgggggcgcgccggcgtctc

SEQ ID NO: 19885 - DNA, 18 bp, Homo sapiens
cccccgcgggggcgcgcc

SEQ ID NO: 19886 - DNA, 19 bp, Homo sapiens
cccccgcgggggcgcgccg

SEQ ID NO: 19887 - DNA, 20 bp, Homo sapiens
cccccgcgggggcgcgccgg

SEQ ID NO: 19888 - DNA, 21 bp, Homo sapiens
cccccgcgggggcgcgccggc

SEQ ID NO: 19889 - DNA, 22 bp, Homo sapiens
cccccgcgggggcgcgccggcg

SEQ ID NO: 19890 - DNA, 17 bp, Homo sapiens
ccccgcgggggcgcgcc

SEQ ID NO: 19891 - DNA, 18 bp, Homo sapiens
ccccgcgggggcgcgccg

SEQ ID NO: 19892 - DNA, 19 bp, Homo sapiens
ccccgcgggggcgcgccgg

SEQ ID NO: 19893 - DNA, 20 bp, Homo sapiens
ccccgcgggggcgcgccggc

SEQ ID NO: 19894 - DNA, 16 bp, Homo sapiens
cccgcgggggcgcgcc

SEQ ID NO: 19895 - DNA, 17 bp, Homo sapiens
cccgcgggggcgcgccg

SEQ ID NO: 19896 - DNA, 18 bp, Homo sapiens
cccgcgggggcgcgccgg

SEQ ID NO: 19897 - DNA, 19 bp, Homo sapiens
cccgcgggggcgcgccggc

SEQ ID NO: 19898 - DNA, 20 bp, Homo sapiens
cccgcgggggcgcgccggcg

SEQ ID NO: 19899 - DNA, 17 bp, Homo sapiens
ccgcgggggcgcgccgg

SEQ ID NO: 19900 - DNA, 16 bp, Homo sapiens
cgcgggggcgcgccgg

SEQ ID NO: 19901 - DNA, 19 bp, Homo sapiens
ccggcgtctcctcgtgggg

SEQ ID NO: 19902 - DNA, 20 bp, Homo sapiens
ccggcgtctcctcgtggggg

SEQ ID NO: 19903 - DNA, 22 bp, Homo sapiens
tctcctcgtgggggggccgggc

SEQ ID NO: 19904 - DNA, 21 bp, Homo sapiens
ctcctcgtgggggggccgggc

SEQ ID NO: 19905 - DNA, 20 bp, Homo sapiens
tcctcgtgggggggccgggc

SEQ ID NO: 19906 - DNA, 19 bp, Homo sapiens
cctcgtgggggggccgggc

SEQ ID NO: 19907 - DNA, 20 bp, Homo sapiens
cctcgtgggggggccgggcc

SEQ ID NO: 19908 - DNA, 21 bp, Homo sapiens
cctcgtgggggggccgggcca

SEQ ID NO: 19909 - DNA, 19 bp, Homo sapiens
ctcgtgggggggccgggcc

SEQ ID NO: 19910 - DNA, 20 bp, Homo sapiens
ctcgtgggggggccgggcca

SEQ ID NO: 19911 - DNA, 18 bp, Homo sapiens
tcgtgggggggccgggcc

SEQ ID NO: 19912 - DNA, 30 bp, Homo sapiens
ggggccgggccacccctcccacggcgcgac

SEQ ID NO: 19913 - DNA, 30 bp, Homo sapiens
cgggccacccctcccacggcgcgaccgctc

SEQ ID NO: 19914 - DNA, 28 bp, Homo sapiens
ccacccctcccacggcgcgaccgctctc

SEQ ID NO: 19915 - DNA, 27 bp, Homo sapiens
cacccctcccacggcgcgaccgctctc

SEQ ID NO: 19916 - DNA, 26 bp, Homo sapiens
acccctcccacggcgcgaccgctctc

SEQ ID NO: 19917 - DNA, 20 bp, Homo sapiens
cccctcccacggcgcgaccg

SEQ ID NO: 19918 - DNA, 21 bp, Homo sapiens
cccctcccacggcgcgaccgc

SEQ ID NO: 19919 - DNA, 18 bp, Homo sapiens
ccctcccacggcgcgacc

SEQ ID NO: 19920 - DNA, 19 bp, Homo sapiens
ccctcccacggcgcgaccg

SEQ ID NO: 19921 - DNA, 20 bp, Homo sapiens
ccctcccacggcgcgaccgc

SEQ ID NO: 19922 - DNA, 17 bp, Homo sapiens
cctcccacggcgcgacc

SEQ ID NO: 19923 - DNA, 18 bp, Homo sapiens
cctcccacggcgcgaccg

SEQ ID NO: 19924 - DNA, 19 bp, Homo sapiens
cctcccacggcgcgaccgc

SEQ ID NO: 19925 - DNA, 21 bp, Homo sapiens
cctcccacggcgcgaccgctc

SEQ ID NO: 19926 - DNA, 23 bp, Homo sapiens
cctcccacggcgcgaccgctctc

SEQ ID NO: 19927 - DNA, 16 bp, Homo sapiens
ctcccacggcgcgacc

SEQ ID NO: 19928 - DNA, 17 bp, Homo sapiens
ctcccacggcgcgaccg

SEQ ID NO: 19929 - DNA, 18 bp, Homo sapiens
ctcccacggcgcgaccgc

SEQ ID NO: 19930 - DNA, 20 bp, Homo sapiens
ctcccacggcgcgaccgctc

SEQ ID NO: 19931 - DNA, 22 bp, Homo sapiens
ctcccacggcgcgaccgctctc

SEQ ID NO: 19932 - DNA, 23 bp, Homo sapiens
ctcccacggcgcgaccgctctcc

SEQ ID NO: 19933 - DNA, 24 bp, Homo sapiens
ctcccacggcgcgaccgctctccc

SEQ ID NO: 19934 - DNA, 16 bp, Homo sapiens
tcccacggcgcgaccg

SEQ ID NO: 19935 - DNA, 19 bp, Homo sapiens
tcccacggcgcgaccgctc

SEQ ID NO: 19936 - DNA, 21 bp, Homo sapiens
tcccacggcgcgaccgctctc

SEQ ID NO: 19937 - DNA, 16 bp, Homo sapiens
cccacggcgcgaccgc

SEQ ID NO: 19938 - DNA, 18 bp, Homo sapiens
cccacggcgcgaccgctc

SEQ ID NO: 19939 - DNA, 22 bp, Homo sapiens
cccacggcgcgaccgctctccc

SEQ ID NO: 19940 - DNA, 18 bp, Homo sapiens
cggcgcgaccgctctccc

SEQ ID NO: 19941 - DNA, 19 bp, Homo sapiens
cggcgcgaccgctctccca

SEQ ID NO: 19942 - DNA, 22 bp, Homo sapiens
cggcgcgaccgctctcccaccc

SEQ ID NO: 19943 - DNA, 23 bp, Homo sapiens
cggcgcgaccgctctcccacccc

SEQ ID NO: 19944 - DNA, 26 bp, Homo sapiens
cggcgcgaccgctctcccacccctcc

SEQ ID NO: 19945 - DNA, 30 bp, Homo sapiens
cggcgcgaccgctctcccacccctcctccc

SEQ ID NO: 19946 - DNA, 32 bp, Homo sapiens
cggcgcgaccgctctcccacccctcctccccg

SEQ ID NO: 19947 - DNA, 25 bp, Homo sapiens
cacccctcctccccgcgcccccgcc

SEQ ID NO: 19948 - DNA, 27 bp, Homo sapiens
acccctcctccccgcgcccccgccccg

SEQ ID NO: 19949 - DNA, 30 bp, Homo sapiens
cccctcctccccgcgcccccgccccggcga

SEQ ID NO: 19950 - DNA, 18 bp, Homo sapiens
tccccgcgcccccgcccc

SEQ ID NO: 19951 - DNA, 19 bp, Homo sapiens
tccccgcgcccccgccccg

SEQ ID NO: 19952 - DNA, 16 bp, Homo sapiens
ccccgcgcccccgccc

SEQ ID NO: 19953 - DNA, 17 bp, Homo sapiens
ccccgcgcccccgcccc

SEQ ID NO: 19954 - DNA, 18 bp, Homo sapiens
ccccgcgcccccgccccg

SEQ ID NO: 19955 - DNA, 16 bp, Homo sapiens
cccgcgcccccgcccc

SEQ ID NO: 19956 - DNA, 17 bp, Homo sapiens
cccgcgcccccgccccg

SEQ ID NO: 19957 - DNA, 19 bp, Homo sapiens
cccgcgcccccgccccggc

SEQ ID NO: 19958 - DNA, 16 bp, Homo sapiens
ccgcgcccccgccccg

SEQ ID NO: 19959 - DNA, 17 bp, Homo sapiens
cgcgcccccgccccggc

SEQ ID NO: 19960 - DNA, 31 bp, Homo sapiens
gccgcgcgcgggtcggggggcggggcggact

SEQ ID NO: 19961 - DNA, 19 bp, Homo sapiens
gcgcgcgggtcggggggcg

SEQ ID NO: 19962 - DNA, 28 bp, Homo sapiens
gcgcgcgggtcggggggcggggcggact

SEQ ID NO: 19963 - DNA, 30 bp, Homo sapiens
gcgcgcgggtcggggggcggggcggactgt

SEQ ID NO: 19964 - DNA, 31 bp, Homo sapiens
gcgcgcgggtcggggggcggggcggactgtc

SEQ ID NO: 19965 - DNA, 32 bp, Homo sapiens; identical to SEQ ID NO: 4266

SEQ ID NO: 19966 - DNA, 33 bp, Homo sapiens
gcgcgcgggtcggggggcggggcggactgtccc

SEQ ID NO: 19967 - DNA, 27 bp, Homo sapiens
cgcgcgggtcggggggcggggcggact

SEQ ID NO: 19968 - DNA, 30 bp, Homo sapiens
cgcgcgggtcggggggcggggcggactgtc

SEQ ID NO: 19969 - DNA, 30 bp, Homo sapiens
cgcgggtcggggggcggggcggactgtccc

SEQ ID NO: 19970 - DNA, 23 bp, Homo sapiens
gcgggtcggggggcggggcggac

SEQ ID NO: 19971 - DNA, 24 bp, Homo sapiens
gcgggtcggggggcggggcggact

SEQ ID NO: 19972 - DNA, 16 bp, Homo sapiens
ggggggcggggcggac

SEQ ID NO: 19973 - DNA, 17 bp, Homo sapiens
ggggggcggggcggact

SEQ ID NO: 19974 - DNA, 19 bp, Homo sapiens
ggggcggggcggactgtcc

SEQ ID NO: 19975 - DNA, 17 bp, Homo sapiens
gggcggggcggactgtc

SEQ ID NO: 19976 - DNA, 18 bp, Homo sapiens
gggcggggcggactgtcc

SEQ ID NO: 19977 - DNA, 19 bp, Homo sapiens
gggcggggcggactgtccc

SEQ ID NO: 19978 - DNA, 16 bp, Homo sapiens
ggcggggcggactgtc

SEQ ID NO: 19979 - DNA, 17 bp, Homo sapiens
ggcggggcggactgtcc

SEQ ID NO: 19980 - DNA, 18 bp, Homo sapiens
ggcggggcggactgtccc

SEQ ID NO: 19981 - DNA, 16 bp, Homo sapiens
gcggggcggactgtcc

SEQ ID NO: 19982 - DNA, 16 bp, Homo sapiens
cggggcggactgtccc

SEQ ID NO: 19983 - DNA, 20 bp, Homo sapiens
ggcggactgtccccagtgcg

SEQ ID NO: 19984 - DNA, 16 bp, Homo sapiens
gcggactgtccccagt

SEQ ID NO: 19985 - DNA, 18 bp, Homo sapiens
gcggactgtccccagtgc

SEQ ID NO: 19986 - DNA, 19 bp, Homo sapiens
gcggactgtccccagtgcg

SEQ ID NO: 19987 - DNA, 17 bp, Homo sapiens
cggactgtccccagtgc

SEQ ID NO: 19988 - DNA, 18 bp, Homo sapiens
cggactgtccccagtgcg

SEQ ID NO: 19989 - DNA, 20 bp, Homo sapiens
cggactgtccccagtgcgcc

SEQ ID NO: 19990 - DNA, 21 bp, Homo sapiens
cggactgtccccagtgcgccc

SEQ ID NO: 19991 - DNA, 22 bp, Homo sapiens
cggactgtccccagtgcgcccc

SEQ ID NO: 19992 - DNA, 23 bp, Homo sapiens
cggactgtccccagtgcgccccg

SEQ ID NO: 19993 - DNA, 24 bp, Homo sapiens
cggactgtccccagtgcgccccgg

SEQ ID NO: 19994 - DNA, 25 bp, Homo sapiens
cggactgtccccagtgcgccccggg

SEQ ID NO: 19995 - DNA, 26 bp, Homo sapiens
cggactgtccccagtgcgccccgggc

SEQ ID NO: 19996 - DNA, 19 bp, Homo sapiens
ctgtccccagtgcgccccg

SEQ ID NO: 19997 - DNA, 20 bp, Homo sapiens
ctgtccccagtgcgccccgg

SEQ ID NO: 19998 - DNA, 22 bp, Homo sapiens
ctgtccccagtgcgccccgggc

SEQ ID NO: 19999 - DNA, 18 bp, Homo sapiens
ccccagtgcgccccgggc

SEQ ID NO: 20000 - DNA, 16 bp, Homo sapiens
ccagtgcgccccgggc

SEQ ID NO: 20001 - DNA, 32 bp, Homo sapiens
ccagtgcgccccgggcgggtcgcgccgtcggg

SEQ ID NO: 20002 - DNA, 33 bp, Homo sapiens; identical to SEQ ID NO: 4271

SEQ ID NO: 20003 - DNA, 34 bp, Homo sapiens
ccagtgcgccccgggcgggtcgcgccgtcgggcc

SEQ ID NO: 20004 - DNA, 16 bp, Homo sapiens
cagtgcgccccgggcg

SEQ ID NO: 20005 - DNA, 17 bp, Homo sapiens
cagtgcgccccgggcgg

SEQ ID NO: 20006 - DNA, 18 bp, Homo sapiens
cagtgcgccccgggcggg

SEQ ID NO: 20007 - DNA, 20 bp, Homo sapiens
cagtgcgccccgggcgggtc

SEQ ID NO: 20008 - DNA, 29 bp, Homo sapiens
cagtgcgccccgggcgggtcgcgccgtcg

SEQ ID NO: 20009 - DNA, 30 bp, Homo sapiens
cagtgcgccccgggcgggtcgcgccgtcgg

SEQ ID NO: 20010 - DNA, 31 bp, Homo sapiens
cagtgcgccccgggcgggtcgcgccgtcggg

SEQ ID NO: 20011 - DNA, 32 bp, Homo sapiens; identical to SEQ ID NO: 4273

SEQ ID NO: 20012 - DNA, 33 bp, Homo sapiens; identical to SEQ ID NO: 4274

SEQ ID NO: 20013 - DNA, 34 bp, Homo sapiens
cagtgcgccccgggcgggtcgcgccgtcgggccc

SEQ ID NO: 20014 - DNA, 35 bp, Homo sapiens
cagtgcgccccgggcgggtcgcgccgtcgggcccg

SEQ ID NO: 20015 - DNA, 36 bp, Homo sapiens
cagtgcgccccgggcgggtcgcgccgtcgggcccgg

SEQ ID NO: 20016 - DNA, 37 bp, Homo sapiens
cagtgcgccccgggcgggtcgcgccgtcgggcccggg

SEQ ID NO: 20017 - DNA, 16 bp, Homo sapiens
agtgcgccccgggcgg

SEQ ID NO: 20018 - DNA, 17 bp, Homo sapiens
agtgcgccccgggcggg

SEQ ID NO: 20019 - DNA, 29 bp, Homo sapiens
agtgcgccccgggcgggtcgcgccgtcgg

SEQ ID NO: 20020 - DNA, 30 bp, Homo sapiens
agtgcgccccgggcgggtcgcgccgtcggg

SEQ ID NO: 20021 - DNA, 31 bp, Homo sapiens; identical to SEQ ID NO: 4275

SEQ ID NO: 20022 - DNA, 32 bp, Homo sapiens; identical to SEQ ID NO: 4276

SEQ ID NO: 20023 - DNA, 33 bp, Homo sapiens; identical to SEQ ID NO: 4277

SEQ ID NO: 20024 - DNA, 34 bp, Homo sapiens
agtgcgccccgggcgggtcgcgccgtcgggcccg

SEQ ID NO: 20025 - DNA, 35 bp, Homo sapiens
agtgcgccccgggcgggtcgcgccgtcgggcccgg

SEQ ID NO: 20026 - DNA, 36 bp, Homo sapiens
agtgcgccccgggcgggtcgcgccgtcgggcccggg

SEQ ID NO: 20027 - DNA, 27 bp, Homo sapiens
gcgccccgggcgggtcgcgccgtcggg

SEQ ID NO: 20028 - DNA, 29 bp, Homo sapiens
gcgccccgggcgggtcgcgccgtcgggcc

SEQ ID NO: 20029 - DNA, 19 bp, Homo sapiens
cgccccgggcgggtcgcgc

SEQ ID NO: 20030 - DNA, 20 bp, Homo sapiens
cgccccgggcgggtcgcgcc

SEQ ID NO: 20031 - DNA, 21 bp, Homo sapiens
cgccccgggcgggtcgcgccg

SEQ ID NO: 20032 - DNA, 23 bp, Homo sapiens
cgccccgggcgggtcgcgccgtc

SEQ ID NO: 20033 - DNA, 25 bp, Homo sapiens
cgccccgggcgggtcgcgccgtcgg

SEQ ID NO: 20034 - DNA, 26 bp, Homo sapiens
cgccccgggcgggtcgcgccgtcggg

SEQ ID NO: 20035 - DNA, 27 bp, Homo sapiens
cgccccgggcgggtcgcgccgtcgggc

SEQ ID NO: 20036 - DNA, 30 bp, Homo sapiens
cgccccgggcgggtcgcgccgtcgggcccg

SEQ ID NO: 20037 - DNA, 31 bp, Homo sapiens
cgccccgggcgggtcgcgccgtcgggcccgg

SEQ ID NO: 20038 - DNA, 19 bp, Homo sapiens
gccccgggcgggtcgcgcc

SEQ ID NO: 20039 - DNA, 20 bp, Homo sapiens
gccccgggcgggtcgcgccg

SEQ ID NO: 20040 - DNA, 21 bp, Homo sapiens
gccccgggcgggtcgcgccgt

SEQ ID NO: 20041 - DNA, 22 bp, Homo sapiens
gccccgggcgggtcgcgccgtc

SEQ ID NO: 20042 - DNA, 25 bp, Homo sapiens
gccccgggcgggtcgcgccgtcggg

SEQ ID NO: 20043 - DNA, 26 bp, Homo sapiens
gccccgggcgggtcgcgccgtcgggc

SEQ ID NO: 20044 - DNA, 29 bp, Homo sapiens
gccccgggcgggtcgcgccgtcgggcccg

SEQ ID NO: 20045 - DNA, 30 bp, Homo sapiens
gccccgggcgggtcgcgccgtcgggcccgg

SEQ ID NO: 20046 - DNA, 19 bp, Homo sapiens
ccccgggcgggtcgcgccg

SEQ ID NO: 20047 - DNA, 25 bp, Homo sapiens
ccccgggcgggtcgcgccgtcgggc

SEQ ID NO: 20048 - DNA, 17 bp, Homo sapiens
cccgggcgggtcgcgcc

SEQ ID NO: 20049 - DNA, 18 bp, Homo sapiens
cccgggcgggtcgcgccg

SEQ ID NO: 20050 - DNA, 24 bp, Homo sapiens
cccgggcgggtcgcgccgtcgggc

SEQ ID NO: 20051 - DNA, 23 bp, Homo sapiens
ccgggcgggtcgcgccgtcgggc

SEQ ID NO: 20052 - DNA, 24 bp, Homo sapiens
ccgggcgggtcgcgccgtcgggcc

SEQ ID NO: 20053 - DNA, 22 bp, Homo sapiens
cgggcgggtcgcgccgtcgggc

SEQ ID NO: 20054 - DNA, 23 bp, Homo sapiens
cgggcgggtcgcgccgtcgggcc

SEQ ID NO: 20055 - DNA, 24 bp, Homo sapiens
cgggcgggtcgcgccgtcgggccc

SEQ ID NO: 20056 - DNA, 25 bp, Homo sapiens
cgggcgggtcgcgccgtcgggcccg

SEQ ID NO: 20057 - DNA, 27 bp, Homo sapiens
cgggcgggtcgcgccgtcgggcccggg

SEQ ID NO: 20058 - DNA, 28 bp, Homo sapiens
cgggcgggtcgcgccgtcgggcccgggg

SEQ ID NO: 20059 - DNA, 21 bp, Homo sapiens
gggcgggtcgcgccgtcgggc

SEQ ID NO: 20060 - DNA, 22 bp, Homo sapiens
gggcgggtcgcgccgtcgggcc

SEQ ID NO: 20061 - DNA, 23 bp, Homo sapiens
gggcgggtcgcgccgtcgggccc

SEQ ID NO: 20062 - DNA, 24 bp, Homo sapiens
gggcgggtcgcgccgtcgggcccg

SEQ ID NO: 20063 - DNA, 25 bp, Homo sapiens
gggcgggtcgcgccgtcgggcccgg

SEQ ID NO: 20064 - DNA, 26 bp, Homo sapiens
gggcgggtcgcgccgtcgggcccggg

SEQ ID NO: 20065 - DNA, 20 bp, Homo sapiens
ggcgggtcgcgccgtcgggc

SEQ ID NO: 20066 - DNA, 21 bp, Homo sapiens
ggcgggtcgcgccgtcgggcc

SEQ ID NO: 20067 - DNA, 22 bp, Homo sapiens
ggcgggtcgcgccgtcgggccc

SEQ ID NO: 20068 - DNA, 23 bp, Homo sapiens
ggcgggtcgcgccgtcgggcccg

SEQ ID NO: 20069 - DNA, 24 bp, Homo sapiens
ggcgggtcgcgccgtcgggcccgg

SEQ ID NO: 20070 - DNA, 28 bp, Homo sapiens
ggcgggtcgcgccgtcgggcccggggga

SEQ ID NO: 20071 - DNA, 20 bp, Homo sapiens
gcgggtcgcgccgtcgggcc

SEQ ID NO: 20072 - DNA, 21 bp, Homo sapiens
gcgggtcgcgccgtcgggccc

SEQ ID NO: 20073 - DNA, 22 bp, Homo sapiens
gcgggtcgcgccgtcgggcccg

SEQ ID NO: 20074 - DNA, 18 bp, Homo sapiens
cgggtcgcgccgtcgggc

SEQ ID NO: 20075 - DNA, 19 bp, Homo sapiens
cgggtcgcgccgtcgggcc

SEQ ID NO: 20076 - DNA, 17 bp, Homo sapiens
gggtcgcgccgtcgggc

SEQ ID NO: 20077 - DNA, 18 bp, Homo sapiens
gggtcgcgccgtcgggcc

SEQ ID NO: 20078 - DNA, 28 bp, Homo sapiens
gggtcgcgccgtcgggcccgggggaggt

SEQ ID NO: 20079 - DNA, 29 bp, Homo sapiens
gggtcgcgccgtcgggcccgggggaggtt

SEQ ID NO: 20080 - DNA, 16 bp, Homo sapiens
ggtcgcgccgtcgggc

SEQ ID NO: 20081 - DNA, 17 bp, Homo sapiens
ggtcgcgccgtcgggcc

SEQ ID NO: 20082 - DNA, 18 bp, Homo sapiens
ggtcgcgccgtcgggccc

SEQ ID NO: 20083 - DNA, 19 bp, Homo sapiens
ggtcgcgccgtcgggcccg

SEQ ID NO: 20084 - DNA, 20 bp, Homo sapiens
ggtcgcgccgtcgggcccgg

SEQ ID NO: 20085 - DNA, 21 bp, Homo sapiens
ggtcgcgccgtcgggcccggg

SEQ ID NO: 20086 - DNA, 22 bp, Homo sapiens
ggtcgcgccgtcgggcccgggg

SEQ ID NO: 20087 - DNA, 23 bp, Homo sapiens
ggtcgcgccgtcgggcccggggg

SEQ ID NO: 20088 - DNA, 24 bp, Homo sapiens
ggtcgcgccgtcgggcccggggga

SEQ ID NO: 20089 - DNA, 25 bp, Homo sapiens
ggtcgcgccgtcgggcccgggggag

SEQ ID NO: 20090 - DNA, 26 bp, Homo sapiens
ggtcgcgccgtcgggcccgggggagg

SEQ ID NO: 20091 - DNA, 30 bp, Homo sapiens
ggtcgcgccgtcgggcccgggggaggttct

SEQ ID NO: 20092 - DNA, 31 bp, Homo sapiens
ggtcgcgccgtcgggcccgggggaggttctc

SEQ ID NO: 20093 - DNA, 32 bp, Homo sapiens; identical to SEQ ID NO: 4290

SEQ ID NO: 20094 - DNA, 16 bp, Homo sapiens
gtcgcgccgtcgggcc

SEQ ID NO: 20095 - DNA, 17 bp, Homo sapiens
gtcgcgccgtcgggccc

SEQ ID NO: 20096 - DNA, 18 bp, Homo sapiens
gtcgcgccgtcgggcccg

SEQ ID NO: 20097 - DNA, 19 bp, Homo sapiens
gtcgcgccgtcgggcccgg

SEQ ID NO: 20098 - DNA, 22 bp, Homo sapiens
gtcgcgccgtcgggcccggggg

SEQ ID NO: 20099 - DNA, 23 bp, Homo sapiens
gtcgcgccgtcgggcccggggga

SEQ ID NO: 20100 - DNA, 16 bp, Homo sapiens
tcgcgccgtcgggccc

SEQ ID NO: 20101 - DNA, 17 bp, Homo sapiens
tcgcgccgtcgggcccg

SEQ ID NO: 20102 - DNA, 19 bp, Homo sapiens
tcgcgccgtcgggcccggg

SEQ ID NO: 20103 - DNA, 20 bp, Homo sapiens
tcgcgccgtcgggcccgggg

SEQ ID NO: 20104 - DNA, 22 bp, Homo sapiens
tcgcgccgtcgggcccggggga

SEQ ID NO: 20105 - DNA, 23 bp, Homo sapiens
tcgcgccgtcgggcccgggggag

SEQ ID NO: 20106 - DNA, 24 bp, Homo sapiens
tcgcgccgtcgggcccgggggagg

SEQ ID NO: 20107 - DNA, 16 bp, Homo sapiens
cgcgccgtcgggcccg

SEQ ID NO: 20108 - DNA, 17 bp, Homo sapiens
cgcgccgtcgggcccgg

SEQ ID NO: 20109 - DNA, 18 bp, Homo sapiens
cgcgccgtcgggcccggg

SEQ ID NO: 20110 - DNA, 19 bp, Homo sapiens
cgcgccgtcgggcccgggg

SEQ ID NO: 20111 - DNA, 21 bp, Homo sapiens
cgcgccgtcgggcccggggga

SEQ ID NO: 20112 - DNA, 33 bp, Homo sapiens
cgcgccgtcgggcccgggggaggttctctcggg

SEQ ID NO: 20113 - DNA, 16 bp, Homo sapiens
gcgccgtcgggcccgg

SEQ ID NO: 20114 - DNA, 17 bp, Homo sapiens
gcgccgtcgggcccggg

SEQ ID NO: 20115 - DNA, 19 bp, Homo sapiens
gcgccgtcgggcccggggg

SEQ ID NO: 20116 - DNA, 20 bp, Homo sapiens
gcgccgtcgggcccggggga

SEQ ID NO: 20117 - DNA, 21 bp, Homo sapiens
gcgccgtcgggcccgggggag

SEQ ID NO: 20118 - DNA, 27 bp, Homo sapiens
gcgccgtcgggcccgggggaggttctc

SEQ ID NO: 20119 - DNA, 28 bp, Homo sapiens
gcgccgtcgggcccgggggaggttctct

SEQ ID NO: 20120 - DNA, 32 bp, Homo sapiens; identical to SEQ ID NO: 4298

SEQ ID NO: 20121 - DNA, 33 bp, Homo sapiens; identical to SEQ ID NO: 4299

SEQ ID NO: 20122 - DNA, 16 bp, Homo sapiens
cgccgtcgggcccggg

SEQ ID NO: 20123 - DNA, 17 bp, Homo sapiens
cgccgtcgggcccgggg

SEQ ID NO: 20124 - DNA, 18 bp, Homo sapiens
cgccgtcgggcccggggg

SEQ ID NO: 20125 - DNA, 19 bp, Homo sapiens
cgccgtcgggcccggggga

SEQ ID NO: 20126 - DNA, 20 bp, Homo sapiens
cgccgtcgggcccgggggag

SEQ ID NO: 20127 - DNA, 21 bp, Homo sapiens
cgccgtcgggcccgggggagg

SEQ ID NO: 20128 - DNA, 23 bp, Homo sapiens
cgccgtcgggcccgggggaggtt

SEQ ID NO: 20129 - DNA, 25 bp, Homo sapiens
cgccgtcgggcccgggggaggttct

SEQ ID NO: 20130 - DNA, 26 bp, Homo sapiens
cgccgtcgggcccgggggaggttctc

SEQ ID NO: 20131 - DNA, 27 bp, Homo sapiens
cgccgtcgggcccgggggaggttctct

SEQ ID NO: 20132 - DNA, 28 bp, Homo sapiens
cgccgtcgggcccgggggaggttctctc

SEQ ID NO: 20133 - DNA, 33 bp, Homo sapiens
cgccgtcgggcccgggggaggttctctcggggc

SEQ ID NO: 20134 - DNA, 17 bp, Homo sapiens
ccgtcgggcccggggga

SEQ ID NO: 20135 - DNA, 33 bp, Homo sapiens
ccgtcgggcccgggggaggttctctcggggcca

SEQ ID NO: 20136 - DNA, 30 bp, Homo sapiens
gtcgggcccgggggaggttctctcggggcc

SEQ ID NO: 20137 - DNA, 16 bp, Homo sapiens
tcgggcccgggggagg

SEQ ID NO: 20138 - DNA, 16 bp, Homo sapiens
cgggcccgggggaggt

SEQ ID NO: 20139 - DNA, 16 bp, Homo sapiens
cccgggggaggttctc

SEQ ID NO: 20140 - DNA, 22 bp, Homo sapiens
cgggggaggttctctcggggcc

SEQ ID NO: 20141 - DNA, 17 bp, Homo sapiens
ggaggttctctcggggc

SEQ ID NO: 20142 - DNA, 16 bp, Homo sapiens
aggttctctcggggcc

SEQ ID NO: 20143 - DNA, 23 bp, Homo sapiens
ggttctctcggggccacgcgcgc

SEQ ID NO: 20144 - DNA, 17 bp, Homo sapiens
ctcggggccacgcgcgc

SEQ ID NO: 20145 - DNA, 19 bp, Homo sapiens
tcggggccacgcgcgcgtc

SEQ ID NO: 20146 - DNA, 18 bp, Homo sapiens
cggggccacgcgcgcgtc

SEQ ID NO: 20147 - DNA, 19 bp, Homo sapiens
cggggccacgcgcgcgtcc

SEQ ID NO: 20148 - DNA, 20 bp, Homo sapiens
cggggccacgcgcgcgtccc

SEQ ID NO: 20149 - DNA, 19 bp, Homo sapiens
cgcgcgcgtcccccgaaga

SEQ ID NO: 20150 - DNA, 27 bp, Homo sapiens
gtcccccgaagagggggacggcggagc

SEQ ID NO: 20151 - DNA, 25 bp, Homo sapiens
cccccgaagagggggacggcggagc

SEQ ID NO: 20152 - DNA, 19 bp, Homo sapiens
ccccgaagagggggacggc

SEQ ID NO: 20153 - DNA, 27 bp, Homo sapiens
ccccgaagagggggacggcggagcgag

SEQ ID NO: 20154 - DNA, 28 bp, Homo sapiens
ccccgaagagggggacggcggagcgagc

SEQ ID NO: 20155 - DNA, 33 bp, Homo sapiens
ccccgaagagggggacggcggagcgagcgcacg

SEQ ID NO: 20156 - DNA, 16 bp, Homo sapiens
cgaagagggggacggc

SEQ ID NO: 20157 - DNA, 20 bp, Homo sapiens
gaagagggggacggcggagc

SEQ ID NO: 20158 - DNA, 24 bp, Homo sapiens
gagggggacggcggagcgagcgca

SEQ ID NO: 20159 - DNA, 21 bp, Homo sapiens
agggggacggcggagcgagcg

SEQ ID NO: 20160 - DNA, 17 bp, Homo sapiens
gggggacggcggagcga

SEQ ID NO: 20161 - DNA, 20 bp, Homo sapiens
gggggacggcggagcgagcg

SEQ ID NO: 20162 - DNA, 22 bp, Homo sapiens
gggggacggcggagcgagcgca

SEQ ID NO: 20163 - DNA, 32 bp, Homo sapiens
acggcggagcgagcgcacggggtcggcggcga

SEQ ID NO: 20164 - DNA, 31 bp, Homo sapiens
gcggagcgagcgcacggggtcggcggcgacg

SEQ ID NO: 20165 - DNA, 29 bp, Homo sapiens
ggagcgagcgcacggggtcggcggcgacg

SEQ ID NO: 20166 - DNA, 28 bp, Homo sapiens
gagcgagcgcacggggtcggcggcgacg

SEQ ID NO: 20167 - DNA, 27 bp, Homo sapiens
agcgagcgcacggggtcggcggcgacg

SEQ ID NO: 20168 - DNA, 26 bp, Homo sapiens
gcgagcgcacggggtcggcggcgacg

SEQ ID NO: 20169 - DNA, 25 bp, Homo sapiens
cgagcgcacggggtcggcggcgacg

SEQ ID NO: 20170 - DNA, 25 bp, Homo sapiens
agcgcacggggtcggcggcgacgtc

SEQ ID NO: 20171 - DNA, 16 bp, Homo sapiens
gcgcacggggtcggcg

SEQ ID NO: 20172 - DNA, 18 bp, Homo sapiens
gcgcacggggtcggcggc

SEQ ID NO: 20173 - DNA, 19 bp, Homo sapiens
gcgcacggggtcggcggcg

SEQ ID NO: 20174 - DNA, 20 bp, Homo sapiens
gcgcacggggtcggcggcga

SEQ ID NO: 20175 - DNA, 21 bp, Homo sapiens
gcgcacggggtcggcggcgac

SEQ ID NO: 20176 - DNA, 22 bp, Homo sapiens
gcgcacggggtcggcggcgacg

SEQ ID NO: 20177 - DNA, 23 bp, Homo sapiens
gcgcacggggtcggcggcgacgt

SEQ ID NO: 20178 - DNA, 24 bp, Homo sapiens
gcgcacggggtcggcggcgacgtc

SEQ ID NO: 20179 - DNA, 20 bp, Homo sapiens
cgcacggggtcggcggcgac

SEQ ID NO: 20180 - DNA, 21 bp, Homo sapiens
cgcacggggtcggcggcgacg

SEQ ID NO: 20181 - DNA, 22 bp, Homo sapiens
cgcacggggtcggcggcgacgt

SEQ ID NO: 20182 - DNA, 23 bp, Homo sapiens
cgcacggggtcggcggcgacgtc

SEQ ID NO: 20183 - DNA, 25 bp, Homo sapiens
cgcacggggtcggcggcgacgtcgg

SEQ ID NO: 20184 - DNA, 19 bp, Homo sapiens
gcacggggtcggcggcgac

SEQ ID NO: 20185 - DNA, 20 bp, Homo sapiens
gcacggggtcggcggcgacg

SEQ ID NO: 20186 - DNA, 21 bp, Homo sapiens
gcacggggtcggcggcgacgt

SEQ ID NO: 20187 - DNA, 22 bp, Homo sapiens
gcacggggtcggcggcgacgtc

SEQ ID NO: 20188 - DNA, 24 bp, Homo sapiens
gcacggggtcggcggcgacgtcgg

SEQ ID NO: 20189 - DNA, 19 bp, Homo sapiens
cacggggtcggcggcgacg

SEQ ID NO: 20190 - DNA, 20 bp, Homo sapiens
cacggggtcggcggcgacgt

SEQ ID NO: 20191 - DNA, 21 bp, Homo sapiens
cacggggtcggcggcgacgtc

SEQ ID NO: 20192 - DNA, 17 bp, Homo sapiens
acggggtcggcggcgac

SEQ ID NO: 20193 - DNA, 18 bp, Homo sapiens
acggggtcggcggcgacg

SEQ ID NO: 20194 - DNA, 19 bp, Homo sapiens
acggggtcggcggcgacgt

SEQ ID NO: 20195 - DNA, 20 bp, Homo sapiens
acggggtcggcggcgacgtc

SEQ ID NO: 20196 - DNA, 23 bp, Homo sapiens
acggggtcggcggcgacgtcggc

SEQ ID NO: 20197 - DNA, 24 bp, Homo sapiens
acggggtcggcggcgacgtcggct

SEQ ID NO: 20198 - DNA, 16 bp, Homo sapiens
cggggtcggcggcgac

SEQ ID NO: 20199 - DNA, 17 bp, Homo sapiens
cggggtcggcggcgacg

SEQ ID NO: 20200 - DNA, 18 bp, Homo sapiens
cggggtcggcggcgacgt

SEQ ID NO: 20201 - DNA, 19 bp, Homo sapiens
cggggtcggcggcgacgtc

SEQ ID NO: 20202 - DNA, 22 bp, Homo sapiens
cggggtcggcggcgacgtcggc

SEQ ID NO: 20203 - DNA, 24 bp, Homo sapiens
cggggtcggcggcgacgtcggcta

SEQ ID NO: 20204 - DNA, 21 bp, Homo sapiens
ggggtcggcggcgacgtcggc

SEQ ID NO: 20205 - DNA, 18 bp, Homo sapiens
tcggcggcgacgtcggct

SEQ ID NO: 20206 - DNA, 16 bp, Homo sapiens
cggcggcgacgtcggc

SEQ ID NO: 20207 - DNA, 17 bp, Homo sapiens
cggcggcgacgtcggct

SEQ ID NO: 20208 - DNA, 18 bp, Homo sapiens
cggcggcgacgtcggcta

SEQ ID NO: 20209 - DNA, 16 bp, Homo sapiens
ggcggcgacgtcggct

SEQ ID NO: 20210 - DNA, 21 bp, Homo sapiens
ggcggcgacgtcggctaccca

SEQ ID NO: 20211 - DNA, 26 bp, Homo sapiens
ggcggcgacgtcggctacccacccga

SEQ ID NO: 20212 - DNA, 28 bp, Homo sapiens
ggcggcgacgtcggctacccacccgacc

SEQ ID NO: 20213 - DNA, 18 bp, Homo sapiens
gcggcgacgtcggctacc

SEQ ID NO: 20214 - DNA, 20 bp, Homo sapiens
gcggcgacgtcggctaccca

SEQ ID NO: 20215 - DNA, 25 bp, Homo sapiens
gcggcgacgtcggctacccacccga

SEQ ID NO: 20216 - DNA, 27 bp, Homo sapiens
gcggcgacgtcggctacccacccgacc

SEQ ID NO: 20217 - DNA, 17 bp, Homo sapiens
cggcgacgtcggctacc

SEQ ID NO: 20218 - DNA, 19 bp, Homo sapiens
cggcgacgtcggctaccca

SEQ ID NO: 20219 - DNA, 23 bp, Homo sapiens
cggcgacgtcggctacccacccg

SEQ ID NO: 20220 - DNA, 25 bp, Homo sapiens
cggcgacgtcggctacccacccgac

SEQ ID NO: 20221 - DNA, 26 bp, Homo sapiens
cggcgacgtcggctacccacccgacc

SEQ ID NO: 20222 - DNA, 27 bp, Homo sapiens
cggcgacgtcggctacccacccgaccc

SEQ ID NO: 20223 - DNA, 16 bp, Homo sapiens
ggcgacgtcggctacc

SEQ ID NO: 20224 - DNA, 17 bp, Homo sapiens
ggcgacgtcggctaccc

SEQ ID NO: 20225 - DNA, 18 bp, Homo sapiens
ggcgacgtcggctaccca

SEQ ID NO: 20226 - DNA, 21 bp, Homo sapiens
ggcgacgtcggctacccaccc

SEQ ID NO: 20227 - DNA, 22 bp, Homo sapiens
ggcgacgtcggctacccacccg

SEQ ID NO: 20228 - DNA, 23 bp, Homo sapiens
ggcgacgtcggctacccacccga

SEQ ID NO: 20229 - DNA, 24 bp, Homo sapiens
ggcgacgtcggctacccacccgac

SEQ ID NO: 20230 - DNA, 25 bp, Homo sapiens
ggcgacgtcggctacccacccgacc

SEQ ID NO: 20231 - DNA, 26 bp, Homo sapiens
ggcgacgtcggctacccacccgaccc

SEQ ID NO: 20232 - DNA, 16 bp, Homo sapiens
gcgacgtcggctaccc

SEQ ID NO: 20233 - DNA, 17 bp, Homo sapiens
gcgacgtcggctaccca

SEQ ID NO: 20234 - DNA, 19 bp, Homo sapiens
gcgacgtcggctacccacc

SEQ ID NO: 20235 - DNA, 20 bp, Homo sapiens
gcgacgtcggctacccaccc

SEQ ID NO: 20236 - DNA, 22 bp, Homo sapiens
gcgacgtcggctacccacccga

SEQ ID NO: 20237 - DNA, 23 bp, Homo sapiens
gcgacgtcggctacccacccgac

SEQ ID NO: 20238 - DNA, 24 bp, Homo sapiens
gcgacgtcggctacccacccgacc

SEQ ID NO: 20239 - DNA, 25 bp, Homo sapiens
gcgacgtcggctacccacccgaccc

SEQ ID NO: 20240 - DNA, 26 bp, Homo sapiens
gcgacgtcggctacccacccgacccg

SEQ ID NO: 20241 - DNA, 16 bp, Homo sapiens
cgacgtcggctaccca

SEQ ID NO: 20242 - DNA, 17 bp, Homo sapiens
cgacgtcggctacccac

SEQ ID NO: 20243 - DNA, 18 bp, Homo sapiens
cgacgtcggctacccacc

SEQ ID NO: 20244 - DNA, 19 bp, Homo sapiens
cgacgtcggctacccaccc

SEQ ID NO: 20245 - DNA, 20 bp, Homo sapiens
cgacgtcggctacccacccg

SEQ ID NO: 20246 - DNA, 21 bp, Homo sapiens
cgacgtcggctacccacccga

SEQ ID NO: 20247 - DNA, 22 bp, Homo sapiens
cgacgtcggctacccacccgac

SEQ ID NO: 20248 - DNA, 23 bp, Homo sapiens
cgacgtcggctacccacccgacc

SEQ ID NO: 20249 - DNA, 24 bp, Homo sapiens
cgacgtcggctacccacccgaccc

SEQ ID NO: 20250 - DNA, 26 bp, Homo sapiens
cgacgtcggctacccacccgacccgt

SEQ ID NO: 20251 - DNA, 17 bp, Homo sapiens
gacgtcggctacccacc

SEQ ID NO: 20252 - DNA, 18 bp, Homo sapiens
gacgtcggctacccaccc

SEQ ID NO: 20253 - DNA, 20 bp, Homo sapiens
gacgtcggctacccacccga

SEQ ID NO: 20254 - DNA, 21 bp, Homo sapiens
gacgtcggctacccacccgac

SEQ ID NO: 20255 - DNA, 22 bp, Homo sapiens
gacgtcggctacccacccgacc

SEQ ID NO: 20256 - DNA, 19 bp, Homo sapiens
acgtcggctacccacccga

SEQ ID NO: 20257 - DNA, 18 bp, Homo sapiens
cgtcggctacccacccga

SEQ ID NO: 20258 - DNA, 17 bp, Homo sapiens
gtcggctacccacccga

SEQ ID NO: 20259 - DNA, 20 bp, Homo sapiens
ggctacccacccgacccgtc

SEQ ID NO: 20260 - DNA, 23 bp, Homo sapiens
ggctacccacccgacccgtcttg

SEQ ID NO: 20261 - DNA, 29 bp, Homo sapiens
ggctacccacccgacccgtcttgaaacac

SEQ ID NO: 20262 - DNA, 17 bp, Homo sapiens
aacacggaccaaggagt

SEQ ID NO: 20263 - DNA, 19 bp, Homo sapiens
aacacggaccaaggagtct

SEQ ID NO: 20264 - DNA, 20 bp, Homo sapiens
aacacggaccaaggagtcta

SEQ ID NO: 20265 - DNA, 16 bp, Homo sapiens
acacggaccaaggagt

SEQ ID NO: 20266 - DNA, 18 bp, Homo sapiens
acacggaccaaggagtct

SEQ ID NO: 20267 - DNA, 19 bp, Homo sapiens
acacggaccaaggagtcta

SEQ ID NO: 20268 - DNA, 22 bp, Homo sapiens
acacggaccaaggagtctaaca

SEQ ID NO: 20269 - DNA, 47 bp, Homo sapiens
acacggaccaaggagtctaacacgtgcgcgagtcgggggctcgcacg

SEQ ID NO: 20270 - DNA, 17 bp, Homo sapiens
cacggaccaaggagtct

SEQ ID NO: 20271 - DNA, 18 bp, Homo sapiens
cacggaccaaggagtcta

SEQ ID NO: 20272 - DNA, 46 bp, Homo sapiens
cacggaccaaggagtctaacacgtgcgcgagtcgggggctcgcacg

SEQ ID NO: 20273 - DNA, 16 bp, Homo sapiens
acggaccaaggagtct

SEQ ID NO: 20274 - DNA, 28 bp, Homo sapiens
acggaccaaggagtctaacacgtgcgcg

SEQ ID NO: 20275 - DNA, 29 bp, Homo sapiens
acggaccaaggagtctaacacgtgcgcga

SEQ ID NO: 20276 - DNA, 30 bp, Homo sapiens
acggaccaaggagtctaacacgtgcgcgag

SEQ ID NO: 20277 - DNA, 31 bp, Homo sapiens
acggaccaaggagtctaacacgtgcgcgagt

SEQ ID NO: 20278 - DNA, 33 bp, Homo sapiens
acggaccaaggagtctaacacgtgcgcgagtcg

SEQ ID NO: 20279 - DNA, 40 bp, Homo sapiens
acggaccaaggagtctaacacgtgcgcgagtcgggggctc

SEQ ID NO: 20280 - DNA, 45 bp, Homo sapiens
acggaccaaggagtctaacacgtgcgcgagtcgggggctcgcacg

SEQ ID NO: 20281 - DNA, 27 bp, Homo sapiens
cggaccaaggagtctaacacgtgcgcg

SEQ ID NO: 20282 - DNA, 32 bp, Homo sapiens
cggaccaaggagtctaacacgtgcgcgagtcg

SEQ ID NO: 20283 - DNA, 44 bp, Homo sapiens
cggaccaaggagtctaacacgtgcgcgagtcgggggctcgcacg

SEQ ID NO: 20284 - DNA, 38 bp, Homo sapiens
gaccaaggagtctaacacgtgcgcgagtcgggggctcg

SEQ ID NO: 20285 - DNA, 24 bp, Homo sapiens
ccaaggagtctaacacgtgcgcga

SEQ ID NO: 20286 - DNA, 25 bp, Homo sapiens
caaggagtctaacacgtgcgcgagt

SEQ ID NO: 20287 - DNA, 26 bp, Homo sapiens
caaggagtctaacacgtgcgcgagtc

SEQ ID NO: 20288 - DNA, 27 bp, Homo sapiens
caaggagtctaacacgtgcgcgagtcg

SEQ ID NO: 20289 - DNA, 29 bp, Homo sapiens
caaggagtctaacacgtgcgcgagtcggg

SEQ ID NO: 20290 - DNA, 31 bp, Homo sapiens
caaggagtctaacacgtgcgcgagtcggggg

SEQ ID NO: 20291 - DNA, 32 bp, Homo sapiens
caaggagtctaacacgtgcgcgagtcgggggc

SEQ ID NO: 20292 - DNA, 33 bp, Homo sapiens
caaggagtctaacacgtgcgcgagtcgggggct

SEQ ID NO: 20293 - DNA, 20 bp, Homo sapiens
aaggagtctaacacgtgcgc

SEQ ID NO: 20294 - DNA, 21 bp, Homo sapiens
aaggagtctaacacgtgcgcg

SEQ ID NO: 20295 - DNA, 22 bp, Homo sapiens
aaggagtctaacacgtgcgcga

SEQ ID NO: 20296 - DNA, 23 bp, Homo sapiens
aaggagtctaacacgtgcgcgag

SEQ ID NO: 20297 - DNA, 24 bp, Homo sapiens
aaggagtctaacacgtgcgcgagt

SEQ ID NO: 20298 - DNA, 25 bp, Homo sapiens
aaggagtctaacacgtgcgcgagtc

SEQ ID NO: 20299 - DNA, 26 bp, Homo sapiens
aaggagtctaacacgtgcgcgagtcg

SEQ ID NO: 20300 - DNA, 27 bp, Homo sapiens
aaggagtctaacacgtgcgcgagtcgg

SEQ ID NO: 20301 - DNA, 28 bp, Homo sapiens
aaggagtctaacacgtgcgcgagtcggg

SEQ ID NO: 20302 - DNA, 29 bp, Homo sapiens
aaggagtctaacacgtgcgcgagtcgggg

SEQ ID NO: 20303 - DNA, 30 bp, Homo sapiens
aaggagtctaacacgtgcgcgagtcggggg

SEQ ID NO: 20304 - DNA, 31 bp, Homo sapiens
aaggagtctaacacgtgcgcgagtcgggggc

SEQ ID NO: 20305 - DNA, 32 bp, Homo sapiens; identical to SEQ ID NO: 4331

SEQ ID NO: 20306 - DNA, 33 bp, Homo sapiens; identical to SEQ ID NO: 4332

SEQ ID NO: 20307 - DNA, 23 bp, Homo sapiens
aggagtctaacacgtgcgcgagt

SEQ ID NO: 20308 - DNA, 31 bp, Homo sapiens
aggagtctaacacgtgcgcgagtcgggggct

SEQ ID NO: 20309 - DNA, 32 bp, Homo sapiens
aggagtctaacacgtgcgcgagtcgggggctc

SEQ ID NO: 20310 - DNA, 22 bp, Homo sapiens
ggagtctaacacgtgcgcgagt

SEQ ID NO: 20311 - DNA, 30 bp, Homo sapiens
ggagtctaacacgtgcgcgagtcgggggct

SEQ ID NO: 20312 - DNA, 31 bp, Homo sapiens
ggagtctaacacgtgcgcgagtcgggggctc

SEQ ID NO: 20313 - DNA, 17 bp, Homo sapiens
gagtctaacacgtgcgc

SEQ ID NO: 20314 - DNA, 21 bp, Homo sapiens
gagtctaacacgtgcgcgagt

SEQ ID NO: 20315 - DNA, 29 bp, Homo sapiens
gagtctaacacgtgcgcgagtcgggggct

SEQ ID NO: 20316 - DNA, 20 bp, Homo sapiens
agtctaacacgtgcgcgagt

SEQ ID NO: 20317 - DNA, 27 bp, Homo sapiens
gtctaacacgtgcgcgagtcgggggct

SEQ ID NO: 20318 - DNA, 29 bp, Homo sapiens
gtctaacacgtgcgcgagtcgggggctcg

SEQ ID NO: 20319 - DNA, 18 bp, Homo sapiens
tctaacacgtgcgcgagt

SEQ ID NO: 20320 - DNA, 26 bp, Homo sapiens
tctaacacgtgcgcgagtcgggggct

SEQ ID NO: 20321 - DNA, 16 bp, Homo sapiens
ctaacacgtgcgcgag

SEQ ID NO: 20322 - DNA, 17 bp, Homo sapiens
ctaacacgtgcgcgagt

SEQ ID NO: 20323 - DNA, 25 bp, Homo sapiens
ctaacacgtgcgcgagtcgggggct

SEQ ID NO: 20324 - DNA, 27 bp, Homo sapiens
ctaacacgtgcgcgagtcgggggctcg

SEQ ID NO: 20325 - DNA, 22 bp, Homo sapiens
aacacgtgcgcgagtcgggggc

SEQ ID NO: 20326 - DNA, 23 bp, Homo sapiens
aacacgtgcgcgagtcgggggct

SEQ ID NO: 20327 - DNA, 24 bp, Homo sapiens
aacacgtgcgcgagtcgggggctc

SEQ ID NO: 20328 - DNA, 25 bp, Homo sapiens
aacacgtgcgcgagtcgggggctcg

SEQ ID NO: 20329 - DNA, 22 bp, Homo sapiens
acacgtgcgcgagtcgggggct

SEQ ID NO: 20330 - DNA, 24 bp, Homo sapiens
acacgtgcgcgagtcgggggctcg

SEQ ID NO: 20331 - DNA, 20 bp, Homo sapiens
acgtgcgcgagtcgggggct

SEQ ID NO: 20332 - DNA, 21 bp, Homo sapiens
cgtgcgcgagtcgggggctcg

SEQ ID NO: 20333 - DNA, 23 bp, Homo sapiens
cgtgcgcgagtcgggggctcgca

SEQ ID NO: 20334 - DNA, 17 bp, Homo sapiens
cgcgagtcgggggctcg

SEQ ID NO: 20335 - DNA, 16 bp, Homo sapiens
gcgagtcgggggctcg

SEQ ID NO: 20336 - DNA, 22 bp, Homo sapiens
cgagtcgggggctcgcacgaaa

SEQ ID NO: 20337 - DNA, 26 bp, Homo sapiens
cgagtcgggggctcgcacgaaagccg

SEQ ID NO: 20338 - DNA, 28 bp, Homo sapiens
cgagtcgggggctcgcacgaaagccgcc

SEQ ID NO: 20339 - DNA, 17 bp, Homo sapiens
gtcgggggctcgcacga

SEQ ID NO: 20340 - DNA, 18 bp, Homo sapiens
gtcgggggctcgcacgaa

SEQ ID NO: 20341 - DNA, 19 bp, Homo sapiens
gtcgggggctcgcacgaaa

SEQ ID NO: 20342 - DNA, 33 bp, Homo sapiens
gtcgggggctcgcacgaaagccgccgtggcgca

SEQ ID NO: 20343 - DNA, 29 bp, Homo sapiens
gggggctcgcacgaaagccgccgtggcgc

SEQ ID NO: 20344 - DNA, 30 bp, Homo sapiens
gggggctcgcacgaaagccgccgtggcgca

SEQ ID NO: 20345 - DNA, 20 bp, Homo sapiens
cgcacgaaagccgccgtggc

SEQ ID NO: 20346 - DNA, 21 bp, Homo sapiens
cgcacgaaagccgccgtggcg

SEQ ID NO: 20347 - DNA, 18 bp, Homo sapiens
cacgaaagccgccgtggc

SEQ ID NO: 20348 - DNA, 16 bp, Homo sapiens
cgaaagccgccgtggc

SEQ ID NO: 20349 - DNA, 33 bp, Homo sapiens
cgaaagccgccgtggcgcaatgaaggtgaaggc

SEQ ID NO: 20350 - DNA, 32 bp, Homo sapiens
gaaagccgccgtggcgcaatgaaggtgaaggc

SEQ ID NO: 20351 - DNA, 31 bp, Homo sapiens
aaagccgccgtggcgcaatgaaggtgaaggc

SEQ ID NO: 20352 - DNA, 32 bp, Homo sapiens
aaagccgccgtggcgcaatgaaggtgaaggcc

SEQ ID NO: 20353 - DNA, 33 bp, Homo sapiens
aaagccgccgtggcgcaatgaaggtgaaggccg

SEQ ID NO: 20354 - DNA, 29 bp, Homo sapiens
agccgccgtggcgcaatgaaggtgaaggc

SEQ ID NO: 20355 - DNA, 26 bp, Homo sapiens
cgccgtggcgcaatgaaggtgaaggc

SEQ ID NO: 20356 - DNA, 29 bp, Homo sapiens
gccgtggcgcaatgaaggtgaaggccggc

SEQ ID NO: 20357 - DNA, 25 bp, Homo sapiens
cgtggcgcaatgaaggtgaaggccg

SEQ ID NO: 20358 - DNA, 24 bp, Homo sapiens
gcgcaatgaaggtgaaggccggcg

SEQ ID NO: 20359 - DNA, 17 bp, Homo sapiens
gcaatgaaggtgaaggc

SEQ ID NO: 20360 - DNA, 16 bp, Homo sapiens
caatgaaggtgaaggc

SEQ ID NO: 20361 - DNA, 17 bp, Homo sapiens
caatgaaggtgaaggcc

SEQ ID NO: 20362 - DNA, 16 bp, Homo sapiens
aatgaaggtgaaggcc

SEQ ID NO: 20363 - DNA, 18 bp, Homo sapiens
atgaaggtgaaggccggc

SEQ ID NO: 20364 - DNA, 23 bp, Homo sapiens
atgaaggtgaaggccggcgcgct

SEQ ID NO: 20365 - DNA, 25 bp, Homo sapiens
tgaaggtgaaggccggcgcgctcgc

SEQ ID NO: 20366 - DNA, 33 bp, Homo sapiens
gaaggtgaaggccggcgcgctcgccggccgagg

SEQ ID NO: 20367 - DNA, 20 bp, Homo sapiens
aaggtgaaggccggcgcgct

SEQ ID NO: 20368 - DNA, 21 bp, Homo sapiens
aaggtgaaggccggcgcgctc

SEQ ID NO: 20369 - DNA, 22 bp, Homo sapiens
aaggtgaaggccggcgcgctcg

SEQ ID NO: 20370 - DNA, 19 bp, Homo sapiens
ggtgaaggccggcgcgctc

SEQ ID NO: 20371 - DNA, 17 bp, Homo sapiens
gtgaaggccggcgcgct

SEQ ID NO: 20372 - DNA, 18 bp, Homo sapiens
gtgaaggccggcgcgctc

SEQ ID NO: 20373 - DNA, 16 bp, Homo sapiens
tgaaggccggcgcgct

SEQ ID NO: 20374 - DNA, 17 bp, Homo sapiens
tgaaggccggcgcgctc

SEQ ID NO: 20375 - DNA, 20 bp, Homo sapiens
tgaaggccggcgcgctcgcc

SEQ ID NO: 20376 - DNA, 16 bp, Homo sapiens
gaaggccggcgcgctc

SEQ ID NO: 20377 - DNA, 18 bp, Homo sapiens
aaggccggcgcgctcgcc

SEQ ID NO: 20378 - DNA, 30 bp, Homo sapiens
ggccggcgcgctcgccggccgaggtgggat

SEQ ID NO: 20379 - DNA, 16 bp, Homo sapiens
cggcgcgctcgccggc

SEQ ID NO: 20380 - DNA, 23 bp, Homo sapiens
cggcgcgctcgccggccgaggtg

SEQ ID NO: 20381 - DNA, 16 bp, Homo sapiens
ggcgcgctcgccggcc

SEQ ID NO: 20382 - DNA, 22 bp, Homo sapiens
ggcgcgctcgccggccgaggtg

SEQ ID NO: 20383 - DNA, 32 bp, Homo sapiens; identical to SEQ ID NO: 4342

SEQ ID NO: 20384 - DNA, 33 bp, Homo sapiens
ggcgcgctcgccggccgaggtgggatcccgagg

SEQ ID NO: 20385 - DNA, 16 bp, Homo sapiens
gcgcgctcgccggccg

SEQ ID NO: 20386 - DNA, 18 bp, Homo sapiens
gcgcgctcgccggccgag

SEQ ID NO: 20387 - DNA, 30 bp, Homo sapiens
gcgcgctcgccggccgaggtgggatcccga

SEQ ID NO: 20388 - DNA, 31 bp, Homo sapiens; identical to SEQ ID NO: 4343

SEQ ID NO: 20389 - DNA, 32 bp, Homo sapiens; identical to SEQ ID NO: 4344

SEQ ID NO: 20390 - DNA, 33 bp, Homo sapiens
gcgcgctcgccggccgaggtgggatcccgaggc

SEQ ID NO: 20391 - DNA, 17 bp, Homo sapiens
cgcgctcgccggccgag

SEQ ID NO: 20392 - DNA, 22 bp, Homo sapiens
cgcgctcgccggccgaggtggg

SEQ ID NO: 20393 - DNA, 28 bp, Homo sapiens
cgcgctcgccggccgaggtgggatcccg

SEQ ID NO: 20394 - DNA, 29 bp, Homo sapiens
cgcgctcgccggccgaggtgggatcccga

SEQ ID NO: 20395 - DNA, 30 bp, Homo sapiens; identical to SEQ ID NO: 4345

SEQ ID NO: 20396 - DNA, 31 bp, Homo sapiens; identical to SEQ ID NO: 4346

SEQ ID NO: 20397 - DNA, 32 bp, Homo sapiens
cgcgctcgccggccgaggtgggatcccgaggc

SEQ ID NO: 20398 - DNA, 33 bp, Homo sapiens
cgcgctcgccggccgaggtgggatcccgaggcc

SEQ ID NO: 20399 - DNA, 34 bp, Homo sapiens
cgcgctcgccggccgaggtgggatcccgaggcct

SEQ ID NO: 20400 - DNA, 38 bp, Homo sapiens
cgcgctcgccggccgaggtgggatcccgaggcctctcc

SEQ ID NO: 20401 - DNA, 39 bp, Homo sapiens
cgcgctcgccggccgaggtgggatcccgaggcctctcca

SEQ ID NO: 20402 - DNA, 16 bp, Homo sapiens
gcgctcgccggccgag

SEQ ID NO: 20403 - DNA, 17 bp, Homo sapiens
gcgctcgccggccgagg

SEQ ID NO: 20404 - DNA, 18 bp, Homo sapiens
gcgctcgccggccgaggt

SEQ ID NO: 20405 - DNA, 29 bp, Homo sapiens
gcgctcgccggccgaggtgggatcccgag

SEQ ID NO: 20406 - DNA, 30 bp, Homo sapiens
gcgctcgccggccgaggtgggatcccgagg

SEQ ID NO: 20407 - DNA, 31 bp, Homo sapiens
gcgctcgccggccgaggtgggatcccgaggc

SEQ ID NO: 20408 - DNA, 33 bp, Homo sapiens
gcgctcgccggccgaggtgggatcccgaggcct

SEQ ID NO: 20409 - DNA, 27 bp, Homo sapiens
cgctcgccggccgaggtgggatcccga

SEQ ID NO: 20410 - DNA, 28 bp, Homo sapiens
cgctcgccggccgaggtgggatcccgag

SEQ ID NO: 20411 - DNA, 29 bp, Homo sapiens
cgctcgccggccgaggtgggatcccgagg

SEQ ID NO: 20412 - DNA, 30 bp, Homo sapiens
cgctcgccggccgaggtgggatcccgaggc

SEQ ID NO: 20413 - DNA, 31 bp, Homo sapiens; identical to SEQ ID NO: 4351

SEQ ID NO: 20414 - DNA, 32 bp, Homo sapiens
cgctcgccggccgaggtgggatcccgaggcct

SEQ ID NO: 20415 - DNA, 28 bp, Homo sapiens
gctcgccggccgaggtgggatcccgagg

SEQ ID NO: 20416 - DNA, 26 bp, Homo sapiens
ctcgccggccgaggtgggatcccgag

SEQ ID NO: 20417 - DNA, 27 bp, Homo sapiens
ctcgccggccgaggtgggatcccgagg

SEQ ID NO: 20418 - DNA, 28 bp, Homo sapiens
ctcgccggccgaggtgggatcccgaggc

SEQ ID NO: 20419 - DNA, 29 bp, Homo sapiens
ctcgccggccgaggtgggatcccgaggcc

SEQ ID NO: 20420 - DNA, 30 bp, Homo sapiens
ctcgccggccgaggtgggatcccgaggcct

SEQ ID NO: 20421 - DNA, 24 bp, Homo sapiens
tcgccggccgaggtgggatcccga

SEQ ID NO: 20422 - DNA, 25 bp, Homo sapiens
tcgccggccgaggtgggatcccgag

SEQ ID NO: 20423 - DNA, 26 bp, Homo sapiens
tcgccggccgaggtgggatcccgagg

SEQ ID NO: 20424 - DNA, 17 bp, Homo sapiens
cgccggccgaggtggga

SEQ ID NO: 20425 - DNA, 23 bp, Homo sapiens
cgccggccgaggtgggatcccga

SEQ ID NO: 20426 - DNA, 24 bp, Homo sapiens
cgccggccgaggtgggatcccgag

SEQ ID NO: 20427 - DNA, 25 bp, Homo sapiens
cgccggccgaggtgggatcccgagg

SEQ ID NO: 20428 - DNA, 26 bp, Homo sapiens
cgccggccgaggtgggatcccgaggc

SEQ ID NO: 20429 - DNA, 27 bp, Homo sapiens
cgccggccgaggtgggatcccgaggcc

SEQ ID NO: 20430 - DNA, 28 bp, Homo sapiens
cgccggccgaggtgggatcccgaggcct

SEQ ID NO: 20431 - DNA, 22 bp, Homo sapiens
ccggccgaggtgggatcccgag

SEQ ID NO: 20432 - DNA, 23 bp, Homo sapiens
ccggccgaggtgggatcccgagg

SEQ ID NO: 20433 - DNA, 22 bp, Homo sapiens
cggccgaggtgggatcccgagg

SEQ ID NO: 20434 - DNA, 20 bp, Homo sapiens
ggccgaggtgggatcccgag

SEQ ID NO: 20435 - DNA, 20 bp, Homo sapiens
ccgaggtgggatcccgaggc

SEQ ID NO: 20436 - DNA, 21 bp, Homo sapiens
ccgaggtgggatcccgaggcc

SEQ ID NO: 20437 - DNA, 22 bp, Homo sapiens
ccgaggtgggatcccgaggcct

SEQ ID NO: 20438 - DNA, 20 bp, Homo sapiens
cgaggtgggatcccgaggcc

SEQ ID NO: 20439 - DNA, 21 bp, Homo sapiens
cgaggtgggatcccgaggcct

SEQ ID NO: 20440 - DNA, 19 bp, Homo sapiens
gaggtgggatcccgaggcc

SEQ ID NO: 20441 - DNA, 20 bp, Homo sapiens
gaggtgggatcccgaggcct

SEQ ID NO: 20442 - DNA, 25 bp, Homo sapiens
tcccgaggcctctccagtccgccga

SEQ ID NO: 20443 - DNA, 28 bp, Homo sapiens
ccagtccgccgagggcgcaccaccggcc

SEQ ID NO: 20444 - DNA, 27 bp, Homo sapiens
cagtccgccgagggcgcaccaccggcc

SEQ ID NO: 20445 - DNA, 26 bp, Homo sapiens
agtccgccgagggcgcaccaccggcc

SEQ ID NO: 20446 - DNA, 27 bp, Homo sapiens
agtccgccgagggcgcaccaccggccc

SEQ ID NO: 20447 - DNA, 29 bp, Homo sapiens
agtccgccgagggcgcaccaccggcccgt

SEQ ID NO: 20448 - DNA, 35 bp, Homo sapiens
agtccgccgagggcgcaccaccggcccgtctcgcc

SEQ ID NO: 20449 - DNA, 25 bp, Homo sapiens
gtccgccgagggcgcaccaccggcc

SEQ ID NO: 20450 - DNA, 32 bp, Homo sapiens
gtccgccgagggcgcaccaccggcccgtctcg

SEQ ID NO: 20451 - DNA, 33 bp, Homo sapiens
gtccgccgagggcgcaccaccggcccgtctcgc

SEQ ID NO: 20452 - DNA, 34 bp, Homo sapiens
gtccgccgagggcgcaccaccggcccgtctcgcc

SEQ ID NO: 20453 - DNA, 32 bp, Homo sapiens
tccgccgagggcgcaccaccggcccgtctcgc

SEQ ID NO: 20454 - DNA, 33 bp, Homo sapiens
tccgccgagggcgcaccaccggcccgtctcgcc

SEQ ID NO: 20455 - DNA, 32 bp, Homo sapiens
ccgccgagggcgcaccaccggcccgtctcgcc

SEQ ID NO: 20456 - DNA, 33 bp, Homo sapiens
ccgccgagggcgcaccaccggcccgtctcgccc

SEQ ID NO: 20457 - DNA, 21 bp, Homo sapiens
cgccgagggcgcaccaccggc

SEQ ID NO: 20458 - DNA, 22 bp, Homo sapiens
cgccgagggcgcaccaccggcc

SEQ ID NO: 20459 - DNA, 29 bp, Homo sapiens
cgccgagggcgcaccaccggcccgtctcg

SEQ ID NO: 20460 - DNA, 30 bp, Homo sapiens
cgccgagggcgcaccaccggcccgtctcgc

SEQ ID NO: 20461 - DNA, 31 bp, Homo sapiens; identical to SEQ ID NO: 4357

SEQ ID NO: 20462 - DNA, 32 bp, Homo sapiens
cgccgagggcgcaccaccggcccgtctcgccc

SEQ ID NO: 20463 - DNA, 33 bp, Homo sapiens
cgccgagggcgcaccaccggcccgtctcgcccg

SEQ ID NO: 20464 - DNA, 21 bp, Homo sapiens
gccgagggcgcaccaccggcc

SEQ ID NO: 20465 - DNA, 23 bp, Homo sapiens
gccgagggcgcaccaccggcccg

SEQ ID NO: 20466 - DNA, 24 bp, Homo sapiens
gccgagggcgcaccaccggcccgt

SEQ ID NO: 20467 - DNA, 30 bp, Homo sapiens
gccgagggcgcaccaccggcccgtctcgcc

SEQ ID NO: 20468 - DNA, 20 bp, Homo sapiens
caccaccggcccgtctcgcc

SEQ ID NO: 20469 - DNA, 19 bp, Homo sapiens
accaccggcccgtctcgcc

SEQ ID NO: 20470 - DNA, 17 bp, Homo sapiens
ccaccggcccgtctcgc

SEQ ID NO: 20471 - DNA, 18 bp, Homo sapiens
ccaccggcccgtctcgcc

SEQ ID NO: 20472 - DNA, 22 bp, Homo sapiens
ccaccggcccgtctcgcccgcc

SEQ ID NO: 20473 - DNA, 16 bp, Homo sapiens
caccggcccgtctcgc

SEQ ID NO: 20474 - DNA, 17 bp, Homo sapiens
caccggcccgtctcgcc

SEQ ID NO: 20475 - DNA, 26 bp, Homo sapiens
caccggcccgtctcgcccgccgcgcc

SEQ ID NO: 20476 - DNA, 33 bp, Homo sapiens
caccggcccgtctcgcccgccgcgccggggagg

SEQ ID NO: 20477 - DNA, 16 bp, Homo sapiens
accggcccgtctcgcc

SEQ ID NO: 20478 - DNA, 19 bp, Homo sapiens
ccggcccgtctcgcccgcc

SEQ ID NO: 20479 - DNA, 24 bp, Homo sapiens
ccggcccgtctcgcccgccgcgcc

SEQ ID NO: 20480 - DNA, 18 bp, Homo sapiens
cgtctcgcccgccgcgcc

SEQ ID NO: 20481 - DNA, 25 bp, Homo sapiens
cgtctcgcccgccgcgccggggagg

SEQ ID NO: 20482 - DNA, 20 bp, Homo sapiens
ctcgcccgccgcgccgggga

SEQ ID NO: 20483 - DNA, 23 bp, Homo sapiens
ctcgcccgccgcgccggggaggt

SEQ ID NO: 20484 - DNA, 16 bp, Homo sapiens
cgcccgccgcgccggg

SEQ ID NO: 20485 - DNA, 21 bp, Homo sapiens
cgcccgccgcgccggggaggt

SEQ ID NO: 20486 - DNA, 20 bp, Homo sapiens
gcccgccgcgccggggaggt

SEQ ID NO: 20487 - DNA, 22 bp, Homo sapiens
cgccgcgccggggaggtggagc

SEQ ID NO: 20488 - DNA, 42 bp, Homo sapiens
cggggaggtggagcacgagcgcacgtgttaggacccgaaaga

SEQ ID NO: 20489 - DNA, 27 bp, Homo sapiens
tggagcacgagcgcacgtgttaggacc

SEQ ID NO: 20490 - DNA, 26 bp, Homo sapiens
ggagcacgagcgcacgtgttaggacc

SEQ ID NO: 20491 - DNA, 33 bp, Homo sapiens; identical to SEQ ID NO: 4363

SEQ ID NO: 20492 - DNA, 25 bp, Homo sapiens
gagcacgagcgcacgtgttaggacc

SEQ ID NO: 20493 - DNA, 32 bp, Homo sapiens
gagcacgagcgcacgtgttaggacccgaaaga

SEQ ID NO: 20494 - DNA, 24 bp, Homo sapiens
agcacgagcgcacgtgttaggacc

SEQ ID NO: 20495 - DNA, 25 bp, Homo sapiens
agcacgagcgcacgtgttaggaccc

SEQ ID NO: 20496 - DNA, 23 bp, Homo sapiens
gcacgagcgcacgtgttaggacc

SEQ ID NO: 20497 - DNA, 24 bp, Homo sapiens
gcacgagcgcacgtgttaggaccc

SEQ ID NO: 20498 - DNA, 26 bp, Homo sapiens
gcacgagcgcacgtgttaggacccga

SEQ ID NO: 20499 - DNA, 28 bp, Homo sapiens
gcacgagcgcacgtgttaggacccgaaa

SEQ ID NO: 20500 - DNA, 30 bp, Homo sapiens
gcacgagcgcacgtgttaggacccgaaaga

SEQ ID NO: 20501 - DNA, 22 bp, Homo sapiens
cacgagcgcacgtgttaggacc

SEQ ID NO: 20502 - DNA, 23 bp, Homo sapiens
cacgagcgcacgtgttaggaccc

SEQ ID NO: 20503 - DNA, 25 bp, Homo sapiens
cacgagcgcacgtgttaggacccga

SEQ ID NO: 20504 - DNA, 27 bp, Homo sapiens
cacgagcgcacgtgttaggacccgaaa

SEQ ID NO: 20505 - DNA, 28 bp, Homo sapiens
cacgagcgcacgtgttaggacccgaaag

SEQ ID NO: 20506 - DNA, 29 bp, Homo sapiens
cacgagcgcacgtgttaggacccgaaaga

SEQ ID NO: 20507 - DNA, 30 bp, Homo sapiens
cacgagcgcacgtgttaggacccgaaagat

SEQ ID NO: 20508 - DNA, 32 bp, Homo sapiens
cacgagcgcacgtgttaggacccgaaagatgg

SEQ ID NO: 20509 - DNA, 21 bp, Homo sapiens
acgagcgcacgtgttaggacc

SEQ ID NO: 20510 - DNA, 22 bp, Homo sapiens
acgagcgcacgtgttaggaccc

SEQ ID NO: 20511 - DNA, 24 bp, Homo sapiens
acgagcgcacgtgttaggacccga

SEQ ID NO: 20512 - DNA, 26 bp, Homo sapiens
acgagcgcacgtgttaggacccgaaa

SEQ ID NO: 20513 - DNA, 27 bp, Homo sapiens
acgagcgcacgtgttaggacccgaaag

SEQ ID NO: 20514 - DNA, 28 bp, Homo sapiens
acgagcgcacgtgttaggacccgaaaga

SEQ ID NO: 20515 - DNA, 29 bp, Homo sapiens
acgagcgcacgtgttaggacccgaaagat

SEQ ID NO: 20516 - DNA, 19 bp, Homo sapiens
cgagcgcacgtgttaggac

SEQ ID NO: 20517 - DNA, 20 bp, Homo sapiens
cgagcgcacgtgttaggacc

SEQ ID NO: 20518 - DNA, 21 bp, Homo sapiens
cgagcgcacgtgttaggaccc

SEQ ID NO: 20519 - DNA, 23 bp, Homo sapiens
cgagcgcacgtgttaggacccga

SEQ ID NO: 20520 - DNA, 25 bp, Homo sapiens
cgagcgcacgtgttaggacccgaaa

SEQ ID NO: 20521 - DNA, 26 bp, Homo sapiens
cgagcgcacgtgttaggacccgaaag

SEQ ID NO: 20522 - DNA, 27 bp, Homo sapiens
cgagcgcacgtgttaggacccgaaaga

SEQ ID NO: 20523 - DNA, 28 bp, Homo sapiens
cgagcgcacgtgttaggacccgaaagat

SEQ ID NO: 20524 - DNA, 29 bp, Homo sapiens
cgagcgcacgtgttaggacccgaaagatg

SEQ ID NO: 20525 - DNA, 30 bp, Homo sapiens
cgagcgcacgtgttaggacccgaaagatgg

SEQ ID NO: 20526 - DNA, 32 bp, Homo sapiens
cgagcgcacgtgttaggacccgaaagatggtg

SEQ ID NO: 20527 - DNA, 33 bp, Homo sapiens
cgagcgcacgtgttaggacccgaaagatggtga

SEQ ID NO: 20528 - DNA, 18 bp, Homo sapiens
gagcgcacgtgttaggac

SEQ ID NO: 20529 - DNA, 19 bp, Homo sapiens
gagcgcacgtgttaggacc

SEQ ID NO: 20530 - DNA, 20 bp, Homo sapiens
gagcgcacgtgttaggaccc

SEQ ID NO: 20531 - DNA, 22 bp, Homo sapiens
gagcgcacgtgttaggacccga

SEQ ID NO: 20532 - DNA, 24 bp, Homo sapiens
gagcgcacgtgttaggacccgaaa

SEQ ID NO: 20533 - DNA, 25 bp, Homo sapiens
gagcgcacgtgttaggacccgaaag

SEQ ID NO: 20534 - DNA, 26 bp, Homo sapiens
gagcgcacgtgttaggacccgaaaga

SEQ ID NO: 20535 - DNA, 27 bp, Homo sapiens
gagcgcacgtgttaggacccgaaagat

SEQ ID NO: 20536 - DNA, 17 bp, Homo sapiens
agcgcacgtgttaggac

SEQ ID NO: 20537 - DNA, 18 bp, Homo sapiens
agcgcacgtgttaggacc

SEQ ID NO: 20538 - DNA, 19 bp, Homo sapiens
agcgcacgtgttaggaccc

SEQ ID NO: 20539 - DNA, 21 bp, Homo sapiens
agcgcacgtgttaggacccga

SEQ ID NO: 20540 - DNA, 23 bp, Homo sapiens
agcgcacgtgttaggacccgaaa

SEQ ID NO: 20541 - DNA, 25 bp, Homo sapiens
agcgcacgtgttaggacccgaaaga

SEQ ID NO: 20542 - DNA, 26 bp, Homo sapiens
agcgcacgtgttaggacccgaaagat

SEQ ID NO: 20543 - DNA, 28 bp, Homo sapiens
agcgcacgtgttaggacccgaaagatgg

SEQ ID NO: 20544 - DNA, 29 bp, Homo sapiens
agcgcacgtgttaggacccgaaagatggt

SEQ ID NO: 20545 - DNA, 30 bp, Homo sapiens
agcgcacgtgttaggacccgaaagatggtg

SEQ ID NO: 20546 - DNA, 31 bp, Homo sapiens
agcgcacgtgttaggacccgaaagatggtga

SEQ ID NO: 20547 - DNA, 33 bp, Homo sapiens
agcgcacgtgttaggacccgaaagatggtgaac

SEQ ID NO: 20548 - DNA, 16 bp, Homo sapiens
gcgcacgtgttaggac

SEQ ID NO: 20549 - DNA, 17 bp, Homo sapiens
gcgcacgtgttaggacc

SEQ ID NO: 20550 - DNA, 18 bp, Homo sapiens
gcgcacgtgttaggaccc

SEQ ID NO: 20551 - DNA, 20 bp, Homo sapiens
gcgcacgtgttaggacccga

SEQ ID NO: 20552 - DNA, 22 bp, Homo sapiens
gcgcacgtgttaggacccgaaa

SEQ ID NO: 20553 - DNA, 24 bp, Homo sapiens
gcgcacgtgttaggacccgaaaga

SEQ ID NO: 20554 - DNA, 27 bp, Homo sapiens
gcgcacgtgttaggacccgaaagatgg

SEQ ID NO: 20555 - DNA, 28 bp, Homo sapiens
gcgcacgtgttaggacccgaaagatggt

SEQ ID NO: 20556 - DNA, 30 bp, Homo sapiens
gcgcacgtgttaggacccgaaagatggtga

SEQ ID NO: 20557 - DNA, 32 bp, Homo sapiens
gcgcacgtgttaggacccgaaagatggtgaac

SEQ ID NO: 20558 - DNA, 33 bp, Homo sapiens
gcgcacgtgttaggacccgaaagatggtgaact

SEQ ID NO: 20559 - DNA, 16 bp, Homo sapiens
cgcacgtgttaggacc

SEQ ID NO: 20560 - DNA, 17 bp, Homo sapiens
cgcacgtgttaggaccc

SEQ ID NO: 20561 - DNA, 19 bp, Homo sapiens
cgcacgtgttaggacccga

SEQ ID NO: 20562 - DNA, 26 bp, Homo sapiens
cgcacgtgttaggacccgaaagatgg

SEQ ID NO: 20563 - DNA, 29 bp, Homo sapiens
cgcacgtgttaggacccgaaagatggtga

SEQ ID NO: 20564 - DNA, 31 bp, Homo sapiens
cgcacgtgttaggacccgaaagatggtgaac

SEQ ID NO: 20565 - DNA, 32 bp, Homo sapiens
cgcacgtgttaggacccgaaagatggtgaact

SEQ ID NO: 20566 - DNA, 33 bp, Homo sapiens
cgcacgtgttaggacccgaaagatggtgaacta

SEQ ID NO: 20567 - DNA, 16 bp, Homo sapiens
gcacgtgttaggaccc

SEQ ID NO: 20568 - DNA, 18 bp, Homo sapiens
gcacgtgttaggacccga

SEQ ID NO: 20569 - DNA, 17 bp, Homo sapiens
cacgtgttaggacccga

SEQ ID NO: 20570 - DNA, 20 bp, Homo sapiens
cacgtgttaggacccgaaag

SEQ ID NO: 20571 - DNA, 21 bp, Homo sapiens
cacgtgttaggacccgaaaga

SEQ ID NO: 20572 - DNA, 22 bp, Homo sapiens
cacgtgttaggacccgaaagat

SEQ ID NO: 20573 - DNA, 29 bp, Homo sapiens
cacgtgttaggacccgaaagatggtgaac

SEQ ID NO: 20574 - DNA, 16 bp, Homo sapiens
acgtgttaggacccga

SEQ ID NO: 20575 - DNA, 28 bp, Homo sapiens
acgtgttaggacccgaaagatggtgaac

SEQ ID NO: 20576 - DNA, 17 bp, Homo sapiens
cgtgttaggacccgaaa

SEQ ID NO: 20577 - DNA, 19 bp, Homo sapiens
cgtgttaggacccgaaaga

SEQ ID NO: 20578 - DNA, 25 bp, Homo sapiens
cgtgttaggacccgaaagatggtga

SEQ ID NO: 20579 - DNA, 27 bp, Homo sapiens
cgtgttaggacccgaaagatggtgaac

SEQ ID NO: 20580 - DNA, 28 bp, Homo sapiens
cgtgttaggacccgaaagatggtgaact

SEQ ID NO: 20581 - DNA, 29 bp, Homo sapiens
cgtgttaggacccgaaagatggtgaacta

SEQ ID NO: 20582 - DNA, 30 bp, Homo sapiens
cgtgttaggacccgaaagatggtgaactat

SEQ ID NO: 20583 - DNA, 33 bp, Homo sapiens; identical to SEQ ID NO: 4390

SEQ ID NO: 20584 - DNA, 28 bp, Homo sapiens
gtgttaggacccgaaagatggtgaacta

SEQ ID NO: 20585 - DNA, 33 bp, Homo sapiens
gtgttaggacccgaaagatggtgaactatgcct

SEQ ID NO: 20586 - DNA, 17 bp, Homo sapiens
tgttaggacccgaaaga

SEQ ID NO: 20587 - DNA, 26 bp, Homo sapiens
tgttaggacccgaaagatggtgaact

SEQ ID NO: 20588 - DNA, 27 bp, Homo sapiens
tgttaggacccgaaagatggtgaacta

SEQ ID NO: 20589 - DNA, 32 bp, Homo sapiens
tgttaggacccgaaagatggtgaactatgcct

SEQ ID NO: 20590 - DNA, 36 bp, Homo sapiens
tgttaggacccgaaagatggtgaactatgcctgggc

SEQ ID NO: 20591 - DNA, 37 bp, Homo sapiens
tgttaggacccgaaagatggtgaactatgcctgggca

SEQ ID NO: 20592 - DNA, 26 bp, Homo sapiens
gttaggacccgaaagatggtgaacta

SEQ ID NO: 20593 - DNA, 25 bp, Homo sapiens
ttaggacccgaaagatggtgaacta

SEQ ID NO: 20594 - DNA, 30 bp, Homo sapiens
ttaggacccgaaagatggtgaactatgcct

SEQ ID NO: 20595 - DNA, 22 bp, Homo sapiens
taggacccgaaagatggtgaac

SEQ ID NO: 20596 - DNA, 23 bp, Homo sapiens
taggacccgaaagatggtgaact

SEQ ID NO: 20597 - DNA, 24 bp, Homo sapiens
taggacccgaaagatggtgaacta

SEQ ID NO: 20598 - DNA, 28 bp, Homo sapiens
taggacccgaaagatggtgaactatgcc

SEQ ID NO: 20599 - DNA, 29 bp, Homo sapiens
taggacccgaaagatggtgaactatgcct

SEQ ID NO: 20600 - DNA, 22 bp, Homo sapiens
aggacccgaaagatggtgaact

SEQ ID NO: 20601 - DNA, 23 bp, Homo sapiens
aggacccgaaagatggtgaacta

SEQ ID NO: 20602 - DNA, 28 bp, Homo sapiens
aggacccgaaagatggtgaactatgcct

SEQ ID NO: 20603 - DNA, 32 bp, Homo sapiens
aggacccgaaagatggtgaactatgcctgggc

SEQ ID NO: 20604 - DNA, 33 bp, Homo sapiens
aggacccgaaagatggtgaactatgcctgggca

SEQ ID NO: 20605 - DNA, 22 bp, Homo sapiens
ggacccgaaagatggtgaacta

SEQ ID NO: 20606 - DNA, 27 bp, Homo sapiens
ggacccgaaagatggtgaactatgcct

SEQ ID NO: 20607 - DNA, 32 bp, Homo sapiens
ggacccgaaagatggtgaactatgcctgggca

SEQ ID NO: 20608 - DNA, 21 bp, Homo sapiens
gacccgaaagatggtgaacta

SEQ ID NO: 20609 - DNA, 26 bp, Homo sapiens
gacccgaaagatggtgaactatgcct

SEQ ID NO: 20610 - DNA, 31 bp, Homo sapiens
gacccgaaagatggtgaactatgcctgggca

SEQ ID NO: 20611 - DNA, 25 bp, Homo sapiens
acccgaaagatggtgaactatgcct

SEQ ID NO: 20612 - DNA, 30 bp, Homo sapiens
acccgaaagatggtgaactatgcctgggca

SEQ ID NO: 20613 - DNA, 31 bp, Homo sapiens
acccgaaagatggtgaactatgcctgggcag

SEQ ID NO: 20614 - DNA, 17 bp, Homo sapiens
cccgaaagatggtgaac

SEQ ID NO: 20615 - DNA, 18 bp, Homo sapiens
cccgaaagatggtgaact

SEQ ID NO: 20616 - DNA, 19 bp, Homo sapiens
cccgaaagatggtgaacta

SEQ ID NO: 20617 - DNA, 20 bp, Homo sapiens
cccgaaagatggtgaactat

SEQ ID NO: 20618 - DNA, 23 bp, Homo sapiens
cccgaaagatggtgaactatgcc

SEQ ID NO: 20619 - DNA, 24 bp, Homo sapiens
cccgaaagatggtgaactatgcct

SEQ ID NO: 20620 - DNA, 25 bp, Homo sapiens
cccgaaagatggtgaactatgcctg

SEQ ID NO: 20621 - DNA, 28 bp, Homo sapiens
cccgaaagatggtgaactatgcctgggc

SEQ ID NO: 20622 - DNA, 29 bp, Homo sapiens
cccgaaagatggtgaactatgcctgggca

SEQ ID NO: 20623 - DNA, 31 bp, Homo sapiens
cccgaaagatggtgaactatgcctgggcagg

SEQ ID NO: 20624 - DNA, 33 bp, Homo sapiens
cccgaaagatggtgaactatgcctgggcagggc

SEQ ID NO: 20625 - DNA, 16 bp, Homo sapiens
ccgaaagatggtgaac

SEQ ID NO: 20626 - DNA, 17 bp, Homo sapiens
ccgaaagatggtgaact

SEQ ID NO: 20627 - DNA, 22 bp, Homo sapiens
ccgaaagatggtgaactatgcc

SEQ ID NO: 20628 - DNA, 23 bp, Homo sapiens
ccgaaagatggtgaactatgcct

SEQ ID NO: 20629 - DNA, 27 bp, Homo sapiens
ccgaaagatggtgaactatgcctgggc

SEQ ID NO: 20630 - DNA, 16 bp, Homo sapiens
cgaaagatggtgaact

SEQ ID NO: 20631 - DNA, 21 bp, Homo sapiens
cgaaagatggtgaactatgcc

SEQ ID NO: 20632 - DNA, 22 bp, Homo sapiens
cgaaagatggtgaactatgcct

SEQ ID NO: 20633 - DNA, 26 bp, Homo sapiens
cgaaagatggtgaactatgcctgggc

SEQ ID NO: 20634 - DNA, 27 bp, Homo sapiens
cgaaagatggtgaactatgcctgggca

SEQ ID NO: 20635 - DNA, 28 bp, Homo sapiens
cgaaagatggtgaactatgcctgggcag

SEQ ID NO: 20636 - DNA, 29 bp, Homo sapiens
cgaaagatggtgaactatgcctgggcagg

SEQ ID NO: 20637 - DNA, 30 bp, Homo sapiens; identical to SEQ ID NO: 4395

SEQ ID NO: 20638 - DNA, 31 bp, Homo sapiens
cgaaagatggtgaactatgcctgggcagggc

SEQ ID NO: 20639 - DNA, 32 bp, Homo sapiens
cgaaagatggtgaactatgcctgggcagggcg

SEQ ID NO: 20640 - DNA, 37 bp, Homo sapiens
cgaaagatggtgaactatgcctgggcagggcgaagcc

SEQ ID NO: 20641 - DNA, 25 bp, Homo sapiens
gaaagatggtgaactatgcctgggc

SEQ ID NO: 20642 - DNA, 26 bp, Homo sapiens
gaaagatggtgaactatgcctgggca

SEQ ID NO: 20643 - DNA, 27 bp, Homo sapiens
gaaagatggtgaactatgcctgggcag

SEQ ID NO: 20644 - DNA, 29 bp, Homo sapiens
gaaagatggtgaactatgcctgggcaggg

SEQ ID NO: 20645 - DNA, 25 bp, Homo sapiens
aaagatggtgaactatgcctgggca

SEQ ID NO: 20646 - DNA, 26 bp, Homo sapiens
aaagatggtgaactatgcctgggcag

SEQ ID NO: 20647 - DNA, 18 bp, Homo sapiens
aagatggtgaactatgcc

SEQ ID NO: 20648 - DNA, 19 bp, Homo sapiens
aagatggtgaactatgcct

SEQ ID NO: 20649 - DNA, 23 bp, Homo sapiens
aagatggtgaactatgcctgggc

SEQ ID NO: 20650 - DNA, 24 bp, Homo sapiens
aagatggtgaactatgcctgggca

SEQ ID NO: 20651 - DNA, 25 bp, Homo sapiens
aagatggtgaactatgcctgggcag

SEQ ID NO: 20652 - DNA, 26 bp, Homo sapiens
aagatggtgaactatgcctgggcagg

SEQ ID NO: 20653 - DNA, 27 bp, Homo sapiens
aagatggtgaactatgcctgggcaggg

SEQ ID NO: 20654 - DNA, 29 bp, Homo sapiens
aagatggtgaactatgcctgggcagggcg

SEQ ID NO: 20655 - DNA, 30 bp, Homo sapiens
aagatggtgaactatgcctgggcagggcga

SEQ ID NO: 20656 - DNA, 31 bp, Homo sapiens
aagatggtgaactatgcctgggcagggcgaa

SEQ ID NO: 20657 - DNA, 23 bp, Homo sapiens
agatggtgaactatgcctgggca

SEQ ID NO: 20658 - DNA, 16 bp, Homo sapiens
gatggtgaactatgcc

SEQ ID NO: 20659 - DNA, 17 bp, Homo sapiens
gatggtgaactatgcct

SEQ ID NO: 20660 - DNA, 21 bp, Homo sapiens
gatggtgaactatgcctgggc

SEQ ID NO: 20661 - DNA, 22 bp, Homo sapiens
gatggtgaactatgcctgggca

SEQ ID NO: 20662 - DNA, 23 bp, Homo sapiens
gatggtgaactatgcctgggcag

SEQ ID NO: 20663 - DNA, 24 bp, Homo sapiens
gatggtgaactatgcctgggcagg

SEQ ID NO: 20664 - DNA, 28 bp, Homo sapiens
gatggtgaactatgcctgggcagggcga

SEQ ID NO: 20665 - DNA, 29 bp, Homo sapiens
gatggtgaactatgcctgggcagggcgaa

SEQ ID NO: 20666 - DNA, 33 bp, Homo sapiens
gatggtgaactatgcctgggcagggcgaagcca

SEQ ID NO: 20667 - DNA, 16 bp, Homo sapiens
atggtgaactatgcct

SEQ ID NO: 20668 - DNA, 20 bp, Homo sapiens
atggtgaactatgcctgggc

SEQ ID NO: 20669 - DNA, 21 bp, Homo sapiens
atggtgaactatgcctgggca

SEQ ID NO: 20670 - DNA, 22 bp, Homo sapiens
atggtgaactatgcctgggcag

SEQ ID NO: 20671 - DNA, 31 bp, Homo sapiens
atggtgaactatgcctgggcagggcgaagcc

SEQ ID NO: 20672 - DNA, 19 bp, Homo sapiens
tggtgaactatgcctgggc

SEQ ID NO: 20673 - DNA, 20 bp, Homo sapiens
tggtgaactatgcctgggca

SEQ ID NO: 20674 - DNA, 22 bp, Homo sapiens
tggtgaactatgcctgggcagg

SEQ ID NO: 20675 - DNA, 26 bp, Homo sapiens
tggtgaactatgcctgggcagggcga

SEQ ID NO: 20676 - DNA, 33 bp, Homo sapiens
tggtgaactatgcctgggcagggcgaagccaga

SEQ ID NO: 20677 - DNA, 19 bp, Homo sapiens
ggtgaactatgcctgggca

SEQ ID NO: 20678 - DNA, 29 bp, Homo sapiens
ggtgaactatgcctgggcagggcgaagcc

SEQ ID NO: 20679 - DNA, 17 bp, Homo sapiens
gtgaactatgcctgggc

SEQ ID NO: 20680 - DNA, 18 bp, Homo sapiens
gtgaactatgcctgggca

SEQ ID NO: 20681 - DNA, 19 bp, Homo sapiens
gtgaactatgcctgggcag

SEQ ID NO: 20682 - DNA, 16 bp, Homo sapiens
tgaactatgcctgggc

SEQ ID NO: 20683 - DNA, 17 bp, Homo sapiens
tgaactatgcctgggca

SEQ ID NO: 20684 - DNA, 18 bp, Homo sapiens
tgaactatgcctgggcag

SEQ ID NO: 20685 - DNA, 27 bp, Homo sapiens
tgaactatgcctgggcagggcgaagcc

SEQ ID NO: 20686 - DNA, 16 bp, Homo sapiens
aactatgcctgggcag

SEQ ID NO: 20687 - DNA, 26 bp, Homo sapiens
tgcctgggcagggcgaagccagagga

SEQ ID NO: 20688 - DNA, 33 bp, Homo sapiens
gcctgggcagggcgaagccagaggaaactctgg

SEQ ID NO: 20689 - DNA, 23 bp, Homo sapiens
ctgggcagggcgaagccagagga

SEQ ID NO: 20690 - DNA, 32 bp, Homo sapiens
ctgggcagggcgaagccagaggaaactctggt

SEQ ID NO: 20691 - DNA, 16 bp, Homo sapiens
tgggcagggcgaagcc

SEQ ID NO: 20692 - DNA, 28 bp, Homo sapiens
gaagccagaggaaactctggtggaggtc

SEQ ID NO: 20693 - DNA, 23 bp, Homo sapiens
cagaggaaactctggtggaggtc

SEQ ID NO: 20694 - DNA, 33 bp, Homo sapiens
cagaggaaactctggtggaggtccgtagcggtc

SEQ ID NO: 20695 - DNA, 19 bp, Homo sapiens
agaggaaactctggtggag

SEQ ID NO: 20696 - DNA, 20 bp, Homo sapiens
agaggaaactctggtggagg

SEQ ID NO: 20697 - DNA, 21 bp, Homo sapiens
agaggaaactctggtggaggt

SEQ ID NO: 20698 - DNA, 22 bp, Homo sapiens
agaggaaactctggtggaggtc

SEQ ID NO: 20699 - DNA, 28 bp, Homo sapiens
agaggaaactctggtggaggtccgtagc

SEQ ID NO: 20700 - DNA, 29 bp, Homo sapiens
agaggaaactctggtggaggtccgtagcg

SEQ ID NO: 20701 - DNA, 31 bp, Homo sapiens
agaggaaactctggtggaggtccgtagcggt

SEQ ID NO: 20702 - DNA, 32 bp, Homo sapiens
agaggaaactctggtggaggtccgtagcggtc

SEQ ID NO: 20703 - DNA, 17 bp, Homo sapiens
gaggaaactctggtgga

SEQ ID NO: 20704 - DNA, 18 bp, Homo sapiens
gaggaaactctggtggag

SEQ ID NO: 20705 - DNA, 19 bp, Homo sapiens
gaggaaactctggtggagg

SEQ ID NO: 20706 - DNA, 20 bp, Homo sapiens
gaggaaactctggtggaggt

SEQ ID NO: 20707 - DNA, 21 bp, Homo sapiens
gaggaaactctggtggaggtc

SEQ ID NO: 20708 - DNA, 22 bp, Homo sapiens
gaggaaactctggtggaggtcc

SEQ ID NO: 20709 - DNA, 28 bp, Homo sapiens
gaggaaactctggtggaggtccgtagcg

SEQ ID NO: 20710 - DNA, 30 bp, Homo sapiens
gaggaaactctggtggaggtccgtagcggt

SEQ ID NO: 20711 - DNA, 31 bp, Homo sapiens
gaggaaactctggtggaggtccgtagcggtc

SEQ ID NO: 20712 - DNA, 32 bp, Homo sapiens
gaggaaactctggtggaggtccgtagcggtcc

SEQ ID NO: 20713 - DNA, 33 bp, Homo sapiens
gaggaaactctggtggaggtccgtagcggtcct

SEQ ID NO: 20714 - DNA, 20 bp, Homo sapiens
aggaaactctggtggaggtc

SEQ ID NO: 20715 - DNA, 21 bp, Homo sapiens
aggaaactctggtggaggtcc

SEQ ID NO: 20716 - DNA, 18 bp, Homo sapiens
ggaaactctggtggaggt

SEQ ID NO: 20717 - DNA, 19 bp, Homo sapiens
actctggtggaggtccgta

SEQ ID NO: 20718 - DNA, 18 bp, Homo sapiens
ctctggtggaggtccgta

SEQ ID NO: 20719 - DNA, 28 bp, Homo sapiens
ctctggtggaggtccgtagcggtcctga

SEQ ID NO: 20720 - DNA, 26 bp, Homo sapiens
tggtggaggtccgtagcggtcctgac

SEQ ID NO: 20721 - DNA, 20 bp, Homo sapiens
ggtggaggtccgtagcggtc

SEQ ID NO: 20722 - DNA, 25 bp, Homo sapiens
ggtggaggtccgtagcggtcctgac

SEQ ID NO: 20723 - DNA, 30 bp, Homo sapiens
ggtggaggtccgtagcggtcctgacgtgca

SEQ ID NO: 20724 - DNA, 18 bp, Homo sapiens
tggaggtccgtagcggtc

SEQ ID NO: 20725 - DNA, 16 bp, Homo sapiens
gaggtccgtagcggtc

SEQ ID NO: 20726 - DNA, 26 bp, Homo sapiens
gaggtccgtagcggtcctgacgtgca

SEQ ID NO: 20727 - DNA, 17 bp, Homo sapiens
ggtccgtagcggtcctg

SEQ ID NO: 20728 - DNA, 18 bp, Homo sapiens
ggtccgtagcggtcctga

SEQ ID NO: 20729 - DNA, 16 bp, Homo sapiens
gtccgtagcggtcctg

SEQ ID NO: 20730 - DNA, 17 bp, Homo sapiens
gtccgtagcggtcctga

SEQ ID NO: 20731 - DNA, 18 bp, Homo sapiens
gtccgtagcggtcctgac

SEQ ID NO: 20732 - DNA, 19 bp, Homo sapiens
gtccgtagcggtcctgacg

SEQ ID NO: 20733 - DNA, 21 bp, Homo sapiens
gtccgtagcggtcctgacgtg

SEQ ID NO: 20734 - DNA, 22 bp, Homo sapiens
gtccgtagcggtcctgacgtgc

SEQ ID NO: 20735 - DNA, 23 bp, Homo sapiens
gtccgtagcggtcctgacgtgca

SEQ ID NO: 20736 - DNA, 31 bp, Homo sapiens
gtccgtagcggtcctgacgtgcaaatcggtc

SEQ ID NO: 20737 - DNA, 16 bp, Homo sapiens
tccgtagcggtcctga

SEQ ID NO: 20738 - DNA, 17 bp, Homo sapiens
tccgtagcggtcctgac

SEQ ID NO: 20739 - DNA, 18 bp, Homo sapiens
tccgtagcggtcctgacg

SEQ ID NO: 20740 - DNA, 16 bp, Homo sapiens
ccgtagcggtcctgac

SEQ ID NO: 20741 - DNA, 17 bp, Homo sapiens
ccgtagcggtcctgacg

SEQ ID NO: 20742 - DNA, 19 bp, Homo sapiens
ccgtagcggtcctgacgtg

SEQ ID NO: 20743 - DNA, 21 bp, Homo sapiens
ccgtagcggtcctgacgtgca

SEQ ID NO: 20744 - DNA, 25 bp, Homo sapiens
ccgtagcggtcctgacgtgcaaatc

SEQ ID NO: 20745 - DNA, 30 bp, Homo sapiens
ccgtagcggtcctgacgtgcaaatcggtcg

SEQ ID NO: 20746 - DNA, 16 bp, Homo sapiens
cgtagcggtcctgacg

SEQ ID NO: 20747 - DNA, 17 bp, Homo sapiens
cgtagcggtcctgacgt

SEQ ID NO: 20748 - DNA, 18 bp, Homo sapiens
cgtagcggtcctgacgtg

SEQ ID NO: 20749 - DNA, 19 bp, Homo sapiens
cgtagcggtcctgacgtgc

SEQ ID NO: 20750 - DNA, 20 bp, Homo sapiens
cgtagcggtcctgacgtgca

SEQ ID NO: 20751 - DNA, 23 bp, Homo sapiens
cgtagcggtcctgacgtgcaaat

SEQ ID NO: 20752 - DNA, 24 bp, Homo sapiens
cgtagcggtcctgacgtgcaaatc

SEQ ID NO: 20753 - DNA, 25 bp, Homo sapiens
cgtagcggtcctgacgtgcaaatcg

SEQ ID NO: 20754 - DNA, 27 bp, Homo sapiens
cgtagcggtcctgacgtgcaaatcggt

SEQ ID NO: 20755 - DNA, 28 bp, Homo sapiens
cgtagcggtcctgacgtgcaaatcggtc

SEQ ID NO: 20756 - DNA, 29 bp, Homo sapiens
cgtagcggtcctgacgtgcaaatcggtcg

SEQ ID NO: 20757 - DNA, 31 bp, Homo sapiens
cgtagcggtcctgacgtgcaaatcggtcgtc

SEQ ID NO: 20758 - DNA, 32 bp, Homo sapiens; identical to SEQ ID NO: 4423

SEQ ID NO: 20759 - DNA, 33 bp, Homo sapiens; identical to SEQ ID NO: 4424

SEQ ID NO: 20760 - DNA, 44 bp, Homo sapiens
cgtagcggtcctgacgtgcaaatcggtcgtccgacctgggtata

SEQ ID NO: 20761 - DNA, 17 bp, Homo sapiens
gtagcggtcctgacgtg

SEQ ID NO: 20762 - DNA, 18 bp, Homo sapiens
gtagcggtcctgacgtgc

SEQ ID NO: 20763 - DNA, 19 bp, Homo sapiens
gtagcggtcctgacgtgca

SEQ ID NO: 20764 - DNA, 21 bp, Homo sapiens
gtagcggtcctgacgtgcaaa

SEQ ID NO: 20765 - DNA, 22 bp, Homo sapiens
gtagcggtcctgacgtgcaaat

SEQ ID NO: 20766 - DNA, 23 bp, Homo sapiens
gtagcggtcctgacgtgcaaatc

SEQ ID NO: 20767 - DNA, 27 bp, Homo sapiens
gtagcggtcctgacgtgcaaatcggtc

SEQ ID NO: 20768 - DNA, 30 bp, Homo sapiens
gtagcggtcctgacgtgcaaatcggtcgtc

SEQ ID NO: 20769 - DNA, 32 bp, Homo sapiens; identical to SEQ ID NO: 4427

SEQ ID NO: 20770 - DNA, 43 bp, Homo sapiens
gtagcggtcctgacgtgcaaatcggtcgtccgacctgggtata

SEQ ID NO: 20771 - DNA, 18 bp, Homo sapiens
tagcggtcctgacgtgca

SEQ ID NO: 20772 - DNA, 26 bp, Homo sapiens
tagcggtcctgacgtgcaaatcggtc

SEQ ID NO: 20773 - DNA, 24 bp, Homo sapiens
gcggtcctgacgtgcaaatcggtc

SEQ ID NO: 20774 - DNA, 25 bp, Homo sapiens
gcggtcctgacgtgcaaatcggtcg

SEQ ID NO: 20775 - DNA, 29 bp, Homo sapiens
gcggtcctgacgtgcaaatcggtcgtccg

SEQ ID NO: 20776 - DNA, 30 bp, Homo sapiens
gcggtcctgacgtgcaaatcggtcgtccga

SEQ ID NO: 20777 - DNA, 32 bp, Homo sapiens
gcggtcctgacgtgcaaatcggtcgtccgacc

SEQ ID NO: 20778 - DNA, 23 bp, Homo sapiens
cggtcctgacgtgcaaatcggtc

SEQ ID NO: 20779 - DNA, 24 bp, Homo sapiens
cggtcctgacgtgcaaatcggtcg

SEQ ID NO: 20780 - DNA, 26 bp, Homo sapiens
cggtcctgacgtgcaaatcggtcgtc

SEQ ID NO: 20781 - DNA, 27 bp, Homo sapiens
cggtcctgacgtgcaaatcggtcgtcc

SEQ ID NO: 20782 - DNA, 28 bp, Homo sapiens
ggtcctgacgtgcaaatcggtcgtccga

SEQ ID NO: 20783 - DNA, 29 bp, Homo sapiens
ggtcctgacgtgcaaatcggtcgtccgac

SEQ ID NO: 20784 - DNA, 17 bp, Homo sapiens
gtcctgacgtgcaaatc

SEQ ID NO: 20785 - DNA, 22 bp, Homo sapiens
gtcctgacgtgcaaatcggtcg

SEQ ID NO: 20786 - DNA, 23 bp, Homo sapiens
gtcctgacgtgcaaatcggtcgt

SEQ ID NO: 20787 - DNA, 25 bp, Homo sapiens
gtcctgacgtgcaaatcggtcgtcc

SEQ ID NO: 20788 - DNA, 27 bp, Homo sapiens
gtcctgacgtgcaaatcggtcgtccga

SEQ ID NO: 20789 - DNA, 29 bp, Homo sapiens
gtcctgacgtgcaaatcggtcgtccgacc

SEQ ID NO: 20790 - DNA, 27 bp, Homo sapiens
cctgacgtgcaaatcggtcgtccgacc

SEQ ID NO: 20791 - DNA, 28 bp, Homo sapiens
cctgacgtgcaaatcggtcgtccgacct

SEQ ID NO: 20792 - DNA, 33 bp, Homo sapiens
cctgacgtgcaaatcggtcgtccgacctgggta

SEQ ID NO: 20793 - DNA, 18 bp, Homo sapiens
ctgacgtgcaaatcggtc

SEQ ID NO: 20794 - DNA, 26 bp, Homo sapiens
ctgacgtgcaaatcggtcgtccgacc

SEQ ID NO: 20795 - DNA, 27 bp, Homo sapiens
ctgacgtgcaaatcggtcgtccgacct

SEQ ID NO: 20796 - DNA, 32 bp, Homo sapiens; identical to SEQ ID NO: 4428

SEQ ID NO: 20797 - DNA, 33 bp, Homo sapiens
ctgacgtgcaaatcggtcgtccgacctgggtat

SEQ ID NO: 20798 - DNA, 17 bp, Homo sapiens
tgacgtgcaaatcggtc

SEQ ID NO: 20799 - DNA, 25 bp, Homo sapiens
tgacgtgcaaatcggtcgtccgacc

SEQ ID NO: 20800 - DNA, 31 bp, Homo sapiens; identical to SEQ ID NO: 4429

SEQ ID NO: 20801 - DNA, 33 bp, Homo sapiens
tgacgtgcaaatcggtcgtccgacctgggtata

SEQ ID NO: 20802 - DNA, 16 bp, Homo sapiens
gacgtgcaaatcggtc

SEQ ID NO: 20803 - DNA, 30 bp, Homo sapiens; identical to SEQ ID NO: 4430

SEQ ID NO: 20804 - DNA, 32 bp, Homo sapiens
gacgtgcaaatcggtcgtccgacctgggtata

SEQ ID NO: 20805 - DNA, 21 bp, Homo sapiens
acgtgcaaatcggtcgtccga

SEQ ID NO: 20806 - DNA, 29 bp, Homo sapiens
acgtgcaaatcggtcgtccgacctgggta

SEQ ID NO: 20807 - DNA, 31 bp, Homo sapiens
acgtgcaaatcggtcgtccgacctgggtata

SEQ ID NO: 20808 - DNA, 20 bp, Homo sapiens
cgtgcaaatcggtcgtccga

SEQ ID NO: 20809 - DNA, 22 bp, Homo sapiens
cgtgcaaatcggtcgtccgacc

SEQ ID NO: 20810 - DNA, 23 bp, Homo sapiens
cgtgcaaatcggtcgtccgacct

SEQ ID NO: 20811 - DNA, 28 bp, Homo sapiens
cgtgcaaatcggtcgtccgacctgggta

SEQ ID NO: 20812 - DNA, 30 bp, Homo sapiens
cgtgcaaatcggtcgtccgacctgggtata

SEQ ID NO: 20813 - DNA, 19 bp, Homo sapiens
gtgcaaatcggtcgtccga

SEQ ID NO: 20814 - DNA, 27 bp, Homo sapiens
gtgcaaatcggtcgtccgacctgggta

SEQ ID NO: 20815 - DNA, 29 bp, Homo sapiens
gtgcaaatcggtcgtccgacctgggtata

SEQ ID NO: 20816 - DNA, 33 bp, Homo sapiens
gtgcaaatcggtcgtccgacctgggtatagggg

SEQ ID NO: 20817 - DNA, 34 bp, Homo sapiens
gtgcaaatcggtcgtccgacctgggtataggggc

SEQ ID NO: 20818 - DNA, 35 bp, Homo sapiens
gtgcaaatcggtcgtccgacctgggtataggggcg

SEQ ID NO: 20819 - DNA, 41 bp, Homo sapiens
gtgcaaatcggtcgtccgacctgggtataggggcgaaagac

SEQ ID NO: 20820 - DNA, 18 bp, Homo sapiens
tgcaaatcggtcgtccga

SEQ ID NO: 20821 - DNA, 26 bp, Homo sapiens
tgcaaatcggtcgtccgacctgggta

SEQ ID NO: 20822 - DNA, 32 bp, Homo sapiens
tgcaaatcggtcgtccgacctgggtatagggg

SEQ ID NO: 20823 - DNA, 33 bp, Homo sapiens; identical to SEQ ID NO: 4432

SEQ ID NO: 20824 - DNA, 34 bp, Homo sapiens
tgcaaatcggtcgtccgacctgggtataggggcg

SEQ ID NO: 20825 - DNA, 40 bp, Homo sapiens
tgcaaatcggtcgtccgacctgggtataggggcgaaagac

SEQ ID NO: 20826 - DNA, 17 bp, Homo sapiens
gcaaatcggtcgtccga

SEQ ID NO: 20827 - DNA, 25 bp, Homo sapiens
gcaaatcggtcgtccgacctgggta

SEQ ID NO: 20828 - DNA, 32 bp, Homo sapiens
gcaaatcggtcgtccgacctgggtataggggc

SEQ ID NO: 20829 - DNA, 33 bp, Homo sapiens
gcaaatcggtcgtccgacctgggtataggggcg

SEQ ID NO: 20830 - DNA, 16 bp, Homo sapiens
caaatcggtcgtccga

SEQ ID NO: 20831 - DNA, 30 bp, Homo sapiens
caaatcggtcgtccgacctgggtatagggg

SEQ ID NO: 20832 - DNA, 31 bp, Homo sapiens; identical to SEQ ID NO: 4433

SEQ ID NO: 20833 - DNA, 32 bp, Homo sapiens; identical to SEQ ID NO: 4434

SEQ ID NO: 20834 - DNA, 33 bp, Homo sapiens
caaatcggtcgtccgacctgggtataggggcga

SEQ ID NO: 20835 - DNA, 16 bp, Homo sapiens
aaatcggtcgtccgac

SEQ ID NO: 20836 - DNA, 17 bp, Homo sapiens
aaatcggtcgtccgacc

SEQ ID NO: 20837 - DNA, 18 bp, Homo sapiens
aaatcggtcgtccgacct

SEQ ID NO: 20838 - DNA, 22 bp, Homo sapiens
aaatcggtcgtccgacctgggt

SEQ ID NO: 20839 - DNA, 23 bp, Homo sapiens
aaatcggtcgtccgacctgggta

SEQ ID NO: 20840 - DNA, 25 bp, Homo sapiens
aaatcggtcgtccgacctgggtata

SEQ ID NO: 20841 - DNA, 29 bp, Homo sapiens
aaatcggtcgtccgacctgggtatagggg

SEQ ID NO: 20842 - DNA, 30 bp, Homo sapiens; identical to SEQ ID NO: 4436

SEQ ID NO: 20843 - DNA, 31 bp, Homo sapiens; identical to SEQ ID NO: 4437

SEQ ID NO: 20844 - DNA, 32 bp, Homo sapiens; identical to SEQ ID NO: 4438

SEQ ID NO: 20845 - DNA, 33 bp, Homo sapiens
aaatcggtcgtccgacctgggtataggggcgaa

SEQ ID NO: 20846 - DNA, 37 bp, Homo sapiens
aaatcggtcgtccgacctgggtataggggcgaaagac

SEQ ID NO: 20847 - DNA, 16 bp, Homo sapiens
aatcggtcgtccgacc

SEQ ID NO: 20848 - DNA, 17 bp, Homo sapiens
aatcggtcgtccgacct

SEQ ID NO: 20849 - DNA, 22 bp, Homo sapiens
aatcggtcgtccgacctgggta

SEQ ID NO: 20850 - DNA, 24 bp, Homo sapiens
aatcggtcgtccgacctgggtata

SEQ ID NO: 20851 - DNA, 27 bp, Homo sapiens
aatcggtcgtccgacctgggtataggg

SEQ ID NO: 20852 - DNA, 28 bp, Homo sapiens
aatcggtcgtccgacctgggtatagggg

SEQ ID NO: 20853 - DNA, 29 bp, Homo sapiens
aatcggtcgtccgacctgggtataggggc

SEQ ID NO: 20854 - DNA, 30 bp, Homo sapiens; identical to SEQ ID NO: 4444

SEQ ID NO: 20855 - DNA, 31 bp, Homo sapiens; identical to SEQ ID NO: 4445

SEQ ID NO: 20856 - DNA, 32 bp, Homo sapiens; identical to SEQ ID NO: 4446

SEQ ID NO: 20857 - DNA, 33 bp, Homo sapiens; identical to SEQ ID NO: 4447

SEQ ID NO: 20858 - DNA, 34 bp, Homo sapiens
aatcggtcgtccgacctgggtataggggcgaaag

SEQ ID NO: 20859 - DNA, 35 bp, Homo sapiens
aatcggtcgtccgacctgggtataggggcgaaaga

SEQ ID NO: 20860 - DNA, 36 bp, Homo sapiens
aatcggtcgtccgacctgggtataggggcgaaagac

SEQ ID NO: 20861 - DNA, 37 bp, Homo sapiens
aatcggtcgtccgacctgggtataggggcgaaagact

SEQ ID NO: 20862 - DNA, 16 bp, Homo sapiens
atcggtcgtccgacct

SEQ ID NO: 20863 - DNA, 21 bp, Homo sapiens
atcggtcgtccgacctgggta

SEQ ID NO: 20864 - DNA, 23 bp, Homo sapiens
atcggtcgtccgacctgggtata

SEQ ID NO: 20865 - DNA, 27 bp, Homo sapiens
atcggtcgtccgacctgggtatagggg

SEQ ID NO: 20866 - DNA, 28 bp, Homo sapiens
atcggtcgtccgacctgggtataggggc

SEQ ID NO: 20867 - DNA, 29 bp, Homo sapiens
atcggtcgtccgacctgggtataggggcg

SEQ ID NO: 20868 - DNA, 30 bp, Homo sapiens; identical to SEQ ID NO: 4451

SEQ ID NO: 20869 - DNA, 31 bp, Homo sapiens
atcggtcgtccgacctgggtataggggcgaa

SEQ ID NO: 20870 - DNA, 32 bp, Homo sapiens
atcggtcgtccgacctgggtataggggcgaaa

SEQ ID NO: 20871 - DNA, 33 bp, Homo sapiens
atcggtcgtccgacctgggtataggggcgaaag

SEQ ID NO: 20872 - DNA, 34 bp, Homo sapiens
atcggtcgtccgacctgggtataggggcgaaaga

SEQ ID NO: 20873 - DNA, 35 bp, Homo sapiens
atcggtcgtccgacctgggtataggggcgaaagac

SEQ ID NO: 20874 - DNA, 36 bp, Homo sapiens
atcggtcgtccgacctgggtataggggcgaaagact

SEQ ID NO: 20875 - DNA, 20 bp, Homo sapiens
tcggtcgtccgacctgggta

SEQ ID NO: 20876 - DNA, 27 bp, Homo sapiens
tcggtcgtccgacctgggtataggggc

SEQ ID NO: 20877 - DNA, 28 bp, Homo sapiens
tcggtcgtccgacctgggtataggggcg

SEQ ID NO: 20878 - DNA, 29 bp, Homo sapiens
tcggtcgtccgacctgggtataggggcga

SEQ ID NO: 20879 - DNA, 25 bp, Homo sapiens
cggtcgtccgacctgggtatagggg

SEQ ID NO: 20880 - DNA, 26 bp, Homo sapiens
cggtcgtccgacctgggtataggggc

SEQ ID NO: 20881 - DNA, 27 bp, Homo sapiens
cggtcgtccgacctgggtataggggcg

SEQ ID NO: 20882 - DNA, 28 bp, Homo sapiens
cggtcgtccgacctgggtataggggcga

SEQ ID NO: 20883 - DNA, 29 bp, Homo sapiens
cggtcgtccgacctgggtataggggcgaa

SEQ ID NO: 20884 - DNA, 33 bp, Homo sapiens; identical to SEQ ID NO: 4455

SEQ ID NO: 20885 - DNA, 34 bp, Homo sapiens
cggtcgtccgacctgggtataggggcgaaagact

SEQ ID NO: 20886 - DNA, 25 bp, Homo sapiens
ggtcgtccgacctgggtataggggc

SEQ ID NO: 20887 - DNA, 26 bp, Homo sapiens
ggtcgtccgacctgggtataggggcg

SEQ ID NO: 20888 - DNA, 32 bp, Homo sapiens
ggtcgtccgacctgggtataggggcgaaagac

SEQ ID NO: 20889 - DNA, 33 bp, Homo sapiens
ggtcgtccgacctgggtataggggcgaaagact

SEQ ID NO: 20890 - DNA, 24 bp, Homo sapiens
gtcgtccgacctgggtataggggc

SEQ ID NO: 20891 - DNA, 25 bp, Homo sapiens
gtcgtccgacctgggtataggggcg

SEQ ID NO: 20892 - DNA, 16 bp, Homo sapiens
tcgtccgacctgggta

SEQ ID NO: 20893 - DNA, 21 bp, Homo sapiens
tcgtccgacctgggtataggg

SEQ ID NO: 20894 - DNA, 22 bp, Homo sapiens
cgtccgacctgggtataggggc

SEQ ID NO: 20895 - DNA, 21 bp, Homo sapiens
gtccgacctgggtataggggc

SEQ ID NO: 20896 - DNA, 22 bp, Homo sapiens
gtccgacctgggtataggggcg

SEQ ID NO: 20897 - DNA, 28 bp, Homo sapiens
gtccgacctgggtataggggcgaaagac

SEQ ID NO: 20898 - DNA, 29 bp, Homo sapiens
gtccgacctgggtataggggcgaaagact

SEQ ID NO: 20899 - DNA, 27 bp, Homo sapiens
ccgacctgggtataggggcgaaagact

SEQ ID NO: 20900 - DNA, 19 bp, Homo sapiens
cgacctgggtataggggcg

SEQ ID NO: 20901 - DNA, 26 bp, Homo sapiens
cgacctgggtataggggcgaaagact

SEQ ID NO: 20902 - DNA, 24 bp, Homo sapiens
gacctgggtataggggcgaaagac

SEQ ID NO: 20903 - DNA, 25 bp, Homo sapiens
gacctgggtataggggcgaaagact

SEQ ID NO: 20904 - DNA, 23 bp, Homo sapiens
acctgggtataggggcgaaagac

SEQ ID NO: 20905 - DNA, 24 bp, Homo sapiens
acctgggtataggggcgaaagact

SEQ ID NO: 20906 - DNA, 24 bp, Homo sapiens
cctgggtataggggcgaaagacta

SEQ ID NO: 20907 - DNA, 33 bp, Homo sapiens
cctgggtataggggcgaaagactaatcgaacca

SEQ ID NO: 20908 - DNA, 21 bp, Homo sapiens
tgggtataggggcgaaagact

SEQ ID NO: 20909 - DNA, 17 bp, Homo sapiens
tataggggcgaaagact

SEQ ID NO: 20910 - DNA, 16 bp, Homo sapiens
ataggggcgaaagact

SEQ ID NO: 20911 - DNA, 25 bp, Homo sapiens
ataggggcgaaagactaatcgaacc

SEQ ID NO: 20912 - DNA, 29 bp, Homo sapiens
ataggggcgaaagactaatcgaaccatct

SEQ ID NO: 20913 - DNA, 16 bp, Homo sapiens
taggggcgaaagacta

SEQ ID NO: 20914 - DNA, 24 bp, Homo sapiens
taggggcgaaagactaatcgaacc

SEQ ID NO: 20915 - DNA, 21 bp, Homo sapiens
aggggcgaaagactaatcgaa

SEQ ID NO: 20916 - DNA, 22 bp, Homo sapiens
aggggcgaaagactaatcgaac

SEQ ID NO: 20917 - DNA, 23 bp, Homo sapiens
aggggcgaaagactaatcgaacc

SEQ ID NO: 20918 - DNA, 24 bp, Homo sapiens
aggggcgaaagactaatcgaacca

SEQ ID NO: 20919 - DNA, 26 bp, Homo sapiens
aggggcgaaagactaatcgaaccatc

SEQ ID NO: 20920 - DNA, 27 bp, Homo sapiens
aggggcgaaagactaatcgaaccatct

SEQ ID NO: 20921 - DNA, 20 bp, Homo sapiens
ggggcgaaagactaatcgaa

SEQ ID NO: 20922 - DNA, 22 bp, Homo sapiens
ggggcgaaagactaatcgaacc

SEQ ID NO: 20923 - DNA, 17 bp, Homo sapiens
gaaagactaatcgaacc

SEQ ID NO: 20924 - DNA, 28 bp, Homo sapiens
gaaagactaatcgaaccatctagtagct

SEQ ID NO: 20925 - DNA, 16 bp, Homo sapiens
aaagactaatcgaacc

SEQ ID NO: 20926 - DNA, 19 bp, Homo sapiens
aaagactaatcgaaccatc

SEQ ID NO: 20927 - DNA, 20 bp, Homo sapiens
aaagactaatcgaaccatct

SEQ ID NO: 20928 - DNA, 23 bp, Homo sapiens
aaagactaatcgaaccatctagt

SEQ ID NO: 20929 - DNA, 27 bp, Homo sapiens
aaagactaatcgaaccatctagtagct

SEQ ID NO: 20930 - DNA, 19 bp, Homo sapiens
aagactaatcgaaccatct

SEQ ID NO: 20931 - DNA, 20 bp, Homo sapiens
aagactaatcgaaccatcta

SEQ ID NO: 20932 - DNA, 22 bp, Homo sapiens
aagactaatcgaaccatctagt

SEQ ID NO: 20933 - DNA, 23 bp, Homo sapiens
aagactaatcgaaccatctagta

SEQ ID NO: 20934 - DNA, 26 bp, Homo sapiens
aagactaatcgaaccatctagtagct

SEQ ID NO: 20935 - DNA, 17 bp, Homo sapiens
agactaatcgaaccatc

SEQ ID NO: 20936 - DNA, 18 bp, Homo sapiens
agactaatcgaaccatct

SEQ ID NO: 20937 - DNA, 19 bp, Homo sapiens
agactaatcgaaccatcta

SEQ ID NO: 20938 - DNA, 21 bp, Homo sapiens
agactaatcgaaccatctagt

SEQ ID NO: 20939 - DNA, 25 bp, Homo sapiens
agactaatcgaaccatctagtagct

SEQ ID NO: 20940 - DNA, 22 bp, Homo sapiens
ctaatcgaaccatctagtagct

SEQ ID NO: 20941 - DNA, 20 bp, Homo sapiens
taatcgaaccatctagtagc

SEQ ID NO: 20942 - DNA, 21 bp, Homo sapiens
taatcgaaccatctagtagct

SEQ ID NO: 20943 - DNA, 19 bp, Homo sapiens
aatcgaaccatctagtagc

SEQ ID NO: 20944 - DNA, 20 bp, Homo sapiens
aatcgaaccatctagtagct

SEQ ID NO: 20945 - DNA, 18 bp, Homo sapiens
atcgaaccatctagtagc

SEQ ID NO: 20946 - DNA, 19 bp, Homo sapiens
atcgaaccatctagtagct

SEQ ID NO: 20947 - DNA, 18 bp, Homo sapiens
tcgaaccatctagtagct

SEQ ID NO: 20948 - DNA, 21 bp, Homo sapiens
ccatctagtagctggttccct

SEQ ID NO: 20949 - DNA, 25 bp, Homo sapiens
ccatctagtagctggttccctccga

SEQ ID NO: 20950 - DNA, 32 bp, Homo sapiens
catctagtagctggttccctccgaagtttccc

SEQ ID NO: 20951 - DNA, 33 bp, Homo sapiens
atctagtagctggttccctccgaagtttccctc

SEQ ID NO: 20952 - DNA, 18 bp, Homo sapiens
tctagtagctggttccct

SEQ ID NO: 20953 - DNA, 22 bp, Homo sapiens
tctagtagctggttccctccga

SEQ ID NO: 20954 - DNA, 23 bp, Homo sapiens
tctagtagctggttccctccgaa

SEQ ID NO: 20955 - DNA, 32 bp, Homo sapiens
tctagtagctggttccctccgaagtttccctc

SEQ ID NO: 20956 - DNA, 33 bp, Homo sapiens
tctagtagctggttccctccgaagtttccctca

SEQ ID NO: 20957 - DNA, 16 bp, Homo sapiens
tagtagctggttccct

SEQ ID NO: 20958 - DNA, 24 bp, Homo sapiens
tagtagctggttccctccgaagtt

SEQ ID NO: 20959 - DNA, 30 bp, Homo sapiens
tagtagctggttccctccgaagtttccctc

SEQ ID NO: 20960 - DNA, 31 bp, Homo sapiens
tagtagctggttccctccgaagtttccctca

SEQ ID NO: 20961 - DNA, 18 bp, Homo sapiens
gtagctggttccctccga

SEQ ID NO: 20962 - DNA, 29 bp, Homo sapiens
gtagctggttccctccgaagtttccctca

SEQ ID NO: 20963 - DNA, 32 bp, Homo sapiens
gtagctggttccctccgaagtttccctcagga

SEQ ID NO: 20964 - DNA, 18 bp, Homo sapiens
agctggttccctccgaag

SEQ ID NO: 20965 - DNA, 31 bp, Homo sapiens
gctggttccctccgaagtttccctcaggata

SEQ ID NO: 20966 - DNA, 33 bp, Homo sapiens
gctggttccctccgaagtttccctcaggatagc

SEQ ID NO: 20967 - DNA, 16 bp, Homo sapiens
agtttccctcaggata

SEQ ID NO: 20968 - DNA, 25 bp, Homo sapiens
gtttccctcaggatagctggcgctc

SEQ ID NO: 20969 - DNA, 30 bp, Homo sapiens
gtttccctcaggatagctggcgctctcgca

SEQ ID NO: 20970 - DNA, 24 bp, Homo sapiens
tttccctcaggatagctggcgctc

SEQ ID NO: 20971 - DNA, 33 bp, Homo sapiens
tttccctcaggatagctggcgctctcgcagacc

SEQ ID NO: 20972 - DNA, 22 bp, Homo sapiens
tccctcaggatagctggcgctc

SEQ ID NO: 20973 - DNA, 28 bp, Homo sapiens
tccctcaggatagctggcgctctcgcag

SEQ ID NO: 20974 - DNA, 29 bp, Homo sapiens
tccctcaggatagctggcgctctcgcaga

SEQ ID NO: 20975 - DNA, 30 bp, Homo sapiens
tccctcaggatagctggcgctctcgcagac

SEQ ID NO: 20976 - DNA, 31 bp, Homo sapiens; identical to SEQ ID NO: 4469

SEQ ID NO: 20977 - DNA, 32 bp, Homo sapiens; identical to SEQ ID NO: 4470

SEQ ID NO: 20978 - DNA, 33 bp, Homo sapiens; identical to SEQ ID NO: 4471

SEQ ID NO: 20979 - DNA, 40 bp, Homo sapiens
tccctcaggatagctggcgctctcgcagacccgacgcacc

SEQ ID NO: 20980 - DNA, 41 bp, Homo sapiens
tccctcaggatagctggcgctctcgcagacccgacgcaccc

SEQ ID NO: 20981 - DNA, 42 bp, Homo sapiens
tccctcaggatagctggcgctctcgcagacccgacgcacccc

SEQ ID NO: 20982 - DNA, 26 bp, Homo sapiens
ccctcaggatagctggcgctctcgca

SEQ ID NO: 20983 - DNA, 27 bp, Homo sapiens
ccctcaggatagctggcgctctcgcag

SEQ ID NO: 20984 - DNA, 28 bp, Homo sapiens
ccctcaggatagctggcgctctcgcaga

SEQ ID NO: 20985 - DNA, 29 bp, Homo sapiens
ccctcaggatagctggcgctctcgcagac

SEQ ID NO: 20986 - DNA, 30 bp, Homo sapiens; identical to SEQ ID NO: 4473

SEQ ID NO: 20987 - DNA, 31 bp, Homo sapiens; identical to SEQ ID NO: 4474

SEQ ID NO: 20988 - DNA, 32 bp, Homo sapiens; identical to SEQ ID NO: 4475

SEQ ID NO: 20989 - DNA, 33 bp, Homo sapiens; identical to SEQ ID NO: 4476

SEQ ID NO: 20990 - DNA, 39 bp, Homo sapiens
ccctcaggatagctggcgctctcgcagacccgacgcacc

SEQ ID NO: 20991 - DNA, 40 bp, Homo sapiens
ccctcaggatagctggcgctctcgcagacccgacgcaccc

SEQ ID NO: 20992 - DNA, 41 bp, Homo sapiens
ccctcaggatagctggcgctctcgcagacccgacgcacccc

SEQ ID NO: 20993 - DNA, 27 bp, Homo sapiens
cctcaggatagctggcgctctcgcaga

SEQ ID NO: 20994 - DNA, 29 bp, Homo sapiens
cctcaggatagctggcgctctcgcagacc

SEQ ID NO: 20995 - DNA, 30 bp, Homo sapiens
cctcaggatagctggcgctctcgcagaccc

SEQ ID NO: 20996 - DNA, 32 bp, Homo sapiens
cctcaggatagctggcgctctcgcagacccga

SEQ ID NO: 20997 - DNA, 26 bp, Homo sapiens
ctcaggatagctggcgctctcgcaga

SEQ ID NO: 20998 - DNA, 27 bp, Homo sapiens
ctcaggatagctggcgctctcgcagac

SEQ ID NO: 20999 - DNA, 28 bp, Homo sapiens
ctcaggatagctggcgctctcgcagacc

SEQ ID NO: 21000 - DNA, 29 bp, Homo sapiens
ctcaggatagctggcgctctcgcagaccc

SEQ ID NO: 21001 - DNA, 30 bp, Homo sapiens; identical to SEQ ID NO: 4478

SEQ ID NO: 21002 - DNA, 31 bp, Homo sapiens; identical to SEQ ID NO: 4479

SEQ ID NO: 21003 - DNA, 32 bp, Homo sapiens
ctcaggatagctggcgctctcgcagacccgac

SEQ ID NO: 21004 - DNA, 33 bp, Homo sapiens
ctcaggatagctggcgctctcgcagacccgacg

SEQ ID NO: 21005 - DNA, 37 bp, Homo sapiens
ctcaggatagctggcgctctcgcagacccgacgcacc

SEQ ID NO: 21006 - DNA, 38 bp, Homo sapiens
ctcaggatagctggcgctctcgcagacccgacgcaccc

SEQ ID NO: 21007 - DNA, 39 bp, Homo sapiens
ctcaggatagctggcgctctcgcagacccgacgcacccc

SEQ ID NO: 21008 - DNA, 27 bp, Homo sapiens
tcaggatagctggcgctctcgcagacc

SEQ ID NO: 21009 - DNA, 28 bp, Homo sapiens
tcaggatagctggcgctctcgcagaccc

SEQ ID NO: 21010 - DNA, 29 bp, Homo sapiens
tcaggatagctggcgctctcgcagacccg

SEQ ID NO: 21011 - DNA, 30 bp, Homo sapiens
tcaggatagctggcgctctcgcagacccga

SEQ ID NO: 21012 - DNA, 36 bp, Homo sapiens
tcaggatagctggcgctctcgcagacccgacgcacc

SEQ ID NO: 21013 - DNA, 37 bp, Homo sapiens
tcaggatagctggcgctctcgcagacccgacgcaccc

SEQ ID NO: 21014 - DNA, 16 bp, Homo sapiens
caggatagctggcgct

SEQ ID NO: 21015 - DNA, 18 bp, Homo sapiens
caggatagctggcgctct

SEQ ID NO: 21016 - DNA, 24 bp, Homo sapiens
caggatagctggcgctctcgcaga

SEQ ID NO: 21017 - DNA, 26 bp, Homo sapiens
caggatagctggcgctctcgcagacc

SEQ ID NO: 21018 - DNA, 27 bp, Homo sapiens
caggatagctggcgctctcgcagaccc

SEQ ID NO: 21019 - DNA, 28 bp, Homo sapiens
caggatagctggcgctctcgcagacccg

SEQ ID NO: 21020 - DNA, 29 bp, Homo sapiens
caggatagctggcgctctcgcagacccga

SEQ ID NO: 21021 - DNA, 30 bp, Homo sapiens
caggatagctggcgctctcgcagacccgac

SEQ ID NO: 21022 - DNA, 35 bp, Homo sapiens
caggatagctggcgctctcgcagacccgacgcacc

SEQ ID NO: 21023 - DNA, 36 bp, Homo sapiens
caggatagctggcgctctcgcagacccgacgcaccc

SEQ ID NO: 21024 - DNA, 37 bp, Homo sapiens
caggatagctggcgctctcgcagacccgacgcacccc

SEQ ID NO: 21025 - DNA, 16 bp, Homo sapiens
aggatagctggcgctc

SEQ ID NO: 21026 - DNA, 17 bp, Homo sapiens
aggatagctggcgctct

SEQ ID NO: 21027 - DNA, 18 bp, Homo sapiens
aggatagctggcgctctc

SEQ ID NO: 21028 - DNA, 22 bp, Homo sapiens
aggatagctggcgctctcgcag

SEQ ID NO: 21029 - DNA, 23 bp, Homo sapiens
aggatagctggcgctctcgcaga

SEQ ID NO: 21030 - DNA, 24 bp, Homo sapiens
aggatagctggcgctctcgcagac

SEQ ID NO: 21031 - DNA, 25 bp, Homo sapiens
aggatagctggcgctctcgcagacc

SEQ ID NO: 21032 - DNA, 26 bp, Homo sapiens
aggatagctggcgctctcgcagaccc

SEQ ID NO: 21033 - DNA, 27 bp, Homo sapiens
aggatagctggcgctctcgcagacccg

SEQ ID NO: 21034 - DNA, 28 bp, Homo sapiens
aggatagctggcgctctcgcagacccga

SEQ ID NO: 21035 - DNA, 29 bp, Homo sapiens
aggatagctggcgctctcgcagacccgac

SEQ ID NO: 21036 - DNA, 30 bp, Homo sapiens; identical to SEQ ID NO: 4494

SEQ ID NO: 21037 - DNA, 31 bp, Homo sapiens
aggatagctggcgctctcgcagacccgacgc

SEQ ID NO: 21038 - DNA, 32 bp, Homo sapiens; identical to SEQ ID NO: 4495

SEQ ID NO: 21039 - DNA, 33 bp, Homo sapiens; identical to SEQ ID NO: 4496

SEQ ID NO: 21040 - DNA, 34 bp, Homo sapiens
aggatagctggcgctctcgcagacccgacgcacc

SEQ ID NO: 21041 - DNA, 35 bp, Homo sapiens
aggatagctggcgctctcgcagacccgacgcaccc

SEQ ID NO: 21042 - DNA, 36 bp, Homo sapiens
aggatagctggcgctctcgcagacccgacgcacccc

SEQ ID NO: 21043 - DNA, 37 bp, Homo sapiens
aggatagctggcgctctcgcagacccgacgcaccccc

SEQ ID NO: 21044 - DNA, 40 bp, Homo sapiens
aggatagctggcgctctcgcagacccgacgcacccccgcc

SEQ ID NO: 21045 - DNA, 41 bp, Homo sapiens
aggatagctggcgctctcgcagacccgacgcacccccgcca

SEQ ID NO: 21046 - DNA, 24 bp, Homo sapiens
ggatagctggcgctctcgcagacc

SEQ ID NO: 21047 - DNA, 25 bp, Homo sapiens
ggatagctggcgctctcgcagaccc

SEQ ID NO: 21048 - DNA, 26 bp, Homo sapiens
ggatagctggcgctctcgcagacccg

SEQ ID NO: 21049 - DNA, 27 bp, Homo sapiens
ggatagctggcgctctcgcagacccga

SEQ ID NO: 21050 - DNA, 33 bp, Homo sapiens; identical to SEQ ID NO: 4498

SEQ ID NO: 21051 - DNA, 34 bp, Homo sapiens
ggatagctggcgctctcgcagacccgacgcaccc

SEQ ID NO: 21052 - DNA, 35 bp, Homo sapiens
ggatagctggcgctctcgcagacccgacgcacccc

SEQ ID NO: 21053 - DNA, 23 bp, Homo sapiens
gatagctggcgctctcgcagacc

SEQ ID NO: 21054 - DNA, 24 bp, Homo sapiens
gatagctggcgctctcgcagaccc

SEQ ID NO: 21055 - DNA, 25 bp, Homo sapiens
gatagctggcgctctcgcagacccg

SEQ ID NO: 21056 - DNA, 26 bp, Homo sapiens
gatagctggcgctctcgcagacccga

SEQ ID NO: 21057 - DNA, 27 bp, Homo sapiens
gatagctggcgctctcgcagacccgac

SEQ ID NO: 21058 - DNA, 28 bp, Homo sapiens
gatagctggcgctctcgcagacccgacg

SEQ ID NO: 21059 - DNA, 32 bp, Homo sapiens; identical to SEQ ID NO: 4499

SEQ ID NO: 21060 - DNA, 33 bp, Homo sapiens; identical to SEQ ID NO: 4500

SEQ ID NO: 21061 - DNA, 34 bp, Homo sapiens
gatagctggcgctctcgcagacccgacgcacccc

SEQ ID NO: 21062 - DNA, 35 bp, Homo sapiens
gatagctggcgctctcgcagacccgacgcaccccc

SEQ ID NO: 21063 - DNA, 36 bp, Homo sapiens
gatagctggcgctctcgcagacccgacgcacccccg

SEQ ID NO: 21064 - DNA, 38 bp, Homo sapiens
gatagctggcgctctcgcagacccgacgcacccccgcc

SEQ ID NO: 21065 - DNA, 22 bp, Homo sapiens
atagctggcgctctcgcagacc

SEQ ID NO: 21066 - DNA, 23 bp, Homo sapiens
atagctggcgctctcgcagaccc

SEQ ID NO: 21067 - DNA, 24 bp, Homo sapiens
atagctggcgctctcgcagacccg

SEQ ID NO: 21068 - DNA, 25 bp, Homo sapiens
atagctggcgctctcgcagacccga

SEQ ID NO: 21069 - DNA, 26 bp, Homo sapiens
atagctggcgctctcgcagacccgac

SEQ ID NO: 21070 - DNA, 27 bp, Homo sapiens
atagctggcgctctcgcagacccgacg

SEQ ID NO: 21071 - DNA, 31 bp, Homo sapiens; identical to SEQ ID NO: 4504

SEQ ID NO: 21072 - DNA, 32 bp, Homo sapiens; identical to SEQ ID NO: 4505

SEQ ID NO: 21073 - DNA, 33 bp, Homo sapiens; identical to SEQ ID NO: 4506

SEQ ID NO: 21074 - DNA, 34 bp, Homo sapiens
atagctggcgctctcgcagacccgacgcaccccc

SEQ ID NO: 21075 - DNA, 17 bp, Homo sapiens
tagctggcgctctcgca

SEQ ID NO: 21076 - DNA, 19 bp, Homo sapiens
tagctggcgctctcgcaga

SEQ ID NO: 21077 - DNA, 20 bp, Homo sapiens
tagctggcgctctcgcagac

SEQ ID NO: 21078 - DNA, 21 bp, Homo sapiens
tagctggcgctctcgcagacc

SEQ ID NO: 21079 - DNA, 22 bp, Homo sapiens
tagctggcgctctcgcagaccc

SEQ ID NO: 21080 - DNA, 23 bp, Homo sapiens
tagctggcgctctcgcagacccg

SEQ ID NO: 21081 - DNA, 24 bp, Homo sapiens
tagctggcgctctcgcagacccga

SEQ ID NO: 21082 - DNA, 25 bp, Homo sapiens
tagctggcgctctcgcagacccgac

SEQ ID NO: 21083 - DNA, 26 bp, Homo sapiens
tagctggcgctctcgcagacccgacg

SEQ ID NO: 21084 - DNA, 27 bp, Homo sapiens
tagctggcgctctcgcagacccgacgc

SEQ ID NO: 21085 - DNA, 28 bp, Homo sapiens
tagctggcgctctcgcagacccgacgca

SEQ ID NO: 21086 - DNA, 30 bp, Homo sapiens; identical to SEQ ID NO: 4507

SEQ ID NO: 21087 - DNA, 31 bp, Homo sapiens; identical to SEQ ID NO: 4508

SEQ ID NO: 21088 - DNA, 32 bp, Homo sapiens; identical to SEQ ID NO: 4509

SEQ ID NO: 21089 - DNA, 33 bp, Homo sapiens
tagctggcgctctcgcagacccgacgcaccccc

SEQ ID NO: 21090 - DNA, 20 bp, Homo sapiens
agctggcgctctcgcagacc

SEQ ID NO: 21091 - DNA, 22 bp, Homo sapiens
agctggcgctctcgcagacccg

SEQ ID NO: 21092 - DNA, 23 bp, Homo sapiens
agctggcgctctcgcagacccga

SEQ ID NO: 21093 - DNA, 25 bp, Homo sapiens
agctggcgctctcgcagacccgacg

SEQ ID NO: 21094 - DNA, 29 bp, Homo sapiens
agctggcgctctcgcagacccgacgcacc

SEQ ID NO: 21095 - DNA, 30 bp, Homo sapiens; identical to SEQ ID NO: 4512

SEQ ID NO: 21096 - DNA, 31 bp, Homo sapiens; identical to SEQ ID NO: 4513

SEQ ID NO: 21097 - DNA, 32 bp, Homo sapiens; identical to SEQ ID NO: 4514

SEQ ID NO: 21098 - DNA, 33 bp, Homo sapiens
agctggcgctctcgcagacccgacgcacccccg

SEQ ID NO: 21099 - DNA, 18 bp, Homo sapiens
gctggcgctctcgcagac

SEQ ID NO: 21100 - DNA, 19 bp, Homo sapiens
gctggcgctctcgcagacc

SEQ ID NO: 21101 - DNA, 20 bp, Homo sapiens
gctggcgctctcgcagaccc

SEQ ID NO: 21102 - DNA, 21 bp, Homo sapiens
gctggcgctctcgcagacccg

SEQ ID NO: 21103 - DNA, 22 bp, Homo sapiens
gctggcgctctcgcagacccga

SEQ ID NO: 21104 - DNA, 28 bp, Homo sapiens
gctggcgctctcgcagacccgacgcacc

SEQ ID NO: 21105 - DNA, 29 bp, Homo sapiens
gctggcgctctcgcagacccgacgcaccc

SEQ ID NO: 21106 - DNA, 30 bp, Homo sapiens; identical to SEQ ID NO: 4517

SEQ ID NO: 21107 - DNA, 31 bp, Homo sapiens
gctggcgctctcgcagacccgacgcaccccc

SEQ ID NO: 21108 - DNA, 18 bp, Homo sapiens
ctggcgctctcgcagacc

SEQ ID NO: 21109 - DNA, 21 bp, Homo sapiens
ctggcgctctcgcagacccga

SEQ ID NO: 21110 - DNA, 27 bp, Homo sapiens
ctggcgctctcgcagacccgacgcacc

SEQ ID NO: 21111 - DNA, 28 bp, Homo sapiens
ctggcgctctcgcagacccgacgcaccc

SEQ ID NO: 21112 - DNA, 29 bp, Homo sapiens
ctggcgctctcgcagacccgacgcacccc

SEQ ID NO: 21113 - DNA, 30 bp, Homo sapiens; identical to SEQ ID NO: 4521

SEQ ID NO: 21114 - DNA, 31 bp, Homo sapiens
ctggcgctctcgcagacccgacgcacccccg

SEQ ID NO: 21115 - DNA, 32 bp, Homo sapiens
ctggcgctctcgcagacccgacgcacccccgc

SEQ ID NO: 21116 - DNA, 33 bp, Homo sapiens
ctggcgctctcgcagacccgacgcacccccgcc

SEQ ID NO: 21117 - DNA, 17 bp, Homo sapiens
tggcgctctcgcagacc

SEQ ID NO: 21118 - DNA, 26 bp, Homo sapiens
tggcgctctcgcagacccgacgcacc

SEQ ID NO: 21119 - DNA, 27 bp, Homo sapiens
tggcgctctcgcagacccgacgcaccc

SEQ ID NO: 21120 - DNA, 28 bp, Homo sapiens
tggcgctctcgcagacccgacgcacccc

SEQ ID NO: 21121 - DNA, 29 bp, Homo sapiens
tggcgctctcgcagacccgacgcaccccc

SEQ ID NO: 21122 - DNA, 16 bp, Homo sapiens
ggcgctctcgcagacc

SEQ ID NO: 21123 - DNA, 25 bp, Homo sapiens
ggcgctctcgcagacccgacgcacc

SEQ ID NO: 21124 - DNA, 26 bp, Homo sapiens
ggcgctctcgcagacccgacgcaccc

SEQ ID NO: 21125 - DNA, 16 bp, Homo sapiens
cgctctcgcagacccg

SEQ ID NO: 21126 - DNA, 21 bp, Homo sapiens
ctctcgcagacccgacgcacc

SEQ ID NO: 21127 - DNA, 22 bp, Homo sapiens
ctctcgcagacccgacgcaccc

SEQ ID NO: 21128 - DNA, 23 bp, Homo sapiens
ctctcgcagacccgacgcacccc

SEQ ID NO: 21129 - DNA, 24 bp, Homo sapiens
ctctcgcagacccgacgcaccccc

SEQ ID NO: 21130 - DNA, 21 bp, Homo sapiens
tctcgcagacccgacgcaccc

SEQ ID NO: 21131 - DNA, 22 bp, Homo sapiens
tctcgcagacccgacgcacccc

SEQ ID NO: 21132 - DNA, 24 bp, Homo sapiens
tctcgcagacccgacgcacccccg

SEQ ID NO: 21133 - DNA, 25 bp, Homo sapiens
tctcgcagacccgacgcacccccgc

SEQ ID NO: 21134 - DNA, 29 bp, Homo sapiens
tctcgcagacccgacgcacccccgccacg

SEQ ID NO: 21135 - DNA, 19 bp, Homo sapiens
ctcgcagacccgacgcacc

SEQ ID NO: 21136 - DNA, 20 bp, Homo sapiens
ctcgcagacccgacgcaccc

SEQ ID NO: 21137 - DNA, 21 bp, Homo sapiens
ctcgcagacccgacgcacccc

SEQ ID NO: 21138 - DNA, 22 bp, Homo sapiens
ctcgcagacccgacgcaccccc

SEQ ID NO: 21139 - DNA, 18 bp, Homo sapiens
cgcagacccgacgcaccc

SEQ ID NO: 21140 - DNA, 22 bp, Homo sapiens
cagacccgacgcacccccgcca

SEQ ID NO: 21141 - DNA, 28 bp, Homo sapiens
cacccccgccacgcagttttatccggta

SEQ ID NO: 21142 - DNA, 26 bp, Homo sapiens
cccccgccacgcagttttatccggta

SEQ ID NO: 21143 - DNA, 30 bp, Homo sapiens
cccccgccacgcagttttatccggtaaagc

SEQ ID NO: 21144 - DNA, 25 bp, Homo sapiens
cgccacgcagttttatccggtaaag

SEQ ID NO: 21145 - DNA, 31 bp, Homo sapiens
cgccacgcagttttatccggtaaagcgaatg

SEQ ID NO: 21146 - DNA, 41 bp, Homo sapiens
gccacgcagttttatccggtaaagcgaatgattagaggtct

SEQ ID NO: 21147 - DNA, 24 bp, Homo sapiens
cacgcagttttatccggtaaagcg

SEQ ID NO: 21148 - DNA, 38 bp, Homo sapiens
acgcagttttatccggtaaagcgaatgattagaggtct

SEQ ID NO: 21149 - DNA, 17 bp, Homo sapiens
cgcagttttatccggta

SEQ ID NO: 21150 - DNA, 19 bp, Homo sapiens
cgcagttttatccggtaaa

SEQ ID NO: 21151 - DNA, 26 bp, Homo sapiens
cgcagttttatccggtaaagcgaatg

SEQ ID NO: 21152 - DNA, 19 bp, Homo sapiens
cagttttatccggtaaagc

SEQ ID NO: 21153 - DNA, 35 bp, Homo sapiens
cagttttatccggtaaagcgaatgattagaggtct

SEQ ID NO: 21154 - DNA, 42 bp, Homo sapiens
cagttttatccggtaaagcgaatgattagaggtcttggggcc

SEQ ID NO: 21155 - DNA, 17 bp, Homo sapiens
gttttatccggtaaagc

SEQ ID NO: 21156 - DNA, 31 bp, Homo sapiens
gttttatccggtaaagcgaatgattagaggt

SEQ ID NO: 21157 - DNA, 32 bp, Homo sapiens
gttttatccggtaaagcgaatgattagaggtc

SEQ ID NO: 21158 - DNA, 33 bp, Homo sapiens; identical to SEQ ID NO: 4530

SEQ ID NO: 21159 - DNA, 34 bp, Homo sapiens
gttttatccggtaaagcgaatgattagaggtctt

SEQ ID NO: 21160 - DNA, 40 bp, Homo sapiens
gttttatccggtaaagcgaatgattagaggtcttggggcc

SEQ ID NO: 21161 - DNA, 16 bp, Homo sapiens
ttttatccggtaaagc

SEQ ID NO: 21162 - DNA, 31 bp, Homo sapiens
ttttatccggtaaagcgaatgattagaggtc

SEQ ID NO: 21163 - DNA, 32 bp, Homo sapiens; identical to SEQ ID NO: 4531

SEQ ID NO: 21164 - DNA, 33 bp, Homo sapiens; identical to SEQ ID NO: 4532

SEQ ID NO: 21165 - DNA, 31 bp, Homo sapiens
tttatccggtaaagcgaatgattagaggtct

SEQ ID NO: 21166 - DNA, 32 bp, Homo sapiens
tttatccggtaaagcgaatgattagaggtctt

SEQ ID NO: 21167 - DNA, 29 bp, Homo sapiens
ttatccggtaaagcgaatgattagaggtc

SEQ ID NO: 21168 - DNA, 30 bp, Homo sapiens; identical to SEQ ID NO: 4533

SEQ ID NO: 21169 - DNA, 31 bp, Homo sapiens; identical to SEQ ID NO: 4534

SEQ ID NO: 21170 - DNA, 32 bp, Homo sapiens
ttatccggtaaagcgaatgattagaggtcttg

SEQ ID NO: 21171 - DNA, 36 bp, Homo sapiens
ttatccggtaaagcgaatgattagaggtcttggggc

SEQ ID NO: 21172 - DNA, 37 bp, Homo sapiens
ttatccggtaaagcgaatgattagaggtcttggggcc

SEQ ID NO: 21173 - DNA, 28 bp, Homo sapiens
tatccggtaaagcgaatgattagaggtc

SEQ ID NO: 21174 - DNA, 29 bp, Homo sapiens
tatccggtaaagcgaatgattagaggtct

SEQ ID NO: 21175 - DNA, 30 bp, Homo sapiens; identical to SEQ ID NO: 4536

SEQ ID NO: 21176 - DNA, 36 bp, Homo sapiens
tatccggtaaagcgaatgattagaggtcttggggcc

SEQ ID NO: 21177 - DNA, 28 bp, Homo sapiens
atccggtaaagcgaatgattagaggtct

SEQ ID NO: 21178 - DNA, 29 bp, Homo sapiens
atccggtaaagcgaatgattagaggtctt

SEQ ID NO: 21179 - DNA, 35 bp, Homo sapiens
atccggtaaagcgaatgattagaggtcttggggcc

SEQ ID NO: 21180 - DNA, 22 bp, Homo sapiens
tccggtaaagcgaatgattaga

SEQ ID NO: 21181 - DNA, 27 bp, Homo sapiens
tccggtaaagcgaatgattagaggtct

SEQ ID NO: 21182 - DNA, 28 bp, Homo sapiens
tccggtaaagcgaatgattagaggtctt

SEQ ID NO: 21183 - DNA, 33 bp, Homo sapiens
tccggtaaagcgaatgattagaggtcttggggc

SEQ ID NO: 21184 - DNA, 26 bp, Homo sapiens
ccggtaaagcgaatgattagaggtct

SEQ ID NO: 21185 - DNA, 27 bp, Homo sapiens
ccggtaaagcgaatgattagaggtctt

SEQ ID NO: 21186 - DNA, 33 bp, Homo sapiens; identical to SEQ ID NO: 4539

SEQ ID NO: 21187 - DNA, 25 bp, Homo sapiens
cggtaaagcgaatgattagaggtct

SEQ ID NO: 21188 - DNA, 31 bp, Homo sapiens
cggtaaagcgaatgattagaggtcttggggc

SEQ ID NO: 21189 - DNA, 32 bp, Homo sapiens; identical to SEQ ID NO: 4540

SEQ ID NO: 21190 - DNA, 24 bp, Homo sapiens
ggtaaagcgaatgattagaggtct

SEQ ID NO: 21191 - DNA, 25 bp, Homo sapiens
ggtaaagcgaatgattagaggtctt

SEQ ID NO: 21192 - DNA, 30 bp, Homo sapiens
ggtaaagcgaatgattagaggtcttggggc

SEQ ID NO: 21193 - DNA, 31 bp, Homo sapiens; identical to SEQ ID NO: 4541

SEQ ID NO: 21194 - DNA, 23 bp, Homo sapiens
gtaaagcgaatgattagaggtct

SEQ ID NO: 21195 - DNA, 24 bp, Homo sapiens
gtaaagcgaatgattagaggtctt

SEQ ID NO: 21196 - DNA, 29 bp, Homo sapiens
gtaaagcgaatgattagaggtcttggggc

SEQ ID NO: 21197 - DNA, 30 bp, Homo sapiens; identical to SEQ ID NO: 4544

SEQ ID NO: 21198 - DNA, 31 bp, Homo sapiens
gtaaagcgaatgattagaggtcttggggccg

SEQ ID NO: 21199 - DNA, 28 bp, Homo sapiens
taaagcgaatgattagaggtcttggggc

SEQ ID NO: 21200 - DNA, 29 bp, Homo sapiens
taaagcgaatgattagaggtcttggggcc

SEQ ID NO: 21201 - DNA, 21 bp, Homo sapiens
aaagcgaatgattagaggtct

SEQ ID NO: 21202 - DNA, 22 bp, Homo sapiens
aaagcgaatgattagaggtctt

SEQ ID NO: 21203 - DNA, 27 bp, Homo sapiens
aaagcgaatgattagaggtcttggggc

SEQ ID NO: 21204 - DNA, 28 bp, Homo sapiens
aaagcgaatgattagaggtcttggggcc

SEQ ID NO: 21205 - DNA, 19 bp, Homo sapiens
aagcgaatgattagaggtc

SEQ ID NO: 21206 - DNA, 20 bp, Homo sapiens
aagcgaatgattagaggtct

SEQ ID NO: 21207 - DNA, 21 bp, Homo sapiens
aagcgaatgattagaggtctt

SEQ ID NO: 21208 - DNA, 26 bp, Homo sapiens
aagcgaatgattagaggtcttggggc

SEQ ID NO: 21209 - DNA, 27 bp, Homo sapiens
aagcgaatgattagaggtcttggggcc

SEQ ID NO: 21210 - DNA, 28 bp, Homo sapiens
aagcgaatgattagaggtcttggggccg

SEQ ID NO: 21211 - DNA, 29 bp, Homo sapiens
aagcgaatgattagaggtcttggggccga

SEQ ID NO: 21212 - DNA, 30 bp, Homo sapiens
aagcgaatgattagaggtcttggggccgaa

SEQ ID NO: 21213 - DNA, 31 bp, Homo sapiens
aagcgaatgattagaggtcttggggccgaaa

SEQ ID NO: 21214 - DNA, 32 bp, Homo sapiens
aagcgaatgattagaggtcttggggccgaaac

SEQ ID NO: 21215 - DNA, 19 bp, Homo sapiens
agcgaatgattagaggtct

SEQ ID NO: 21216 - DNA, 20 bp, Homo sapiens
agcgaatgattagaggtctt

SEQ ID NO: 21217 - DNA, 22 bp, Homo sapiens
agcgaatgattagaggtcttgg

SEQ ID NO: 21218 - DNA, 25 bp, Homo sapiens
agcgaatgattagaggtcttggggc

SEQ ID NO: 21219 - DNA, 26 bp, Homo sapiens
agcgaatgattagaggtcttggggcc

SEQ ID NO: 21220 - DNA, 27 bp, Homo sapiens
agcgaatgattagaggtcttggggccg

SEQ ID NO: 21221 - DNA, 28 bp, Homo sapiens
agcgaatgattagaggtcttggggccga

SEQ ID NO: 21222 - DNA, 29 bp, Homo sapiens
agcgaatgattagaggtcttggggccgaa

SEQ ID NO: 21223 - DNA, 30 bp, Homo sapiens
agcgaatgattagaggtcttggggccgaaa

SEQ ID NO: 21224 - DNA, 18 bp, Homo sapiens
gcgaatgattagaggtct

SEQ ID NO: 21225 - DNA, 19 bp, Homo sapiens
gcgaatgattagaggtctt

SEQ ID NO: 21226 - DNA, 21 bp, Homo sapiens
gcgaatgattagaggtcttgg

SEQ ID NO: 21227 - DNA, 24 bp, Homo sapiens
gcgaatgattagaggtcttggggc

SEQ ID NO: 21228 - DNA, 25 bp, Homo sapiens
gcgaatgattagaggtcttggggcc

SEQ ID NO: 21229 - DNA, 27 bp, Homo sapiens
gcgaatgattagaggtcttggggccga

SEQ ID NO: 21230 - DNA, 28 bp, Homo sapiens
gcgaatgattagaggtcttggggccgaa

SEQ ID NO: 21231 - DNA, 29 bp, Homo sapiens
gcgaatgattagaggtcttggggccgaaa

SEQ ID NO: 21232 - DNA, 24 bp, Homo sapiens
cgaatgattagaggtcttggggcc

SEQ ID NO: 21233 - DNA, 16 bp, Homo sapiens
gaatgattagaggtct

SEQ ID NO: 21234 - DNA, 22 bp, Homo sapiens
gaatgattagaggtcttggggc

SEQ ID NO: 21235 - DNA, 23 bp, Homo sapiens
gaatgattagaggtcttggggcc

SEQ ID NO: 21236 - DNA, 28 bp, Homo sapiens
gaatgattagaggtcttggggccgaaac

SEQ ID NO: 21237 - DNA, 21 bp, Homo sapiens
aatgattagaggtcttggggc

SEQ ID NO: 21238 - DNA, 22 bp, Homo sapiens
aatgattagaggtcttggggcc

SEQ ID NO: 21239 - DNA, 23 bp, Homo sapiens
aatgattagaggtcttggggccg

SEQ ID NO: 21240 - DNA, 28 bp, Homo sapiens
aatgattagaggtcttggggccgaaacg

SEQ ID NO: 21241 - DNA, 38 bp, Homo sapiens
aatgattagaggtcttggggccgaaacgatctcaacct

SEQ ID NO: 21242 - DNA, 20 bp, Homo sapiens
atgattagaggtcttggggc

SEQ ID NO: 21243 - DNA, 21 bp, Homo sapiens
atgattagaggtcttggggcc

SEQ ID NO: 21244 - DNA, 19 bp, Homo sapiens
tgattagaggtcttggggc

SEQ ID NO: 21245 - DNA, 20 bp, Homo sapiens
tgattagaggtcttggggcc

SEQ ID NO: 21246 - DNA, 18 bp, Homo sapiens
gattagaggtcttggggc

SEQ ID NO: 21247 - DNA, 19 bp, Homo sapiens
gattagaggtcttggggcc

SEQ ID NO: 21248 - DNA, 34 bp, Homo sapiens
gattagaggtcttggggccgaaacgatctcaacc

SEQ ID NO: 21249 - DNA, 35 bp, Homo sapiens
gattagaggtcttggggccgaaacgatctcaacct

SEQ ID NO: 21250 - DNA, 17 bp, Homo sapiens
attagaggtcttggggc

SEQ ID NO: 21251 - DNA, 18 bp, Homo sapiens
attagaggtcttggggcc

SEQ ID NO: 21252 - DNA, 32 bp, Homo sapiens
attagaggtcttggggccgaaacgatctcaac

SEQ ID NO: 21253 - DNA, 33 bp, Homo sapiens; identical to SEQ ID NO: 4565

SEQ ID NO: 21254 - DNA, 34 bp, Homo sapiens
attagaggtcttggggccgaaacgatctcaacct

SEQ ID NO: 21255 - DNA, 16 bp, Homo sapiens
ttagaggtcttggggc

SEQ ID NO: 21256 - DNA, 17 bp, Homo sapiens
ttagaggtcttggggcc

SEQ ID NO: 21257 - DNA, 29 bp, Homo sapiens
ttagaggtcttggggccgaaacgatctca

SEQ ID NO: 21258 - DNA, 32 bp, Homo sapiens; identical to SEQ ID NO: 4566

SEQ ID NO: 21259 - DNA, 33 bp, Homo sapiens; identical to SEQ ID NO: 4567

SEQ ID NO: 21260 - DNA, 16 bp, Homo sapiens
tagaggtcttggggcc

SEQ ID NO: 21261 - DNA, 27 bp, Homo sapiens
tagaggtcttggggccgaaacgatctc

SEQ ID NO: 21262 - DNA, 30 bp, Homo sapiens
tagaggtcttggggccgaaacgatctcaac

SEQ ID NO: 21263 - DNA, 31 bp, Homo sapiens; identical to SEQ ID NO: 4569

SEQ ID NO: 21264 - DNA, 32 bp, Homo sapiens; identical to SEQ ID NO: 4570

SEQ ID NO: 21265 - DNA, 26 bp, Homo sapiens
agaggtcttggggccgaaacgatctc

SEQ ID NO: 21266 - DNA, 30 bp, Homo sapiens; identical to SEQ ID NO: 4572

SEQ ID NO: 21267 - DNA, 31 bp, Homo sapiens; identical to SEQ ID NO: 4573

SEQ ID NO: 21268 - DNA, 28 bp, Homo sapiens
gaggtcttggggccgaaacgatctcaac

SEQ ID NO: 21269 - DNA, 29 bp, Homo sapiens
gaggtcttggggccgaaacgatctcaacc

SEQ ID NO: 21270 - DNA, 28 bp, Homo sapiens
aggtcttggggccgaaacgatctcaacc

SEQ ID NO: 21271 - DNA, 26 bp, Homo sapiens
ggtcttggggccgaaacgatctcaac

SEQ ID NO: 21272 - DNA, 27 bp, Homo sapiens
ggtcttggggccgaaacgatctcaacc

SEQ ID NO: 21273 - DNA, 26 bp, Homo sapiens
gtcttggggccgaaacgatctcaacc

SEQ ID NO: 21274 - DNA, 27 bp, Homo sapiens
gtcttggggccgaaacgatctcaacct

SEQ ID NO: 21275 - DNA, 21 bp, Homo sapiens
tcttggggccgaaacgatctc

SEQ ID NO: 21276 - DNA, 25 bp, Homo sapiens
tcttggggccgaaacgatctcaacc

SEQ ID NO: 21277 - DNA, 26 bp, Homo sapiens
tcttggggccgaaacgatctcaacct

SEQ ID NO: 21278 - DNA, 20 bp, Homo sapiens
cttggggccgaaacgatctc

SEQ ID NO: 21279 - DNA, 24 bp, Homo sapiens
cttggggccgaaacgatctcaacc

SEQ ID NO: 21280 - DNA, 25 bp, Homo sapiens
cttggggccgaaacgatctcaacct

SEQ ID NO: 21281 - DNA, 19 bp, Homo sapiens
ttggggccgaaacgatctc

SEQ ID NO: 21282 - DNA, 23 bp, Homo sapiens
ttggggccgaaacgatctcaacc

SEQ ID NO: 21283 - DNA, 24 bp, Homo sapiens
ttggggccgaaacgatctcaacct

SEQ ID NO: 21284 - DNA, 21 bp, Homo sapiens
tggggccgaaacgatctcaac

SEQ ID NO: 21285 - DNA, 22 bp, Homo sapiens
tggggccgaaacgatctcaacc

SEQ ID NO: 21286 - DNA, 23 bp, Homo sapiens
tggggccgaaacgatctcaacct

SEQ ID NO: 21287 - DNA, 28 bp, Homo sapiens
tggggccgaaacgatctcaacctattct

SEQ ID NO: 21288 - DNA, 20 bp, Homo sapiens
ggggccgaaacgatctcaac

SEQ ID NO: 21289 - DNA, 21 bp, Homo sapiens
ggggccgaaacgatctcaacc

SEQ ID NO: 21290 - DNA, 22 bp, Homo sapiens
ggggccgaaacgatctcaacct

SEQ ID NO: 21291 - DNA, 27 bp, Homo sapiens
ggggccgaaacgatctcaacctattct

SEQ ID NO: 21292 - DNA, 33 bp, Homo sapiens
ggggccgaaacgatctcaacctattctcaaact

SEQ ID NO: 21293 - DNA, 16 bp, Homo sapiens
gggccgaaacgatctc

SEQ ID NO: 21294 - DNA, 20 bp, Homo sapiens
gggccgaaacgatctcaacc

SEQ ID NO: 21295 - DNA, 21 bp, Homo sapiens
gggccgaaacgatctcaacct

SEQ ID NO: 21296 - DNA, 16 bp, Homo sapiens
ccgaaacgatctcaac

SEQ ID NO: 21297 - DNA, 18 bp, Homo sapiens
ccgaaacgatctcaacct

SEQ ID NO: 21298 - DNA, 19 bp, Homo sapiens
ccgaaacgatctcaaccta

SEQ ID NO: 21299 - DNA, 16 bp, Homo sapiens
cgaaacgatctcaacc

SEQ ID NO: 21300 - DNA, 17 bp, Homo sapiens
cgaaacgatctcaacct

SEQ ID NO: 21301 - DNA, 23 bp, Homo sapiens
cgaaacgatctcaacctattctc

SEQ ID NO: 21302 - DNA, 28 bp, Homo sapiens
cgaaacgatctcaacctattctcaaact

SEQ ID NO: 21303 - DNA, 33 bp, Homo sapiens; identical to SEQ ID NO: 4588

SEQ ID NO: 21304 - DNA, 16 bp, Homo sapiens
gaaacgatctcaacct

SEQ ID NO: 21305 - DNA, 21 bp, Homo sapiens
gaaacgatctcaacctattct

SEQ ID NO: 21306 - DNA, 22 bp, Homo sapiens
gaaacgatctcaacctattctc

SEQ ID NO: 21307 - DNA, 23 bp, Homo sapiens
gaaacgatctcaacctattctca

SEQ ID NO: 21308 - DNA, 27 bp, Homo sapiens
gaaacgatctcaacctattctcaaact

SEQ ID NO: 21309 - DNA, 30 bp, Homo sapiens
gaaacgatctcaacctattctcaaacttta

SEQ ID NO: 21310 - DNA, 19 bp, Homo sapiens
aaacgatctcaacctattc

SEQ ID NO: 21311 - DNA, 20 bp, Homo sapiens
aaacgatctcaacctattct

SEQ ID NO: 21312 - DNA, 21 bp, Homo sapiens
aaacgatctcaacctattctc

SEQ ID NO: 21313 - DNA, 22 bp, Homo sapiens
aaacgatctcaacctattctca

SEQ ID NO: 21314 - DNA, 26 bp, Homo sapiens
aaacgatctcaacctattctcaaact

SEQ ID NO: 21315 - DNA, 27 bp, Homo sapiens
aaacgatctcaacctattctcaaactt

SEQ ID NO: 21316 - DNA, 28 bp, Homo sapiens
aaacgatctcaacctattctcaaacttt

SEQ ID NO: 21317 - DNA, 29 bp, Homo sapiens
aaacgatctcaacctattctcaaacttta

SEQ ID NO: 21318 - DNA, 31 bp, Homo sapiens
aaacgatctcaacctattctcaaactttaaa

SEQ ID NO: 21319 - DNA, 32 bp, Homo sapiens
aaacgatctcaacctattctcaaactttaaat

SEQ ID NO: 21320 - DNA, 33 bp, Homo sapiens
aaacgatctcaacctattctcaaactttaaatg

SEQ ID NO: 21321 - DNA, 21 bp, Homo sapiens
aacgatctcaacctattctca

SEQ ID NO: 21322 - DNA, 22 bp, Homo sapiens
aacgatctcaacctattctcaa

SEQ ID NO: 21323 - DNA, 23 bp, Homo sapiens
aacgatctcaacctattctcaaa

SEQ ID NO: 21324 - DNA, 25 bp, Homo sapiens
aacgatctcaacctattctcaaact

SEQ ID NO: 21325 - DNA, 28 bp, Homo sapiens
aacgatctcaacctattctcaaacttta

SEQ ID NO: 21326 - DNA, 29 bp, Homo sapiens
aacgatctcaacctattctcaaactttaa

SEQ ID NO: 21327 - DNA, 30 bp, Homo sapiens
aacgatctcaacctattctcaaactttaaa

SEQ ID NO: 21328 - DNA, 33 bp, Homo sapiens
aacgatctcaacctattctcaaactttaaatgg

SEQ ID NO: 21329 - DNA, 27 bp, Homo sapiens
acgatctcaacctattctcaaacttta

SEQ ID NO: 21330 - DNA, 26 bp, Homo sapiens
cgatctcaacctattctcaaacttta

SEQ ID NO: 21331 - DNA, 24 bp, Homo sapiens
atctcaacctattctcaaacttta

SEQ ID NO: 21332 - DNA, 46 bp, Homo sapiens
atctcaacctattctcaaactttaaatgggtaagaagcccggctcg

SEQ ID NO: 21333 - DNA, 20 bp, Homo sapiens
tctcaacctattctcaaact

SEQ ID NO: 21334 - DNA, 23 bp, Homo sapiens
tctcaacctattctcaaacttta

SEQ ID NO: 21335 - DNA, 18 bp, Homo sapiens
tcaacctattctcaaact

SEQ ID NO: 21336 - DNA, 23 bp, Homo sapiens
tcaacctattctcaaactttaaa

SEQ ID NO: 21337 - DNA, 18 bp, Homo sapiens
aactttaaatgggtaaga

SEQ ID NO: 21338 - DNA, 32 bp, Homo sapiens
tttaaatgggtaagaagcccggctcgctggcg

SEQ ID NO: 21339 - DNA, 30 bp, Homo sapiens
taaatgggtaagaagcccggctcgctggcg

SEQ ID NO: 21340 - DNA, 28 bp, Homo sapiens
aaatgggtaagaagcccggctcgctggc

SEQ ID NO: 21341 - DNA, 29 bp, Homo sapiens
aaatgggtaagaagcccggctcgctggcg

SEQ ID NO: 21342 - DNA, 27 bp, Homo sapiens
aatgggtaagaagcccggctcgctggc

SEQ ID NO: 21343 - DNA, 28 bp, Homo sapiens
aatgggtaagaagcccggctcgctggcg

SEQ ID NO: 21344 - DNA, 29 bp, Homo sapiens
aatgggtaagaagcccggctcgctggcgt

SEQ ID NO: 21345 - DNA, 26 bp, Homo sapiens
atgggtaagaagcccggctcgctggc

SEQ ID NO: 21346 - DNA, 27 bp, Homo sapiens
atgggtaagaagcccggctcgctggcg

SEQ ID NO: 21347 - DNA, 28 bp, Homo sapiens
atgggtaagaagcccggctcgctggcgt

SEQ ID NO: 21348 - DNA, 26 bp, Homo sapiens
tgggtaagaagcccggctcgctggcg

SEQ ID NO: 21349 - DNA, 20 bp, Homo sapiens
gtaagaagcccggctcgctg

SEQ ID NO: 21350 - DNA, 19 bp, Homo sapiens
taagaagcccggctcgctg

SEQ ID NO: 21351 - DNA, 16 bp, Homo sapiens
aagaagcccggctcgc

SEQ ID NO: 21352 - DNA, 17 bp, Homo sapiens
aagaagcccggctcgct

SEQ ID NO: 21353 - DNA, 18 bp, Homo sapiens
aagaagcccggctcgctg

SEQ ID NO: 21354 - DNA, 21 bp, Homo sapiens
aagaagcccggctcgctggcg

SEQ ID NO: 21355 - DNA, 33 bp, Homo sapiens
aagaagcccggctcgctggcgtggagccgggcg

SEQ ID NO: 21356 - DNA, 16 bp, Homo sapiens
agaagcccggctcgct

SEQ ID NO: 21357 - DNA, 17 bp, Homo sapiens
agaagcccggctcgctg

SEQ ID NO: 21358 - DNA, 32 bp, Homo sapiens
agaagcccggctcgctggcgtggagccgggcg

SEQ ID NO: 21359 - DNA, 16 bp, Homo sapiens
gaagcccggctcgctg

SEQ ID NO: 21360 - DNA, 31 bp, Homo sapiens
gaagcccggctcgctggcgtggagccgggcg

SEQ ID NO: 21361 - DNA, 23 bp, Homo sapiens
agcccggctcgctggcgtggagc

SEQ ID NO: 21362 - DNA, 18 bp, Homo sapiens
gcccggctcgctggcgtg

SEQ ID NO: 21363 - DNA, 22 bp, Homo sapiens
gcccggctcgctggcgtggagc

SEQ ID NO: 21364 - DNA, 23 bp, Homo sapiens
gcccggctcgctggcgtggagcc

SEQ ID NO: 21365 - DNA, 19 bp, Homo sapiens
cggctcgctggcgtggagc

SEQ ID NO: 21366 - DNA, 25 bp, Homo sapiens
gctcgctggcgtggagccgggcgtg

SEQ ID NO: 21367 - DNA, 17 bp, Homo sapiens
ctcgctggcgtggagcc

SEQ ID NO: 21368 - DNA, 22 bp, Homo sapiens
ctcgctggcgtggagccgggcg

SEQ ID NO: 21369 - DNA, 38 bp, Homo sapiens
ctcgctggcgtggagccgggcgtggaatgcgagtgcct

SEQ ID NO: 21370 - DNA, 21 bp, Homo sapiens
tcgctggcgtggagccgggcg

SEQ ID NO: 21371 - DNA, 20 bp, Homo sapiens
cgctggcgtggagccgggcg

SEQ ID NO: 21372 - DNA, 36 bp, Homo sapiens
cgctggcgtggagccgggcgtggaatgcgagtgcct

SEQ ID NO: 21373 - DNA, 43 bp, Homo sapiens
cgctggcgtggagccgggcgtggaatgcgagtgcctagtgggc

SEQ ID NO: 21374 - DNA, 44 bp, Homo sapiens
cgctggcgtggagccgggcgtggaatgcgagtgcctagtgggcc

SEQ ID NO: 21375 - DNA, 18 bp, Homo sapiens
ctggcgtggagccgggcg

SEQ ID NO: 21376 - DNA, 33 bp, Homo sapiens
ctggcgtggagccgggcgtggaatgcgagtgcc

SEQ ID NO: 21377 - DNA, 34 bp, Homo sapiens
ctggcgtggagccgggcgtggaatgcgagtgcct

SEQ ID NO: 21378 - DNA, 18 bp, Homo sapiens
tggcgtggagccgggcgt

SEQ ID NO: 21379 - DNA, 16 bp, Homo sapiens
ggcgtggagccgggcg

SEQ ID NO: 21380 - DNA, 30 bp, Homo sapiens
gcgtggagccgggcgtggaatgcgagtgcc

SEQ ID NO: 21381 - DNA, 24 bp, Homo sapiens
tggagccgggcgtggaatgcgagt

SEQ ID NO: 21382 - DNA, 25 bp, Homo sapiens
tggagccgggcgtggaatgcgagtg

SEQ ID NO: 21383 - DNA, 28 bp, Homo sapiens
tggagccgggcgtggaatgcgagtgcct

SEQ ID NO: 21384 - DNA, 21 bp, Homo sapiens
ggagccgggcgtggaatgcga

SEQ ID NO: 21385 - DNA, 20 bp, Homo sapiens
gagccgggcgtggaatgcga

SEQ ID NO: 21386 - DNA, 18 bp, Homo sapiens
gccgggcgtggaatgcga

SEQ ID NO: 21387 - DNA, 20 bp, Homo sapiens
gccgggcgtggaatgcgagt

SEQ ID NO: 21388 - DNA, 21 bp, Homo sapiens
gccgggcgtggaatgcgagtg

SEQ ID NO: 21389 - DNA, 25 bp, Homo sapiens
gccgggcgtggaatgcgagtgccta

SEQ ID NO: 21390 - DNA, 27 bp, Homo sapiens
gccgggcgtggaatgcgagtgcctagt

SEQ ID NO: 21391 - DNA, 28 bp, Homo sapiens
gccgggcgtggaatgcgagtgcctagtg

SEQ ID NO: 21392 - DNA, 33 bp, Homo sapiens
gccgggcgtggaatgcgagtgcctagtgggcca

SEQ ID NO: 21393 - DNA, 33 bp, Homo sapiens
ggcgtggaatgcgagtgcctagtgggccacttt

SEQ ID NO: 21394 - DNA, 18 bp, Homo sapiens
gcgtggaatgcgagtgcc

SEQ ID NO: 21395 - DNA, 19 bp, Homo sapiens
gcgtggaatgcgagtgcct

SEQ ID NO: 21396 - DNA, 17 bp, Homo sapiens
cgtggaatgcgagtgcc

SEQ ID NO: 21397 - DNA, 18 bp, Homo sapiens
cgtggaatgcgagtgcct

SEQ ID NO: 21398 - DNA, 32 bp, Homo sapiens
tgcctagtgggccacttttggtaagcagaact

SEQ ID NO: 21399 - DNA, 31 bp, Homo sapiens
gcctagtgggccacttttggtaagcagaact

SEQ ID NO: 21400 - DNA, 30 bp, Homo sapiens; identical to SEQ ID NO: 4605

SEQ ID NO: 21401 - DNA, 29 bp, Homo sapiens
ctagtgggccacttttggtaagcagaact

SEQ ID NO: 21402 - DNA, 27 bp, Homo sapiens
tagtgggccacttttggtaagcagaac

SEQ ID NO: 21403 - DNA, 28 bp, Homo sapiens
tagtgggccacttttggtaagcagaact

SEQ ID NO: 21404 - DNA, 26 bp, Homo sapiens
agtgggccacttttggtaagcagaac

SEQ ID NO: 21405 - DNA, 27 bp, Homo sapiens
agtgggccacttttggtaagcagaact

SEQ ID NO: 21406 - DNA, 28 bp, Homo sapiens
agtgggccacttttggtaagcagaactg

SEQ ID NO: 21407 - DNA, 17 bp, Homo sapiens
gtgggccacttttggta

SEQ ID NO: 21408 - DNA, 26 bp, Homo sapiens
gtgggccacttttggtaagcagaact

SEQ ID NO: 21409 - DNA, 27 bp, Homo sapiens
gtgggccacttttggtaagcagaactg

SEQ ID NO: 21410 - DNA, 25 bp, Homo sapiens
tgggccacttttggtaagcagaact

SEQ ID NO: 21411 - DNA, 26 bp, Homo sapiens
tgggccacttttggtaagcagaactg

SEQ ID NO: 21412 - DNA, 25 bp, Homo sapiens
gggccacttttggtaagcagaactg

SEQ ID NO: 21413 - DNA, 23 bp, Homo sapiens
ggccacttttggtaagcagaact

SEQ ID NO: 21414 - DNA, 24 bp, Homo sapiens
ggccacttttggtaagcagaactg

SEQ ID NO: 21415 - DNA, 21 bp, Homo sapiens
ccacttttggtaagcagaact

SEQ ID NO: 21416 - DNA, 33 bp, Homo sapiens
ccacttttggtaagcagaactggcgctgcggga

SEQ ID NO: 21417 - DNA, 20 bp, Homo sapiens
cacttttggtaagcagaact

SEQ ID NO: 21418 - DNA, 32 bp, Homo sapiens
cacttttggtaagcagaactggcgctgcggga

SEQ ID NO: 21419 - DNA, 33 bp, Homo sapiens
cacttttggtaagcagaactggcgctgcgggat

SEQ ID NO: 21420 - DNA, 38 bp, Homo sapiens
cacttttggtaagcagaactggcgctgcgggatgaacc

SEQ ID NO: 21421 - DNA, 19 bp, Homo sapiens
acttttggtaagcagaact

SEQ ID NO: 21422 - DNA, 31 bp, Homo sapiens
acttttggtaagcagaactggcgctgcggga

SEQ ID NO: 21423 - DNA, 33 bp, Homo sapiens
acttttggtaagcagaactggcgctgcgggatg

SEQ ID NO: 21424 - DNA, 18 bp, Homo sapiens
cttttggtaagcagaact

SEQ ID NO: 21425 - DNA, 24 bp, Homo sapiens
cttttggtaagcagaactggcgct

SEQ ID NO: 21426 - DNA, 26 bp, Homo sapiens
cttttggtaagcagaactggcgctgc

SEQ ID NO: 21427 - DNA, 28 bp, Homo sapiens
cttttggtaagcagaactggcgctgcgg

SEQ ID NO: 21428 - DNA, 29 bp, Homo sapiens
cttttggtaagcagaactggcgctgcggg

SEQ ID NO: 21429 - DNA, 30 bp, Homo sapiens
cttttggtaagcagaactggcgctgcggga

SEQ ID NO: 21430 - DNA, 31 bp, Homo sapiens
cttttggtaagcagaactggcgctgcgggat

SEQ ID NO: 21431 - DNA, 32 bp, Homo sapiens
cttttggtaagcagaactggcgctgcgggatg

SEQ ID NO: 21432 - DNA, 33 bp, Homo sapiens
cttttggtaagcagaactggcgctgcgggatga

SEQ ID NO: 21433 - DNA, 17 bp, Homo sapiens
ttttggtaagcagaact

SEQ ID NO: 21434 - DNA, 23 bp, Homo sapiens
ttttggtaagcagaactggcgct

SEQ ID NO: 21435 - DNA, 29 bp, Homo sapiens
ttttggtaagcagaactggcgctgcggga

SEQ ID NO: 21436 - DNA, 31 bp, Homo sapiens
ttttggtaagcagaactggcgctgcgggatg

SEQ ID NO: 21437 - DNA, 35 bp, Homo sapiens
ttttggtaagcagaactggcgctgcgggatgaacc

SEQ ID NO: 21438 - DNA, 16 bp, Homo sapiens
tttggtaagcagaact

SEQ ID NO: 21439 - DNA, 22 bp, Homo sapiens
tttggtaagcagaactggcgct

SEQ ID NO: 21440 - DNA, 23 bp, Homo sapiens
tttggtaagcagaactggcgctg

SEQ ID NO: 21441 - DNA, 28 bp, Homo sapiens
tttggtaagcagaactggcgctgcggga

SEQ ID NO: 21442 - DNA, 29 bp, Homo sapiens
tttggtaagcagaactggcgctgcgggat

SEQ ID NO: 21443 - DNA, 30 bp, Homo sapiens; identical to SEQ ID NO: 4616

SEQ ID NO: 21444 - DNA, 32 bp, Homo sapiens
tttggtaagcagaactggcgctgcgggatgaa

SEQ ID NO: 21445 - DNA, 33 bp, Homo sapiens; identical to SEQ ID NO: 4617

SEQ ID NO: 21446 - DNA, 34 bp, Homo sapiens
tttggtaagcagaactggcgctgcgggatgaacc

SEQ ID NO: 21447 - DNA, 35 bp, Homo sapiens
tttggtaagcagaactggcgctgcgggatgaaccg

SEQ ID NO: 21448 - DNA, 21 bp, Homo sapiens
ttggtaagcagaactggcgct

SEQ ID NO: 21449 - DNA, 27 bp, Homo sapiens
ttggtaagcagaactggcgctgcggga

SEQ ID NO: 21450 - DNA, 28 bp, Homo sapiens
ttggtaagcagaactggcgctgcgggat

SEQ ID NO: 21451 - DNA, 29 bp, Homo sapiens
ttggtaagcagaactggcgctgcgggatg

SEQ ID NO: 21452 - DNA, 32 bp, Homo sapiens
ttggtaagcagaactggcgctgcgggatgaac

SEQ ID NO: 21453 - DNA, 33 bp, Homo sapiens; identical to SEQ ID NO: 4618

SEQ ID NO: 21454 - DNA, 20 bp, Homo sapiens
ggtaagcagaactggcgctg

SEQ ID NO: 21455 - DNA, 25 bp, Homo sapiens
ggtaagcagaactggcgctgcggga

SEQ ID NO: 21456 - DNA, 31 bp, Homo sapiens
ggtaagcagaactggcgctgcgggatgaacc

SEQ ID NO: 21457 - DNA, 19 bp, Homo sapiens
gtaagcagaactggcgctg

SEQ ID NO: 21458 - DNA, 25 bp, Homo sapiens
gtaagcagaactggcgctgcgggat

SEQ ID NO: 21459 - DNA, 29 bp, Homo sapiens
gtaagcagaactggcgctgcgggatgaac

SEQ ID NO: 21460 - DNA, 18 bp, Homo sapiens
taagcagaactggcgctg

SEQ ID NO: 21461 - DNA, 17 bp, Homo sapiens
aagcagaactggcgctg

SEQ ID NO: 21462 - DNA, 16 bp, Homo sapiens
agcagaactggcgctg

SEQ ID NO: 21463 - DNA, 21 bp, Homo sapiens
agcagaactggcgctgcggga

SEQ ID NO: 21464 - DNA, 27 bp, Homo sapiens
agcagaactggcgctgcgggatgaacc

SEQ ID NO: 21465 - DNA, 29 bp, Homo sapiens
agcagaactggcgctgcgggatgaaccga

SEQ ID NO: 21466 - DNA, 30 bp, Homo sapiens
agcagaactggcgctgcgggatgaaccgaa

SEQ ID NO: 21467 - DNA, 20 bp, Homo sapiens
gcagaactggcgctgcggga

SEQ ID NO: 21468 - DNA, 24 bp, Homo sapiens
gcagaactggcgctgcgggatgaa

SEQ ID NO: 21469 - DNA, 28 bp, Homo sapiens
gcagaactggcgctgcgggatgaaccga

SEQ ID NO: 21470 - DNA, 29 bp, Homo sapiens
gcagaactggcgctgcgggatgaaccgaa

SEQ ID NO: 21471 - DNA, 33 bp, Homo sapiens
gcagaactggcgctgcgggatgaaccgaacgcc

SEQ ID NO: 21472 - DNA, 19 bp, Homo sapiens
cagaactggcgctgcggga

SEQ ID NO: 21473 - DNA, 21 bp, Homo sapiens
cagaactggcgctgcgggatg

SEQ ID NO: 21474 - DNA, 24 bp, Homo sapiens
cagaactggcgctgcgggatgaac

SEQ ID NO: 21475 - DNA, 25 bp, Homo sapiens
cagaactggcgctgcgggatgaacc

SEQ ID NO: 21476 - DNA, 28 bp, Homo sapiens
cagaactggcgctgcgggatgaaccgaa

SEQ ID NO: 21477 - DNA, 25 bp, Homo sapiens
aactggcgctgcgggatgaaccgaa

SEQ ID NO: 21478 - DNA, 18 bp, Homo sapiens
actggcgctgcgggatga

SEQ ID NO: 21479 - DNA, 19 bp, Homo sapiens
actggcgctgcgggatgaa

SEQ ID NO: 21480 - DNA, 20 bp, Homo sapiens
actggcgctgcgggatgaac

SEQ ID NO: 21481 - DNA, 21 bp, Homo sapiens
actggcgctgcgggatgaacc

SEQ ID NO: 21482 - DNA, 22 bp, Homo sapiens
actggcgctgcgggatgaaccg

SEQ ID NO: 21483 - DNA, 23 bp, Homo sapiens
actggcgctgcgggatgaaccga

SEQ ID NO: 21484 - DNA, 24 bp, Homo sapiens
actggcgctgcgggatgaaccgaa

SEQ ID NO: 21485 - DNA, 25 bp, Homo sapiens
actggcgctgcgggatgaaccgaac

SEQ ID NO: 21486 - DNA, 26 bp, Homo sapiens
actggcgctgcgggatgaaccgaacg

SEQ ID NO: 21487 - DNA, 27 bp, Homo sapiens
actggcgctgcgggatgaaccgaacgc

SEQ ID NO: 21488 - DNA, 30 bp, Homo sapiens
actggcgctgcgggatgaaccgaacgccgg

SEQ ID NO: 21489 - DNA, 17 bp, Homo sapiens
ctggcgctgcgggatga

SEQ ID NO: 21490 - DNA, 18 bp, Homo sapiens
ctggcgctgcgggatgaa

SEQ ID NO: 21491 - DNA, 19 bp, Homo sapiens
ctggcgctgcgggatgaac

SEQ ID NO: 21492 - DNA, 20 bp, Homo sapiens
ctggcgctgcgggatgaacc

SEQ ID NO: 21493 - DNA, 21 bp, Homo sapiens
ctggcgctgcgggatgaaccg

SEQ ID NO: 21494 - DNA, 22 bp, Homo sapiens
ctggcgctgcgggatgaaccga

SEQ ID NO: 21495 - DNA, 23 bp, Homo sapiens
ctggcgctgcgggatgaaccgaa

SEQ ID NO: 21496 - DNA, 24 bp, Homo sapiens
ctggcgctgcgggatgaaccgaac

SEQ ID NO: 21497 - DNA, 25 bp, Homo sapiens
ctggcgctgcgggatgaaccgaacg

SEQ ID NO: 21498 - DNA, 26 bp, Homo sapiens
ctggcgctgcgggatgaaccgaacgc

SEQ ID NO: 21499 - DNA, 27 bp, Homo sapiens
ctggcgctgcgggatgaaccgaacgcc

SEQ ID NO: 21500 - DNA, 18 bp, Homo sapiens
tggcgctgcgggatgaac

SEQ ID NO: 21501 - DNA, 19 bp, Homo sapiens
tggcgctgcgggatgaacc

SEQ ID NO: 21502 - DNA, 21 bp, Homo sapiens
tggcgctgcgggatgaaccga

SEQ ID NO: 21503 - DNA, 22 bp, Homo sapiens
tggcgctgcgggatgaaccgaa

SEQ ID NO: 21504 - DNA, 23 bp, Homo sapiens
tggcgctgcgggatgaaccgaac

SEQ ID NO: 21505 - DNA, 25 bp, Homo sapiens
tggcgctgcgggatgaaccgaacgc

SEQ ID NO: 21506 - DNA, 18 bp, Homo sapiens
ggcgctgcgggatgaacc

SEQ ID NO: 21507 - DNA, 30 bp, Homo sapiens
gcgctgcgggatgaaccgaacgccgggtta

SEQ ID NO: 21508 - DNA, 16 bp, Homo sapiens
cgctgcgggatgaacc

SEQ ID NO: 21509 - DNA, 19 bp, Homo sapiens
cgctgcgggatgaaccgaa

SEQ ID NO: 21510 - DNA, 20 bp, Homo sapiens
cgctgcgggatgaaccgaac

SEQ ID NO: 21511 - DNA, 29 bp, Homo sapiens
cgctgcgggatgaaccgaacgccgggtta

SEQ ID NO: 21512 - DNA, 28 bp, Homo sapiens
gctgcgggatgaaccgaacgccgggtta

SEQ ID NO: 21513 - DNA, 21 bp, Homo sapiens
ctgcgggatgaaccgaacgcc

SEQ ID NO: 21514 - DNA, 23 bp, Homo sapiens
ctgcgggatgaaccgaacgccgg

SEQ ID NO: 21515 - DNA, 25 bp, Homo sapiens
ctgcgggatgaaccgaacgccgggt

SEQ ID NO: 21516 - DNA, 26 bp, Homo sapiens
ctgcgggatgaaccgaacgccgggtt

SEQ ID NO: 21517 - DNA, 37 bp, Homo sapiens
ctgcgggatgaaccgaacgccgggttaaggcgcccga

SEQ ID NO: 21518 - DNA, 19 bp, Homo sapiens
gcgggatgaaccgaacgcc

SEQ ID NO: 21519 - DNA, 24 bp, Homo sapiens
gcgggatgaaccgaacgccgggtt

SEQ ID NO: 21520 - DNA, 25 bp, Homo sapiens
gcgggatgaaccgaacgccgggtta

SEQ ID NO: 21521 - DNA, 18 bp, Homo sapiens
cgggatgaaccgaacgcc

SEQ ID NO: 21522 - DNA, 22 bp, Homo sapiens
cgggatgaaccgaacgccgggt

SEQ ID NO: 21523 - DNA, 24 bp, Homo sapiens
cgggatgaaccgaacgccgggtta

SEQ ID NO: 21524 - DNA, 16 bp, Homo sapiens
gggatgaaccgaacgc

SEQ ID NO: 21525 - DNA, 17 bp, Homo sapiens
gggatgaaccgaacgcc

SEQ ID NO: 21526 - DNA, 20 bp, Homo sapiens
gggatgaaccgaacgccggg

SEQ ID NO: 21527 - DNA, 21 bp, Homo sapiens
gggatgaaccgaacgccgggt

SEQ ID NO: 21528 - DNA, 22 bp, Homo sapiens
gggatgaaccgaacgccgggtt

SEQ ID NO: 21529 - DNA, 23 bp, Homo sapiens
gggatgaaccgaacgccgggtta

SEQ ID NO: 21530 - DNA, 33 bp, Homo sapiens
gggatgaaccgaacgccgggttaaggcgcccga

SEQ ID NO: 21531 - DNA, 16 bp, Homo sapiens
ggatgaaccgaacgcc

SEQ ID NO: 21532 - DNA, 18 bp, Homo sapiens
ggatgaaccgaacgccgg

SEQ ID NO: 21533 - DNA, 19 bp, Homo sapiens
ggatgaaccgaacgccggg

SEQ ID NO: 21534 - DNA, 20 bp, Homo sapiens
ggatgaaccgaacgccgggt

SEQ ID NO: 21535 - DNA, 21 bp, Homo sapiens
ggatgaaccgaacgccgggtt

SEQ ID NO: 21536 - DNA, 22 bp, Homo sapiens
ggatgaaccgaacgccgggtta

SEQ ID NO: 21537 - DNA, 23 bp, Homo sapiens
ggatgaaccgaacgccgggttaa

SEQ ID NO: 21538 - DNA, 24 bp, Homo sapiens
ggatgaaccgaacgccgggttaag

SEQ ID NO: 21539 - DNA, 25 bp, Homo sapiens
ggatgaaccgaacgccgggttaagg

SEQ ID NO: 21540 - DNA, 26 bp, Homo sapiens
ggatgaaccgaacgccgggttaaggc

SEQ ID NO: 21541 - DNA, 27 bp, Homo sapiens
ggatgaaccgaacgccgggttaaggcg

SEQ ID NO: 21542 - DNA, 29 bp, Homo sapiens
ggatgaaccgaacgccgggttaaggcgcc

SEQ ID NO: 21543 - DNA, 30 bp, Homo sapiens
ggatgaaccgaacgccgggttaaggcgccc

SEQ ID NO: 21544 - DNA, 31 bp, Homo sapiens
ggatgaaccgaacgccgggttaaggcgcccg

SEQ ID NO: 21545 - DNA, 32 bp, Homo sapiens; identical to SEQ ID NO: 4633

SEQ ID NO: 21546 - DNA, 33 bp, Homo sapiens
ggatgaaccgaacgccgggttaaggcgcccgat

SEQ ID NO: 21547 - DNA, 20 bp, Homo sapiens
gatgaaccgaacgccgggtt

SEQ ID NO: 21548 - DNA, 21 bp, Homo sapiens
gatgaaccgaacgccgggtta

SEQ ID NO: 21549 - DNA, 23 bp, Homo sapiens
gatgaaccgaacgccgggttaag

SEQ ID NO: 21550 - DNA, 24 bp, Homo sapiens
gatgaaccgaacgccgggttaagg

SEQ ID NO: 21551 - DNA, 25 bp, Homo sapiens
gatgaaccgaacgccgggttaaggc

SEQ ID NO: 21552 - DNA, 28 bp, Homo sapiens
gatgaaccgaacgccgggttaaggcgcc

SEQ ID NO: 21553 - DNA, 29 bp, Homo sapiens
gatgaaccgaacgccgggttaaggcgccc

SEQ ID NO: 21554 - DNA, 30 bp, Homo sapiens
gatgaaccgaacgccgggttaaggcgcccg

SEQ ID NO: 21555 - DNA, 31 bp, Homo sapiens; identical to SEQ ID NO: 4635

SEQ ID NO: 21556 - DNA, 32 bp, Homo sapiens
gatgaaccgaacgccgggttaaggcgcccgat

SEQ ID NO: 21557 - DNA, 33 bp, Homo sapiens
gatgaaccgaacgccgggttaaggcgcccgatg

SEQ ID NO: 21558 - DNA, 38 bp, Homo sapiens
gatgaaccgaacgccgggttaaggcgcccgatgccgac

SEQ ID NO: 21559 - DNA, 39 bp, Homo sapiens
gatgaaccgaacgccgggttaaggcgcccgatgccgacg

SEQ ID NO: 21560 - DNA, 20 bp, Homo sapiens
atgaaccgaacgccgggtta

SEQ ID NO: 21561 - DNA, 23 bp, Homo sapiens
atgaaccgaacgccgggttaagg

SEQ ID NO: 21562 - DNA, 28 bp, Homo sapiens
atgaaccgaacgccgggttaaggcgccc

SEQ ID NO: 21563 - DNA, 29 bp, Homo sapiens
atgaaccgaacgccgggttaaggcgcccg

SEQ ID NO: 21564 - DNA, 30 bp, Homo sapiens
atgaaccgaacgccgggttaaggcgcccga

SEQ ID NO: 21565 - DNA, 32 bp, Homo sapiens
atgaaccgaacgccgggttaaggcgcccgatg

SEQ ID NO: 21566 - DNA, 18 bp, Homo sapiens
tgaaccgaacgccgggtt

SEQ ID NO: 21567 - DNA, 19 bp, Homo sapiens
tgaaccgaacgccgggtta

SEQ ID NO: 21568 - DNA, 20 bp, Homo sapiens
tgaaccgaacgccgggttaa

SEQ ID NO: 21569 - DNA, 22 bp, Homo sapiens
tgaaccgaacgccgggttaagg

SEQ ID NO: 21570 - DNA, 28 bp, Homo sapiens
tgaaccgaacgccgggttaaggcgcccg

SEQ ID NO: 21571 - DNA, 29 bp, Homo sapiens
tgaaccgaacgccgggttaaggcgcccga

SEQ ID NO: 21572 - DNA, 16 bp, Homo sapiens
gaaccgaacgccgggt

SEQ ID NO: 21573 - DNA, 17 bp, Homo sapiens
gaaccgaacgccgggtt

SEQ ID NO: 21574 - DNA, 18 bp, Homo sapiens
gaaccgaacgccgggtta

SEQ ID NO: 21575 - DNA, 16 bp, Homo sapiens
aaccgaacgccgggtt

SEQ ID NO: 21576 - DNA, 18 bp, Homo sapiens
accgaacgccgggttaag

SEQ ID NO: 21577 - DNA, 26 bp, Homo sapiens
accgaacgccgggttaaggcgcccga

SEQ ID NO: 21578 - DNA, 25 bp, Homo sapiens
ccgaacgccgggttaaggcgcccga

SEQ ID NO: 21579 - DNA, 32 bp, Homo sapiens
cgaacgccgggttaaggcgcccgatgccgacg

SEQ ID NO: 21580 - DNA, 16 bp, Homo sapiens
gaacgccgggttaagg

SEQ ID NO: 21581 - DNA, 23 bp, Homo sapiens
gaacgccgggttaaggcgcccga

SEQ ID NO: 21582 - DNA, 30 bp, Homo sapiens
gaacgccgggttaaggcgcccgatgccgac

SEQ ID NO: 21583 - DNA, 31 bp, Homo sapiens
gaacgccgggttaaggcgcccgatgccgacg

SEQ ID NO: 21584 - DNA, 33 bp, Homo sapiens
gaacgccgggttaaggcgcccgatgccgacgct

SEQ ID NO: 21585 - DNA, 41 bp, Homo sapiens
gaacgccgggttaaggcgcccgatgccgacgctcatcagac

SEQ ID NO: 21586 - DNA, 42 bp, Homo sapiens
gaacgccgggttaaggcgcccgatgccgacgctcatcagacc

SEQ ID NO: 21587 - DNA, 30 bp, Homo sapiens
aacgccgggttaaggcgcccgatgccgacg

SEQ ID NO: 21588 - DNA, 40 bp, Homo sapiens
aacgccgggttaaggcgcccgatgccgacgctcatcagac

SEQ ID NO: 21589 - DNA, 21 bp, Homo sapiens
acgccgggttaaggcgcccga

SEQ ID NO: 21590 - DNA, 20 bp, Homo sapiens
cgccgggttaaggcgcccga

SEQ ID NO: 21591 - DNA, 33 bp, Homo sapiens
ggttaaggcgcccgatgccgacgctcatcagac

SEQ ID NO: 21592 - DNA, 32 bp, Homo sapiens; identical to SEQ ID NO: 4637

SEQ ID NO: 21593 - DNA, 33 bp, Homo sapiens
gttaaggcgcccgatgccgacgctcatcagacc

SEQ ID NO: 21594 - DNA, 31 bp, Homo sapiens
ttaaggcgcccgatgccgacgctcatcagac

SEQ ID NO: 21595 - DNA, 30 bp, Homo sapiens
taaggcgcccgatgccgacgctcatcagac

SEQ ID NO: 21596 - DNA, 29 bp, Homo sapiens
aaggcgcccgatgccgacgctcatcagac

SEQ ID NO: 21597 - DNA, 30 bp, Homo sapiens
aaggcgcccgatgccgacgctcatcagacc

SEQ ID NO: 21598 - DNA, 31 bp, Homo sapiens
aaggcgcccgatgccgacgctcatcagaccc

SEQ ID NO: 21599 - DNA, 28 bp, Homo sapiens
aggcgcccgatgccgacgctcatcagac

SEQ ID NO: 21600 - DNA, 29 bp, Homo sapiens
aggcgcccgatgccgacgctcatcagacc

SEQ ID NO: 21601 - DNA, 30 bp, Homo sapiens
aggcgcccgatgccgacgctcatcagaccc

SEQ ID NO: 21602 - DNA, 27 bp, Homo sapiens
ggcgcccgatgccgacgctcatcagac

SEQ ID NO: 21603 - DNA, 28 bp, Homo sapiens
ggcgcccgatgccgacgctcatcagacc

SEQ ID NO: 21604 - DNA, 29 bp, Homo sapiens
ggcgcccgatgccgacgctcatcagaccc

SEQ ID NO: 21605 - DNA, 30 bp, Homo sapiens
ggcgcccgatgccgacgctcatcagacccc

SEQ ID NO: 21606 - DNA, 26 bp, Homo sapiens
gcgcccgatgccgacgctcatcagac

SEQ ID NO: 21607 - DNA, 24 bp, Homo sapiens
gcccgatgccgacgctcatcagac

SEQ ID NO: 21608 - DNA, 23 bp, Homo sapiens
cccgatgccgacgctcatcagac

SEQ ID NO: 21609 - DNA, 24 bp, Homo sapiens
cccgatgccgacgctcatcagacc

SEQ ID NO: 21610 - DNA, 21 bp, Homo sapiens
cgatgccgacgctcatcagac

SEQ ID NO: 21611 - DNA, 22 bp, Homo sapiens
cgatgccgacgctcatcagacc

SEQ ID NO: 21612 - DNA, 23 bp, Homo sapiens
cgatgccgacgctcatcagaccc

SEQ ID NO: 21613 - DNA, 20 bp, Homo sapiens
gatgccgacgctcatcagac

SEQ ID NO: 21614 - DNA, 21 bp, Homo sapiens
gatgccgacgctcatcagacc

SEQ ID NO: 21615 - DNA, 19 bp, Homo sapiens
atgccgacgctcatcagac

SEQ ID NO: 21616 - DNA, 20 bp, Homo sapiens
atgccgacgctcatcagacc

SEQ ID NO: 21617 - DNA, 21 bp, Homo sapiens
atgccgacgctcatcagaccc

SEQ ID NO: 21618 - DNA, 25 bp, Homo sapiens
atgccgacgctcatcagaccccaga

SEQ ID NO: 21619 - DNA, 26 bp, Homo sapiens
atgccgacgctcatcagaccccagaa

SEQ ID NO: 21620 - DNA, 18 bp, Homo sapiens
tgccgacgctcatcagac

SEQ ID NO: 21621 - DNA, 19 bp, Homo sapiens
tgccgacgctcatcagacc

SEQ ID NO: 21622 - DNA, 20 bp, Homo sapiens
tgccgacgctcatcagaccc

SEQ ID NO: 21623 - DNA, 22 bp, Homo sapiens
tgccgacgctcatcagacccca

SEQ ID NO: 21624 - DNA, 24 bp, Homo sapiens
tgccgacgctcatcagaccccaga

SEQ ID NO: 21625 - DNA, 25 bp, Homo sapiens
tgccgacgctcatcagaccccagaa

SEQ ID NO: 21626 - DNA, 26 bp, Homo sapiens
tgccgacgctcatcagaccccagaaa

SEQ ID NO: 21627 - DNA, 27 bp, Homo sapiens
tgccgacgctcatcagaccccagaaaa

SEQ ID NO: 21628 - DNA, 29 bp, Homo sapiens
tgccgacgctcatcagaccccagaaaagg

SEQ ID NO: 21629 - DNA, 17 bp, Homo sapiens
gccgacgctcatcagac

SEQ ID NO: 21630 - DNA, 17 bp, Homo sapiens
ccgacgctcatcagacc

SEQ ID NO: 21631 - DNA, 23 bp, Homo sapiens
ccgacgctcatcagaccccagaa

SEQ ID NO: 21632 - DNA, 16 bp, Homo sapiens
gacgctcatcagaccc

SEQ ID NO: 21633 - DNA, 17 bp, Homo sapiens
cgctcatcagaccccag

SEQ ID NO: 21634 - DNA, 18 bp, Homo sapiens
cgctcatcagaccccaga

SEQ ID NO: 21635 - DNA, 19 bp, Homo sapiens
cgctcatcagaccccagaa

SEQ ID NO: 21636 - DNA, 20 bp, Homo sapiens
cgctcatcagaccccagaaa

SEQ ID NO: 21637 - DNA, 30 bp, Homo sapiens
atcagaccccagaaaaggtgttggttgata

SEQ ID NO: 21638 - DNA, 31 bp, Homo sapiens
atcagaccccagaaaaggtgttggttgatat

SEQ ID NO: 21639 - DNA, 42 bp, Homo sapiens
ccagaaaaggtgttggttgatatagacagcaggacggtggcc

SEQ ID NO: 21640 - DNA, 17 bp, Homo sapiens
cagaaaaggtgttggtt

SEQ ID NO: 21641 - DNA, 41 bp, Homo sapiens
cagaaaaggtgttggttgatatagacagcaggacggtggcc

SEQ ID NO: 21642 - DNA, 42 bp, Homo sapiens
cagaaaaggtgttggttgatatagacagcaggacggtggcca

SEQ ID NO: 21643 - DNA, 16 bp, Homo sapiens
agaaaaggtgttggtt

SEQ ID NO: 21644 - DNA, 17 bp, Homo sapiens
agaaaaggtgttggttg

SEQ ID NO: 21645 - DNA, 18 bp, Homo sapiens
agaaaaggtgttggttga

SEQ ID NO: 21646 - DNA, 19 bp, Homo sapiens
agaaaaggtgttggttgat

SEQ ID NO: 21647 - DNA, 20 bp, Homo sapiens
agaaaaggtgttggttgata

SEQ ID NO: 21648 - DNA, 25 bp, Homo sapiens
agaaaaggtgttggttgatatagac

SEQ ID NO: 21649 - DNA, 26 bp, Homo sapiens
agaaaaggtgttggttgatatagaca

SEQ ID NO: 21650 - DNA, 40 bp, Homo sapiens
agaaaaggtgttggttgatatagacagcaggacggtggcc

SEQ ID NO: 21651 - DNA, 41 bp, Homo sapiens
agaaaaggtgttggttgatatagacagcaggacggtggcca

SEQ ID NO: 21652 - DNA, 16 bp, Homo sapiens
gaaaaggtgttggttg

SEQ ID NO: 21653 - DNA, 17 bp, Homo sapiens
gaaaaggtgttggttga

SEQ ID NO: 21654 - DNA, 19 bp, Homo sapiens
gaaaaggtgttggttgata

SEQ ID NO: 21655 - DNA, 21 bp, Homo sapiens
gaaaaggtgttggttgatata

SEQ ID NO: 21656 - DNA, 23 bp, Homo sapiens
gaaaaggtgttggttgatataga

SEQ ID NO: 21657 - DNA, 24 bp, Homo sapiens
gaaaaggtgttggttgatatagac

SEQ ID NO: 21658 - DNA, 25 bp, Homo sapiens
gaaaaggtgttggttgatatagaca

SEQ ID NO: 21659 - DNA, 28 bp, Homo sapiens
gaaaaggtgttggttgatatagacagca

SEQ ID NO: 21660 - DNA, 38 bp, Homo sapiens
gaaaaggtgttggttgatatagacagcaggacggtggc

SEQ ID NO: 21661 - DNA, 39 bp, Homo sapiens
gaaaaggtgttggttgatatagacagcaggacggtggcc

SEQ ID NO: 21662 - DNA, 40 bp, Homo sapiens
gaaaaggtgttggttgatatagacagcaggacggtggcca

SEQ ID NO: 21663 - DNA, 18 bp, Homo sapiens
aaaaggtgttggttgata

SEQ ID NO: 21664 - DNA, 33 bp, Homo sapiens; identical to SEQ ID NO: 4650

SEQ ID NO: 21665 - DNA, 38 bp, Homo sapiens
aaaaggtgttggttgatatagacagcaggacggtggcc

SEQ ID NO: 21666 - DNA, 39 bp, Homo sapiens
aaaaggtgttggttgatatagacagcaggacggtggcca

SEQ ID NO: 21667 - DNA, 16 bp, Homo sapiens
aaaggtgttggttgat

SEQ ID NO: 21668 - DNA, 17 bp, Homo sapiens
aaaggtgttggttgata

SEQ ID NO: 21669 - DNA, 19 bp, Homo sapiens
aaaggtgttggttgatata

SEQ ID NO: 21670 - DNA, 20 bp, Homo sapiens
aaaggtgttggttgatatag

SEQ ID NO: 21671 - DNA, 21 bp, Homo sapiens
aaaggtgttggttgatataga

SEQ ID NO: 21672 - DNA, 23 bp, Homo sapiens
aaaggtgttggttgatatagaca

SEQ ID NO: 21673 - DNA, 26 bp, Homo sapiens
aaaggtgttggttgatatagacagca

SEQ ID NO: 21674 - DNA, 16 bp, Homo sapiens
aaggtgttggttgata

SEQ ID NO: 21675 - DNA, 18 bp, Homo sapiens
aaggtgttggttgatata

SEQ ID NO: 21676 - DNA, 19 bp, Homo sapiens
aaggtgttggttgatatag

SEQ ID NO: 21677 - DNA, 20 bp, Homo sapiens
aaggtgttggttgatataga

SEQ ID NO: 21678 - DNA, 22 bp, Homo sapiens
aaggtgttggttgatatagaca

SEQ ID NO: 21679 - DNA, 24 bp, Homo sapiens
aaggtgttggttgatatagacagc

SEQ ID NO: 21680 - DNA, 25 bp, Homo sapiens
aaggtgttggttgatatagacagca

SEQ ID NO: 21681 - DNA, 36 bp, Homo sapiens
aaggtgttggttgatatagacagcaggacggtggcc

SEQ ID NO: 21682 - DNA, 17 bp, Homo sapiens
aggtgttggttgatata

SEQ ID NO: 21683 - DNA, 18 bp, Homo sapiens
aggtgttggttgatatag

SEQ ID NO: 21684 - DNA, 19 bp, Homo sapiens
aggtgttggttgatataga

SEQ ID NO: 21685 - DNA, 21 bp, Homo sapiens
aggtgttggttgatatagaca

SEQ ID NO: 21686 - DNA, 23 bp, Homo sapiens
aggtgttggttgatatagacagc

SEQ ID NO: 21687 - DNA, 24 bp, Homo sapiens
aggtgttggttgatatagacagca

SEQ ID NO: 21688 - DNA, 27 bp, Homo sapiens
aggtgttggttgatatagacagcagga

SEQ ID NO: 21689 - DNA, 35 bp, Homo sapiens
aggtgttggttgatatagacagcaggacggtggcc

SEQ ID NO: 21690 - DNA, 16 bp, Homo sapiens
ggtgttggttgatata

SEQ ID NO: 21691 - DNA, 17 bp, Homo sapiens
ggtgttggttgatatag

SEQ ID NO: 21692 - DNA, 18 bp, Homo sapiens
ggtgttggttgatataga

SEQ ID NO: 21693 - DNA, 20 bp, Homo sapiens
ggtgttggttgatatagaca

SEQ ID NO: 21694 - DNA, 22 bp, Homo sapiens
ggtgttggttgatatagacagc

SEQ ID NO: 21695 - DNA, 23 bp, Homo sapiens
ggtgttggttgatatagacagca

SEQ ID NO: 21696 - DNA, 26 bp, Homo sapiens
ggtgttggttgatatagacagcagga

SEQ ID NO: 21697 - DNA, 19 bp, Homo sapiens
gtgttggttgatatagaca

SEQ ID NO: 21698 - DNA, 33 bp, Homo sapiens
gtgttggttgatatagacagcaggacggtggcc

SEQ ID NO: 21699 - DNA, 18 bp, Homo sapiens
tgttggttgatatagaca

SEQ ID NO: 21700 - DNA, 33 bp, Homo sapiens
tgttggttgatatagacagcaggacggtggcca

SEQ ID NO: 21701 - DNA, 31 bp, Homo sapiens
gttggttgatatagacagcaggacggtggcc

SEQ ID NO: 21702 - DNA, 32 bp, Homo sapiens
gttggttgatatagacagcaggacggtggcca

SEQ ID NO: 21703 - DNA, 30 bp, Homo sapiens
ttggttgatatagacagcaggacggtggcc

SEQ ID NO: 21704 - DNA, 31 bp, Homo sapiens
ttggttgatatagacagcaggacggtggcca

SEQ ID NO: 21705 - DNA, 26 bp, Homo sapiens
ttgatatagacagcaggacggtggcc

SEQ ID NO: 21706 - DNA, 25 bp, Homo sapiens
tgatatagacagcaggacggtggcc

SEQ ID NO: 21707 - DNA, 26 bp, Homo sapiens
tgatatagacagcaggacggtggcca

SEQ ID NO: 21708 - DNA, 23 bp, Homo sapiens
gatatagacagcaggacggtggc

SEQ ID NO: 21709 - DNA, 24 bp, Homo sapiens
gatatagacagcaggacggtggcc

SEQ ID NO: 21710 - DNA, 25 bp, Homo sapiens
gatatagacagcaggacggtggcca

SEQ ID NO: 21711 - DNA, 30 bp, Homo sapiens
gatatagacagcaggacggtggccatggaa

SEQ ID NO: 21712 - DNA, 32 bp, Homo sapiens
gatatagacagcaggacggtggccatggaagt

SEQ ID NO: 21713 - DNA, 33 bp, Homo sapiens; identical to SEQ ID NO: 4653

SEQ ID NO: 21714 - DNA, 34 bp, Homo sapiens
gatatagacagcaggacggtggccatggaagtcg

SEQ ID NO: 21715 - DNA, 23 bp, Homo sapiens
atatagacagcaggacggtggcc

SEQ ID NO: 21716 - DNA, 24 bp, Homo sapiens
atatagacagcaggacggtggcca

SEQ ID NO: 21717 - DNA, 18 bp, Homo sapiens
tatagacagcaggacggt

SEQ ID NO: 21718 - DNA, 22 bp, Homo sapiens
tatagacagcaggacggtggcc

SEQ ID NO: 21719 - DNA, 23 bp, Homo sapiens
tatagacagcaggacggtggcca

SEQ ID NO: 21720 - DNA, 27 bp, Homo sapiens
tatagacagcaggacggtggccatgga

SEQ ID NO: 21721 - DNA, 28 bp, Homo sapiens
tatagacagcaggacggtggccatggaa

SEQ ID NO: 21722 - DNA, 21 bp, Homo sapiens
atagacagcaggacggtggcc

SEQ ID NO: 21723 - DNA, 16 bp, Homo sapiens
tagacagcaggacggt

SEQ ID NO: 21724 - DNA, 20 bp, Homo sapiens
tagacagcaggacggtggcc

SEQ ID NO: 21725 - DNA, 21 bp, Homo sapiens
tagacagcaggacggtggcca

SEQ ID NO: 21726 - DNA, 25 bp, Homo sapiens
tagacagcaggacggtggccatgga

SEQ ID NO: 21727 - DNA, 26 bp, Homo sapiens
tagacagcaggacggtggccatggaa

SEQ ID NO: 21728 - DNA, 19 bp, Homo sapiens
agacagcaggacggtggcc

SEQ ID NO: 21729 - DNA, 18 bp, Homo sapiens
gacagcaggacggtggcc

SEQ ID NO: 21730 - DNA, 19 bp, Homo sapiens
gacagcaggacggtggcca

SEQ ID NO: 21731 - DNA, 23 bp, Homo sapiens
gacagcaggacggtggccatgga

SEQ ID NO: 21732 - DNA, 24 bp, Homo sapiens
gacagcaggacggtggccatggaa

SEQ ID NO: 21733 - DNA, 16 bp, Homo sapiens
acagcaggacggtggc

SEQ ID NO: 21734 - DNA, 17 bp, Homo sapiens
acagcaggacggtggcc

SEQ ID NO: 21735 - DNA, 18 bp, Homo sapiens
acagcaggacggtggcca

SEQ ID NO: 21736 - DNA, 22 bp, Homo sapiens
acagcaggacggtggccatgga

SEQ ID NO: 21737 - DNA, 23 bp, Homo sapiens
acagcaggacggtggccatggaa

SEQ ID NO: 21738 - DNA, 25 bp, Homo sapiens
acagcaggacggtggccatggaagt

SEQ ID NO: 21739 - DNA, 27 bp, Homo sapiens
acagcaggacggtggccatggaagtcg

SEQ ID NO: 21740 - DNA, 28 bp, Homo sapiens
acagcaggacggtggccatggaagtcgg

SEQ ID NO: 21741 - DNA, 29 bp, Homo sapiens
acagcaggacggtggccatggaagtcgga

SEQ ID NO: 21742 - DNA, 30 bp, Homo sapiens
acagcaggacggtggccatggaagtcggaa

SEQ ID NO: 21743 - DNA, 32 bp, Homo sapiens
acagcaggacggtggccatggaagtcggaatc

SEQ ID NO: 21744 - DNA, 33 bp, Homo sapiens; identical to SEQ ID NO: 4655

SEQ ID NO: 21745 - DNA, 16 bp, Homo sapiens
cagcaggacggtggcc

SEQ ID NO: 21746 - DNA, 17 bp, Homo sapiens
cagcaggacggtggcca

SEQ ID NO: 21747 - DNA, 21 bp, Homo sapiens
cagcaggacggtggccatgga

SEQ ID NO: 21748 - DNA, 22 bp, Homo sapiens
cagcaggacggtggccatggaa

SEQ ID NO: 21749 - DNA, 24 bp, Homo sapiens
cagcaggacggtggccatggaagt

SEQ ID NO: 21750 - DNA, 26 bp, Homo sapiens
cagcaggacggtggccatggaagtcg

SEQ ID NO: 21751 - DNA, 28 bp, Homo sapiens
cagcaggacggtggccatggaagtcgga

SEQ ID NO: 21752 - DNA, 29 bp, Homo sapiens
cagcaggacggtggccatggaagtcggaa

SEQ ID NO: 21753 - DNA, 32 bp, Homo sapiens; identical to SEQ ID NO: 4656

SEQ ID NO: 21754 - DNA, 16 bp, Homo sapiens
agcaggacggtggcca

SEQ ID NO: 21755 - DNA, 20 bp, Homo sapiens
agcaggacggtggccatgga

SEQ ID NO: 21756 - DNA, 21 bp, Homo sapiens
agcaggacggtggccatggaa

SEQ ID NO: 21757 - DNA, 22 bp, Homo sapiens
agcaggacggtggccatggaag

SEQ ID NO: 21758 - DNA, 23 bp, Homo sapiens
agcaggacggtggccatggaagt

SEQ ID NO: 21759 - DNA, 24 bp, Homo sapiens
agcaggacggtggccatggaagtc

SEQ ID NO: 21760 - DNA, 25 bp, Homo sapiens
agcaggacggtggccatggaagtcg

SEQ ID NO: 21761 - DNA, 29 bp, Homo sapiens
agcaggacggtggccatggaagtcggaat

SEQ ID NO: 21762 - DNA, 31 bp, Homo sapiens; identical to SEQ ID NO: 4659

SEQ ID NO: 21763 - DNA, 32 bp, Homo sapiens
agcaggacggtggccatggaagtcggaatccg

SEQ ID NO: 21764 - DNA, 33 bp, Homo sapiens; identical to SEQ ID NO: 4660

SEQ ID NO: 21765 - DNA, 19 bp, Homo sapiens
gcaggacggtggccatgga

SEQ ID NO: 21766 - DNA, 20 bp, Homo sapiens
gcaggacggtggccatggaa

SEQ ID NO: 21767 - DNA, 22 bp, Homo sapiens
gcaggacggtggccatggaagt

SEQ ID NO: 21768 - DNA, 23 bp, Homo sapiens
gcaggacggtggccatggaagtc

SEQ ID NO: 21769 - DNA, 24 bp, Homo sapiens
gcaggacggtggccatggaagtcg

SEQ ID NO: 21770 - DNA, 25 bp, Homo sapiens
gcaggacggtggccatggaagtcgg

SEQ ID NO: 21771 - DNA, 26 bp, Homo sapiens
gcaggacggtggccatggaagtcgga

SEQ ID NO: 21772 - DNA, 27 bp, Homo sapiens
gcaggacggtggccatggaagtcggaa

SEQ ID NO: 21773 - DNA, 30 bp, Homo sapiens; identical to SEQ ID NO: 4661

SEQ ID NO: 21774 - DNA, 18 bp, Homo sapiens
caggacggtggccatgga

SEQ ID NO: 21775 - DNA, 29 bp, Homo sapiens
caggacggtggccatggaagtcggaatcc

SEQ ID NO: 21776 - DNA, 32 bp, Homo sapiens; identical to SEQ ID NO: 4663

SEQ ID NO: 21777 - DNA, 33 bp, Homo sapiens
caggacggtggccatggaagtcggaatccgcta

SEQ ID NO: 21778 - DNA, 28 bp, Homo sapiens
aggacggtggccatggaagtcggaatcc

SEQ ID NO: 21779 - DNA, 31 bp, Homo sapiens
aggacggtggccatggaagtcggaatccgct

SEQ ID NO: 21780 - DNA, 32 bp, Homo sapiens
aggacggtggccatggaagtcggaatccgcta

SEQ ID NO: 21781 - DNA, 21 bp, Homo sapiens
acggtggccatggaagtcgga

SEQ ID NO: 21782 - DNA, 22 bp, Homo sapiens
acggtggccatggaagtcggaa

SEQ ID NO: 21783 - DNA, 17 bp, Homo sapiens
cggtggccatggaagtc

SEQ ID NO: 21784 - DNA, 20 bp, Homo sapiens
cggtggccatggaagtcgga

SEQ ID NO: 21785 - DNA, 21 bp, Homo sapiens
cggtggccatggaagtcggaa

SEQ ID NO: 21786 - DNA, 22 bp, Homo sapiens
cggtggccatggaagtcggaat

SEQ ID NO: 21787 - DNA, 23 bp, Homo sapiens
cggtggccatggaagtcggaatc

SEQ ID NO: 21788 - DNA, 24 bp, Homo sapiens
cggtggccatggaagtcggaatcc

SEQ ID NO: 21789 - DNA, 25 bp, Homo sapiens
cggtggccatggaagtcggaatccg

SEQ ID NO: 21790 - DNA, 27 bp, Homo sapiens
cggtggccatggaagtcggaatccgct

SEQ ID NO: 21791 - DNA, 28 bp, Homo sapiens
cggtggccatggaagtcggaatccgcta

SEQ ID NO: 21792 - DNA, 29 bp, Homo sapiens
cggtggccatggaagtcggaatccgctaa

SEQ ID NO: 21793 - DNA, 32 bp, Homo sapiens
cggtggccatggaagtcggaatccgctaagga

SEQ ID NO: 21794 - DNA, 18 bp, Homo sapiens
gtggccatggaagtcgga

SEQ ID NO: 21795 - DNA, 20 bp, Homo sapiens
gtggccatggaagtcggaat

SEQ ID NO: 21796 - DNA, 21 bp, Homo sapiens
gtggccatggaagtcggaatc

SEQ ID NO: 21797 - DNA, 22 bp, Homo sapiens
gtggccatggaagtcggaatcc

SEQ ID NO: 21798 - DNA, 23 bp, Homo sapiens
gtggccatggaagtcggaatccg

SEQ ID NO: 21799 - DNA, 33 bp, Homo sapiens
gtggccatggaagtcggaatccgctaaggagtg

SEQ ID NO: 21800 - DNA, 17 bp, Homo sapiens
tggccatggaagtcgga

SEQ ID NO: 21801 - DNA, 18 bp, Homo sapiens
tggccatggaagtcggaa

SEQ ID NO: 21802 - DNA, 19 bp, Homo sapiens
tggccatggaagtcggaat

SEQ ID NO: 21803 - DNA, 20 bp, Homo sapiens
tggccatggaagtcggaatc

SEQ ID NO: 21804 - DNA, 21 bp, Homo sapiens
tggccatggaagtcggaatcc

SEQ ID NO: 21805 - DNA, 22 bp, Homo sapiens
tggccatggaagtcggaatccg

SEQ ID NO: 21806 - DNA, 26 bp, Homo sapiens
tggccatggaagtcggaatccgctaa

SEQ ID NO: 21807 - DNA, 29 bp, Homo sapiens
tggccatggaagtcggaatccgctaagga

SEQ ID NO: 21808 - DNA, 32 bp, Homo sapiens
tggccatggaagtcggaatccgctaaggagtg

SEQ ID NO: 21809 - DNA, 16 bp, Homo sapiens
ggccatggaagtcgga

SEQ ID NO: 21810 - DNA, 17 bp, Homo sapiens
ggccatggaagtcggaa

SEQ ID NO: 21811 - DNA, 18 bp, Homo sapiens
ggccatggaagtcggaat

SEQ ID NO: 21812 - DNA, 19 bp, Homo sapiens
ggccatggaagtcggaatc

SEQ ID NO: 21813 - DNA, 20 bp, Homo sapiens
ggccatggaagtcggaatcc

SEQ ID NO: 21814 - DNA, 21 bp, Homo sapiens
ggccatggaagtcggaatccg

SEQ ID NO: 21815 - DNA, 28 bp, Homo sapiens
ggccatggaagtcggaatccgctaagga

SEQ ID NO: 21816 - DNA, 31 bp, Homo sapiens
ggccatggaagtcggaatccgctaaggagtg

SEQ ID NO: 21817 - DNA, 18 bp, Homo sapiens
gccatggaagtcggaatc

SEQ ID NO: 21818 - DNA, 19 bp, Homo sapiens
gccatggaagtcggaatcc

SEQ ID NO: 21819 - DNA, 20 bp, Homo sapiens
gccatggaagtcggaatccg

SEQ ID NO: 21820 - DNA, 24 bp, Homo sapiens
gccatggaagtcggaatccgctaa

SEQ ID NO: 21821 - DNA, 27 bp, Homo sapiens
gccatggaagtcggaatccgctaagga

SEQ ID NO: 21822 - DNA, 29 bp, Homo sapiens
gccatggaagtcggaatccgctaaggagt

SEQ ID NO: 21823 - DNA, 30 bp, Homo sapiens; identical to SEQ ID NO: 4672

SEQ ID NO: 21824 - DNA, 31 bp, Homo sapiens
gccatggaagtcggaatccgctaaggagtgt

SEQ ID NO: 21825 - DNA, 18 bp, Homo sapiens
ccatggaagtcggaatcc

SEQ ID NO: 21826 - DNA, 19 bp, Homo sapiens
ccatggaagtcggaatccg

SEQ ID NO: 21827 - DNA, 22 bp, Homo sapiens
ccatggaagtcggaatccgcta

SEQ ID NO: 21828 - DNA, 23 bp, Homo sapiens
ccatggaagtcggaatccgctaa

SEQ ID NO: 21829 - DNA, 26 bp, Homo sapiens
ccatggaagtcggaatccgctaagga

SEQ ID NO: 21830 - DNA, 16 bp, Homo sapiens
catggaagtcggaatc

SEQ ID NO: 21831 - DNA, 17 bp, Homo sapiens
catggaagtcggaatcc

SEQ ID NO: 21832 - DNA, 24 bp, Homo sapiens
catggaagtcggaatccgctaagg

SEQ ID NO: 21833 - DNA, 25 bp, Homo sapiens
catggaagtcggaatccgctaagga

SEQ ID NO: 21834 - DNA, 26 bp, Homo sapiens
catggaagtcggaatccgctaaggag

SEQ ID NO: 21835 - DNA, 27 bp, Homo sapiens
catggaagtcggaatccgctaaggagt

SEQ ID NO: 21836 - DNA, 28 bp, Homo sapiens
catggaagtcggaatccgctaaggagtg

SEQ ID NO: 21837 - DNA, 16 bp, Homo sapiens
atggaagtcggaatcc

SEQ ID NO: 21838 - DNA, 19 bp, Homo sapiens
atggaagtcggaatccgct

SEQ ID NO: 21839 - DNA, 23 bp, Homo sapiens
atggaagtcggaatccgctaagg

SEQ ID NO: 21840 - DNA, 24 bp, Homo sapiens
atggaagtcggaatccgctaagga

SEQ ID NO: 21841 - DNA, 25 bp, Homo sapiens
atggaagtcggaatccgctaaggag

SEQ ID NO: 21842 - DNA, 26 bp, Homo sapiens
atggaagtcggaatccgctaaggagt

SEQ ID NO: 21843 - DNA, 27 bp, Homo sapiens
atggaagtcggaatccgctaaggagtg

SEQ ID NO: 21844 - DNA, 28 bp, Homo sapiens
atggaagtcggaatccgctaaggagtgt

SEQ ID NO: 21845 - DNA, 23 bp, Homo sapiens
tggaagtcggaatccgctaagga

SEQ ID NO: 21846 - DNA, 30 bp, Homo sapiens
tggaagtcggaatccgctaaggagtgtgta

SEQ ID NO: 21847 - DNA, 17 bp, Homo sapiens
ggaagtcggaatccgct

SEQ ID NO: 21848 - DNA, 22 bp, Homo sapiens
ggaagtcggaatccgctaagga

SEQ ID NO: 21849 - DNA, 24 bp, Homo sapiens
ggaagtcggaatccgctaaggagt

SEQ ID NO: 21850 - DNA, 25 bp, Homo sapiens
ggaagtcggaatccgctaaggagtg

SEQ ID NO: 21851 - DNA, 16 bp, Homo sapiens
gaagtcggaatccgct

SEQ ID NO: 21852 - DNA, 18 bp, Homo sapiens
gaagtcggaatccgctaa

SEQ ID NO: 21853 - DNA, 20 bp, Homo sapiens
gaagtcggaatccgctaagg

SEQ ID NO: 21854 - DNA, 21 bp, Homo sapiens
gaagtcggaatccgctaagga

SEQ ID NO: 21855 - DNA, 24 bp, Homo sapiens
gaagtcggaatccgctaaggagtg

SEQ ID NO: 21856 - DNA, 17 bp, Homo sapiens
aagtcggaatccgctaa

SEQ ID NO: 21857 - DNA, 20 bp, Homo sapiens
aagtcggaatccgctaagga

SEQ ID NO: 21858 - DNA, 21 bp, Homo sapiens
aagtcggaatccgctaaggag

SEQ ID NO: 21859 - DNA, 23 bp, Homo sapiens
aagtcggaatccgctaaggagtg

SEQ ID NO: 21860 - DNA, 19 bp, Homo sapiens
agtcggaatccgctaagga

SEQ ID NO: 21861 - DNA, 18 bp, Homo sapiens
gtcggaatccgctaagga

SEQ ID NO: 21862 - DNA, 33 bp, Homo sapiens
gtcggaatccgctaaggagtgtgtaacaactca

SEQ ID NO: 21863 - DNA, 17 bp, Homo sapiens
tcggaatccgctaagga

SEQ ID NO: 21864 - DNA, 20 bp, Homo sapiens
tcggaatccgctaaggagtg

SEQ ID NO: 21865 - DNA, 32 bp, Homo sapiens
tcggaatccgctaaggagtgtgtaacaactca

SEQ ID NO: 21866 - DNA, 36 bp, Homo sapiens
tcggaatccgctaaggagtgtgtaacaactcacctg

SEQ ID NO: 21867 - DNA, 31 bp, Homo sapiens
aatccgctaaggagtgtgtaacaactcacct

SEQ ID NO: 21868 - DNA, 32 bp, Homo sapiens
aatccgctaaggagtgtgtaacaactcacctg

SEQ ID NO: 21869 - DNA, 30 bp, Homo sapiens
atccgctaaggagtgtgtaacaactcacct

SEQ ID NO: 21870 - DNA, 31 bp, Homo sapiens
atccgctaaggagtgtgtaacaactcacctg

SEQ ID NO: 21871 - DNA, 28 bp, Homo sapiens
ccgctaaggagtgtgtaacaactcacct

SEQ ID NO: 21872 - DNA, 21 bp, Homo sapiens
gctaaggagtgtgtaacaact

SEQ ID NO: 21873 - DNA, 26 bp, Homo sapiens
gctaaggagtgtgtaacaactcacct

SEQ ID NO: 21874 - DNA, 27 bp, Homo sapiens
gctaaggagtgtgtaacaactcacctg

SEQ ID NO: 21875 - DNA, 18 bp, Homo sapiens
aaggagtgtgtaacaact

SEQ ID NO: 21876 - DNA, 17 bp, Homo sapiens
aggagtgtgtaacaact

SEQ ID NO: 21877 - DNA, 18 bp, Homo sapiens
aggagtgtgtaacaactc

SEQ ID NO: 21878 - DNA, 19 bp, Homo sapiens
aggagtgtgtaacaactca

SEQ ID NO: 21879 - DNA, 21 bp, Homo sapiens
aggagtgtgtaacaactcacc

SEQ ID NO: 21880 - DNA, 22 bp, Homo sapiens
aggagtgtgtaacaactcacct

SEQ ID NO: 21881 - DNA, 17 bp, Homo sapiens
tgtgtaacaactcacct

SEQ ID NO: 21882 - DNA, 16 bp, Homo sapiens
gtgtaacaactcacct

SEQ ID NO: 21883 - DNA, 16 bp, Homo sapiens
tgtaacaactcacctg

SEQ ID NO: 21884 - DNA, 18 bp, Homo sapiens
tgtaacaactcacctgcc

SEQ ID NO: 21885 - DNA, 33 bp, Homo sapiens
tgtaacaactcacctgccgaatcaactagccct

SEQ ID NO: 21886 - DNA, 29 bp, Homo sapiens
acaactcacctgccgaatcaactagccct

SEQ ID NO: 21887 - DNA, 31 bp, Homo sapiens
acaactcacctgccgaatcaactagccctga

SEQ ID NO: 21888 - DNA, 32 bp, Homo sapiens
acaactcacctgccgaatcaactagccctgaa

SEQ ID NO: 21889 - DNA, 33 bp, Homo sapiens
acaactcacctgccgaatcaactagccctgaaa

SEQ ID NO: 21890 - DNA, 28 bp, Homo sapiens
caactcacctgccgaatcaactagccct

SEQ ID NO: 21891 - DNA, 30 bp, Homo sapiens
caactcacctgccgaatcaactagccctga

SEQ ID NO: 21892 - DNA, 31 bp, Homo sapiens
caactcacctgccgaatcaactagccctgaa

SEQ ID NO: 21893 - DNA, 32 bp, Homo sapiens
caactcacctgccgaatcaactagccctgaaa

SEQ ID NO: 21894 - DNA, 33 bp, Homo sapiens
caactcacctgccgaatcaactagccctgaaaa

SEQ ID NO: 21895 - DNA, 26 bp, Homo sapiens
actcacctgccgaatcaactagccct

SEQ ID NO: 21896 - DNA, 28 bp, Homo sapiens
actcacctgccgaatcaactagccctga

SEQ ID NO: 21897 - DNA, 29 bp, Homo sapiens
actcacctgccgaatcaactagccctgaa

SEQ ID NO: 21898 - DNA, 30 bp, Homo sapiens
actcacctgccgaatcaactagccctgaaa

SEQ ID NO: 21899 - DNA, 31 bp, Homo sapiens
actcacctgccgaatcaactagccctgaaaa

SEQ ID NO: 21900 - DNA, 25 bp, Homo sapiens
ctcacctgccgaatcaactagccct

SEQ ID NO: 21901 - DNA, 27 bp, Homo sapiens
ctcacctgccgaatcaactagccctga

SEQ ID NO: 21902 - DNA, 28 bp, Homo sapiens
ctcacctgccgaatcaactagccctgaa

SEQ ID NO: 21903 - DNA, 29 bp, Homo sapiens
ctcacctgccgaatcaactagccctgaaa

SEQ ID NO: 21904 - DNA, 30 bp, Homo sapiens
ctcacctgccgaatcaactagccctgaaaa

SEQ ID NO: 21905 - DNA, 24 bp, Homo sapiens
tcacctgccgaatcaactagccct

SEQ ID NO: 21906 - DNA, 23 bp, Homo sapiens
cctgccgaatcaactagccctga

SEQ ID NO: 21907 - DNA, 25 bp, Homo sapiens
cctgccgaatcaactagccctgaaa

SEQ ID NO: 21908 - DNA, 26 bp, Homo sapiens
cctgccgaatcaactagccctgaaaa

SEQ ID NO: 21909 - DNA, 30 bp, Homo sapiens
cctgccgaatcaactagccctgaaaatgga

SEQ ID NO: 21910 - DNA, 32 bp, Homo sapiens
atcaactagccctgaaaatggatggcgctgga

SEQ ID NO: 21911 - DNA, 31 bp, Homo sapiens
tcaactagccctgaaaatggatggcgctgga

SEQ ID NO: 21912 - DNA, 22 bp, Homo sapiens
gccctgaaaatggatggcgctg

SEQ ID NO: 21913 - DNA, 21 bp, Homo sapiens
ccctgaaaatggatggcgctg

SEQ ID NO: 21914 - DNA, 29 bp, Homo sapiens
gaaaatggatggcgctggagcgtcgggcc

SEQ ID NO: 21915 - DNA, 16 bp, Homo sapiens
aaaatggatggcgctg

SEQ ID NO: 21916 - DNA, 28 bp, Homo sapiens
aaaatggatggcgctggagcgtcgggcc

SEQ ID NO: 21917 - DNA, 29 bp, Homo sapiens
aaaatggatggcgctggagcgtcgggccc

SEQ ID NO: 21918 - DNA, 17 bp, Homo sapiens
aaatggatggcgctgga

SEQ ID NO: 21919 - DNA, 19 bp, Homo sapiens
aaatggatggcgctggagc

SEQ ID NO: 21920 - DNA, 27 bp, Homo sapiens
aaatggatggcgctggagcgtcgggcc

SEQ ID NO: 21921 - DNA, 28 bp, Homo sapiens
aaatggatggcgctggagcgtcgggccc

SEQ ID NO: 21922 - DNA, 29 bp, Homo sapiens
aaatggatggcgctggagcgtcgggccca

SEQ ID NO: 21923 - DNA, 16 bp, Homo sapiens
aatggatggcgctgga

SEQ ID NO: 21924 - DNA, 17 bp, Homo sapiens
aatggatggcgctggag

SEQ ID NO: 21925 - DNA, 18 bp, Homo sapiens
aatggatggcgctggagc

SEQ ID NO: 21926 - DNA, 21 bp, Homo sapiens
aatggatggcgctggagcgtc

SEQ ID NO: 21927 - DNA, 26 bp, Homo sapiens
aatggatggcgctggagcgtcgggcc

SEQ ID NO: 21928 - DNA, 27 bp, Homo sapiens
aatggatggcgctggagcgtcgggccc

SEQ ID NO: 21929 - DNA, 28 bp, Homo sapiens
aatggatggcgctggagcgtcgggccca

SEQ ID NO: 21930 - DNA, 29 bp, Homo sapiens
aatggatggcgctggagcgtcgggcccat

SEQ ID NO: 21931 - DNA, 32 bp, Homo sapiens
aatggatggcgctggagcgtcgggcccatacc

SEQ ID NO: 21932 - DNA, 33 bp, Homo sapiens
aatggatggcgctggagcgtcgggcccataccc

SEQ ID NO: 21933 - DNA, 16 bp, Homo sapiens
atggatggcgctggag

SEQ ID NO: 21934 - DNA, 17 bp, Homo sapiens
atggatggcgctggagc

SEQ ID NO: 21935 - DNA, 20 bp, Homo sapiens
atggatggcgctggagcgtc

SEQ ID NO: 21936 - DNA, 25 bp, Homo sapiens
atggatggcgctggagcgtcgggcc

SEQ ID NO: 21937 - DNA, 26 bp, Homo sapiens
atggatggcgctggagcgtcgggccc

SEQ ID NO: 21938 - DNA, 27 bp, Homo sapiens
atggatggcgctggagcgtcgggccca

SEQ ID NO: 21939 - DNA, 28 bp, Homo sapiens
atggatggcgctggagcgtcgggcccat

SEQ ID NO: 21940 - DNA, 29 bp, Homo sapiens
atggatggcgctggagcgtcgggcccata

SEQ ID NO: 21941 - DNA, 31 bp, Homo sapiens
atggatggcgctggagcgtcgggcccatacc

SEQ ID NO: 21942 - DNA, 32 bp, Homo sapiens
atggatggcgctggagcgtcgggcccataccc

SEQ ID NO: 21943 - DNA, 33 bp, Homo sapiens
atggatggcgctggagcgtcgggcccatacccg

SEQ ID NO: 21944 - DNA, 42 bp, Homo sapiens
atggatggcgctggagcgtcgggcccatacccggccgtcgcc

SEQ ID NO: 21945 - DNA, 24 bp, Homo sapiens
tggatggcgctggagcgtcgggcc

SEQ ID NO: 21946 - DNA, 25 bp, Homo sapiens
tggatggcgctggagcgtcgggccc

SEQ ID NO: 21947 - DNA, 30 bp, Homo sapiens
tggatggcgctggagcgtcgggcccatacc

SEQ ID NO: 21948 - DNA, 23 bp, Homo sapiens
ggatggcgctggagcgtcgggcc

SEQ ID NO: 21949 - DNA, 24 bp, Homo sapiens
ggatggcgctggagcgtcgggccc

SEQ ID NO: 21950 - DNA, 29 bp, Homo sapiens
ggatggcgctggagcgtcgggcccatacc

SEQ ID NO: 21951 - DNA, 22 bp, Homo sapiens
gatggcgctggagcgtcgggcc

SEQ ID NO: 21952 - DNA, 23 bp, Homo sapiens
gatggcgctggagcgtcgggccc

SEQ ID NO: 21953 - DNA, 24 bp, Homo sapiens
gatggcgctggagcgtcgggccca

SEQ ID NO: 21954 - DNA, 25 bp, Homo sapiens
gatggcgctggagcgtcgggcccat

SEQ ID NO: 21955 - DNA, 26 bp, Homo sapiens
gatggcgctggagcgtcgggcccata

SEQ ID NO: 21956 - DNA, 28 bp, Homo sapiens
gatggcgctggagcgtcgggcccatacc

SEQ ID NO: 21957 - DNA, 21 bp, Homo sapiens
atggcgctggagcgtcgggcc

SEQ ID NO: 21958 - DNA, 22 bp, Homo sapiens
atggcgctggagcgtcgggccc

SEQ ID NO: 21959 - DNA, 23 bp, Homo sapiens
atggcgctggagcgtcgggccca

SEQ ID NO: 21960 - DNA, 20 bp, Homo sapiens
tggcgctggagcgtcgggcc

SEQ ID NO: 21961 - DNA, 21 bp, Homo sapiens
tggcgctggagcgtcgggccc

SEQ ID NO: 21962 - DNA, 22 bp, Homo sapiens
tggcgctggagcgtcgggccca

SEQ ID NO: 21963 - DNA, 24 bp, Homo sapiens
tggcgctggagcgtcgggcccata

SEQ ID NO: 21964 - DNA, 19 bp, Homo sapiens
ggcgctggagcgtcgggcc

SEQ ID NO: 21965 - DNA, 20 bp, Homo sapiens
ggcgctggagcgtcgggccc

SEQ ID NO: 21966 - DNA, 21 bp, Homo sapiens
ggcgctggagcgtcgggccca

SEQ ID NO: 21967 - DNA, 22 bp, Homo sapiens
ggcgctggagcgtcgggcccat

SEQ ID NO: 21968 - DNA, 18 bp, Homo sapiens
gcgctggagcgtcgggcc

SEQ ID NO: 21969 - DNA, 19 bp, Homo sapiens
gcgctggagcgtcgggccc

SEQ ID NO: 21970 - DNA, 20 bp, Homo sapiens
gcgctggagcgtcgggccca

SEQ ID NO: 21971 - DNA, 17 bp, Homo sapiens
cgctggagcgtcgggcc

SEQ ID NO: 21972 - DNA, 18 bp, Homo sapiens
cgctggagcgtcgggccc

SEQ ID NO: 21973 - DNA, 16 bp, Homo sapiens
gctggagcgtcgggcc

SEQ ID NO: 21974 - DNA, 17 bp, Homo sapiens
gctggagcgtcgggccc

SEQ ID NO: 21975 - DNA, 33 bp, Homo sapiens
gctggagcgtcgggcccatacccggccgtcgcc

SEQ ID NO: 21976 - DNA, 16 bp, Homo sapiens
ctggagcgtcgggccc

SEQ ID NO: 21977 - DNA, 32 bp, Homo sapiens
ctggagcgtcgggcccatacccggccgtcgcc

SEQ ID NO: 21978 - DNA, 39 bp, Homo sapiens
ctggagcgtcgggcccatacccggccgtcgccggcagtc

SEQ ID NO: 21979 - DNA, 21 bp, Homo sapiens
gagcgtcgggcccatacccgg

SEQ ID NO: 21980 - DNA, 20 bp, Homo sapiens
agcgtcgggcccatacccgg

SEQ ID NO: 21981 - DNA, 32 bp, Homo sapiens
agcgtcgggcccatacccggccgtcgccggca

SEQ ID NO: 21982 - DNA, 30 bp, Homo sapiens
gcgtcgggcccatacccggccgtcgccggc

SEQ ID NO: 21983 - DNA, 31 bp, Homo sapiens
gcgtcgggcccatacccggccgtcgccggca

SEQ ID NO: 21984 - DNA, 32 bp, Homo sapiens
gcgtcgggcccatacccggccgtcgccggcag

SEQ ID NO: 21985 - DNA, 33 bp, Homo sapiens
gcgtcgggcccatacccggccgtcgccggcagt

SEQ ID NO: 21986 - DNA, 26 bp, Homo sapiens
cgtcgggcccatacccggccgtcgcc

SEQ ID NO: 21987 - DNA, 30 bp, Homo sapiens
cgtcgggcccatacccggccgtcgccggca

SEQ ID NO: 21988 - DNA, 32 bp, Homo sapiens
cgtcgggcccatacccggccgtcgccggcagt

SEQ ID NO: 21989 - DNA, 33 bp, Homo sapiens; identical to SEQ ID NO: 4713

SEQ ID NO: 21990 - DNA, 29 bp, Homo sapiens
gtcgggcccatacccggccgtcgccggca

SEQ ID NO: 21991 - DNA, 31 bp, Homo sapiens
gtcgggcccatacccggccgtcgccggcagt

SEQ ID NO: 21992 - DNA, 32 bp, Homo sapiens; identical to SEQ ID NO: 4714

SEQ ID NO: 21993 - DNA, 25 bp, Homo sapiens
tcgggcccatacccggccgtcgccg

SEQ ID NO: 21994 - DNA, 28 bp, Homo sapiens
tcgggcccatacccggccgtcgccggca

SEQ ID NO: 21995 - DNA, 30 bp, Homo sapiens
tcgggcccatacccggccgtcgccggcagt

SEQ ID NO: 21996 - DNA, 31 bp, Homo sapiens
tcgggcccatacccggccgtcgccggcagtc

SEQ ID NO: 21997 - DNA, 23 bp, Homo sapiens
cgggcccatacccggccgtcgcc

SEQ ID NO: 21998 - DNA, 24 bp, Homo sapiens
cgggcccatacccggccgtcgccg

SEQ ID NO: 21999 - DNA, 25 bp, Homo sapiens
cgggcccatacccggccgtcgccgg

SEQ ID NO: 22000 - DNA, 27 bp, Homo sapiens
cgggcccatacccggccgtcgccggca

SEQ ID NO: 22001 - DNA, 30 bp, Homo sapiens
cgggcccatacccggccgtcgccggcagtc

SEQ ID NO: 22002 - DNA, 22 bp, Homo sapiens
gggcccatacccggccgtcgcc

SEQ ID NO: 22003 - DNA, 23 bp, Homo sapiens
gggcccatacccggccgtcgccg

SEQ ID NO: 22004 - DNA, 24 bp, Homo sapiens
gggcccatacccggccgtcgccgg

SEQ ID NO: 22005 - DNA, 25 bp, Homo sapiens
gggcccatacccggccgtcgccggc

SEQ ID NO: 22006 - DNA, 26 bp, Homo sapiens
gggcccatacccggccgtcgccggca

SEQ ID NO: 22007 - DNA, 27 bp, Homo sapiens
gggcccatacccggccgtcgccggcag

SEQ ID NO: 22008 - DNA, 28 bp, Homo sapiens
gggcccatacccggccgtcgccggcagt

SEQ ID NO: 22009 - DNA, 29 bp, Homo sapiens
gggcccatacccggccgtcgccggcagtc

SEQ ID NO: 22010 - DNA, 32 bp, Homo sapiens
gggcccatacccggccgtcgccggcagtcgag

SEQ ID NO: 22011 - DNA, 33 bp, Homo sapiens
gggcccatacccggccgtcgccggcagtcgaga

SEQ ID NO: 22012 - DNA, 21 bp, Homo sapiens
ggcccatacccggccgtcgcc

SEQ ID NO: 22013 - DNA, 25 bp, Homo sapiens
ggcccatacccggccgtcgccggca

SEQ ID NO: 22014 - DNA, 26 bp, Homo sapiens
ggcccatacccggccgtcgccggcag

SEQ ID NO: 22015 - DNA, 27 bp, Homo sapiens
ggcccatacccggccgtcgccggcagt

SEQ ID NO: 22016 - DNA, 28 bp, Homo sapiens
ggcccatacccggccgtcgccggcagtc

SEQ ID NO: 22017 - DNA, 30 bp, Homo sapiens
ggcccatacccggccgtcgccggcagtcga

SEQ ID NO: 22018 - DNA, 33 bp, Homo sapiens; identical to SEQ ID NO: 4719

SEQ ID NO: 22019 - DNA, 20 bp, Homo sapiens
gcccatacccggccgtcgcc

SEQ ID NO: 22020 - DNA, 24 bp, Homo sapiens
gcccatacccggccgtcgccggca

SEQ ID NO: 22021 - DNA, 25 bp, Homo sapiens
gcccatacccggccgtcgccggcag

SEQ ID NO: 22022 - DNA, 26 bp, Homo sapiens
gcccatacccggccgtcgccggcagt

SEQ ID NO: 22023 - DNA, 27 bp, Homo sapiens
gcccatacccggccgtcgccggcagtc

SEQ ID NO: 22024 - DNA, 32 bp, Homo sapiens
gcccatacccggccgtcgccggcagtcgagag

SEQ ID NO: 22025 - DNA, 19 bp, Homo sapiens
cccatacccggccgtcgcc

SEQ ID NO: 22026 - DNA, 24 bp, Homo sapiens
cccatacccggccgtcgccggcag

SEQ ID NO: 22027 - DNA, 23 bp, Homo sapiens
ccatacccggccgtcgccggcag

SEQ ID NO: 22028 - DNA, 28 bp, Homo sapiens
ccatacccggccgtcgccggcagtcgag

SEQ ID NO: 22029 - DNA, 16 bp, Homo sapiens
catacccggccgtcgc

SEQ ID NO: 22030 - DNA, 17 bp, Homo sapiens
catacccggccgtcgcc

SEQ ID NO: 22031 - DNA, 18 bp, Homo sapiens
catacccggccgtcgccg

SEQ ID NO: 22032 - DNA, 31 bp, Homo sapiens
catacccggccgtcgccggcagtcgagagtg

SEQ ID NO: 22033 - DNA, 16 bp, Homo sapiens
atacccggccgtcgcc

SEQ ID NO: 22034 - DNA, 17 bp, Homo sapiens
atacccggccgtcgccg

SEQ ID NO: 22035 - DNA, 26 bp, Homo sapiens
atacccggccgtcgccggcagtcgag

SEQ ID NO: 22036 - DNA, 33 bp, Homo sapiens
atacccggccgtcgccggcagtcgagagtggac

SEQ ID NO: 22037 - DNA, 16 bp, Homo sapiens
tacccggccgtcgccg

SEQ ID NO: 22038 - DNA, 26 bp, Homo sapiens
tacccggccgtcgccggcagtcgaga

SEQ ID NO: 22039 - DNA, 27 bp, Homo sapiens
tacccggccgtcgccggcagtcgagag

SEQ ID NO: 22040 - DNA, 28 bp, Homo sapiens
tacccggccgtcgccggcagtcgagagt

SEQ ID NO: 22041 - DNA, 29 bp, Homo sapiens
tacccggccgtcgccggcagtcgagagtg

SEQ ID NO: 22042 - DNA, 31 bp, Homo sapiens
tacccggccgtcgccggcagtcgagagtgga

SEQ ID NO: 22043 - DNA, 32 bp, Homo sapiens
tacccggccgtcgccggcagtcgagagtggac

SEQ ID NO: 22044 - DNA, 33 bp, Homo sapiens
tacccggccgtcgccggcagtcgagagtggacg

SEQ ID NO: 22045 - DNA, 17 bp, Homo sapiens
acccggccgtcgccggc

SEQ ID NO: 22046 - DNA, 23 bp, Homo sapiens
cccggccgtcgccggcagtcgag

SEQ ID NO: 22047 - DNA, 24 bp, Homo sapiens
cccggccgtcgccggcagtcgaga

SEQ ID NO: 22048 - DNA, 27 bp, Homo sapiens
cccggccgtcgccggcagtcgagagtg

SEQ ID NO: 22049 - DNA, 30 bp, Homo sapiens; identical to SEQ ID NO: 4726

SEQ ID NO: 22050 - DNA, 29 bp, Homo sapiens
ccggccgtcgccggcagtcgagagtggac

SEQ ID NO: 22051 - DNA, 18 bp, Homo sapiens
cggccgtcgccggcagtc

SEQ ID NO: 22052 - DNA, 22 bp, Homo sapiens
cggccgtcgccggcagtcgaga

SEQ ID NO: 22053 - DNA, 28 bp, Homo sapiens
cggccgtcgccggcagtcgagagtggac

SEQ ID NO: 22054 - DNA, 32 bp, Homo sapiens
cggccgtcgccggcagtcgagagtggacggga

SEQ ID NO: 22055 - DNA, 17 bp, Homo sapiens
ggccgtcgccggcagtc

SEQ ID NO: 22056 - DNA, 24 bp, Homo sapiens
ggccgtcgccggcagtcgagagtg

SEQ ID NO: 22057 - DNA, 27 bp, Homo sapiens
ggccgtcgccggcagtcgagagtggac

SEQ ID NO: 22058 - DNA, 31 bp, Homo sapiens
ggccgtcgccggcagtcgagagtggacggga

SEQ ID NO: 22059 - DNA, 17 bp, Homo sapiens
ccgtcgccggcagtcga

SEQ ID NO: 22060 - DNA, 29 bp, Homo sapiens
ccgtcgccggcagtcgagagtggacggga

SEQ ID NO: 22061 - DNA, 16 bp, Homo sapiens
cgtcgccggcagtcga

SEQ ID NO: 22062 - DNA, 28 bp, Homo sapiens
cgtcgccggcagtcgagagtggacggga

SEQ ID NO: 22063 - DNA, 24 bp, Homo sapiens
tcgccggcagtcgagagtggacgg

SEQ ID NO: 22064 - DNA, 23 bp, Homo sapiens
cgccggcagtcgagagtggacgg

SEQ ID NO: 22065 - DNA, 25 bp, Homo sapiens
cgccggcagtcgagagtggacggga

SEQ ID NO: 22066 - DNA, 22 bp, Homo sapiens
gccggcagtcgagagtggacgg

SEQ ID NO: 22067 - DNA, 21 bp, Homo sapiens
ccggcagtcgagagtggacgg

SEQ ID NO: 22068 - DNA, 20 bp, Homo sapiens
cggcagtcgagagtggacgg

SEQ ID NO: 22069 - DNA, 28 bp, Homo sapiens
cggcagtcgagagtggacgggagcggcg

SEQ ID NO: 22070 - DNA, 17 bp, Homo sapiens
ggcagtcgagagtggac

SEQ ID NO: 22071 - DNA, 18 bp, Homo sapiens
ggcagtcgagagtggacg

SEQ ID NO: 22072 - DNA, 19 bp, Homo sapiens
ggcagtcgagagtggacgg

SEQ ID NO: 22073 - DNA, 22 bp, Homo sapiens
ggcagtcgagagtggacgggag

SEQ ID NO: 22074 - DNA, 25 bp, Homo sapiens
ggcagtcgagagtggacgggagcgg

SEQ ID NO: 22075 - DNA, 27 bp, Homo sapiens
ggcagtcgagagtggacgggagcggcg

SEQ ID NO: 22076 - DNA, 16 bp, Homo sapiens
gcagtcgagagtggac

SEQ ID NO: 22077 - DNA, 17 bp, Homo sapiens
gcagtcgagagtggacg

SEQ ID NO: 22078 - DNA, 18 bp, Homo sapiens
gcagtcgagagtggacgg

SEQ ID NO: 22079 - DNA, 21 bp, Homo sapiens
gcagtcgagagtggacgggag

SEQ ID NO: 22080 - DNA, 23 bp, Homo sapiens
gcagtcgagagtggacgggagcg

SEQ ID NO: 22081 - DNA, 19 bp, Homo sapiens
cagtcgagagtggacggga

SEQ ID NO: 22082 - DNA, 21 bp, Homo sapiens
cagtcgagagtggacgggagc

SEQ ID NO: 22083 - DNA, 16 bp, Homo sapiens
agtcgagagtggacgg

SEQ ID NO: 22084 - DNA, 20 bp, Homo sapiens
agtcgagagtggacgggagc

SEQ ID NO: 22085 - DNA, 17 bp, Homo sapiens
gtcgagagtggacggga

SEQ ID NO: 22086 - DNA, 19 bp, Homo sapiens
gtcgagagtggacgggagc

SEQ ID NO: 22087 - DNA, 16 bp, Homo sapiens
gagagtggacgggagc

SEQ ID NO: 22088 - DNA, 17 bp, Homo sapiens
gagagtggacgggagcg

SEQ ID NO: 22089 - DNA, 16 bp, Homo sapiens
cgggggcggcgcgcgc

SEQ ID NO: 22090 - DNA, 17 bp, Homo sapiens
cgggggcggcgcgcgcg

SEQ ID NO: 22091 - DNA, 19 bp, Homo sapiens
cgggggcggcgcgcgcgcg

SEQ ID NO: 22092 - DNA, 25 bp, Homo sapiens
cgggggcggcgcgcgcgcgcgcgcg

SEQ ID NO: 22093 - DNA, 33 bp, Homo sapiens
gcgcgcgcgcgcgcgcgtgtggtgtgcgtcgga

SEQ ID NO: 22094 - DNA, 30 bp, Homo sapiens
cgcgcgcgcgcgcgtgtggtgtgcgtcgga

SEQ ID NO: 22095 - DNA, 28 bp, Homo sapiens
cgcgcgcgcgcgtgtggtgtgcgtcgga

SEQ ID NO: 22096 - DNA, 32 bp, Homo sapiens
cgcgcgcgcgcgtgtggtgtgcgtcggagggc

SEQ ID NO: 22097 - DNA, 26 bp, Homo sapiens
cgcgcgcgcgtgtggtgtgcgtcgga

SEQ ID NO: 22098 - DNA, 30 bp, Homo sapiens
cgcgcgcgcgtgtggtgtgcgtcggagggc

SEQ ID NO: 22099 - DNA, 25 bp, Homo sapiens
gcgcgcgcgtgtggtgtgcgtcgga

SEQ ID NO: 22100 - DNA, 24 bp, Homo sapiens
cgcgcgcgtgtggtgtgcgtcgga

SEQ ID NO: 22101 - DNA, 23 bp, Homo sapiens
gcgcgcgtgtggtgtgcgtcgga

SEQ ID NO: 22102 - DNA, 22 bp, Homo sapiens
cgcgcgtgtggtgtgcgtcgga

SEQ ID NO: 22103 - DNA, 21 bp, Homo sapiens
gcgcgtgtggtgtgcgtcgga

SEQ ID NO: 22104 - DNA, 20 bp, Homo sapiens
cgcgtgtggtgtgcgtcgga

SEQ ID NO: 22105 - DNA, 19 bp, Homo sapiens
gcgtgtggtgtgcgtcgga

SEQ ID NO: 22106 - DNA, 18 bp, Homo sapiens
cgtgtggtgtgcgtcgga

SEQ ID NO: 22107 - DNA, 16 bp, Homo sapiens
tgtggtgtgcgtcgga

SEQ ID NO: 22108 - DNA, 16 bp, Homo sapiens
tgtgcgtcggagggcg

SEQ ID NO: 22109 - DNA, 18 bp, Homo sapiens
tgtgcgtcggagggcggc

SEQ ID NO: 22110 - DNA, 19 bp, Homo sapiens
gtcggagggcggcggcggc

SEQ ID NO: 22111 - DNA, 16 bp, Homo sapiens
ggagggcggcggcggc

SEQ ID NO: 22112 - DNA, 25 bp, Homo sapiens
agggcggcggcggcggcggcggcgg

SEQ ID NO: 22113 - DNA, 18 bp, Homo sapiens
gcggcggcggcggcggcg

SEQ ID NO: 22114 - DNA, 21 bp, Homo sapiens
gcggcggcggcggcggcggcg

SEQ ID NO: 22115 - DNA, 32 bp, Homo sapiens
gcggcggcggcggcggcggcgggggtgtgggg

SEQ ID NO: 22116 - DNA, 16 bp, Homo sapiens
cggcggcggcggcggc

SEQ ID NO: 22117 - DNA, 18 bp, Homo sapiens
gcggcggcggcggcggcg

SEQ ID NO: 22118 - DNA, 16 bp, Homo sapiens
cggcggcggcggcggc

SEQ ID NO: 22119 - DNA, 27 bp, Homo sapiens
gcggcggcggcggcgggggtgtggggt

SEQ ID NO: 22120 - DNA, 24 bp, Homo sapiens
cgcctcctcccctcctcccgccca

SEQ ID NO: 22121 - DNA, 20 bp, Homo sapiens
cgccccgctccccgcccccg

SEQ ID NO: 22122 - DNA, 22 bp, Homo sapiens
cgccccgctccccgcccccgga

SEQ ID NO: 22123 - DNA, 32 bp, Homo sapiens; identical to SEQ ID NO: 4732

SEQ ID NO: 22124 - DNA, 30 bp, Homo sapiens
cccgctccccgcccccggagccccgcggac

SEQ ID NO: 22125 - DNA, 29 bp, Homo sapiens
ccgctccccgcccccggagccccgcggac

SEQ ID NO: 22126 - DNA, 28 bp, Homo sapiens
cgctccccgcccccggagccccgcggac

SEQ ID NO: 22127 - DNA, 27 bp, Homo sapiens
gctccccgcccccggagccccgcggac

SEQ ID NO: 22128 - DNA, 26 bp, Homo sapiens
ctccccgcccccggagccccgcggac

SEQ ID NO: 22129 - DNA, 25 bp, Homo sapiens
tccccgcccccggagccccgcggac

SEQ ID NO: 22130 - DNA, 26 bp, Homo sapiens
tccccgcccccggagccccgcggacg

SEQ ID NO: 22131 - DNA, 24 bp, Homo sapiens
ccccgcccccggagccccgcggac

SEQ ID NO: 22132 - DNA, 25 bp, Homo sapiens
ccccgcccccggagccccgcggacg

SEQ ID NO: 22133 - DNA, 18 bp, Homo sapiens
cccgcccccggagccccg

SEQ ID NO: 22134 - DNA, 23 bp, Homo sapiens
cccgcccccggagccccgcggac

SEQ ID NO: 22135 - DNA, 24 bp, Homo sapiens
cccgcccccggagccccgcggacg

SEQ ID NO: 22136 - DNA, 17 bp, Homo sapiens
ccgcccccggagccccg

SEQ ID NO: 22137 - DNA, 22 bp, Homo sapiens
ccgcccccggagccccgcggac

SEQ ID NO: 22138 - DNA, 23 bp, Homo sapiens
ccgcccccggagccccgcggacg

SEQ ID NO: 22139 - DNA, 16 bp, Homo sapiens
cgcccccggagccccg

SEQ ID NO: 22140 - DNA, 21 bp, Homo sapiens
cgcccccggagccccgcggac

SEQ ID NO: 22141 - DNA, 22 bp, Homo sapiens
cgcccccggagccccgcggacg

SEQ ID NO: 22142 - DNA, 24 bp, Homo sapiens
cgcccccggagccccgcggacgct

SEQ ID NO: 22143 - DNA, 20 bp, Homo sapiens
gcccccggagccccgcggac

SEQ ID NO: 22144 - DNA, 17 bp, Homo sapiens
cccggagccccgcggac

SEQ ID NO: 22145 - DNA, 18 bp, Homo sapiens
cccggagccccgcggacg

SEQ ID NO: 22146 - DNA, 20 bp, Homo sapiens
cccggagccccgcggacgct

SEQ ID NO: 22147 - DNA, 22 bp, Homo sapiens
cccggagccccgcggacgctac

SEQ ID NO: 22148 - DNA, 16 bp, Homo sapiens
ccggagccccgcggac

SEQ ID NO: 22149 - DNA, 18 bp, Homo sapiens
ccggagccccgcggacgc

SEQ ID NO: 22150 - DNA, 16 bp, Homo sapiens
cggagccccgcggacg

SEQ ID NO: 22151 - DNA, 17 bp, Homo sapiens
cggagccccgcggacgc

SEQ ID NO: 22152 - DNA, 18 bp, Homo sapiens
cggagccccgcggacgct

SEQ ID NO: 22153 - DNA, 17 bp, Homo sapiens
ggagccccgcggacgct

SEQ ID NO: 22154 - DNA, 16 bp, Homo sapiens
gccccgcggacgctac

SEQ ID NO: 22155 - DNA, 17 bp, Homo sapiens
gccccgcggacgctacg

SEQ ID NO: 22156 - DNA, 18 bp, Homo sapiens
gccccgcggacgctacgc

SEQ ID NO: 22157 - DNA, 19 bp, Homo sapiens
gccccgcggacgctacgcc

SEQ ID NO: 22158 - DNA, 18 bp, Homo sapiens
ccccgcggacgctacgcc

SEQ ID NO: 22159 - DNA, 16 bp, Homo sapiens
cccgcggacgctacgc

SEQ ID NO: 22160 - DNA, 17 bp, Homo sapiens
cccgcggacgctacgcc

SEQ ID NO: 22161 - DNA, 16 bp, Homo sapiens
cgcggacgctacgccg

SEQ ID NO: 22162 - DNA, 18 bp, Homo sapiens
cggacgctacgccgcgac

SEQ ID NO: 22163 - DNA, 26 bp, Homo sapiens
cggacgctacgccgcgacgagtagga

SEQ ID NO: 22164 - DNA, 25 bp, Homo sapiens
ggacgctacgccgcgacgagtagga

SEQ ID NO: 22165 - DNA, 24 bp, Homo sapiens
gacgctacgccgcgacgagtagga

SEQ ID NO: 22166 - DNA, 23 bp, Homo sapiens
acgctacgccgcgacgagtagga

SEQ ID NO: 22167 - DNA, 16 bp, Homo sapiens
cgctacgccgcgacga

SEQ ID NO: 22168 - DNA, 19 bp, Homo sapiens
cgctacgccgcgacgagta

SEQ ID NO: 22169 - DNA, 20 bp, Homo sapiens
cgctacgccgcgacgagtag

SEQ ID NO: 22170 - DNA, 22 bp, Homo sapiens
cgctacgccgcgacgagtagga

SEQ ID NO: 22171 - DNA, 26 bp, Homo sapiens
cgctacgccgcgacgagtaggagggc

SEQ ID NO: 22172 - DNA, 27 bp, Homo sapiens
cgctacgccgcgacgagtaggagggcc

SEQ ID NO: 22173 - DNA, 33 bp, Homo sapiens
cgctacgccgcgacgagtaggagggccgctgcg

SEQ ID NO: 22174 - DNA, 16 bp, Homo sapiens
gctacgccgcgacgag

SEQ ID NO: 22175 - DNA, 21 bp, Homo sapiens
gctacgccgcgacgagtagga

SEQ ID NO: 22176 - DNA, 26 bp, Homo sapiens
gctacgccgcgacgagtaggagggcc

SEQ ID NO: 22177 - DNA, 32 bp, Homo sapiens
gctacgccgcgacgagtaggagggccgctgcg

SEQ ID NO: 22178 - DNA, 33 bp, Homo sapiens
gctacgccgcgacgagtaggagggccgctgcgg

SEQ ID NO: 22179 - DNA, 17 bp, Homo sapiens
ctacgccgcgacgagta

SEQ ID NO: 22180 - DNA, 20 bp, Homo sapiens
ctacgccgcgacgagtagga

SEQ ID NO: 22181 - DNA, 25 bp, Homo sapiens
ctacgccgcgacgagtaggagggcc

SEQ ID NO: 22182 - DNA, 31 bp, Homo sapiens
ctacgccgcgacgagtaggagggccgctgcg

SEQ ID NO: 22183 - DNA, 32 bp, Homo sapiens
ctacgccgcgacgagtaggagggccgctgcgg

SEQ ID NO: 22184 - DNA, 19 bp, Homo sapiens
tacgccgcgacgagtagga

SEQ ID NO: 22185 - DNA, 18 bp, Homo sapiens
acgccgcgacgagtagga

SEQ ID NO: 22186 - DNA, 16 bp, Homo sapiens
cgccgcgacgagtagg

SEQ ID NO: 22187 - DNA, 17 bp, Homo sapiens
cgccgcgacgagtagga

SEQ ID NO: 22188 - DNA, 18 bp, Homo sapiens
cgccgcgacgagtaggag

SEQ ID NO: 22189 - DNA, 19 bp, Homo sapiens
cgccgcgacgagtaggagg

SEQ ID NO: 22190 - DNA, 20 bp, Homo sapiens
cgccgcgacgagtaggaggg

SEQ ID NO: 22191 - DNA, 21 bp, Homo sapiens
cgccgcgacgagtaggagggc

SEQ ID NO: 22192 - DNA, 29 bp, Homo sapiens
cgccgcgacgagtaggagggccgctgcgg

SEQ ID NO: 22193 - DNA, 16 bp, Homo sapiens
gccgcgacgagtagga

SEQ ID NO: 22194 - DNA, 33 bp, Homo sapiens
ccgcgacgagtaggagggccgctgcggtgagcc

SEQ ID NO: 22195 - DNA, 39 bp, Homo sapiens
gcgacgagtaggagggccgctgcggtgagccttgaagcc

SEQ ID NO: 22196 - DNA, 38 bp, Homo sapiens
cgacgagtaggagggccgctgcggtgagccttgaagcc

SEQ ID NO: 22197 - DNA, 36 bp, Homo sapiens
acgagtaggagggccgctgcggtgagccttgaagcc

SEQ ID NO: 22198 - DNA, 24 bp, Homo sapiens
cgagtaggagggccgctgcggtga

SEQ ID NO: 22199 - DNA, 33 bp, Homo sapiens
agtaggagggccgctgcggtgagccttgaagcc

SEQ ID NO: 22200 - DNA, 21 bp, Homo sapiens
gtaggagggccgctgcggtga

SEQ ID NO: 22201 - DNA, 16 bp, Homo sapiens
aggagggccgctgcgg

SEQ ID NO: 22202 - DNA, 17 bp, Homo sapiens
aggagggccgctgcggt

SEQ ID NO: 22203 - DNA, 16 bp, Homo sapiens
ggagggccgctgcggt

SEQ ID NO: 22204 - DNA, 18 bp, Homo sapiens
ggagggccgctgcggtga

SEQ ID NO: 22205 - DNA, 31 bp, Homo sapiens
ggagggccgctgcggtgagccttgaagccta

SEQ ID NO: 22206 - DNA, 32 bp, Homo sapiens
gagggccgctgcggtgagccttgaagcctagg

SEQ ID NO: 22207 - DNA, 33 bp, Homo sapiens
gagggccgctgcggtgagccttgaagcctaggg

SEQ ID NO: 22208 - DNA, 28 bp, Homo sapiens
agggccgctgcggtgagccttgaagcct

SEQ ID NO: 22209 - DNA, 31 bp, Homo sapiens; identical to SEQ ID NO: 4741

SEQ ID NO: 22210 - DNA, 32 bp, Homo sapiens; identical to SEQ ID NO: 4742

SEQ ID NO: 22211 - DNA, 33 bp, Homo sapiens; identical to SEQ ID NO: 4743

SEQ ID NO: 22212 - DNA, 31 bp, Homo sapiens
gggccgctgcggtgagccttgaagcctaggg

SEQ ID NO: 22213 - DNA, 32 bp, Homo sapiens
gggccgctgcggtgagccttgaagcctagggc

SEQ ID NO: 22214 - DNA, 25 bp, Homo sapiens
gccgctgcggtgagccttgaagcct

SEQ ID NO: 22215 - DNA, 26 bp, Homo sapiens
gccgctgcggtgagccttgaagccta

SEQ ID NO: 22216 - DNA, 24 bp, Homo sapiens
ccgctgcggtgagccttgaagcct

SEQ ID NO: 22217 - DNA, 25 bp, Homo sapiens
ccgctgcggtgagccttgaagccta

SEQ ID NO: 22218 - DNA, 31 bp, Homo sapiens
ccgctgcggtgagccttgaagcctagggcgc

SEQ ID NO: 22219 - DNA, 24 bp, Homo sapiens
cgctgcggtgagccttgaagccta

SEQ ID NO: 22220 - DNA, 22 bp, Homo sapiens
gctgcggtgagccttgaagcct

SEQ ID NO: 22221 - DNA, 23 bp, Homo sapiens
gctgcggtgagccttgaagccta

SEQ ID NO: 22222 - DNA, 29 bp, Homo sapiens
gctgcggtgagccttgaagcctagggcgc

SEQ ID NO: 22223 - DNA, 20 bp, Homo sapiens
ctgcggtgagccttgaagcc

SEQ ID NO: 22224 - DNA, 21 bp, Homo sapiens
ctgcggtgagccttgaagcct

SEQ ID NO: 22225 - DNA, 22 bp, Homo sapiens
ctgcggtgagccttgaagccta

SEQ ID NO: 22226 - DNA, 20 bp, Homo sapiens
tgcggtgagccttgaagcct

SEQ ID NO: 22227 - DNA, 21 bp, Homo sapiens
tgcggtgagccttgaagccta

SEQ ID NO: 22228 - DNA, 19 bp, Homo sapiens
gcggtgagccttgaagcct

SEQ ID NO: 22229 - DNA, 20 bp, Homo sapiens
gcggtgagccttgaagccta

SEQ ID NO: 22230 - DNA, 26 bp, Homo sapiens
gcggtgagccttgaagcctagggcgc

SEQ ID NO: 22231 - DNA, 17 bp, Homo sapiens
cggtgagccttgaagcc

SEQ ID NO: 22232 - DNA, 18 bp, Homo sapiens
cggtgagccttgaagcct

SEQ ID NO: 22233 - DNA, 19 bp, Homo sapiens
cggtgagccttgaagccta

SEQ ID NO: 22234 - DNA, 25 bp, Homo sapiens
cggtgagccttgaagcctagggcgc

SEQ ID NO: 22235 - DNA, 17 bp, Homo sapiens
ggtgagccttgaagcct

SEQ ID NO: 22236 - DNA, 16 bp, Homo sapiens
gtgagccttgaagcct

SEQ ID NO: 22237 - DNA, 16 bp, Homo sapiens
ccttgaagcctagggc

SEQ ID NO: 22238 - DNA, 16 bp, Homo sapiens
agcctagggcgcgggc

SEQ ID NO: 22239 - DNA, 17 bp, Homo sapiens
agggcgcgggcccgggt

SEQ ID NO: 22240 - DNA, 19 bp, Homo sapiens
gggcgcgggcccgggtgga

SEQ ID NO: 22241 - DNA, 16 bp, Homo sapiens
cgcgggcccgggtgga

SEQ ID NO: 22242 - DNA, 18 bp, Homo sapiens
gcgggcccgggtggagcc

SEQ ID NO: 22243 - DNA, 25 bp, Homo sapiens
gggcccgggtggagccgccgcaggt

SEQ ID NO: 22244 - DNA, 27 bp, Homo sapiens
gagccgccgcaggtgcagatcttggtg

SEQ ID NO: 22245 - DNA, 25 bp, Homo sapiens
gccgccgcaggtgcagatcttggtg

SEQ ID NO: 22246 - DNA, 16 bp, Homo sapiens
ggtgcagatcttggtg

SEQ ID NO: 22247 - DNA, 19 bp, Homo sapiens
ggtgcagatcttggtggta

SEQ ID NO: 22248 - DNA, 25 bp, Homo sapiens
ggtgcagatcttggtggtagtagca

SEQ ID NO: 22249 - DNA, 24 bp, Homo sapiens
gtgcagatcttggtggtagtagca

SEQ ID NO: 22250 - DNA, 19 bp, Homo sapiens
gatcttggtggtagtagca

SEQ ID NO: 22251 - DNA, 17 bp, Homo sapiens
tcttggtggtagtagca

SEQ ID NO: 22252 - DNA, 18 bp, Homo sapiens
tcttggtggtagtagcaa

SEQ ID NO: 22253 - DNA, 19 bp, Homo sapiens
tcttggtggtagtagcaaa

SEQ ID NO: 22254 - DNA, 21 bp, Homo sapiens
tcttggtggtagtagcaaata

SEQ ID NO: 22255 - DNA, 30 bp, Homo sapiens
tcttggtggtagtagcaaatattcaaacga

SEQ ID NO: 22256 - DNA, 32 bp, Homo sapiens
tcttggtggtagtagcaaatattcaaacgaga

SEQ ID NO: 22257 - DNA, 33 bp, Homo sapiens
tcttggtggtagtagcaaatattcaaacgagaa

SEQ ID NO: 22258 - DNA, 23 bp, Homo sapiens
cttggtggtagtagcaaatattc

SEQ ID NO: 22259 - DNA, 33 bp, Homo sapiens
ggtagtagcaaatattcaaacgagaactttgaa

SEQ ID NO: 22260 - DNA, 32 bp, Homo sapiens
gtagtagcaaatattcaaacgagaactttgaa

SEQ ID NO: 22261 - DNA, 30 bp, Homo sapiens
agtagcaaatattcaaacgagaactttgaa

SEQ ID NO: 22262 - DNA, 29 bp, Homo sapiens
gtagcaaatattcaaacgagaactttgaa

SEQ ID NO: 22263 - DNA, 33 bp, Homo sapiens
gtagcaaatattcaaacgagaactttgaaggcc

SEQ ID NO: 22264 - DNA, 28 bp, Homo sapiens
tagcaaatattcaaacgagaactttgaa

SEQ ID NO: 22265 - DNA, 32 bp, Homo sapiens
tagcaaatattcaaacgagaactttgaaggcc

SEQ ID NO: 22266 - DNA, 36 bp, Homo sapiens
tagcaaatattcaaacgagaactttgaaggccgaag

SEQ ID NO: 22267 - DNA, 27 bp, Homo sapiens
agcaaatattcaaacgagaactttgaa

SEQ ID NO: 22268 - DNA, 31 bp, Homo sapiens
agcaaatattcaaacgagaactttgaaggcc

SEQ ID NO: 22269 - DNA, 35 bp, Homo sapiens
agcaaatattcaaacgagaactttgaaggccgaag

SEQ ID NO: 22270 - DNA, 30 bp, Homo sapiens
gcaaatattcaaacgagaactttgaaggcc

SEQ ID NO: 22271 - DNA, 34 bp, Homo sapiens
gcaaatattcaaacgagaactttgaaggccgaag

SEQ ID NO: 22272 - DNA, 29 bp, Homo sapiens
caaatattcaaacgagaactttgaaggcc

SEQ ID NO: 22273 - DNA, 33 bp, Homo sapiens; identical to SEQ ID NO: 4745

SEQ ID NO: 22274 - DNA, 31 bp, Homo sapiens
aaatattcaaacgagaactttgaaggccgaa

SEQ ID NO: 22275 - DNA, 32 bp, Homo sapiens; identical to SEQ ID NO: 4746

SEQ ID NO: 22276 - DNA, 18 bp, Homo sapiens
aatattcaaacgagaact

SEQ ID NO: 22277 - DNA, 22 bp, Homo sapiens
aatattcaaacgagaactttga

SEQ ID NO: 22278 - DNA, 23 bp, Homo sapiens
aatattcaaacgagaactttgaa

SEQ ID NO: 22279 - DNA, 27 bp, Homo sapiens
aatattcaaacgagaactttgaaggcc

SEQ ID NO: 22280 - DNA, 28 bp, Homo sapiens
aatattcaaacgagaactttgaaggccg

SEQ ID NO: 22281 - DNA, 29 bp, Homo sapiens
aatattcaaacgagaactttgaaggccga

SEQ ID NO: 22282 - DNA, 30 bp, Homo sapiens
aatattcaaacgagaactttgaaggccgaa

SEQ ID NO: 22283 - DNA, 31 bp, Homo sapiens; identical to SEQ ID NO: 4748

SEQ ID NO: 22284 - DNA, 32 bp, Homo sapiens
aatattcaaacgagaactttgaaggccgaagt

SEQ ID NO: 22285 - DNA, 17 bp, Homo sapiens
atattcaaacgagaact

SEQ ID NO: 22286 - DNA, 21 bp, Homo sapiens
atattcaaacgagaactttga

SEQ ID NO: 22287 - DNA, 22 bp, Homo sapiens
atattcaaacgagaactttgaa

SEQ ID NO: 22288 - DNA, 26 bp, Homo sapiens
atattcaaacgagaactttgaaggcc

SEQ ID NO: 22289 - DNA, 27 bp, Homo sapiens
atattcaaacgagaactttgaaggccg

SEQ ID NO: 22290 - DNA, 28 bp, Homo sapiens
atattcaaacgagaactttgaaggccga

SEQ ID NO: 22291 - DNA, 29 bp, Homo sapiens
atattcaaacgagaactttgaaggccgaa

SEQ ID NO: 22292 - DNA, 30 bp, Homo sapiens; identical to SEQ ID NO: 4751

SEQ ID NO: 22293 - DNA, 31 bp, Homo sapiens
atattcaaacgagaactttgaaggccgaagt

SEQ ID NO: 22294 - DNA, 32 bp, Homo sapiens
atattcaaacgagaactttgaaggccgaagtg

SEQ ID NO: 22295 - DNA, 16 bp, Homo sapiens
tattcaaacgagaact

SEQ ID NO: 22296 - DNA, 20 bp, Homo sapiens
tattcaaacgagaactttga

SEQ ID NO: 22297 - DNA, 21 bp, Homo sapiens
tattcaaacgagaactttgaa

SEQ ID NO: 22298 - DNA, 25 bp, Homo sapiens
tattcaaacgagaactttgaaggcc

SEQ ID NO: 22299 - DNA, 26 bp, Homo sapiens
tattcaaacgagaactttgaaggccg

SEQ ID NO: 22300 - DNA, 27 bp, Homo sapiens
tattcaaacgagaactttgaaggccga

SEQ ID NO: 22301 - DNA, 28 bp, Homo sapiens
tattcaaacgagaactttgaaggccgaa

SEQ ID NO: 22302 - DNA, 29 bp, Homo sapiens
tattcaaacgagaactttgaaggccgaag

SEQ ID NO: 22303 - DNA, 30 bp, Homo sapiens
tattcaaacgagaactttgaaggccgaagt

SEQ ID NO: 22304 - DNA, 31 bp, Homo sapiens
tattcaaacgagaactttgaaggccgaagtg

SEQ ID NO: 22305 - DNA, 19 bp, Homo sapiens
attcaaacgagaactttga

SEQ ID NO: 22306 - DNA, 20 bp, Homo sapiens
attcaaacgagaactttgaa

SEQ ID NO: 22307 - DNA, 23 bp, Homo sapiens
attcaaacgagaactttgaaggc

SEQ ID NO: 22308 - DNA, 24 bp, Homo sapiens
attcaaacgagaactttgaaggcc

SEQ ID NO: 22309 - DNA, 25 bp, Homo sapiens
attcaaacgagaactttgaaggccg

SEQ ID NO: 22310 - DNA, 26 bp, Homo sapiens
attcaaacgagaactttgaaggccga

SEQ ID NO: 22311 - DNA, 27 bp, Homo sapiens
attcaaacgagaactttgaaggccgaa

SEQ ID NO: 22312 - DNA, 28 bp, Homo sapiens
attcaaacgagaactttgaaggccgaag

SEQ ID NO: 22313 - DNA, 29 bp, Homo sapiens
attcaaacgagaactttgaaggccgaagt

SEQ ID NO: 22314 - DNA, 30 bp, Homo sapiens; identical to SEQ ID NO: 4759

SEQ ID NO: 22315 - DNA, 31 bp, Homo sapiens
attcaaacgagaactttgaaggccgaagtgg

SEQ ID NO: 22316 - DNA, 35 bp, Homo sapiens
attcaaacgagaactttgaaggccgaagtggagaa

SEQ ID NO: 22317 - DNA, 18 bp, Homo sapiens
ttcaaacgagaactttga

SEQ ID NO: 22318 - DNA, 19 bp, Homo sapiens
ttcaaacgagaactttgaa

SEQ ID NO: 22319 - DNA, 22 bp, Homo sapiens
ttcaaacgagaactttgaaggc

SEQ ID NO: 22320 - DNA, 23 bp, Homo sapiens
ttcaaacgagaactttgaaggcc

SEQ ID NO: 22321 - DNA, 24 bp, Homo sapiens
ttcaaacgagaactttgaaggccg

SEQ ID NO: 22322 - DNA, 25 bp, Homo sapiens
ttcaaacgagaactttgaaggccga

SEQ ID NO: 22323 - DNA, 26 bp, Homo sapiens
ttcaaacgagaactttgaaggccgaa

SEQ ID NO: 22324 - DNA, 27 bp, Homo sapiens
ttcaaacgagaactttgaaggccgaag

SEQ ID NO: 22325 - DNA, 28 bp, Homo sapiens
ttcaaacgagaactttgaaggccgaagt

SEQ ID NO: 22326 - DNA, 29 bp, Homo sapiens
ttcaaacgagaactttgaaggccgaagtg

SEQ ID NO: 22327 - DNA, 30 bp, Homo sapiens
ttcaaacgagaactttgaaggccgaagtgg

SEQ ID NO: 22328 - DNA, 31 bp, Homo sapiens
ttcaaacgagaactttgaaggccgaagtgga

SEQ ID NO: 22329 - DNA, 33 bp, Homo sapiens; identical to SEQ ID NO: 4767

SEQ ID NO: 22330 - DNA, 34 bp, Homo sapiens
ttcaaacgagaactttgaaggccgaagtggagaa

SEQ ID NO: 22331 - DNA, 38 bp, Homo sapiens
ttcaaacgagaactttgaaggccgaagtggagaagggt

SEQ ID NO: 22332 - DNA, 17 bp, Homo sapiens
tcaaacgagaactttga

SEQ ID NO: 22333 - DNA, 18 bp, Homo sapiens
tcaaacgagaactttgaa

SEQ ID NO: 22334 - DNA, 19 bp, Homo sapiens
tcaaacgagaactttgaag

SEQ ID NO: 22335 - DNA, 20 bp, Homo sapiens
tcaaacgagaactttgaagg

SEQ ID NO: 22336 - DNA, 21 bp, Homo sapiens
tcaaacgagaactttgaaggc

SEQ ID NO: 22337 - DNA, 22 bp, Homo sapiens
tcaaacgagaactttgaaggcc

SEQ ID NO: 22338 - DNA, 23 bp, Homo sapiens
tcaaacgagaactttgaaggccg

SEQ ID NO: 22339 - DNA, 24 bp, Homo sapiens
tcaaacgagaactttgaaggccga

SEQ ID NO: 22340 - DNA, 25 bp, Homo sapiens
tcaaacgagaactttgaaggccgaa

SEQ ID NO: 22341 - DNA, 26 bp, Homo sapiens
tcaaacgagaactttgaaggccgaag

SEQ ID NO: 22342 - DNA, 27 bp, Homo sapiens
tcaaacgagaactttgaaggccgaagt

SEQ ID NO: 22343 - DNA, 28 bp, Homo sapiens
tcaaacgagaactttgaaggccgaagtg

SEQ ID NO: 22344 - DNA, 29 bp, Homo sapiens
tcaaacgagaactttgaaggccgaagtgg

SEQ ID NO: 22345 - DNA, 30 bp, Homo sapiens
tcaaacgagaactttgaaggccgaagtgga

SEQ ID NO: 22346 - DNA, 32 bp, Homo sapiens; identical to SEQ ID NO: 4777

SEQ ID NO: 22347 - DNA, 33 bp, Homo sapiens; identical to SEQ ID NO: 4778

SEQ ID NO: 22348 - DNA, 34 bp, Homo sapiens
tcaaacgagaactttgaaggccgaagtggagaag

SEQ ID NO: 22349 - DNA, 35 bp, Homo sapiens
tcaaacgagaactttgaaggccgaagtggagaagg

SEQ ID NO: 22350 - DNA, 37 bp, Homo sapiens
tcaaacgagaactttgaaggccgaagtggagaagggt

SEQ ID NO: 22351 - DNA, 16 bp, Homo sapiens
caaacgagaactttga

SEQ ID NO: 22352 - DNA, 17 bp, Homo sapiens
caaacgagaactttgaa

SEQ ID NO: 22353 - DNA, 18 bp, Homo sapiens
caaacgagaactttgaag

SEQ ID NO: 22354 - DNA, 19 bp, Homo sapiens
caaacgagaactttgaagg

SEQ ID NO: 22355 - DNA, 20 bp, Homo sapiens
caaacgagaactttgaaggc

SEQ ID NO: 22356 - DNA, 21 bp, Homo sapiens
caaacgagaactttgaaggcc

SEQ ID NO: 22357 - DNA, 22 bp, Homo sapiens
caaacgagaactttgaaggccg

SEQ ID NO: 22358 - DNA, 23 bp, Homo sapiens
caaacgagaactttgaaggccga

SEQ ID NO: 22359 - DNA, 24 bp, Homo sapiens
caaacgagaactttgaaggccgaa

SEQ ID NO: 22360 - DNA, 25 bp, Homo sapiens
caaacgagaactttgaaggccgaag

SEQ ID NO: 22361 - DNA, 26 bp, Homo sapiens
caaacgagaactttgaaggccgaagt

SEQ ID NO: 22362 - DNA, 27 bp, Homo sapiens
caaacgagaactttgaaggccgaagtg

SEQ ID NO: 22363 - DNA, 28 bp, Homo sapiens
caaacgagaactttgaaggccgaagtgg

SEQ ID NO: 22364 - DNA, 29 bp, Homo sapiens
caaacgagaactttgaaggccgaagtgga

SEQ ID NO: 22365 - DNA, 30 bp, Homo sapiens
caaacgagaactttgaaggccgaagtggag

SEQ ID NO: 22366 - DNA, 31 bp, Homo sapiens; identical to SEQ ID NO: 4791

SEQ ID NO: 22367 - DNA, 32 bp, Homo sapiens; identical to SEQ ID NO: 4792

SEQ ID NO: 22368 - DNA, 33 bp, Homo sapiens; identical to SEQ ID NO: 4793

SEQ ID NO: 22369 - DNA, 34 bp, Homo sapiens
caaacgagaactttgaaggccgaagtggagaagg

SEQ ID NO: 22370 - DNA, 35 bp, Homo sapiens
caaacgagaactttgaaggccgaagtggagaaggg

SEQ ID NO: 22371 - DNA, 36 bp, Homo sapiens
caaacgagaactttgaaggccgaagtggagaagggt

SEQ ID NO: 22372 - DNA, 37 bp, Homo sapiens
caaacgagaactttgaaggccgaagtggagaagggtt

SEQ ID NO: 22373 - DNA, 38 bp, Homo sapiens
caaacgagaactttgaaggccgaagtggagaagggttc

SEQ ID NO: 22374 - DNA, 46 bp, Homo sapiens
caaacgagaactttgaaggccgaagtggagaagggttccatgtgaa

SEQ ID NO: 22375 - DNA, 16 bp, Homo sapiens
aaacgagaactttgaa

SEQ ID NO: 22376 - DNA, 17 bp, Homo sapiens
aaacgagaactttgaag

SEQ ID NO: 22377 - DNA, 18 bp, Homo sapiens
aaacgagaactttgaagg

SEQ ID NO: 22378 - DNA, 19 bp, Homo sapiens
aaacgagaactttgaaggc

SEQ ID NO: 22379 - DNA, 20 bp, Homo sapiens
aaacgagaactttgaaggcc

SEQ ID NO: 22380 - DNA, 21 bp, Homo sapiens
aaacgagaactttgaaggccg

SEQ ID NO: 22381 - DNA, 22 bp, Homo sapiens
aaacgagaactttgaaggccga

SEQ ID NO: 22382 - DNA, 23 bp, Homo sapiens
aaacgagaactttgaaggccgaa

SEQ ID NO: 22383 - DNA, 24 bp, Homo sapiens
aaacgagaactttgaaggccgaag

SEQ ID NO: 22384 - DNA, 25 bp, Homo sapiens
aaacgagaactttgaaggccgaagt

SEQ ID NO: 22385 - DNA, 26 bp, Homo sapiens
aaacgagaactttgaaggccgaagtg

SEQ ID NO: 22386 - DNA, 27 bp, Homo sapiens
aaacgagaactttgaaggccgaagtgg

SEQ ID NO: 22387 - DNA, 28 bp, Homo sapiens
aaacgagaactttgaaggccgaagtgga

SEQ ID NO: 22388 - DNA, 29 bp, Homo sapiens
aaacgagaactttgaaggccgaagtggag

SEQ ID NO: 22389 - DNA, 30 bp, Homo sapiens; identical to SEQ ID NO: 4808

SEQ ID NO: 22390 - DNA, 31 bp, Homo sapiens; identical to SEQ ID NO: 4809

SEQ ID NO: 22391 - DNA, 32 bp, Homo sapiens; identical to SEQ ID NO: 4810

SEQ ID NO: 22392 - DNA, 33 bp, Homo sapiens; identical to SEQ ID NO: 4811

SEQ ID NO: 22393 - DNA, 34 bp, Homo sapiens
aaacgagaactttgaaggccgaagtggagaaggg

SEQ ID NO: 22394 - DNA, 35 bp, Homo sapiens
aaacgagaactttgaaggccgaagtggagaagggt

SEQ ID NO: 22395 - DNA, 36 bp, Homo sapiens
aaacgagaactttgaaggccgaagtggagaagggtt

SEQ ID NO: 22396 - DNA, 37 bp, Homo sapiens
aaacgagaactttgaaggccgaagtggagaagggttc

SEQ ID NO: 22397 - DNA, 38 bp, Homo sapiens
aaacgagaactttgaaggccgaagtggagaagggttcc

SEQ ID NO: 22398 - DNA, 39 bp, Homo sapiens
aaacgagaactttgaaggccgaagtggagaagggttcca

SEQ ID NO: 22399 - DNA, 40 bp, Homo sapiens
aaacgagaactttgaaggccgaagtggagaagggttccat

SEQ ID NO: 22400 - DNA, 41 bp, Homo sapiens
aaacgagaactttgaaggccgaagtggagaagggttccatg

SEQ ID NO: 22401 - DNA, 42 bp, Homo sapiens
aaacgagaactttgaaggccgaagtggagaagggttccatgt

SEQ ID NO: 22402 - DNA, 43 bp, Homo sapiens
aaacgagaactttgaaggccgaagtggagaagggttccatgtg

SEQ ID NO: 22403 - DNA, 44 bp, Homo sapiens
aaacgagaactttgaaggccgaagtggagaagggttccatgtga

SEQ ID NO: 22404 - DNA, 45 bp, Homo sapiens
aaacgagaactttgaaggccgaagtggagaagggttccatgtgaa

SEQ ID NO: 22405 - DNA, 46 bp, Homo sapiens
aaacgagaactttgaaggccgaagtggagaagggttccatgtgaac

SEQ ID NO: 22406 - DNA, 47 bp, Homo sapiens
aaacgagaactttgaaggccgaagtggagaagggttccatgtgaaca

SEQ ID NO: 22407 - DNA, 16 bp, Homo sapiens
aacgagaactttgaag

SEQ ID NO: 22408 - DNA, 17 bp, Homo sapiens
aacgagaactttgaagg

SEQ ID NO: 22409 - DNA, 18 bp, Homo sapiens
aacgagaactttgaaggc

SEQ ID NO: 22410 - DNA, 19 bp, Homo sapiens
aacgagaactttgaaggcc

SEQ ID NO: 22411 - DNA, 20 bp, Homo sapiens
aacgagaactttgaaggccg

SEQ ID NO: 22412 - DNA, 21 bp, Homo sapiens
aacgagaactttgaaggccga

SEQ ID NO: 22413 - DNA, 22 bp, Homo sapiens
aacgagaactttgaaggccgaa

SEQ ID NO: 22414 - DNA, 23 bp, Homo sapiens
aacgagaactttgaaggccgaag

SEQ ID NO: 22415 - DNA, 24 bp, Homo sapiens
aacgagaactttgaaggccgaagt

SEQ ID NO: 22416 - DNA, 25 bp, Homo sapiens
aacgagaactttgaaggccgaagtg

SEQ ID NO: 22417 - DNA, 26 bp, Homo sapiens
aacgagaactttgaaggccgaagtgg

SEQ ID NO: 22418 - DNA, 27 bp, Homo sapiens
aacgagaactttgaaggccgaagtgga

SEQ ID NO: 22419 - DNA, 28 bp, Homo sapiens
aacgagaactttgaaggccgaagtggag

SEQ ID NO: 22420 - DNA, 29 bp, Homo sapiens
aacgagaactttgaaggccgaagtggaga

SEQ ID NO: 22421 - DNA, 30 bp, Homo sapiens; identical to SEQ ID NO: 4826

SEQ ID NO: 22422 - DNA, 31 bp, Homo sapiens; identical to SEQ ID NO: 4827

SEQ ID NO: 22423 - DNA, 32 bp, Homo sapiens; identical to SEQ ID NO: 4828

SEQ ID NO: 22424 - DNA, 33 bp, Homo sapiens; identical to SEQ ID NO: 4829

SEQ ID NO: 22425 - DNA, 34 bp, Homo sapiens
aacgagaactttgaaggccgaagtggagaagggt

SEQ ID NO: 22426 - DNA, 35 bp, Homo sapiens
aacgagaactttgaaggccgaagtggagaagggtt

SEQ ID NO: 22427 - DNA, 36 bp, Homo sapiens
aacgagaactttgaaggccgaagtggagaagggttc

SEQ ID NO: 22428 - DNA, 37 bp, Homo sapiens
aacgagaactttgaaggccgaagtggagaagggttcc

SEQ ID NO: 22429 - DNA, 38 bp, Homo sapiens
aacgagaactttgaaggccgaagtggagaagggttcca

SEQ ID NO: 22430 - DNA, 39 bp, Homo sapiens
aacgagaactttgaaggccgaagtggagaagggttccat

SEQ ID NO: 22431 - DNA, 40 bp, Homo sapiens
aacgagaactttgaaggccgaagtggagaagggttccatg

SEQ ID NO: 22432 - DNA, 41 bp, Homo sapiens
aacgagaactttgaaggccgaagtggagaagggttccatgt

SEQ ID NO: 22433 - DNA, 42 bp, Homo sapiens
aacgagaactttgaaggccgaagtggagaagggttccatgtg

SEQ ID NO: 22434 - DNA, 43 bp, Homo sapiens
aacgagaactttgaaggccgaagtggagaagggttccatgtga

SEQ ID NO: 22435 - DNA, 44 bp, Homo sapiens
aacgagaactttgaaggccgaagtggagaagggttccatgtgaa

SEQ ID NO: 22436 - DNA, 45 bp, Homo sapiens
aacgagaactttgaaggccgaagtggagaagggttccatgtgaac

SEQ ID NO: 22437 - DNA, 46 bp, Homo sapiens
aacgagaactttgaaggccgaagtggagaagggttccatgtgaaca

SEQ ID NO: 22438 - DNA, 16 bp, Homo sapiens
acgagaactttgaagg

SEQ ID NO: 22439 - DNA, 17 bp, Homo sapiens
acgagaactttgaaggc

SEQ ID NO: 22440 - DNA, 18 bp, Homo sapiens
acgagaactttgaaggcc

SEQ ID NO: 22441 - DNA, 19 bp, Homo sapiens
acgagaactttgaaggccg

SEQ ID NO: 22442 - DNA, 20 bp, Homo sapiens
acgagaactttgaaggccga

SEQ ID NO: 22443 - DNA, 21 bp, Homo sapiens
acgagaactttgaaggccgaa

SEQ ID NO: 22444 - DNA, 22 bp, Homo sapiens
acgagaactttgaaggccgaag

SEQ ID NO: 22445 - DNA, 23 bp, Homo sapiens
acgagaactttgaaggccgaagt

SEQ ID NO: 22446 - DNA, 24 bp, Homo sapiens
acgagaactttgaaggccgaagtg

SEQ ID NO: 22447 - DNA, 25 bp, Homo sapiens
acgagaactttgaaggccgaagtgg

SEQ ID NO: 22448 - DNA, 26 bp, Homo sapiens
acgagaactttgaaggccgaagtgga

SEQ ID NO: 22449 - DNA, 27 bp, Homo sapiens
acgagaactttgaaggccgaagtggag

SEQ ID NO: 22450 - DNA, 28 bp, Homo sapiens
acgagaactttgaaggccgaagtggaga

SEQ ID NO: 22451 - DNA, 29 bp, Homo sapiens
acgagaactttgaaggccgaagtggagaa

SEQ ID NO: 22452 - DNA, 30 bp, Homo sapiens; identical to SEQ ID NO: 4843

SEQ ID NO: 22453 - DNA, 31 bp, Homo sapiens; identical to SEQ ID NO: 4844

SEQ ID NO: 22454 - DNA, 32 bp, Homo sapiens; identical to SEQ ID NO: 4845

SEQ ID NO: 22455 - DNA, 33 bp, Homo sapiens; identical to SEQ ID NO: 4846

SEQ ID NO: 22456 - DNA, 34 bp, Homo sapiens
acgagaactttgaaggccgaagtggagaagggtt

SEQ ID NO: 22457 - DNA, 35 bp, Homo sapiens
acgagaactttgaaggccgaagtggagaagggttc

SEQ ID NO: 22458 - DNA, 36 bp, Homo sapiens
acgagaactttgaaggccgaagtggagaagggttcc

SEQ ID NO: 22459 - DNA, 40 bp, Homo sapiens
acgagaactttgaaggccgaagtggagaagggttccatgt

SEQ ID NO: 22460 - DNA, 42 bp, Homo sapiens
acgagaactttgaaggccgaagtggagaagggttccatgtga

SEQ ID NO: 22461 - DNA, 43 bp, Homo sapiens
acgagaactttgaaggccgaagtggagaagggttccatgtgaa

SEQ ID NO: 22462 - DNA, 44 bp, Homo sapiens
acgagaactttgaaggccgaagtggagaagggttccatgtgaac

SEQ ID NO: 22463 - DNA, 45 bp, Homo sapiens
acgagaactttgaaggccgaagtggagaagggttccatgtgaaca

SEQ ID NO: 22464 - DNA, 16 bp, Homo sapiens
cgagaactttgaaggc

SEQ ID NO: 22465 - DNA, 17 bp, Homo sapiens
cgagaactttgaaggcc

SEQ ID NO: 22466 - DNA, 18 bp, Homo sapiens
cgagaactttgaaggccg

SEQ ID NO: 22467 - DNA, 19 bp, Homo sapiens
cgagaactttgaaggccga

SEQ ID NO: 22468 - DNA, 20 bp, Homo sapiens
cgagaactttgaaggccgaa

SEQ ID NO: 22469 - DNA, 21 bp, Homo sapiens
cgagaactttgaaggccgaag

SEQ ID NO: 22470 - DNA, 22 bp, Homo sapiens
cgagaactttgaaggccgaagt

SEQ ID NO: 22471 - DNA, 24 bp, Homo sapiens
cgagaactttgaaggccgaagtgg

SEQ ID NO: 22472 - DNA, 25 bp, Homo sapiens
cgagaactttgaaggccgaagtgga

SEQ ID NO: 22473 - DNA, 26 bp, Homo sapiens
cgagaactttgaaggccgaagtggag

SEQ ID NO: 22474 - DNA, 27 bp, Homo sapiens
cgagaactttgaaggccgaagtggaga

SEQ ID NO: 22475 - DNA, 28 bp, Homo sapiens
cgagaactttgaaggccgaagtggagaa

SEQ ID NO: 22476 - DNA, 29 bp, Homo sapiens
cgagaactttgaaggccgaagtggagaag

SEQ ID NO: 22477 - DNA, 30 bp, Homo sapiens; identical to SEQ ID NO: 4856

SEQ ID NO: 22478 - DNA, 31 bp, Homo sapiens
cgagaactttgaaggccgaagtggagaaggg

SEQ ID NO: 22479 - DNA, 32 bp, Homo sapiens; identical to SEQ ID NO: 4857

SEQ ID NO: 22480 - DNA, 33 bp, Homo sapiens; identical to SEQ ID NO: 4858

SEQ ID NO: 22481 - DNA, 42 bp, Homo sapiens
cgagaactttgaaggccgaagtggagaagggttccatgtgaa

SEQ ID NO: 22482 - DNA, 43 bp, Homo sapiens
cgagaactttgaaggccgaagtggagaagggttccatgtgaac

SEQ ID NO: 22483 - DNA, 16 bp, Homo sapiens
gagaactttgaaggcc

SEQ ID NO: 22484 - DNA, 17 bp, Homo sapiens
gagaactttgaaggccg

SEQ ID NO: 22485 - DNA, 19 bp, Homo sapiens
gagaactttgaaggccgaa

SEQ ID NO: 22486 - DNA, 20 bp, Homo sapiens
gagaactttgaaggccgaag

SEQ ID NO: 22487 - DNA, 21 bp, Homo sapiens
gagaactttgaaggccgaagt

SEQ ID NO: 22488 - DNA, 27 bp, Homo sapiens
gagaactttgaaggccgaagtggagaa

SEQ ID NO: 22489 - DNA, 28 bp, Homo sapiens
gagaactttgaaggccgaagtggagaag

SEQ ID NO: 22490 - DNA, 29 bp, Homo sapiens
gagaactttgaaggccgaagtggagaagg

SEQ ID NO: 22491 - DNA, 31 bp, Homo sapiens
gagaactttgaaggccgaagtggagaagggt

SEQ ID NO: 22492 - DNA, 32 bp, Homo sapiens
gagaactttgaaggccgaagtggagaagggtt

SEQ ID NO: 22493 - DNA, 33 bp, Homo sapiens
gagaactttgaaggccgaagtggagaagggttc

SEQ ID NO: 22494 - DNA, 16 bp, Homo sapiens
agaactttgaaggccg

SEQ ID NO: 22495 - DNA, 18 bp, Homo sapiens
agaactttgaaggccgaa

SEQ ID NO: 22496 - DNA, 19 bp, Homo sapiens
agaactttgaaggccgaag

SEQ ID NO: 22497 - DNA, 20 bp, Homo sapiens
agaactttgaaggccgaagt

SEQ ID NO: 22498 - DNA, 25 bp, Homo sapiens
agaactttgaaggccgaagtggaga

SEQ ID NO: 22499 - DNA, 26 bp, Homo sapiens
agaactttgaaggccgaagtggagaa

SEQ ID NO: 22500 - DNA, 27 bp, Homo sapiens
agaactttgaaggccgaagtggagaag

SEQ ID NO: 22501 - DNA, 28 bp, Homo sapiens
agaactttgaaggccgaagtggagaagg

SEQ ID NO: 22502 - DNA, 30 bp, Homo sapiens; identical to SEQ ID NO: 4865

SEQ ID NO: 22503 - DNA, 31 bp, Homo sapiens
agaactttgaaggccgaagtggagaagggtt

SEQ ID NO: 22504 - DNA, 32 bp, Homo sapiens
agaactttgaaggccgaagtggagaagggttc

SEQ ID NO: 22505 - DNA, 41 bp, Homo sapiens
agaactttgaaggccgaagtggagaagggttccatgtgaac

SEQ ID NO: 22506 - DNA, 17 bp, Homo sapiens
aactttgaaggccgaag

SEQ ID NO: 22507 - DNA, 28 bp, Homo sapiens
aactttgaaggccgaagtggagaagggt

SEQ ID NO: 22508 - DNA, 29 bp, Homo sapiens
aactttgaaggccgaagtggagaagggtt

SEQ ID NO: 22509 - DNA, 23 bp, Homo sapiens
actttgaaggccgaagtggagaa

SEQ ID NO: 22510 - DNA, 16 bp, Homo sapiens
ctttgaaggccgaagt

SEQ ID NO: 22511 - DNA, 21 bp, Homo sapiens
ctttgaaggccgaagtggaga

SEQ ID NO: 22512 - DNA, 22 bp, Homo sapiens
ctttgaaggccgaagtggagaa

SEQ ID NO: 22513 - DNA, 26 bp, Homo sapiens
ctttgaaggccgaagtggagaagggt

SEQ ID NO: 22514 - DNA, 32 bp, Homo sapiens
ctttgaaggccgaagtggagaagggttccatg

SEQ ID NO: 22515 - DNA, 25 bp, Homo sapiens
tttgaaggccgaagtggagaagggt

SEQ ID NO: 22516 - DNA, 31 bp, Homo sapiens
tttgaaggccgaagtggagaagggttccatg

SEQ ID NO: 22517 - DNA, 21 bp, Homo sapiens
ttgaaggccgaagtggagaag

SEQ ID NO: 22518 - DNA, 22 bp, Homo sapiens
ttgaaggccgaagtggagaagg

SEQ ID NO: 22519 - DNA, 23 bp, Homo sapiens
ttgaaggccgaagtggagaaggg

SEQ ID NO: 22520 - DNA, 24 bp, Homo sapiens
ttgaaggccgaagtggagaagggt

SEQ ID NO: 22521 - DNA, 25 bp, Homo sapiens
ttgaaggccgaagtggagaagggtt

SEQ ID NO: 22522 - DNA, 26 bp, Homo sapiens
ttgaaggccgaagtggagaagggttc

SEQ ID NO: 22523 - DNA, 30 bp, Homo sapiens
ttgaaggccgaagtggagaagggttccatg

SEQ ID NO: 22524 - DNA, 32 bp, Homo sapiens
ttgaaggccgaagtggagaagggttccatgtg

SEQ ID NO: 22525 - DNA, 33 bp, Homo sapiens; identical to SEQ ID NO: 4867

SEQ ID NO: 22526 - DNA, 23 bp, Homo sapiens
tgaaggccgaagtggagaagggt

SEQ ID NO: 22527 - DNA, 25 bp, Homo sapiens
tgaaggccgaagtggagaagggttc

SEQ ID NO: 22528 - DNA, 22 bp, Homo sapiens
gaaggccgaagtggagaagggt

SEQ ID NO: 22529 - DNA, 31 bp, Homo sapiens
gaaggccgaagtggagaagggttccatgtga

SEQ ID NO: 22530 - DNA, 32 bp, Homo sapiens
gaaggccgaagtggagaagggttccatgtgaa

SEQ ID NO: 22531 - DNA, 21 bp, Homo sapiens
aaggccgaagtggagaagggt

SEQ ID NO: 22532 - DNA, 30 bp, Homo sapiens
aaggccgaagtggagaagggttccatgtga

SEQ ID NO: 22533 - DNA, 32 bp, Homo sapiens
aaggccgaagtggagaagggttccatgtgaac

SEQ ID NO: 22534 - DNA, 16 bp, Homo sapiens
aggccgaagtggagaa

SEQ ID NO: 22535 - DNA, 29 bp, Homo sapiens
aggccgaagtggagaagggttccatgtga

SEQ ID NO: 22536 - DNA, 32 bp, Homo sapiens
aggccgaagtggagaagggttccatgtgaaca

SEQ ID NO: 22537 - DNA, 28 bp, Homo sapiens
tggagaagggttccatgtgaacagcagt

SEQ ID NO: 22538 - DNA, 33 bp, Homo sapiens
ggagaagggttccatgtgaacagcagttgaaca

SEQ ID NO: 22539 - DNA, 31 bp, Homo sapiens
gagaagggttccatgtgaacagcagttgaac

SEQ ID NO: 22540 - DNA, 19 bp, Homo sapiens
gttccatgtgaacagcagt

SEQ ID NO: 22541 - DNA, 27 bp, Homo sapiens
gttccatgtgaacagcagttgaacatg

SEQ ID NO: 22542 - DNA, 22 bp, Homo sapiens
tccatgtgaacagcagttgaac

SEQ ID NO: 22543 - DNA, 33 bp, Homo sapiens
tccatgtgaacagcagttgaacatgggtcagtc

SEQ ID NO: 22544 - DNA, 39 bp, Homo sapiens
tccatgtgaacagcagttgaacatgggtcagtcggtcct

SEQ ID NO: 22545 - DNA, 32 bp, Homo sapiens
ccatgtgaacagcagttgaacatgggtcagtc

SEQ ID NO: 22546 - DNA, 21 bp, Homo sapiens
catgtgaacagcagttgaaca

SEQ ID NO: 22547 - DNA, 31 bp, Homo sapiens
catgtgaacagcagttgaacatgggtcagtc

SEQ ID NO: 22548 - DNA, 33 bp, Homo sapiens
catgtgaacagcagttgaacatgggtcagtcgg

SEQ ID NO: 22549 - DNA, 20 bp, Homo sapiens
atgtgaacagcagttgaaca

SEQ ID NO: 22550 - DNA, 30 bp, Homo sapiens
atgtgaacagcagttgaacatgggtcagtc

SEQ ID NO: 22551 - DNA, 19 bp, Homo sapiens
tgtgaacagcagttgaaca

SEQ ID NO: 22552 - DNA, 31 bp, Homo sapiens
aacagcagttgaacatgggtcagtcggtcct

SEQ ID NO: 22553 - DNA, 32 bp, Homo sapiens
aacagcagttgaacatgggtcagtcggtcctg

SEQ ID NO: 22554 - DNA, 16 bp, Homo sapiens
acagcagttgaacatg

SEQ ID NO: 22555 - DNA, 27 bp, Homo sapiens
acagcagttgaacatgggtcagtcggt

SEQ ID NO: 22556 - DNA, 28 bp, Homo sapiens
acagcagttgaacatgggtcagtcggtc

SEQ ID NO: 22557 - DNA, 30 bp, Homo sapiens; identical to SEQ ID NO: 4869

SEQ ID NO: 22558 - DNA, 31 bp, Homo sapiens
acagcagttgaacatgggtcagtcggtcctg

SEQ ID NO: 22559 - DNA, 32 bp, Homo sapiens
acagcagttgaacatgggtcagtcggtcctga

SEQ ID NO: 22560 - DNA, 37 bp, Homo sapiens
acagcagttgaacatgggtcagtcggtcctgagagat

SEQ ID NO: 22561 - DNA, 41 bp, Homo sapiens
acagcagttgaacatgggtcagtcggtcctgagagatgggc

SEQ ID NO: 22562 - DNA, 47 bp, Homo sapiens
acagcagttgaacatgggtcagtcggtcctgagagatgggcgagcgc

SEQ ID NO: 22563 - DNA, 23 bp, Homo sapiens
cagcagttgaacatgggtcagtc

SEQ ID NO: 22564 - DNA, 27 bp, Homo sapiens
cagcagttgaacatgggtcagtcggtc

SEQ ID NO: 22565 - DNA, 29 bp, Homo sapiens
cagcagttgaacatgggtcagtcggtcct

SEQ ID NO: 22566 - DNA, 30 bp, Homo sapiens; identical to SEQ ID NO: 4872

SEQ ID NO: 22567 - DNA, 32 bp, Homo sapiens
cagcagttgaacatgggtcagtcggtcctgag

SEQ ID NO: 22568 - DNA, 33 bp, Homo sapiens
cagcagttgaacatgggtcagtcggtcctgaga

SEQ ID NO: 22569 - DNA, 36 bp, Homo sapiens
cagcagttgaacatgggtcagtcggtcctgagagat

SEQ ID NO: 22570 - DNA, 26 bp, Homo sapiens
agcagttgaacatgggtcagtcggtc

SEQ ID NO: 22571 - DNA, 27 bp, Homo sapiens
agcagttgaacatgggtcagtcggtcc

SEQ ID NO: 22572 - DNA, 28 bp, Homo sapiens
agcagttgaacatgggtcagtcggtcct

SEQ ID NO: 22573 - DNA, 29 bp, Homo sapiens
agcagttgaacatgggtcagtcggtcctg

SEQ ID NO: 22574 - DNA, 31 bp, Homo sapiens
agcagttgaacatgggtcagtcggtcctgag

SEQ ID NO: 22575 - DNA, 32 bp, Homo sapiens
agcagttgaacatgggtcagtcggtcctgaga

SEQ ID NO: 22576 - DNA, 33 bp, Homo sapiens; identical to SEQ ID NO: 4876

SEQ ID NO: 22577 - DNA, 35 bp, Homo sapiens
agcagttgaacatgggtcagtcggtcctgagagat

SEQ ID NO: 22578 - DNA, 39 bp, Homo sapiens
agcagttgaacatgggtcagtcggtcctgagagatgggc

SEQ ID NO: 22579 - DNA, 46 bp, Homo sapiens
agcagttgaacatgggtcagtcggtcctgagagatgggcgagcgcc

SEQ ID NO: 22580 - DNA, 47 bp, Homo sapiens
agcagttgaacatgggtcagtcggtcctgagagatgggcgagcgccg

SEQ ID NO: 22581 - DNA, 25 bp, Homo sapiens
gcagttgaacatgggtcagtcggtc

SEQ ID NO: 22582 - DNA, 26 bp, Homo sapiens
gcagttgaacatgggtcagtcggtcc

SEQ ID NO: 22583 - DNA, 27 bp, Homo sapiens
gcagttgaacatgggtcagtcggtcct

SEQ ID NO: 22584 - DNA, 28 bp, Homo sapiens
gcagttgaacatgggtcagtcggtcctg

SEQ ID NO: 22585 - DNA, 29 bp, Homo sapiens
gcagttgaacatgggtcagtcggtcctga

SEQ ID NO: 22586 - DNA, 30 bp, Homo sapiens
gcagttgaacatgggtcagtcggtcctgag

SEQ ID NO: 22587 - DNA, 31 bp, Homo sapiens; identical to SEQ ID NO: 4879

SEQ ID NO: 22588 - DNA, 32 bp, Homo sapiens; identical to SEQ ID NO: 4880

SEQ ID NO: 22589 - DNA, 33 bp, Homo sapiens; identical to SEQ ID NO: 4881

SEQ ID NO: 22590 - DNA, 34 bp, Homo sapiens
gcagttgaacatgggtcagtcggtcctgagagat

SEQ ID NO: 22591 - DNA, 45 bp, Homo sapiens
gcagttgaacatgggtcagtcggtcctgagagatgggcgagcgcc

SEQ ID NO: 22592 - DNA, 20 bp, Homo sapiens
cagttgaacatgggtcagtc

SEQ ID NO: 22593 - DNA, 26 bp, Homo sapiens
cagttgaacatgggtcagtcggtcct

SEQ ID NO: 22594 - DNA, 27 bp, Homo sapiens
cagttgaacatgggtcagtcggtcctg

SEQ ID NO: 22595 - DNA, 30 bp, Homo sapiens
cagttgaacatgggtcagtcggtcctgaga

SEQ ID NO: 22596 - DNA, 31 bp, Homo sapiens
cagttgaacatgggtcagtcggtcctgagag

SEQ ID NO: 22597 - DNA, 32 bp, Homo sapiens
cagttgaacatgggtcagtcggtcctgagaga

SEQ ID NO: 22598 - DNA, 33 bp, Homo sapiens; identical to SEQ ID NO: 4883

SEQ ID NO: 22599 - DNA, 24 bp, Homo sapiens
gttgaacatgggtcagtcggtcct

SEQ ID NO: 22600 - DNA, 25 bp, Homo sapiens
gttgaacatgggtcagtcggtcctg

SEQ ID NO: 22601 - DNA, 26 bp, Homo sapiens
gttgaacatgggtcagtcggtcctga

SEQ ID NO: 22602 - DNA, 28 bp, Homo sapiens
gttgaacatgggtcagtcggtcctgaga

SEQ ID NO: 22603 - DNA, 30 bp, Homo sapiens
gttgaacatgggtcagtcggtcctgagaga

SEQ ID NO: 22604 - DNA, 26 bp, Homo sapiens
tgaacatgggtcagtcggtcctgaga

SEQ ID NO: 22605 - DNA, 16 bp, Homo sapiens
gaacatgggtcagtcg

SEQ ID NO: 22606 - DNA, 19 bp, Homo sapiens
gaacatgggtcagtcggtc

SEQ ID NO: 22607 - DNA, 20 bp, Homo sapiens
gaacatgggtcagtcggtcc

SEQ ID NO: 22608 - DNA, 21 bp, Homo sapiens
gaacatgggtcagtcggtcct

SEQ ID NO: 22609 - DNA, 22 bp, Homo sapiens
gaacatgggtcagtcggtcctg

SEQ ID NO: 22610 - DNA, 24 bp, Homo sapiens
gaacatgggtcagtcggtcctgag

SEQ ID NO: 22611 - DNA, 25 bp, Homo sapiens
gaacatgggtcagtcggtcctgaga

SEQ ID NO: 22612 - DNA, 26 bp, Homo sapiens
gaacatgggtcagtcggtcctgagag

SEQ ID NO: 22613 - DNA, 27 bp, Homo sapiens
gaacatgggtcagtcggtcctgagaga

SEQ ID NO: 22614 - DNA, 28 bp, Homo sapiens
gaacatgggtcagtcggtcctgagagat

SEQ ID NO: 22615 - DNA, 29 bp, Homo sapiens
gaacatgggtcagtcggtcctgagagatg

SEQ ID NO: 22616 - DNA, 31 bp, Homo sapiens
gaacatgggtcagtcggtcctgagagatggg

SEQ ID NO: 22617 - DNA, 32 bp, Homo sapiens; identical to SEQ ID NO: 4892

SEQ ID NO: 22618 - DNA, 33 bp, Homo sapiens
gaacatgggtcagtcggtcctgagagatgggcg

SEQ ID NO: 22619 - DNA, 36 bp, Homo sapiens
gaacatgggtcagtcggtcctgagagatgggcgagc

SEQ ID NO: 22620 - DNA, 37 bp, Homo sapiens
gaacatgggtcagtcggtcctgagagatgggcgagcg

SEQ ID NO: 22621 - DNA, 39 bp, Homo sapiens
gaacatgggtcagtcggtcctgagagatgggcgagcgcc

SEQ ID NO: 22622 - DNA, 40 bp, Homo sapiens
gaacatgggtcagtcggtcctgagagatgggcgagcgccg

SEQ ID NO: 22623 - DNA, 16 bp, Homo sapiens
aacatgggtcagtcgg

SEQ ID NO: 22624 - DNA, 18 bp, Homo sapiens
aacatgggtcagtcggtc

SEQ ID NO: 22625 - DNA, 19 bp, Homo sapiens
aacatgggtcagtcggtcc

SEQ ID NO: 22626 - DNA, 20 bp, Homo sapiens
aacatgggtcagtcggtcct

SEQ ID NO: 22627 - DNA, 21 bp, Homo sapiens
aacatgggtcagtcggtcctg

SEQ ID NO: 22628 - DNA, 24 bp, Homo sapiens
aacatgggtcagtcggtcctgaga

SEQ ID NO: 22629 - DNA, 25 bp, Homo sapiens
aacatgggtcagtcggtcctgagag

SEQ ID NO: 22630 - DNA, 26 bp, Homo sapiens
aacatgggtcagtcggtcctgagaga

SEQ ID NO: 22631 - DNA, 28 bp, Homo sapiens
aacatgggtcagtcggtcctgagagatg

SEQ ID NO: 22632 - DNA, 31 bp, Homo sapiens; identical to SEQ ID NO: 4894

SEQ ID NO: 22633 - DNA, 33 bp, Homo sapiens
aacatgggtcagtcggtcctgagagatgggcga

SEQ ID NO: 22634 - DNA, 38 bp, Homo sapiens
aacatgggtcagtcggtcctgagagatgggcgagcgcc

SEQ ID NO: 22635 - DNA, 39 bp, Homo sapiens
aacatgggtcagtcggtcctgagagatgggcgagcgccg

SEQ ID NO: 22636 - DNA, 18 bp, Homo sapiens
acatgggtcagtcggtcc

SEQ ID NO: 22637 - DNA, 19 bp, Homo sapiens
acatgggtcagtcggtcct

SEQ ID NO: 22638 - DNA, 20 bp, Homo sapiens
acatgggtcagtcggtcctg

SEQ ID NO: 22639 - DNA, 21 bp, Homo sapiens
acatgggtcagtcggtcctga

SEQ ID NO: 22640 - DNA, 23 bp, Homo sapiens
acatgggtcagtcggtcctgaga

SEQ ID NO: 22641 - DNA, 25 bp, Homo sapiens
acatgggtcagtcggtcctgagaga

SEQ ID NO: 22642 - DNA, 30 bp, Homo sapiens
acatgggtcagtcggtcctgagagatgggc

SEQ ID NO: 22643 - DNA, 32 bp, Homo sapiens
acatgggtcagtcggtcctgagagatgggcga

SEQ ID NO: 22644 - DNA, 20 bp, Homo sapiens
catgggtcagtcggtcctga

SEQ ID NO: 22645 - DNA, 22 bp, Homo sapiens
catgggtcagtcggtcctgaga

SEQ ID NO: 22646 - DNA, 24 bp, Homo sapiens
catgggtcagtcggtcctgagaga

SEQ ID NO: 22647 - DNA, 29 bp, Homo sapiens
catgggtcagtcggtcctgagagatgggc

SEQ ID NO: 22648 - DNA, 31 bp, Homo sapiens
catgggtcagtcggtcctgagagatgggcga

SEQ ID NO: 22649 - DNA, 33 bp, Homo sapiens
catgggtcagtcggtcctgagagatgggcgagc

SEQ ID NO: 22650 - DNA, 16 bp, Homo sapiens
atgggtcagtcggtcc

SEQ ID NO: 22651 - DNA, 28 bp, Homo sapiens
atgggtcagtcggtcctgagagatgggc

SEQ ID NO: 22652 - DNA, 32 bp, Homo sapiens
atgggtcagtcggtcctgagagatgggcgagc

SEQ ID NO: 22653 - DNA, 33 bp, Homo sapiens
atgggtcagtcggtcctgagagatgggcgagcg

SEQ ID NO: 22654 - DNA, 35 bp, Homo sapiens
atgggtcagtcggtcctgagagatgggcgagcgcc

SEQ ID NO: 22655 - DNA, 18 bp, Homo sapiens
tgggtcagtcggtcctga

SEQ ID NO: 22656 - DNA, 20 bp, Homo sapiens
tgggtcagtcggtcctgaga

SEQ ID NO: 22657 - DNA, 22 bp, Homo sapiens
tgggtcagtcggtcctgagaga

SEQ ID NO: 22658 - DNA, 29 bp, Homo sapiens
tgggtcagtcggtcctgagagatgggcga

SEQ ID NO: 22659 - DNA, 26 bp, Homo sapiens
gggtcagtcggtcctgagagatgggc

SEQ ID NO: 22660 - DNA, 28 bp, Homo sapiens
gggtcagtcggtcctgagagatgggcga

SEQ ID NO: 22661 - DNA, 33 bp, Homo sapiens
gggtcagtcggtcctgagagatgggcgagcgcc

SEQ ID NO: 22662 - DNA, 16 bp, Homo sapiens
ggtcagtcggtcctga

SEQ ID NO: 22663 - DNA, 18 bp, Homo sapiens
ggtcagtcggtcctgaga

SEQ ID NO: 22664 - DNA, 20 bp, Homo sapiens
ggtcagtcggtcctgagaga

SEQ ID NO: 22665 - DNA, 25 bp, Homo sapiens
ggtcagtcggtcctgagagatgggc

SEQ ID NO: 22666 - DNA, 27 bp, Homo sapiens
ggtcagtcggtcctgagagatgggcga

SEQ ID NO: 22667 - DNA, 29 bp, Homo sapiens
ggtcagtcggtcctgagagatgggcgagc

SEQ ID NO: 22668 - DNA, 31 bp, Homo sapiens
ggtcagtcggtcctgagagatgggcgagcgc

SEQ ID NO: 22669 - DNA, 32 bp, Homo sapiens; identical to SEQ ID NO: 4895

SEQ ID NO: 22670 - DNA, 17 bp, Homo sapiens
gtcagtcggtcctgaga

SEQ ID NO: 22671 - DNA, 18 bp, Homo sapiens
gtcagtcggtcctgagag

SEQ ID NO: 22672 - DNA, 19 bp, Homo sapiens
gtcagtcggtcctgagaga

SEQ ID NO: 22673 - DNA, 20 bp, Homo sapiens
gtcagtcggtcctgagagat

SEQ ID NO: 22674 - DNA, 21 bp, Homo sapiens
gtcagtcggtcctgagagatg

SEQ ID NO: 22675 - DNA, 24 bp, Homo sapiens
gtcagtcggtcctgagagatgggc

SEQ ID NO: 22676 - DNA, 26 bp, Homo sapiens
gtcagtcggtcctgagagatgggcga

SEQ ID NO: 22677 - DNA, 28 bp, Homo sapiens
gtcagtcggtcctgagagatgggcgagc

SEQ ID NO: 22678 - DNA, 30 bp, Homo sapiens
gtcagtcggtcctgagagatgggcgagcgc

SEQ ID NO: 22679 - DNA, 31 bp, Homo sapiens; identical to SEQ ID NO: 4899

SEQ ID NO: 22680 - DNA, 32 bp, Homo sapiens; identical to SEQ ID NO: 4900

SEQ ID NO: 22681 - DNA, 16 bp, Homo sapiens
tcagtcggtcctgaga

SEQ ID NO: 22682 - DNA, 18 bp, Homo sapiens
tcagtcggtcctgagaga

SEQ ID NO: 22683 - DNA, 23 bp, Homo sapiens
tcagtcggtcctgagagatgggc

SEQ ID NO: 22684 - DNA, 25 bp, Homo sapiens
tcagtcggtcctgagagatgggcga

SEQ ID NO: 22685 - DNA, 27 bp, Homo sapiens
tcagtcggtcctgagagatgggcgagc

SEQ ID NO: 22686 - DNA, 30 bp, Homo sapiens; identical to SEQ ID NO: 4901

SEQ ID NO: 22687 - DNA, 16 bp, Homo sapiens
cagtcggtcctgagag

SEQ ID NO: 22688 - DNA, 17 bp, Homo sapiens
cagtcggtcctgagaga

SEQ ID NO: 22689 - DNA, 18 bp, Homo sapiens
cagtcggtcctgagagat

SEQ ID NO: 22690 - DNA, 19 bp, Homo sapiens
cagtcggtcctgagagatg

SEQ ID NO: 22691 - DNA, 22 bp, Homo sapiens
cagtcggtcctgagagatgggc

SEQ ID NO: 22692 - DNA, 24 bp, Homo sapiens
cagtcggtcctgagagatgggcga

SEQ ID NO: 22693 - DNA, 26 bp, Homo sapiens
cagtcggtcctgagagatgggcgagc

SEQ ID NO: 22694 - DNA, 29 bp, Homo sapiens
cagtcggtcctgagagatgggcgagcgcc

SEQ ID NO: 22695 - DNA, 16 bp, Homo sapiens
agtcggtcctgagaga

SEQ ID NO: 22696 - DNA, 17 bp, Homo sapiens
agtcggtcctgagagat

SEQ ID NO: 22697 - DNA, 21 bp, Homo sapiens
agtcggtcctgagagatgggc

SEQ ID NO: 22698 - DNA, 28 bp, Homo sapiens
agtcggtcctgagagatgggcgagcgcc

SEQ ID NO: 22699 - DNA, 16 bp, Homo sapiens
gtcggtcctgagagat

SEQ ID NO: 22700 - DNA, 20 bp, Homo sapiens
gtcggtcctgagagatgggc

SEQ ID NO: 22701 - DNA, 22 bp, Homo sapiens
gtcggtcctgagagatgggcga

SEQ ID NO: 22702 - DNA, 26 bp, Homo sapiens
gtcggtcctgagagatgggcgagcgc

SEQ ID NO: 22703 - DNA, 27 bp, Homo sapiens
gtcggtcctgagagatgggcgagcgcc

SEQ ID NO: 22704 - DNA, 28 bp, Homo sapiens
gtcggtcctgagagatgggcgagcgccg

SEQ ID NO: 22705 - DNA, 30 bp, Homo sapiens
gtcggtcctgagagatgggcgagcgccgtt

SEQ ID NO: 22706 - DNA, 31 bp, Homo sapiens
gtcggtcctgagagatgggcgagcgccgttc

SEQ ID NO: 22707 - DNA, 32 bp, Homo sapiens
gtcggtcctgagagatgggcgagcgccgttcc

SEQ ID NO: 22708 - DNA, 26 bp, Homo sapiens
tcggtcctgagagatgggcgagcgcc

SEQ ID NO: 22709 - DNA, 17 bp, Homo sapiens
ggtcctgagagatgggc

SEQ ID NO: 22710 - DNA, 24 bp, Homo sapiens
ggtcctgagagatgggcgagcgcc

SEQ ID NO: 22711 - DNA, 28 bp, Homo sapiens
ggtcctgagagatgggcgagcgccgttc

SEQ ID NO: 22712 - DNA, 29 bp, Homo sapiens
ggtcctgagagatgggcgagcgccgttcc

SEQ ID NO: 22713 - DNA, 30 bp, Homo sapiens
ggtcctgagagatgggcgagcgccgttccg

SEQ ID NO: 22714 - DNA, 33 bp, Homo sapiens; identical to SEQ ID NO: 4908

SEQ ID NO: 22715 - DNA, 22 bp, Homo sapiens
gtcctgagagatgggcgagcgc

SEQ ID NO: 22716 - DNA, 23 bp, Homo sapiens
gtcctgagagatgggcgagcgcc

SEQ ID NO: 22717 - DNA, 24 bp, Homo sapiens
gtcctgagagatgggcgagcgccg

SEQ ID NO: 22718 - DNA, 26 bp, Homo sapiens
gtcctgagagatgggcgagcgccgtt

SEQ ID NO: 22719 - DNA, 27 bp, Homo sapiens
gtcctgagagatgggcgagcgccgttc

SEQ ID NO: 22720 - DNA, 28 bp, Homo sapiens
gtcctgagagatgggcgagcgccgttcc

SEQ ID NO: 22721 - DNA, 30 bp, Homo sapiens
gtcctgagagatgggcgagcgccgttccga

SEQ ID NO: 22722 - DNA, 32 bp, Homo sapiens; identical to SEQ ID NO: 4910

SEQ ID NO: 22723 - DNA, 33 bp, Homo sapiens
gtcctgagagatgggcgagcgccgttccgaagg

SEQ ID NO: 22724 - DNA, 22 bp, Homo sapiens
tcctgagagatgggcgagcgcc

SEQ ID NO: 22725 - DNA, 26 bp, Homo sapiens
tcctgagagatgggcgagcgccgttc

SEQ ID NO: 22726 - DNA, 20 bp, Homo sapiens
ctgagagatgggcgagcgcc

SEQ ID NO: 22727 - DNA, 37 bp, Homo sapiens
ctgagagatgggcgagcgccgttccgaagggacgggc

SEQ ID NO: 22728 - DNA, 19 bp, Homo sapiens
tgagagatgggcgagcgcc

SEQ ID NO: 22729 - DNA, 33 bp, Homo sapiens
tgagagatgggcgagcgccgttccgaagggacg

SEQ ID NO: 22730 - DNA, 18 bp, Homo sapiens
gagagatgggcgagcgcc

SEQ ID NO: 22731 - DNA, 33 bp, Homo sapiens
gagagatgggcgagcgccgttccgaagggacgg

SEQ ID NO: 22732 - DNA, 17 bp, Homo sapiens
agagatgggcgagcgcc

SEQ ID NO: 22733 - DNA, 31 bp, Homo sapiens
agagatgggcgagcgccgttccgaagggacg

SEQ ID NO: 22734 - DNA, 32 bp, Homo sapiens
agagatgggcgagcgccgttccgaagggacgg

SEQ ID NO: 22735 - DNA, 29 bp, Homo sapiens
gagatgggcgagcgccgttccgaagggac

SEQ ID NO: 22736 - DNA, 29 bp, Homo sapiens
agatgggcgagcgccgttccgaagggacg

SEQ ID NO: 22737 - DNA, 32 bp, Homo sapiens
agatgggcgagcgccgttccgaagggacgggc

SEQ ID NO: 22738 - DNA, 33 bp, Homo sapiens
gatgggcgagcgccgttccgaagggacgggcga

SEQ ID NO: 22739 - DNA, 27 bp, Homo sapiens
atgggcgagcgccgttccgaagggacg

SEQ ID NO: 22740 - DNA, 28 bp, Homo sapiens
atgggcgagcgccgttccgaagggacgg

SEQ ID NO: 22741 - DNA, 30 bp, Homo sapiens; identical to SEQ ID NO: 4912

SEQ ID NO: 22742 - DNA, 25 bp, Homo sapiens
gggcgagcgccgttccgaagggacg

SEQ ID NO: 22743 - DNA, 28 bp, Homo sapiens
gggcgagcgccgttccgaagggacgggc

SEQ ID NO: 22744 - DNA, 24 bp, Homo sapiens
ggcgagcgccgttccgaagggacg

SEQ ID NO: 22745 - DNA, 20 bp, Homo sapiens
gagcgccgttccgaagggac

SEQ ID NO: 22746 - DNA, 19 bp, Homo sapiens
agcgccgttccgaagggac

SEQ ID NO: 22747 - DNA, 17 bp, Homo sapiens
gcgccgttccgaaggga

SEQ ID NO: 22748 - DNA, 18 bp, Homo sapiens
gcgccgttccgaagggac

SEQ ID NO: 22749 - DNA, 19 bp, Homo sapiens
gcgccgttccgaagggacg

SEQ ID NO: 22750 - DNA, 29 bp, Homo sapiens
gcgccgttccgaagggacgggcgatggcc

SEQ ID NO: 22751 - DNA, 17 bp, Homo sapiens
cgccgttccgaagggac

SEQ ID NO: 22752 - DNA, 16 bp, Homo sapiens
gccgttccgaagggac

SEQ ID NO: 22753 - DNA, 16 bp, Homo sapiens
ccgttccgaagggacg

SEQ ID NO: 22754 - DNA, 16 bp, Homo sapiens
gttccgaagggacggg

SEQ ID NO: 22755 - DNA, 17 bp, Homo sapiens
gttccgaagggacgggc

SEQ ID NO: 22756 - DNA, 21 bp, Homo sapiens
gttccgaagggacgggcgatg

SEQ ID NO: 22757 - DNA, 16 bp, Homo sapiens
ttccgaagggacgggc

SEQ ID NO: 22758 - DNA, 20 bp, Homo sapiens
cgaagggacgggcgatggcc

SEQ ID NO: 22759 - DNA, 21 bp, Homo sapiens
cgaagggacgggcgatggcct

SEQ ID NO: 22760 - DNA, 23 bp, Homo sapiens
cgaagggacgggcgatggcctcc

SEQ ID NO: 22761 - DNA, 19 bp, Homo sapiens
agggacgggcgatggcctc

SEQ ID NO: 22762 - DNA, 29 bp, Homo sapiens
acgggcgatggcctccgttgccctcggcc

SEQ ID NO: 22763 - DNA, 28 bp, Homo sapiens
cgggcgatggcctccgttgccctcggcc

SEQ ID NO: 22764 - DNA, 32 bp, Homo sapiens
gggcgatggcctccgttgccctcggccgatcg

SEQ ID NO: 22765 - DNA, 22 bp, Homo sapiens
gatggcctccgttgccctcggc

SEQ ID NO: 22766 - DNA, 23 bp, Homo sapiens
gatggcctccgttgccctcggcc

SEQ ID NO: 22767 - DNA, 24 bp, Homo sapiens
gatggcctccgttgccctcggccg

SEQ ID NO: 22768 - DNA, 26 bp, Homo sapiens
gatggcctccgttgccctcggccgat

SEQ ID NO: 22769 - DNA, 27 bp, Homo sapiens
gatggcctccgttgccctcggccgatc

SEQ ID NO: 22770 - DNA, 28 bp, Homo sapiens
gatggcctccgttgccctcggccgatcg

SEQ ID NO: 22771 - DNA, 30 bp, Homo sapiens
gatggcctccgttgccctcggccgatcgaa

SEQ ID NO: 22772 - DNA, 31 bp, Homo sapiens
gatggcctccgttgccctcggccgatcgaaa

SEQ ID NO: 22773 - DNA, 32 bp, Homo sapiens
gatggcctccgttgccctcggccgatcgaaag

SEQ ID NO: 22774 - DNA, 33 bp, Homo sapiens
gatggcctccgttgccctcggccgatcgaaagg

SEQ ID NO: 22775 - DNA, 37 bp, Homo sapiens
gatggcctccgttgccctcggccgatcgaaagggagt

SEQ ID NO: 22776 - DNA, 39 bp, Homo sapiens
gatggcctccgttgccctcggccgatcgaaagggagtcg

SEQ ID NO: 22777 - DNA, 40 bp, Homo sapiens
gatggcctccgttgccctcggccgatcgaaagggagtcgg

SEQ ID NO: 22778 - DNA, 21 bp, Homo sapiens
atggcctccgttgccctcggc

SEQ ID NO: 22779 - DNA, 22 bp, Homo sapiens
atggcctccgttgccctcggcc

SEQ ID NO: 22780 - DNA, 23 bp, Homo sapiens
atggcctccgttgccctcggccg

SEQ ID NO: 22781 - DNA, 20 bp, Homo sapiens
tggcctccgttgccctcggc

SEQ ID NO: 22782 - DNA, 21 bp, Homo sapiens
tggcctccgttgccctcggcc

SEQ ID NO: 22783 - DNA, 23 bp, Homo sapiens
tggcctccgttgccctcggccga

SEQ ID NO: 22784 - DNA, 27 bp, Homo sapiens
tggcctccgttgccctcggccgatcga

SEQ ID NO: 22785 - DNA, 28 bp, Homo sapiens
tggcctccgttgccctcggccgatcgaa

SEQ ID NO: 22786 - DNA, 29 bp, Homo sapiens
tggcctccgttgccctcggccgatcgaaa

SEQ ID NO: 22787 - DNA, 32 bp, Homo sapiens
tggcctccgttgccctcggccgatcgaaaggg

SEQ ID NO: 22788 - DNA, 33 bp, Homo sapiens
tggcctccgttgccctcggccgatcgaaaggga

SEQ ID NO: 22789 - DNA, 26 bp, Homo sapiens
ggcctccgttgccctcggccgatcga

SEQ ID NO: 22790 - DNA, 28 bp, Homo sapiens
ggcctccgttgccctcggccgatcgaaa

SEQ ID NO: 22791 - DNA, 32 bp, Homo sapiens
ggcctccgttgccctcggccgatcgaaaggga

SEQ ID NO: 22792 - DNA, 24 bp, Homo sapiens
gcctccgttgccctcggccgatcg

SEQ ID NO: 22793 - DNA, 31 bp, Homo sapiens
gcctccgttgccctcggccgatcgaaaggga

SEQ ID NO: 22794 - DNA, 32 bp, Homo sapiens
gcctccgttgccctcggccgatcgaaagggag

SEQ ID NO: 22795 - DNA, 33 bp, Homo sapiens
gcctccgttgccctcggccgatcgaaagggagt

SEQ ID NO: 22796 - DNA, 30 bp, Homo sapiens
cctccgttgccctcggccgatcgaaaggga

SEQ ID NO: 22797 - DNA, 31 bp, Homo sapiens
cctccgttgccctcggccgatcgaaagggag

SEQ ID NO: 22798 - DNA, 33 bp, Homo sapiens
cctccgttgccctcggccgatcgaaagggagtc

SEQ ID NO: 22799 - DNA, 17 bp, Homo sapiens
ctccgttgccctcggcc

SEQ ID NO: 22800 - DNA, 29 bp, Homo sapiens
ctccgttgccctcggccgatcgaaaggga

SEQ ID NO: 22801 - DNA, 32 bp, Homo sapiens
ctccgttgccctcggccgatcgaaagggagtc

SEQ ID NO: 22802 - DNA, 16 bp, Homo sapiens
tccgttgccctcggcc

SEQ ID NO: 22803 - DNA, 17 bp, Homo sapiens
tccgttgccctcggccg

SEQ ID NO: 22804 - DNA, 18 bp, Homo sapiens
tccgttgccctcggccga

SEQ ID NO: 22805 - DNA, 28 bp, Homo sapiens
tccgttgccctcggccgatcgaaaggga

SEQ ID NO: 22806 - DNA, 29 bp, Homo sapiens
tccgttgccctcggccgatcgaaagggag

SEQ ID NO: 22807 - DNA, 31 bp, Homo sapiens; identical to SEQ ID NO: 4922

SEQ ID NO: 22808 - DNA, 32 bp, Homo sapiens
tccgttgccctcggccgatcgaaagggagtcg

SEQ ID NO: 22809 - DNA, 16 bp, Homo sapiens
ccgttgccctcggccg

SEQ ID NO: 22810 - DNA, 17 bp, Homo sapiens
gttgccctcggccgatc

SEQ ID NO: 22811 - DNA, 18 bp, Homo sapiens
gttgccctcggccgatcg

SEQ ID NO: 22812 - DNA, 27 bp, Homo sapiens
gttgccctcggccgatcgaaagggagt

SEQ ID NO: 22813 - DNA, 28 bp, Homo sapiens
gttgccctcggccgatcgaaagggagtc

SEQ ID NO: 22814 - DNA, 29 bp, Homo sapiens
gttgccctcggccgatcgaaagggagtcg

SEQ ID NO: 22815 - DNA, 30 bp, Homo sapiens; identical to SEQ ID NO: 4924

SEQ ID NO: 22816 - DNA, 31 bp, Homo sapiens
gttgccctcggccgatcgaaagggagtcggg

SEQ ID NO: 22817 - DNA, 33 bp, Homo sapiens
gttgccctcggccgatcgaaagggagtcgggtt

SEQ ID NO: 22818 - DNA, 16 bp, Homo sapiens
ttgccctcggccgatc

SEQ ID NO: 22819 - DNA, 17 bp, Homo sapiens
ttgccctcggccgatcg

SEQ ID NO: 22820 - DNA, 18 bp, Homo sapiens
ttgccctcggccgatcga

SEQ ID NO: 22821 - DNA, 22 bp, Homo sapiens
ttgccctcggccgatcgaaagg

SEQ ID NO: 22822 - DNA, 24 bp, Homo sapiens
ttgccctcggccgatcgaaaggga

SEQ ID NO: 22823 - DNA, 27 bp, Homo sapiens
ttgccctcggccgatcgaaagggagtc

SEQ ID NO: 22824 - DNA, 28 bp, Homo sapiens
ttgccctcggccgatcgaaagggagtcg

SEQ ID NO: 22825 - DNA, 29 bp, Homo sapiens
ttgccctcggccgatcgaaagggagtcgg

SEQ ID NO: 22826 - DNA, 30 bp, Homo sapiens; identical to SEQ ID NO: 4929

SEQ ID NO: 22827 - DNA, 32 bp, Homo sapiens
ttgccctcggccgatcgaaagggagtcgggtt

SEQ ID NO: 22828 - DNA, 34 bp, Homo sapiens
ttgccctcggccgatcgaaagggagtcgggttca

SEQ ID NO: 22829 - DNA, 17 bp, Homo sapiens
tgccctcggccgatcga

SEQ ID NO: 22830 - DNA, 23 bp, Homo sapiens
tgccctcggccgatcgaaaggga

SEQ ID NO: 22831 - DNA, 25 bp, Homo sapiens
tgccctcggccgatcgaaagggagt

SEQ ID NO: 22832 - DNA, 26 bp, Homo sapiens
tgccctcggccgatcgaaagggagtc

SEQ ID NO: 22833 - DNA, 28 bp, Homo sapiens
tgccctcggccgatcgaaagggagtcgg

SEQ ID NO: 22834 - DNA, 29 bp, Homo sapiens
tgccctcggccgatcgaaagggagtcggg

SEQ ID NO: 22835 - DNA, 22 bp, Homo sapiens
gccctcggccgatcgaaaggga

SEQ ID NO: 22836 - DNA, 24 bp, Homo sapiens
gccctcggccgatcgaaagggagt

SEQ ID NO: 22837 - DNA, 25 bp, Homo sapiens
gccctcggccgatcgaaagggagtc

SEQ ID NO: 22838 - DNA, 27 bp, Homo sapiens
gccctcggccgatcgaaagggagtcgg

SEQ ID NO: 22839 - DNA, 28 bp, Homo sapiens
gccctcggccgatcgaaagggagtcggg

SEQ ID NO: 22840 - DNA, 25 bp, Homo sapiens
ccctcggccgatcgaaagggagtcg

SEQ ID NO: 22841 - DNA, 27 bp, Homo sapiens
ccctcggccgatcgaaagggagtcggg

SEQ ID NO: 22842 - DNA, 24 bp, Homo sapiens
cctcggccgatcgaaagggagtcg

SEQ ID NO: 22843 - DNA, 19 bp, Homo sapiens
ctcggccgatcgaaaggga

SEQ ID NO: 22844 - DNA, 22 bp, Homo sapiens
ctcggccgatcgaaagggagtc

SEQ ID NO: 22845 - DNA, 23 bp, Homo sapiens
ctcggccgatcgaaagggagtcg

SEQ ID NO: 22846 - DNA, 24 bp, Homo sapiens
ctcggccgatcgaaagggagtcgg

SEQ ID NO: 22847 - DNA, 25 bp, Homo sapiens
ctcggccgatcgaaagggagtcggg

SEQ ID NO: 22848 - DNA, 21 bp, Homo sapiens
tcggccgatcgaaagggagtc

SEQ ID NO: 22849 - DNA, 17 bp, Homo sapiens
cggccgatcgaaaggga

SEQ ID NO: 22850 - DNA, 20 bp, Homo sapiens
cggccgatcgaaagggagtc

SEQ ID NO: 22851 - DNA, 16 bp, Homo sapiens
ggccgatcgaaaggga

SEQ ID NO: 22852 - DNA, 18 bp, Homo sapiens
ggccgatcgaaagggagt

SEQ ID NO: 22853 - DNA, 19 bp, Homo sapiens
ggccgatcgaaagggagtc

SEQ ID NO: 22854 - DNA, 18 bp, Homo sapiens
gccgatcgaaagggagtc

SEQ ID NO: 22855 - DNA, 19 bp, Homo sapiens
gccgatcgaaagggagtcg

SEQ ID NO: 22856 - DNA, 26 bp, Homo sapiens
atcgaaagggagtcgggttcagatcc

SEQ ID NO: 22857 - DNA, 16 bp, Homo sapiens
cgaaagggagtcgggt

SEQ ID NO: 22858 - DNA, 16 bp, Homo sapiens
gaaagggagtcgggtt

SEQ ID NO: 22859 - DNA, 18 bp, Homo sapiens
gaaagggagtcgggttca

SEQ ID NO: 22860 - DNA, 22 bp, Homo sapiens
gaaagggagtcgggttcagatc

SEQ ID NO: 22861 - DNA, 23 bp, Homo sapiens
gaaagggagtcgggttcagatcc

SEQ ID NO: 22862 - DNA, 17 bp, Homo sapiens
aaagggagtcgggttca

SEQ ID NO: 22863 - DNA, 21 bp, Homo sapiens
aaagggagtcgggttcagatc

SEQ ID NO: 22864 - DNA, 22 bp, Homo sapiens
aaagggagtcgggttcagatcc

SEQ ID NO: 22865 - DNA, 23 bp, Homo sapiens
aaagggagtcgggttcagatccc

SEQ ID NO: 22866 - DNA, 29 bp, Homo sapiens
aaagggagtcgggttcagatccccgaatc

SEQ ID NO: 22867 - DNA, 18 bp, Homo sapiens
aagggagtcgggttcaga

SEQ ID NO: 22868 - DNA, 20 bp, Homo sapiens
aagggagtcgggttcagatc

SEQ ID NO: 22869 - DNA, 17 bp, Homo sapiens
agggagtcgggttcaga

SEQ ID NO: 22870 - DNA, 19 bp, Homo sapiens
agggagtcgggttcagatc

SEQ ID NO: 22871 - DNA, 20 bp, Homo sapiens
agggagtcgggttcagatcc

SEQ ID NO: 22872 - DNA, 21 bp, Homo sapiens
agggagtcgggttcagatccc

SEQ ID NO: 22873 - DNA, 16 bp, Homo sapiens
gggagtcgggttcaga

SEQ ID NO: 22874 - DNA, 18 bp, Homo sapiens
gggagtcgggttcagatc

SEQ ID NO: 22875 - DNA, 19 bp, Homo sapiens
gggagtcgggttcagatcc

SEQ ID NO: 22876 - DNA, 20 bp, Homo sapiens
gggagtcgggttcagatccc

SEQ ID NO: 22877 - DNA, 23 bp, Homo sapiens
gggagtcgggttcagatccccga

SEQ ID NO: 22878 - DNA, 26 bp, Homo sapiens
gggagtcgggttcagatccccgaatc

SEQ ID NO: 22879 - DNA, 17 bp, Homo sapiens
ggagtcgggttcagatc

SEQ ID NO: 22880 - DNA, 18 bp, Homo sapiens
ggagtcgggttcagatcc

SEQ ID NO: 22881 - DNA, 26 bp, Homo sapiens
gtcgggttcagatccccgaatccgga

SEQ ID NO: 22882 - DNA, 33 bp, Homo sapiens; identical to SEQ ID NO: 4937

SEQ ID NO: 22883 - DNA, 37 bp, Homo sapiens
ggttcagatccccgaatccggagtggcggagatgggc

SEQ ID NO: 22884 - DNA, 17 bp, Homo sapiens
gttcagatccccgaatc

SEQ ID NO: 22885 - DNA, 21 bp, Homo sapiens
gttcagatccccgaatccgga

SEQ ID NO: 22886 - DNA, 36 bp, Homo sapiens
gttcagatccccgaatccggagtggcggagatgggc

SEQ ID NO: 22887 - DNA, 24 bp, Homo sapiens
cagatccccgaatccggagtggcg

SEQ ID NO: 22888 - DNA, 26 bp, Homo sapiens
cagatccccgaatccggagtggcgga

SEQ ID NO: 22889 - DNA, 33 bp, Homo sapiens
cagatccccgaatccggagtggcggagatgggc

SEQ ID NO: 22890 - DNA, 19 bp, Homo sapiens
agatccccgaatccggagt

SEQ ID NO: 22891 - DNA, 16 bp, Homo sapiens
gatccccgaatccgga

SEQ ID NO: 22892 - DNA, 19 bp, Homo sapiens
gatccccgaatccggagtg

SEQ ID NO: 22893 - DNA, 24 bp, Homo sapiens
gatccccgaatccggagtggcgga

SEQ ID NO: 22894 - DNA, 18 bp, Homo sapiens
atccccgaatccggagtg

SEQ ID NO: 22895 - DNA, 17 bp, Homo sapiens
tccccgaatccggagtg

SEQ ID NO: 22896 - DNA, 22 bp, Homo sapiens
tccccgaatccggagtggcgga

SEQ ID NO: 22897 - DNA, 26 bp, Homo sapiens
ccgaatccggagtggcggagatgggc

SEQ ID NO: 22898 - DNA, 29 bp, Homo sapiens
ccgaatccggagtggcggagatgggcgcc

SEQ ID NO: 22899 - DNA, 25 bp, Homo sapiens
cgaatccggagtggcggagatgggc

SEQ ID NO: 22900 - DNA, 28 bp, Homo sapiens
cgaatccggagtggcggagatgggcgcc

SEQ ID NO: 22901 - DNA, 30 bp, Homo sapiens
cgaatccggagtggcggagatgggcgccgc

SEQ ID NO: 22902 - DNA, 24 bp, Homo sapiens
gaatccggagtggcggagatgggc

SEQ ID NO: 22903 - DNA, 27 bp, Homo sapiens
gaatccggagtggcggagatgggcgcc

SEQ ID NO: 22904 - DNA, 23 bp, Homo sapiens
aatccggagtggcggagatgggc

SEQ ID NO: 22905 - DNA, 25 bp, Homo sapiens
atccggagtggcggagatgggcgcc

SEQ ID NO: 22906 - DNA, 16 bp, Homo sapiens
tccggagtggcggaga

SEQ ID NO: 22907 - DNA, 21 bp, Homo sapiens
tccggagtggcggagatgggc

SEQ ID NO: 22908 - DNA, 24 bp, Homo sapiens
tccggagtggcggagatgggcgcc

SEQ ID NO: 22909 - DNA, 20 bp, Homo sapiens
ccggagtggcggagatgggc

SEQ ID NO: 22910 - DNA, 23 bp, Homo sapiens
ccggagtggcggagatgggcgcc

SEQ ID NO: 22911 - DNA, 33 bp, Homo sapiens
ccggagtggcggagatgggcgccgcgaggcgtc

SEQ ID NO: 22912 - DNA, 30 bp, Homo sapiens
gtggcggagatgggcgccgcgaggcgtcca

SEQ ID NO: 22913 - DNA, 28 bp, Homo sapiens
tgggcgccgcgaggcgtccagtgcggta

SEQ ID NO: 22914 - DNA, 23 bp, Homo sapiens
gccgcgaggcgtccagtgcggta

SEQ ID NO: 22915 - DNA, 28 bp, Homo sapiens
gccgcgaggcgtccagtgcggtaacgcg

SEQ ID NO: 22916 - DNA, 26 bp, Homo sapiens
cgcgaggcgtccagtgcggtaacgcg

SEQ ID NO: 22917 - DNA, 25 bp, Homo sapiens
gcgaggcgtccagtgcggtaacgcg

SEQ ID NO: 22918 - DNA, 29 bp, Homo sapiens
gcgaggcgtccagtgcggtaacgcgaccg

SEQ ID NO: 22919 - DNA, 24 bp, Homo sapiens
cgaggcgtccagtgcggtaacgcg

SEQ ID NO: 22920 - DNA, 28 bp, Homo sapiens
cgaggcgtccagtgcggtaacgcgaccg

SEQ ID NO: 22921 - DNA, 24 bp, Homo sapiens
gaggcgtccagtgcggtaacgcga

SEQ ID NO: 22922 - DNA, 33 bp, Homo sapiens
ggcgtccagtgcggtaacgcgaccgatcccgga

SEQ ID NO: 22923 - DNA, 31 bp, Homo sapiens
cgtccagtgcggtaacgcgaccgatcccgga

SEQ ID NO: 22924 - DNA, 33 bp, Homo sapiens
cgtccagtgcggtaacgcgaccgatcccggaga

SEQ ID NO: 22925 - DNA, 22 bp, Homo sapiens
gtccagtgcggtaacgcgaccg

SEQ ID NO: 22926 - DNA, 30 bp, Homo sapiens
gtccagtgcggtaacgcgaccgatcccgga

SEQ ID NO: 22927 - DNA, 29 bp, Homo sapiens
tccagtgcggtaacgcgaccgatcccgga

SEQ ID NO: 22928 - DNA, 28 bp, Homo sapiens
ccagtgcggtaacgcgaccgatcccgga

SEQ ID NO: 22929 - DNA, 30 bp, Homo sapiens
ccagtgcggtaacgcgaccgatcccggaga

SEQ ID NO: 22930 - DNA, 31 bp, Homo sapiens
ccagtgcggtaacgcgaccgatcccggagaa

SEQ ID NO: 22931 - DNA, 17 bp, Homo sapiens
cagtgcggtaacgcgac

SEQ ID NO: 22932 - DNA, 19 bp, Homo sapiens
cagtgcggtaacgcgaccg

SEQ ID NO: 22933 - DNA, 27 bp, Homo sapiens
cagtgcggtaacgcgaccgatcccgga

SEQ ID NO: 22934 - DNA, 28 bp, Homo sapiens
cagtgcggtaacgcgaccgatcccggag

SEQ ID NO: 22935 - DNA, 29 bp, Homo sapiens
cagtgcggtaacgcgaccgatcccggaga

SEQ ID NO: 22936 - DNA, 30 bp, Homo sapiens; identical to SEQ ID NO: 4944

SEQ ID NO: 22937 - DNA, 31 bp, Homo sapiens
cagtgcggtaacgcgaccgatcccggagaag

SEQ ID NO: 22938 - DNA, 32 bp, Homo sapiens; identical to SEQ ID NO: 4945

SEQ ID NO: 22939 - DNA, 33 bp, Homo sapiens; identical to SEQ ID NO: 4946

SEQ ID NO: 22940 - DNA, 34 bp, Homo sapiens
cagtgcggtaacgcgaccgatcccggagaagccg

SEQ ID NO: 22941 - DNA, 16 bp, Homo sapiens
agtgcggtaacgcgac

SEQ ID NO: 22942 - DNA, 18 bp, Homo sapiens
agtgcggtaacgcgaccg

SEQ ID NO: 22943 - DNA, 26 bp, Homo sapiens
agtgcggtaacgcgaccgatcccgga

SEQ ID NO: 22944 - DNA, 27 bp, Homo sapiens
agtgcggtaacgcgaccgatcccggag

SEQ ID NO: 22945 - DNA, 28 bp, Homo sapiens
agtgcggtaacgcgaccgatcccggaga

SEQ ID NO: 22946 - DNA, 29 bp, Homo sapiens
agtgcggtaacgcgaccgatcccggagaa

SEQ ID NO: 22947 - DNA, 30 bp, Homo sapiens; identical to SEQ ID NO: 4950

SEQ ID NO: 22948 - DNA, 31 bp, Homo sapiens; identical to SEQ ID NO: 4951

SEQ ID NO: 22949 - DNA, 32 bp, Homo sapiens; identical to SEQ ID NO: 4952

SEQ ID NO: 22950 - DNA, 33 bp, Homo sapiens; identical to SEQ ID NO: 4953

SEQ ID NO: 22951 - DNA, 25 bp, Homo sapiens
gtgcggtaacgcgaccgatcccgga

SEQ ID NO: 22952 - DNA, 26 bp, Homo sapiens
gtgcggtaacgcgaccgatcccggag

SEQ ID NO: 22953 - DNA, 27 bp, Homo sapiens
gtgcggtaacgcgaccgatcccggaga

SEQ ID NO: 22954 - DNA, 28 bp, Homo sapiens
gtgcggtaacgcgaccgatcccggagaa

SEQ ID NO: 22955 - DNA, 29 bp, Homo sapiens
gtgcggtaacgcgaccgatcccggagaag

SEQ ID NO: 22956 - DNA, 30 bp, Homo sapiens; identical to SEQ ID NO: 4956

SEQ ID NO: 22957 - DNA, 31 bp, Homo sapiens; identical to SEQ ID NO: 4957

SEQ ID NO: 22958 - DNA, 32 bp, Homo sapiens
gtgcggtaacgcgaccgatcccggagaagccg

SEQ ID NO: 22959 - DNA, 24 bp, Homo sapiens
tgcggtaacgcgaccgatcccgga

SEQ ID NO: 22960 - DNA, 26 bp, Homo sapiens
tgcggtaacgcgaccgatcccggaga

SEQ ID NO: 22961 - DNA, 28 bp, Homo sapiens
tgcggtaacgcgaccgatcccggagaag

SEQ ID NO: 22962 - DNA, 29 bp, Homo sapiens
tgcggtaacgcgaccgatcccggagaagc

SEQ ID NO: 22963 - DNA, 30 bp, Homo sapiens
tgcggtaacgcgaccgatcccggagaagcc

SEQ ID NO: 22964 - DNA, 31 bp, Homo sapiens
tgcggtaacgcgaccgatcccggagaagccg

SEQ ID NO: 22965 - DNA, 22 bp, Homo sapiens
cggtaacgcgaccgatcccgga

SEQ ID NO: 22966 - DNA, 21 bp, Homo sapiens
ggtaacgcgaccgatcccgga

SEQ ID NO: 22967 - DNA, 22 bp, Homo sapiens
ggtaacgcgaccgatcccggag

SEQ ID NO: 22968 - DNA, 23 bp, Homo sapiens
ggtaacgcgaccgatcccggaga

SEQ ID NO: 22969 - DNA, 24 bp, Homo sapiens
ggtaacgcgaccgatcccggagaa

SEQ ID NO: 22970 - DNA, 25 bp, Homo sapiens
ggtaacgcgaccgatcccggagaag

SEQ ID NO: 22971 - DNA, 26 bp, Homo sapiens
ggtaacgcgaccgatcccggagaagc

SEQ ID NO: 22972 - DNA, 27 bp, Homo sapiens
ggtaacgcgaccgatcccggagaagcc

SEQ ID NO: 22973 - DNA, 20 bp, Homo sapiens
gtaacgcgaccgatcccgga

SEQ ID NO: 22974 - DNA, 21 bp, Homo sapiens
gtaacgcgaccgatcccggag

SEQ ID NO: 22975 - DNA, 22 bp, Homo sapiens
gtaacgcgaccgatcccggaga

SEQ ID NO: 22976 - DNA, 24 bp, Homo sapiens
gtaacgcgaccgatcccggagaag

SEQ ID NO: 22977 - DNA, 19 bp, Homo sapiens
taacgcgaccgatcccgga

SEQ ID NO: 22978 - DNA, 20 bp, Homo sapiens
taacgcgaccgatcccggag

SEQ ID NO: 22979 - DNA, 21 bp, Homo sapiens
taacgcgaccgatcccggaga

SEQ ID NO: 22980 - DNA, 23 bp, Homo sapiens
taacgcgaccgatcccggagaag

SEQ ID NO: 22981 - DNA, 18 bp, Homo sapiens
aacgcgaccgatcccgga

SEQ ID NO: 22982 - DNA, 19 bp, Homo sapiens
aacgcgaccgatcccggag

SEQ ID NO: 22983 - DNA, 20 bp, Homo sapiens
aacgcgaccgatcccggaga

SEQ ID NO: 22984 - DNA, 21 bp, Homo sapiens
aacgcgaccgatcccggagaa

SEQ ID NO: 22985 - DNA, 22 bp, Homo sapiens
aacgcgaccgatcccggagaag

SEQ ID NO: 22986 - DNA, 17 bp, Homo sapiens
acgcgaccgatcccgga

SEQ ID NO: 22987 - DNA, 18 bp, Homo sapiens
acgcgaccgatcccggag

SEQ ID NO: 22988 - DNA, 19 bp, Homo sapiens
acgcgaccgatcccggaga

SEQ ID NO: 22989 - DNA, 20 bp, Homo sapiens
acgcgaccgatcccggagaa

SEQ ID NO: 22990 - DNA, 21 bp, Homo sapiens
acgcgaccgatcccggagaag

SEQ ID NO: 22991 - DNA, 22 bp, Homo sapiens
acgcgaccgatcccggagaagc

SEQ ID NO: 22992 - DNA, 27 bp, Homo sapiens
acgcgaccgatcccggagaagccggcg

SEQ ID NO: 22993 - DNA, 16 bp, Homo sapiens
cgcgaccgatcccgga

SEQ ID NO: 22994 - DNA, 17 bp, Homo sapiens
cgcgaccgatcccggag

SEQ ID NO: 22995 - DNA, 18 bp, Homo sapiens
cgcgaccgatcccggaga

SEQ ID NO: 22996 - DNA, 19 bp, Homo sapiens
cgcgaccgatcccggagaa

SEQ ID NO: 22997 - DNA, 20 bp, Homo sapiens
cgcgaccgatcccggagaag

SEQ ID NO: 22998 - DNA, 21 bp, Homo sapiens
cgcgaccgatcccggagaagc

SEQ ID NO: 22999 - DNA, 26 bp, Homo sapiens
cgcgaccgatcccggagaagccggcg

SEQ ID NO: 23000 - DNA, 27 bp, Homo sapiens
cgcgaccgatcccggagaagccggcgg

SEQ ID NO: 23001 - DNA, 29 bp, Homo sapiens
cgcgaccgatcccggagaagccggcggga

SEQ ID NO: 23002 - DNA, 17 bp, Homo sapiens
gcgaccgatcccggaga

SEQ ID NO: 23003 - DNA, 20 bp, Homo sapiens
gcgaccgatcccggagaagc

SEQ ID NO: 23004 - DNA, 20 bp, Homo sapiens
cgaccgatcccggagaagcc

SEQ ID NO: 23005 - DNA, 21 bp, Homo sapiens
cgaccgatcccggagaagccg

SEQ ID NO: 23006 - DNA, 18 bp, Homo sapiens
gaccgatcccggagaagc

SEQ ID NO: 23007 - DNA, 19 bp, Homo sapiens
gaccgatcccggagaagcc

SEQ ID NO: 23008 - DNA, 20 bp, Homo sapiens
gaccgatcccggagaagccg

SEQ ID NO: 23009 - DNA, 23 bp, Homo sapiens
gaccgatcccggagaagccggcg

SEQ ID NO: 23010 - DNA, 29 bp, Homo sapiens
gaccgatcccggagaagccggcgggagcc

SEQ ID NO: 23011 - DNA, 30 bp, Homo sapiens; identical to SEQ ID NO: 4964

SEQ ID NO: 23012 - DNA, 32 bp, Homo sapiens
gaccgatcccggagaagccggcgggagccccg

SEQ ID NO: 23013 - DNA, 33 bp, Homo sapiens
gaccgatcccggagaagccggcgggagccccgg

SEQ ID NO: 23014 - DNA, 34 bp, Homo sapiens
gaccgatcccggagaagccggcgggagccccggg

SEQ ID NO: 23015 - DNA, 35 bp, Homo sapiens
gaccgatcccggagaagccggcgggagccccgggg

SEQ ID NO: 23016 - DNA, 40 bp, Homo sapiens
gaccgatcccggagaagccggcgggagccccggggagagt

SEQ ID NO: 23017 - DNA, 18 bp, Homo sapiens
accgatcccggagaagcc

SEQ ID NO: 23018 - DNA, 22 bp, Homo sapiens
accgatcccggagaagccggcg

SEQ ID NO: 23019 - DNA, 21 bp, Homo sapiens
ccgatcccggagaagccggcg

SEQ ID NO: 23020 - DNA, 33 bp, Homo sapiens
cccggagaagccggcgggagccccggggagagt

SEQ ID NO: 23021 - DNA, 29 bp, Homo sapiens
ggagaagccggcgggagccccggggagag

SEQ ID NO: 23022 - DNA, 30 bp, Homo sapiens
ggagaagccggcgggagccccggggagagt

SEQ ID NO: 23023 - DNA, 17 bp, Homo sapiens
agaagccggcgggagcc

SEQ ID NO: 23024 - DNA, 18 bp, Homo sapiens
agaagccggcgggagccc

SEQ ID NO: 23025 - DNA, 24 bp, Homo sapiens
agaagccggcgggagccccgggga

SEQ ID NO: 23026 - DNA, 27 bp, Homo sapiens
agaagccggcgggagccccggggagag

SEQ ID NO: 23027 - DNA, 28 bp, Homo sapiens
agaagccggcgggagccccggggagagt

SEQ ID NO: 23028 - DNA, 16 bp, Homo sapiens
gaagccggcgggagcc

SEQ ID NO: 23029 - DNA, 17 bp, Homo sapiens
gaagccggcgggagccc

SEQ ID NO: 23030 - DNA, 27 bp, Homo sapiens
gaagccggcgggagccccggggagagt

SEQ ID NO: 23031 - DNA, 16 bp, Homo sapiens
aagccggcgggagccc

SEQ ID NO: 23032 - DNA, 26 bp, Homo sapiens
aagccggcgggagccccggggagagt

SEQ ID NO: 23033 - DNA, 21 bp, Homo sapiens
agccggcgggagccccgggga

SEQ ID NO: 23034 - DNA, 19 bp, Homo sapiens
gccggcgggagccccgggg

SEQ ID NO: 23035 - DNA, 20 bp, Homo sapiens
gccggcgggagccccgggga

SEQ ID NO: 23036 - DNA, 19 bp, Homo sapiens
ccggcgggagccccgggga

SEQ ID NO: 23037 - DNA, 17 bp, Homo sapiens
cggcgggagccccgggg

SEQ ID NO: 23038 - DNA, 18 bp, Homo sapiens
cggcgggagccccgggga

SEQ ID NO: 23039 - DNA, 21 bp, Homo sapiens
cggcgggagccccggggagag

SEQ ID NO: 23040 - DNA, 21 bp, Homo sapiens
ggcgggagccccggggagagt

SEQ ID NO: 23041 - DNA, 22 bp, Homo sapiens
cggggagagttctcttttcttt

SEQ ID NO: 23042 - DNA, 23 bp, Homo sapiens
cggggagagttctcttttctttg

SEQ ID NO: 23043 - DNA, 30 bp, Homo sapiens
gagttctcttttctttgtgaagggcagggc

SEQ ID NO: 23044 - DNA, 33 bp, Homo sapiens
agttctcttttctttgtgaagggcagggcgccc

SEQ ID NO: 23045 - DNA, 18 bp, Homo sapiens
gttctcttttctttgtga

SEQ ID NO: 23046 - DNA, 19 bp, Homo sapiens
gttctcttttctttgtgaa

SEQ ID NO: 23047 - DNA, 28 bp, Homo sapiens
gttctcttttctttgtgaagggcagggc

SEQ ID NO: 23048 - DNA, 32 bp, Homo sapiens
gttctcttttctttgtgaagggcagggcgccc

SEQ ID NO: 23049 - DNA, 27 bp, Homo sapiens
ttgtgaagggcagggcgccctggaatg

SEQ ID NO: 23050 - DNA, 25 bp, Homo sapiens
gtgaagggcagggcgccctggaatg

SEQ ID NO: 23051 - DNA, 33 bp, Homo sapiens
gtgaagggcagggcgccctggaatgggttcgcc

SEQ ID NO: 23052 - DNA, 32 bp, Homo sapiens; identical to SEQ ID NO: 4968

SEQ ID NO: 23053 - DNA, 33 bp, Homo sapiens; identical to SEQ ID NO: 4969

SEQ ID NO: 23054 - DNA, 16 bp, Homo sapiens
gaagggcagggcgccc

SEQ ID NO: 23055 - DNA, 26 bp, Homo sapiens
gaagggcagggcgccctggaatgggt

SEQ ID NO: 23056 - DNA, 27 bp, Homo sapiens
gaagggcagggcgccctggaatgggtt

SEQ ID NO: 23057 - DNA, 22 bp, Homo sapiens
aagggcagggcgccctggaatg

SEQ ID NO: 23058 - DNA, 30 bp, Homo sapiens; identical to SEQ ID NO: 4971

SEQ ID NO: 23059 - DNA, 31 bp, Homo sapiens; identical to SEQ ID NO: 4972

SEQ ID NO: 23060 - DNA, 25 bp, Homo sapiens
agggcagggcgccctggaatgggtt

SEQ ID NO: 23061 - DNA, 30 bp, Homo sapiens
agggcagggcgccctggaatgggttcgccc

SEQ ID NO: 23062 - DNA, 29 bp, Homo sapiens
tggaatgggttcgccccgagagaggggcc

SEQ ID NO: 23063 - DNA, 33 bp, Homo sapiens
aatgggttcgccccgagagaggggcccgtgcct

SEQ ID NO: 23064 - DNA, 32 bp, Homo sapiens
atgggttcgccccgagagaggggcccgtgcct

SEQ ID NO: 23065 - DNA, 31 bp, Homo sapiens; identical to SEQ ID NO: 4973

SEQ ID NO: 23066 - DNA, 22 bp, Homo sapiens
gggttcgccccgagagaggggc

SEQ ID NO: 23067 - DNA, 16 bp, Homo sapiens
ggttcgccccgagaga

SEQ ID NO: 23068 - DNA, 33 bp, Homo sapiens
ggttcgccccgagagaggggcccgtgccttgga

SEQ ID NO: 23069 - DNA, 16 bp, Homo sapiens
gttcgccccgagagag

SEQ ID NO: 23070 - DNA, 18 bp, Homo sapiens
ccccgagagaggggcccg

SEQ ID NO: 23071 - DNA, 24 bp, Homo sapiens
ccccgagagaggggcccgtgcctt

SEQ ID NO: 23072 - DNA, 16 bp, Homo sapiens
cccgagagaggggccc

SEQ ID NO: 23073 - DNA, 17 bp, Homo sapiens
cccgagagaggggcccg

SEQ ID NO: 23074 - DNA, 18 bp, Homo sapiens
cccgagagaggggcccgt

SEQ ID NO: 23075 - DNA, 21 bp, Homo sapiens
cccgagagaggggcccgtgcc

SEQ ID NO: 23076 - DNA, 22 bp, Homo sapiens
cccgagagaggggcccgtgcct

SEQ ID NO: 23077 - DNA, 23 bp, Homo sapiens
cccgagagaggggcccgtgcctt

SEQ ID NO: 23078 - DNA, 16 bp, Homo sapiens
ccgagagaggggcccg

SEQ ID NO: 23079 - DNA, 17 bp, Homo sapiens
ccgagagaggggcccgt

SEQ ID NO: 23080 - DNA, 21 bp, Homo sapiens
ccgagagaggggcccgtgcct

SEQ ID NO: 23081 - DNA, 22 bp, Homo sapiens
ccgagagaggggcccgtgcctt

SEQ ID NO: 23082 - DNA, 32 bp, Homo sapiens; identical to SEQ ID NO: 4976

SEQ ID NO: 23083 - DNA, 33 bp, Homo sapiens
ccgagagaggggcccgtgccttggaaagcgtcg

SEQ ID NO: 23084 - DNA, 35 bp, Homo sapiens
ccgagagaggggcccgtgccttggaaagcgtcgcg

SEQ ID NO: 23085 - DNA, 16 bp, Homo sapiens
cgagagaggggcccgt

SEQ ID NO: 23086 - DNA, 21 bp, Homo sapiens
cgagagaggggcccgtgcctt

SEQ ID NO: 23087 - DNA, 31 bp, Homo sapiens; identical to SEQ ID NO: 4977

SEQ ID NO: 23088 - DNA, 32 bp, Homo sapiens; identical to SEQ ID NO: 4978

SEQ ID NO: 23089 - DNA, 33 bp, Homo sapiens; identical to SEQ ID NO: 4979

SEQ ID NO: 23090 - DNA, 34 bp, Homo sapiens
cgagagaggggcccgtgccttggaaagcgtcgcg

SEQ ID NO: 23091 - DNA, 20 bp, Homo sapiens
gagagaggggcccgtgcctt

SEQ ID NO: 23092 - DNA, 30 bp, Homo sapiens; identical to SEQ ID NO: 4980

SEQ ID NO: 23093 - DNA, 31 bp, Homo sapiens
gagagaggggcccgtgccttggaaagcgtcg

SEQ ID NO: 23094 - DNA, 32 bp, Homo sapiens; identical to SEQ ID NO: 4981

SEQ ID NO: 23095 - DNA, 33 bp, Homo sapiens; identical to SEQ ID NO: 4982

SEQ ID NO: 23096 - DNA, 19 bp, Homo sapiens
agagaggggcccgtgcctt

SEQ ID NO: 23097 - DNA, 29 bp, Homo sapiens
agagaggggcccgtgccttggaaagcgtc

SEQ ID NO: 23098 - DNA, 30 bp, Homo sapiens; identical to SEQ ID NO: 4984

SEQ ID NO: 23099 - DNA, 31 bp, Homo sapiens; identical to SEQ ID NO: 4985

SEQ ID NO: 23100 - DNA, 32 bp, Homo sapiens; identical to SEQ ID NO: 4986

SEQ ID NO: 23101 - DNA, 33 bp, Homo sapiens
agagaggggcccgtgccttggaaagcgtcgcgg

SEQ ID NO: 23102 - DNA, 28 bp, Homo sapiens
gagaggggcccgtgccttggaaagcgtc

SEQ ID NO: 23103 - DNA, 30 bp, Homo sapiens
gagaggggcccgtgccttggaaagcgtcgc

SEQ ID NO: 23104 - DNA, 31 bp, Homo sapiens; identical to SEQ ID NO: 4987

SEQ ID NO: 23105 - DNA, 27 bp, Homo sapiens
agaggggcccgtgccttggaaagcgtc

SEQ ID NO: 23106 - DNA, 28 bp, Homo sapiens
agaggggcccgtgccttggaaagcgtcg

SEQ ID NO: 23107 - DNA, 29 bp, Homo sapiens
agaggggcccgtgccttggaaagcgtcgc

SEQ ID NO: 23108 - DNA, 30 bp, Homo sapiens; identical to SEQ ID NO: 4990

SEQ ID NO: 23109 - DNA, 33 bp, Homo sapiens
agaggggcccgtgccttggaaagcgtcgcggtt

SEQ ID NO: 23110 - DNA, 28 bp, Homo sapiens
gaggggcccgtgccttggaaagcgtcgc

SEQ ID NO: 23111 - DNA, 29 bp, Homo sapiens
gaggggcccgtgccttggaaagcgtcgcg

SEQ ID NO: 23112 - DNA, 31 bp, Homo sapiens
gaggggcccgtgccttggaaagcgtcgcggt

SEQ ID NO: 23113 - DNA, 25 bp, Homo sapiens
aggggcccgtgccttggaaagcgtc

SEQ ID NO: 23114 - DNA, 27 bp, Homo sapiens
aggggcccgtgccttggaaagcgtcgc

SEQ ID NO: 23115 - DNA, 28 bp, Homo sapiens
aggggcccgtgccttggaaagcgtcgcg

SEQ ID NO: 23116 - DNA, 31 bp, Homo sapiens
aggggcccgtgccttggaaagcgtcgcggtt

SEQ ID NO: 23117 - DNA, 32 bp, Homo sapiens
aggggcccgtgccttggaaagcgtcgcggttc

SEQ ID NO: 23118 - DNA, 24 bp, Homo sapiens
ggggcccgtgccttggaaagcgtc

SEQ ID NO: 23119 - DNA, 26 bp, Homo sapiens
ggggcccgtgccttggaaagcgtcgc

SEQ ID NO: 23120 - DNA, 27 bp, Homo sapiens
ggggcccgtgccttggaaagcgtcgcg

SEQ ID NO: 23121 - DNA, 29 bp, Homo sapiens
ggggcccgtgccttggaaagcgtcgcggt

SEQ ID NO: 23122 - DNA, 30 bp, Homo sapiens
ggggcccgtgccttggaaagcgtcgcggtt

SEQ ID NO: 23123 - DNA, 31 bp, Homo sapiens
ggggcccgtgccttggaaagcgtcgcggttc

SEQ ID NO: 23124 - DNA, 23 bp, Homo sapiens
gggcccgtgccttggaaagcgtc

SEQ ID NO: 23125 - DNA, 29 bp, Homo sapiens
gggcccgtgccttggaaagcgtcgcggtt

SEQ ID NO: 23126 - DNA, 30 bp, Homo sapiens
gggcccgtgccttggaaagcgtcgcggttc

SEQ ID NO: 23127 - DNA, 29 bp, Homo sapiens
ggcccgtgccttggaaagcgtcgcggttc

SEQ ID NO: 23128 - DNA, 27 bp, Homo sapiens
cgtgccttggaaagcgtcgcggttccg

SEQ ID NO: 23129 - DNA, 23 bp, Homo sapiens
gtgccttggaaagcgtcgcggtt

SEQ ID NO: 23130 - DNA, 24 bp, Homo sapiens
gtgccttggaaagcgtcgcggttc

SEQ ID NO: 23131 - DNA, 25 bp, Homo sapiens
gtgccttggaaagcgtcgcggttcc

SEQ ID NO: 23132 - DNA, 26 bp, Homo sapiens
gtgccttggaaagcgtcgcggttccg

SEQ ID NO: 23133 - DNA, 18 bp, Homo sapiens
tgccttggaaagcgtcgc

SEQ ID NO: 23134 - DNA, 19 bp, Homo sapiens
tgccttggaaagcgtcgcg

SEQ ID NO: 23135 - DNA, 20 bp, Homo sapiens
tgccttggaaagcgtcgcgg

SEQ ID NO: 23136 - DNA, 21 bp, Homo sapiens
tgccttggaaagcgtcgcggt

SEQ ID NO: 23137 - DNA, 22 bp, Homo sapiens
tgccttggaaagcgtcgcggtt

SEQ ID NO: 23138 - DNA, 23 bp, Homo sapiens
tgccttggaaagcgtcgcggttc

SEQ ID NO: 23139 - DNA, 24 bp, Homo sapiens
tgccttggaaagcgtcgcggttcc

SEQ ID NO: 23140 - DNA, 25 bp, Homo sapiens
tgccttggaaagcgtcgcggttccg

SEQ ID NO: 23141 - DNA, 33 bp, Homo sapiens
tgccttggaaagcgtcgcggttccggcggcgtc

SEQ ID NO: 23142 - DNA, 47 bp, Homo sapiens
tgccttggaaagcgtcgcggttccggcggcgtccggtgagctctcgc

SEQ ID NO: 23143 - DNA, 18 bp, Homo sapiens
gccttggaaagcgtcgcg

SEQ ID NO: 23144 - DNA, 20 bp, Homo sapiens
gccttggaaagcgtcgcggt

SEQ ID NO: 23145 - DNA, 21 bp, Homo sapiens
gccttggaaagcgtcgcggtt

SEQ ID NO: 23146 - DNA, 22 bp, Homo sapiens
gccttggaaagcgtcgcggttc

SEQ ID NO: 23147 - DNA, 23 bp, Homo sapiens
gccttggaaagcgtcgcggttcc

SEQ ID NO: 23148 - DNA, 24 bp, Homo sapiens
gccttggaaagcgtcgcggttccg

SEQ ID NO: 23149 - DNA, 16 bp, Homo sapiens
ccttggaaagcgtcgc

SEQ ID NO: 23150 - DNA, 17 bp, Homo sapiens
ccttggaaagcgtcgcg

SEQ ID NO: 23151 - DNA, 18 bp, Homo sapiens
ccttggaaagcgtcgcgg

SEQ ID NO: 23152 - DNA, 19 bp, Homo sapiens
ccttggaaagcgtcgcggt

SEQ ID NO: 23153 - DNA, 20 bp, Homo sapiens
ccttggaaagcgtcgcggtt

SEQ ID NO: 23154 - DNA, 21 bp, Homo sapiens
ccttggaaagcgtcgcggttc

SEQ ID NO: 23155 - DNA, 22 bp, Homo sapiens
ccttggaaagcgtcgcggttcc

SEQ ID NO: 23156 - DNA, 23 bp, Homo sapiens
ccttggaaagcgtcgcggttccg

SEQ ID NO: 23157 - DNA, 46 bp, Homo sapiens
ccttggaaagcgtcgcggttccggcggcgtccggtgagctctcgct

SEQ ID NO: 23158 - DNA, 16 bp, Homo sapiens
cttggaaagcgtcgcg

SEQ ID NO: 23159 - DNA, 19 bp, Homo sapiens
cttggaaagcgtcgcggtt

SEQ ID NO: 23160 - DNA, 20 bp, Homo sapiens
cttggaaagcgtcgcggttc

SEQ ID NO: 23161 - DNA, 21 bp, Homo sapiens
cttggaaagcgtcgcggttcc

SEQ ID NO: 23162 - DNA, 44 bp, Homo sapiens
cttggaaagcgtcgcggttccggcggcgtccggtgagctctcgc

SEQ ID NO: 23163 - DNA, 45 bp, Homo sapiens
cttggaaagcgtcgcggttccggcggcgtccggtgagctctcgct

SEQ ID NO: 23164 - DNA, 18 bp, Homo sapiens
ttggaaagcgtcgcggtt

SEQ ID NO: 23165 - DNA, 19 bp, Homo sapiens
ttggaaagcgtcgcggttc

SEQ ID NO: 23166 - DNA, 20 bp, Homo sapiens
ttggaaagcgtcgcggttcc

SEQ ID NO: 23167 - DNA, 17 bp, Homo sapiens
ggaaagcgtcgcggttc

SEQ ID NO: 23168 - DNA, 18 bp, Homo sapiens
ggaaagcgtcgcggttcc

SEQ ID NO: 23169 - DNA, 16 bp, Homo sapiens
gaaagcgtcgcggttc

SEQ ID NO: 23170 - DNA, 17 bp, Homo sapiens
gaaagcgtcgcggttcc

SEQ ID NO: 23171 - DNA, 18 bp, Homo sapiens
gaaagcgtcgcggttccg

SEQ ID NO: 23172 - DNA, 46 bp, Homo sapiens
gaaagcgtcgcggttccggcggcgtccggtgagctctcgctggccc

SEQ ID NO: 23173 - DNA, 16 bp, Homo sapiens
aaagcgtcgcggttcc

SEQ ID NO: 23174 - DNA, 17 bp, Homo sapiens
aaagcgtcgcggttccg

SEQ ID NO: 23175 - DNA, 19 bp, Homo sapiens
aaagcgtcgcggttccggc

SEQ ID NO: 23176 - DNA, 20 bp, Homo sapiens
aaagcgtcgcggttccggcg

SEQ ID NO: 23177 - DNA, 45 bp, Homo sapiens
aaagcgtcgcggttccggcggcgtccggtgagctctcgctggccc

SEQ ID NO: 23178 - DNA, 16 bp, Homo sapiens
aagcgtcgcggttccg

SEQ ID NO: 23179 - DNA, 18 bp, Homo sapiens
aagcgtcgcggttccggc

SEQ ID NO: 23180 - DNA, 19 bp, Homo sapiens
aagcgtcgcggttccggcg

SEQ ID NO: 23181 - DNA, 17 bp, Homo sapiens
agcgtcgcggttccggc

SEQ ID NO: 23182 - DNA, 18 bp, Homo sapiens
agcgtcgcggttccggcg

SEQ ID NO: 23183 - DNA, 16 bp, Homo sapiens
gcgtcgcggttccggc

SEQ ID NO: 23184 - DNA, 17 bp, Homo sapiens
gcgtcgcggttccggcg

SEQ ID NO: 23185 - DNA, 24 bp, Homo sapiens
tcgcggttccggcggcgtccggtg

SEQ ID NO: 23186 - DNA, 33 bp, Homo sapiens
tcgcggttccggcggcgtccggtgagctctcgc

SEQ ID NO: 23187 - DNA, 23 bp, Homo sapiens
cgcggttccggcggcgtccggtg

SEQ ID NO: 23188 - DNA, 22 bp, Homo sapiens
gcggttccggcggcgtccggtg

SEQ ID NO: 23189 - DNA, 31 bp, Homo sapiens; identical to SEQ ID NO: 5021

SEQ ID NO: 23190 - DNA, 32 bp, Homo sapiens; identical to SEQ ID NO: 5022

SEQ ID NO: 23191 - DNA, 33 bp, Homo sapiens
gcggttccggcggcgtccggtgagctctcgctg

SEQ ID NO: 23192 - DNA, 36 bp, Homo sapiens
gcggttccggcggcgtccggtgagctctcgctggcc

SEQ ID NO: 23193 - DNA, 37 bp, Homo sapiens
gcggttccggcggcgtccggtgagctctcgctggccc

SEQ ID NO: 23194 - DNA, 38 bp, Homo sapiens
gcggttccggcggcgtccggtgagctctcgctggccct

SEQ ID NO: 23195 - DNA, 39 bp, Homo sapiens
gcggttccggcggcgtccggtgagctctcgctggccctt

SEQ ID NO: 23196 - DNA, 40 bp, Homo sapiens
gcggttccggcggcgtccggtgagctctcgctggcccttg

SEQ ID NO: 23197 - DNA, 42 bp, Homo sapiens
gcggttccggcggcgtccggtgagctctcgctggcccttgaa

SEQ ID NO: 23198 - DNA, 43 bp, Homo sapiens
gcggttccggcggcgtccggtgagctctcgctggcccttgaaa

SEQ ID NO: 23199 - DNA, 30 bp, Homo sapiens; identical to SEQ ID NO: 5023

SEQ ID NO: 23200 - DNA, 31 bp, Homo sapiens; identical to SEQ ID NO: 5024

SEQ ID NO: 23201 - DNA, 32 bp, Homo sapiens
cggttccggcggcgtccggtgagctctcgctg

SEQ ID NO: 23202 - DNA, 33 bp, Homo sapiens
cggttccggcggcgtccggtgagctctcgctgg

SEQ ID NO: 23203 - DNA, 35 bp, Homo sapiens
cggttccggcggcgtccggtgagctctcgctggcc

SEQ ID NO: 23204 - DNA, 36 bp, Homo sapiens
cggttccggcggcgtccggtgagctctcgctggccc

SEQ ID NO: 23205 - DNA, 37 bp, Homo sapiens
cggttccggcggcgtccggtgagctctcgctggccct

SEQ ID NO: 23206 - DNA, 29 bp, Homo sapiens
ggttccggcggcgtccggtgagctctcgc

SEQ ID NO: 23207 - DNA, 30 bp, Homo sapiens; identical to SEQ ID NO: 5025

SEQ ID NO: 23208 - DNA, 31 bp, Homo sapiens
ggttccggcggcgtccggtgagctctcgctg

SEQ ID NO: 23209 - DNA, 32 bp, Homo sapiens
ggttccggcggcgtccggtgagctctcgctgg

SEQ ID NO: 23210 - DNA, 34 bp, Homo sapiens
ggttccggcggcgtccggtgagctctcgctggcc

SEQ ID NO: 23211 - DNA, 35 bp, Homo sapiens
ggttccggcggcgtccggtgagctctcgctggccc

SEQ ID NO: 23212 - DNA, 27 bp, Homo sapiens
gttccggcggcgtccggtgagctctcg

SEQ ID NO: 23213 - DNA, 28 bp, Homo sapiens
gttccggcggcgtccggtgagctctcgc

SEQ ID NO: 23214 - DNA, 29 bp, Homo sapiens
gttccggcggcgtccggtgagctctcgct

SEQ ID NO: 23215 - DNA, 30 bp, Homo sapiens
gttccggcggcgtccggtgagctctcgctg

SEQ ID NO: 23216 - DNA, 31 bp, Homo sapiens
gttccggcggcgtccggtgagctctcgctgg

SEQ ID NO: 23217 - DNA, 32 bp, Homo sapiens
gttccggcggcgtccggtgagctctcgctggc

SEQ ID NO: 23218 - DNA, 33 bp, Homo sapiens; identical to SEQ ID NO: 5027

SEQ ID NO: 23219 - DNA, 34 bp, Homo sapiens
gttccggcggcgtccggtgagctctcgctggccc

SEQ ID NO: 23220 - DNA, 35 bp, Homo sapiens
gttccggcggcgtccggtgagctctcgctggccct

SEQ ID NO: 23221 - DNA, 36 bp, Homo sapiens
gttccggcggcgtccggtgagctctcgctggccctt

SEQ ID NO: 23222 - DNA, 37 bp, Homo sapiens
gttccggcggcgtccggtgagctctcgctggcccttg

SEQ ID NO: 23223 - DNA, 38 bp, Homo sapiens
gttccggcggcgtccggtgagctctcgctggcccttga

SEQ ID NO: 23224 - DNA, 39 bp, Homo sapiens
gttccggcggcgtccggtgagctctcgctggcccttgaa

SEQ ID NO: 23225 - DNA, 30 bp, Homo sapiens
ttccggcggcgtccggtgagctctcgctgg

SEQ ID NO: 23226 - DNA, 32 bp, Homo sapiens; identical to SEQ ID NO: 5028

SEQ ID NO: 23227 - DNA, 33 bp, Homo sapiens; identical to SEQ ID NO: 5029

SEQ ID NO: 23228 - DNA, 34 bp, Homo sapiens
ttccggcggcgtccggtgagctctcgctggccct

SEQ ID NO: 23229 - DNA, 29 bp, Homo sapiens
tccggcggcgtccggtgagctctcgctgg

SEQ ID NO: 23230 - DNA, 31 bp, Homo sapiens; identical to SEQ ID NO: 5030

SEQ ID NO: 23231 - DNA, 32 bp, Homo sapiens; identical to SEQ ID NO: 5031

SEQ ID NO: 23232 - DNA, 33 bp, Homo sapiens; identical to SEQ ID NO: 5032

SEQ ID NO: 23233 - DNA, 25 bp, Homo sapiens
ccggcggcgtccggtgagctctcgc

SEQ ID NO: 23234 - DNA, 26 bp, Homo sapiens
ccggcggcgtccggtgagctctcgct

SEQ ID NO: 23235 - DNA, 28 bp, Homo sapiens
ccggcggcgtccggtgagctctcgctgg

SEQ ID NO: 23236 - DNA, 29 bp, Homo sapiens
ccggcggcgtccggtgagctctcgctggc

SEQ ID NO: 23237 - DNA, 30 bp, Homo sapiens; identical to SEQ ID NO: 5033

SEQ ID NO: 23238 - DNA, 31 bp, Homo sapiens; identical to SEQ ID NO: 5034

SEQ ID NO: 23239 - DNA, 32 bp, Homo sapiens; identical to SEQ ID NO: 5035

SEQ ID NO: 23240 - DNA, 24 bp, Homo sapiens
cggcggcgtccggtgagctctcgc

SEQ ID NO: 23241 - DNA, 25 bp, Homo sapiens
cggcggcgtccggtgagctctcgct

SEQ ID NO: 23242 - DNA, 26 bp, Homo sapiens
cggcggcgtccggtgagctctcgctg

SEQ ID NO: 23243 - DNA, 27 bp, Homo sapiens
cggcggcgtccggtgagctctcgctgg

SEQ ID NO: 23244 - DNA, 28 bp, Homo sapiens
cggcggcgtccggtgagctctcgctggc

SEQ ID NO: 23245 - DNA, 29 bp, Homo sapiens
cggcggcgtccggtgagctctcgctggcc

SEQ ID NO: 23246 - DNA, 30 bp, Homo sapiens; identical to SEQ ID NO: 5041

SEQ ID NO: 23247 - DNA, 31 bp, Homo sapiens; identical to SEQ ID NO: 5042

SEQ ID NO: 23248 - DNA, 33 bp, Homo sapiens
cggcggcgtccggtgagctctcgctggcccttg

SEQ ID NO: 23249 - DNA, 20 bp, Homo sapiens
ggcggcgtccggtgagctct

SEQ ID NO: 23250 - DNA, 21 bp, Homo sapiens
ggcggcgtccggtgagctctc

SEQ ID NO: 23251 - DNA, 22 bp, Homo sapiens
ggcggcgtccggtgagctctcg

SEQ ID NO: 23252 - DNA, 23 bp, Homo sapiens
ggcggcgtccggtgagctctcgc

SEQ ID NO: 23253 - DNA, 24 bp, Homo sapiens
ggcggcgtccggtgagctctcgct

SEQ ID NO: 23254 - DNA, 25 bp, Homo sapiens
ggcggcgtccggtgagctctcgctg

SEQ ID NO: 23255 - DNA, 26 bp, Homo sapiens
ggcggcgtccggtgagctctcgctgg

SEQ ID NO: 23256 - DNA, 27 bp, Homo sapiens
ggcggcgtccggtgagctctcgctggc

SEQ ID NO: 23257 - DNA, 28 bp, Homo sapiens
ggcggcgtccggtgagctctcgctggcc

SEQ ID NO: 23258 - DNA, 29 bp, Homo sapiens
ggcggcgtccggtgagctctcgctggccc

SEQ ID NO: 23259 - DNA, 30 bp, Homo sapiens; identical to SEQ ID NO: 5051

SEQ ID NO: 23260 - DNA, 31 bp, Homo sapiens; identical to SEQ ID NO: 5052

SEQ ID NO: 23261 - DNA, 32 bp, Homo sapiens
ggcggcgtccggtgagctctcgctggcccttg

SEQ ID NO: 23262 - DNA, 33 bp, Homo sapiens
ggcggcgtccggtgagctctcgctggcccttga

SEQ ID NO: 23263 - DNA, 40 bp, Homo sapiens
ggcggcgtccggtgagctctcgctggcccttgaaaatccg

SEQ ID NO: 23264 - DNA, 18 bp, Homo sapiens
gcggcgtccggtgagctc

SEQ ID NO: 23265 - DNA, 19 bp, Homo sapiens
gcggcgtccggtgagctct

SEQ ID NO: 23266 - DNA, 20 bp, Homo sapiens
gcggcgtccggtgagctctc

SEQ ID NO: 23267 - DNA, 21 bp, Homo sapiens
gcggcgtccggtgagctctcg

SEQ ID NO: 23268 - DNA, 22 bp, Homo sapiens
gcggcgtccggtgagctctcgc

SEQ ID NO: 23269 - DNA, 23 bp, Homo sapiens
gcggcgtccggtgagctctcgct

SEQ ID NO: 23270 - DNA, 24 bp, Homo sapiens
gcggcgtccggtgagctctcgctg

SEQ ID NO: 23271 - DNA, 25 bp, Homo sapiens
gcggcgtccggtgagctctcgctgg

SEQ ID NO: 23272 - DNA, 26 bp, Homo sapiens
gcggcgtccggtgagctctcgctggc

SEQ ID NO: 23273 - DNA, 27 bp, Homo sapiens
gcggcgtccggtgagctctcgctggcc

SEQ ID NO: 23274 - DNA, 28 bp, Homo sapiens
gcggcgtccggtgagctctcgctggccc

SEQ ID NO: 23275 - DNA, 29 bp, Homo sapiens
gcggcgtccggtgagctctcgctggccct

SEQ ID NO: 23276 - DNA, 30 bp, Homo sapiens
gcggcgtccggtgagctctcgctggccctt

SEQ ID NO: 23277 - DNA, 31 bp, Homo sapiens; identical to SEQ ID NO: 5063

SEQ ID NO: 23278 - DNA, 33 bp, Homo sapiens
gcggcgtccggtgagctctcgctggcccttgaa

SEQ ID NO: 23279 - DNA, 39 bp, Homo sapiens
gcggcgtccggtgagctctcgctggcccttgaaaatccg

SEQ ID NO: 23280 - DNA, 19 bp, Homo sapiens
cggcgtccggtgagctctc

SEQ ID NO: 23281 - DNA, 21 bp, Homo sapiens
cggcgtccggtgagctctcgc

SEQ ID NO: 23282 - DNA, 22 bp, Homo sapiens
cggcgtccggtgagctctcgct

SEQ ID NO: 23283 - DNA, 24 bp, Homo sapiens
cggcgtccggtgagctctcgctgg

SEQ ID NO: 23284 - DNA, 25 bp, Homo sapiens
cggcgtccggtgagctctcgctggc

SEQ ID NO: 23285 - DNA, 26 bp, Homo sapiens
cggcgtccggtgagctctcgctggcc

SEQ ID NO: 23286 - DNA, 27 bp, Homo sapiens
cggcgtccggtgagctctcgctggccc

SEQ ID NO: 23287 - DNA, 21 bp, Homo sapiens
ggcgtccggtgagctctcgct

SEQ ID NO: 23288 - DNA, 23 bp, Homo sapiens
ggcgtccggtgagctctcgctgg

SEQ ID NO: 23289 - DNA, 25 bp, Homo sapiens
ggcgtccggtgagctctcgctggcc

SEQ ID NO: 23290 - DNA, 26 bp, Homo sapiens
ggcgtccggtgagctctcgctggccc

SEQ ID NO: 23291 - DNA, 20 bp, Homo sapiens
gcgtccggtgagctctcgct

SEQ ID NO: 23292 - DNA, 24 bp, Homo sapiens
gcgtccggtgagctctcgctggcc

SEQ ID NO: 23293 - DNA, 25 bp, Homo sapiens
gcgtccggtgagctctcgctggccc

SEQ ID NO: 23294 - DNA, 26 bp, Homo sapiens
gcgtccggtgagctctcgctggccct

SEQ ID NO: 23295 - DNA, 19 bp, Homo sapiens
cgtccggtgagctctcgct

SEQ ID NO: 23296 - DNA, 23 bp, Homo sapiens
cgtccggtgagctctcgctggcc

SEQ ID NO: 23297 - DNA, 24 bp, Homo sapiens
cgtccggtgagctctcgctggccc

SEQ ID NO: 23298 - DNA, 17 bp, Homo sapiens
gtccggtgagctctcgc

SEQ ID NO: 23299 - DNA, 18 bp, Homo sapiens
gtccggtgagctctcgct

SEQ ID NO: 23300 - DNA, 20 bp, Homo sapiens
gtccggtgagctctcgctgg

SEQ ID NO: 23301 - DNA, 21 bp, Homo sapiens
gtccggtgagctctcgctggc

SEQ ID NO: 23302 - DNA, 22 bp, Homo sapiens
gtccggtgagctctcgctggcc

SEQ ID NO: 23303 - DNA, 23 bp, Homo sapiens
gtccggtgagctctcgctggccc

SEQ ID NO: 23304 - DNA, 24 bp, Homo sapiens
gtccggtgagctctcgctggccct

SEQ ID NO: 23305 - DNA, 16 bp, Homo sapiens
tccggtgagctctcgc

SEQ ID NO: 23306 - DNA, 17 bp, Homo sapiens
tccggtgagctctcgct

SEQ ID NO: 23307 - DNA, 19 bp, Homo sapiens
tccggtgagctctcgctgg

SEQ ID NO: 23308 - DNA, 21 bp, Homo sapiens
tccggtgagctctcgctggcc

SEQ ID NO: 23309 - DNA, 22 bp, Homo sapiens
tccggtgagctctcgctggccc

SEQ ID NO: 23310 - DNA, 23 bp, Homo sapiens
tccggtgagctctcgctggccct

SEQ ID NO: 23311 - DNA, 26 bp, Homo sapiens
tccggtgagctctcgctggcccttga

SEQ ID NO: 23312 - DNA, 27 bp, Homo sapiens
tccggtgagctctcgctggcccttgaa

SEQ ID NO: 23313 - DNA, 28 bp, Homo sapiens
tccggtgagctctcgctggcccttgaaa

SEQ ID NO: 23314 - DNA, 16 bp, Homo sapiens
ccggtgagctctcgct

SEQ ID NO: 23315 - DNA, 18 bp, Homo sapiens
ccggtgagctctcgctgg

SEQ ID NO: 23316 - DNA, 19 bp, Homo sapiens
ccggtgagctctcgctggc

SEQ ID NO: 23317 - DNA, 20 bp, Homo sapiens
ccggtgagctctcgctggcc

SEQ ID NO: 23318 - DNA, 21 bp, Homo sapiens
ccggtgagctctcgctggccc

SEQ ID NO: 23319 - DNA, 22 bp, Homo sapiens
ccggtgagctctcgctggccct

SEQ ID NO: 23320 - DNA, 25 bp, Homo sapiens
ccggtgagctctcgctggcccttga

SEQ ID NO: 23321 - DNA, 26 bp, Homo sapiens
ccggtgagctctcgctggcccttgaa

SEQ ID NO: 23322 - DNA, 27 bp, Homo sapiens
ccggtgagctctcgctggcccttgaaa

SEQ ID NO: 23323 - DNA, 18 bp, Homo sapiens
cggtgagctctcgctggc

SEQ ID NO: 23324 - DNA, 19 bp, Homo sapiens
cggtgagctctcgctggcc

SEQ ID NO: 23325 - DNA, 20 bp, Homo sapiens
cggtgagctctcgctggccc

SEQ ID NO: 23326 - DNA, 21 bp, Homo sapiens
cggtgagctctcgctggccct

SEQ ID NO: 23327 - DNA, 17 bp, Homo sapiens
ggtgagctctcgctggc

SEQ ID NO: 23328 - DNA, 18 bp, Homo sapiens
ggtgagctctcgctggcc

SEQ ID NO: 23329 - DNA, 19 bp, Homo sapiens
ggtgagctctcgctggccc

SEQ ID NO: 23330 - DNA, 20 bp, Homo sapiens
ggtgagctctcgctggccct

SEQ ID NO: 23331 - DNA, 16 bp, Homo sapiens
gtgagctctcgctggc

SEQ ID NO: 23332 - DNA, 17 bp, Homo sapiens
gtgagctctcgctggcc

SEQ ID NO: 23333 - DNA, 18 bp, Homo sapiens
gtgagctctcgctggccc

SEQ ID NO: 23334 - DNA, 19 bp, Homo sapiens
gtgagctctcgctggccct

SEQ ID NO: 23335 - DNA, 22 bp, Homo sapiens
gtgagctctcgctggcccttga

SEQ ID NO: 23336 - DNA, 23 bp, Homo sapiens
gtgagctctcgctggcccttgaa

SEQ ID NO: 23337 - DNA, 24 bp, Homo sapiens
gtgagctctcgctggcccttgaaa

SEQ ID NO: 23338 - DNA, 16 bp, Homo sapiens
tgagctctcgctggcc

SEQ ID NO: 23339 - DNA, 17 bp, Homo sapiens
tgagctctcgctggccc

SEQ ID NO: 23340 - DNA, 23 bp, Homo sapiens
tgagctctcgctggcccttgaaa

SEQ ID NO: 23341 - DNA, 16 bp, Homo sapiens
gagctctcgctggccc

SEQ ID NO: 23342 - DNA, 17 bp, Homo sapiens
gagctctcgctggccct

SEQ ID NO: 23343 - DNA, 20 bp, Homo sapiens
gctctcgctggcccttgaaa

SEQ ID NO: 23344 - DNA, 16 bp, Homo sapiens
ctctcgctggcccttg

SEQ ID NO: 23345 - DNA, 29 bp, Homo sapiens
ctctcgctggcccttgaaaatccggggga

SEQ ID NO: 23346 - DNA, 33 bp, Homo sapiens
cttgaaaatccgggggagagggtgtaaatctcg

SEQ ID NO: 23347 - DNA, 32 bp, Homo sapiens
ttgaaaatccgggggagagggtgtaaatctcg

SEQ ID NO: 23348 - DNA, 18 bp, Homo sapiens
tgaaaatccgggggagag

SEQ ID NO: 23349 - DNA, 31 bp, Homo sapiens
tgaaaatccgggggagagggtgtaaatctcg

SEQ ID NO: 23350 - DNA, 17 bp, Homo sapiens
gaaaatccgggggagag

SEQ ID NO: 23351 - DNA, 30 bp, Homo sapiens
gaaaatccgggggagagggtgtaaatctcg

SEQ ID NO: 23352 - DNA, 31 bp, Homo sapiens
gaaaatccgggggagagggtgtaaatctcgc

SEQ ID NO: 23353 - DNA, 16 bp, Homo sapiens
aaaatccgggggagag

SEQ ID NO: 23354 - DNA, 22 bp, Homo sapiens
aaaatccgggggagagggtgta

SEQ ID NO: 23355 - DNA, 27 bp, Homo sapiens
aaaatccgggggagagggtgtaaatct

SEQ ID NO: 23356 - DNA, 28 bp, Homo sapiens
aaaatccgggggagagggtgtaaatctc

SEQ ID NO: 23357 - DNA, 29 bp, Homo sapiens
aaaatccgggggagagggtgtaaatctcg

SEQ ID NO: 23358 - DNA, 30 bp, Homo sapiens
aaaatccgggggagagggtgtaaatctcgc

SEQ ID NO: 23359 - DNA, 33 bp, Homo sapiens
aaaatccgggggagagggtgtaaatctcgcgcc

SEQ ID NO: 23360 - DNA, 20 bp, Homo sapiens
aatccgggggagagggtgta

SEQ ID NO: 23361 - DNA, 27 bp, Homo sapiens
aatccgggggagagggtgtaaatctcg

SEQ ID NO: 23362 - DNA, 29 bp, Homo sapiens
gggagagggtgtaaatctcgcgccgggcc

SEQ ID NO: 23363 - DNA, 27 bp, Homo sapiens
ggagagggtgtaaatctcgcgccgggc

SEQ ID NO: 23364 - DNA, 28 bp, Homo sapiens
ggagagggtgtaaatctcgcgccgggcc

SEQ ID NO: 23365 - DNA, 26 bp, Homo sapiens
gagagggtgtaaatctcgcgccgggc

SEQ ID NO: 23366 - DNA, 27 bp, Homo sapiens
gagagggtgtaaatctcgcgccgggcc

SEQ ID NO: 23367 - DNA, 31 bp, Homo sapiens
gagagggtgtaaatctcgcgccgggccgtac

SEQ ID NO: 23368 - DNA, 32 bp, Homo sapiens; identical to SEQ ID NO: 5088

SEQ ID NO: 23369 - DNA, 21 bp, Homo sapiens
agagggtgtaaatctcgcgcc

SEQ ID NO: 23370 - DNA, 25 bp, Homo sapiens
agagggtgtaaatctcgcgccgggc

SEQ ID NO: 23371 - DNA, 26 bp, Homo sapiens
agagggtgtaaatctcgcgccgggcc

SEQ ID NO: 23372 - DNA, 30 bp, Homo sapiens
agagggtgtaaatctcgcgccgggccgtac

SEQ ID NO: 23373 - DNA, 31 bp, Homo sapiens; identical to SEQ ID NO: 5090

SEQ ID NO: 23374 - DNA, 20 bp, Homo sapiens
gagggtgtaaatctcgcgcc

SEQ ID NO: 23375 - DNA, 21 bp, Homo sapiens
gagggtgtaaatctcgcgccg

SEQ ID NO: 23376 - DNA, 24 bp, Homo sapiens
gagggtgtaaatctcgcgccgggc

SEQ ID NO: 23377 - DNA, 25 bp, Homo sapiens
gagggtgtaaatctcgcgccgggcc

SEQ ID NO: 23378 - DNA, 26 bp, Homo sapiens
gagggtgtaaatctcgcgccgggccg

SEQ ID NO: 23379 - DNA, 28 bp, Homo sapiens
gagggtgtaaatctcgcgccgggccgta

SEQ ID NO: 23380 - DNA, 30 bp, Homo sapiens; identical to SEQ ID NO: 5091

SEQ ID NO: 23381 - DNA, 31 bp, Homo sapiens
gagggtgtaaatctcgcgccgggccgtaccc

SEQ ID NO: 23382 - DNA, 19 bp, Homo sapiens
agggtgtaaatctcgcgcc

SEQ ID NO: 23383 - DNA, 23 bp, Homo sapiens
agggtgtaaatctcgcgccgggc

SEQ ID NO: 23384 - DNA, 24 bp, Homo sapiens
agggtgtaaatctcgcgccgggcc

SEQ ID NO: 23385 - DNA, 28 bp, Homo sapiens
agggtgtaaatctcgcgccgggccgtac

SEQ ID NO: 23386 - DNA, 29 bp, Homo sapiens
agggtgtaaatctcgcgccgggccgtacc

SEQ ID NO: 23387 - DNA, 23 bp, Homo sapiens
gggtgtaaatctcgcgccgggcc

SEQ ID NO: 23388 - DNA, 22 bp, Homo sapiens
ggtgtaaatctcgcgccgggcc

SEQ ID NO: 23389 - DNA, 16 bp, Homo sapiens
gtgtaaatctcgcgcc

SEQ ID NO: 23390 - DNA, 17 bp, Homo sapiens
gtgtaaatctcgcgccg

SEQ ID NO: 23391 - DNA, 21 bp, Homo sapiens
gtgtaaatctcgcgccgggcc

SEQ ID NO: 23392 - DNA, 22 bp, Homo sapiens
gtgtaaatctcgcgccgggccg

SEQ ID NO: 23393 - DNA, 26 bp, Homo sapiens
gtgtaaatctcgcgccgggccgtacc

SEQ ID NO: 23394 - DNA, 32 bp, Homo sapiens
gtgtaaatctcgcgccgggccgtacccatatc

SEQ ID NO: 23395 - DNA, 16 bp, Homo sapiens
tgtaaatctcgcgccg

SEQ ID NO: 23396 - DNA, 19 bp, Homo sapiens
tgtaaatctcgcgccgggc

SEQ ID NO: 23397 - DNA, 20 bp, Homo sapiens
tgtaaatctcgcgccgggcc

SEQ ID NO: 23398 - DNA, 25 bp, Homo sapiens
tgtaaatctcgcgccgggccgtacc

SEQ ID NO: 23399 - DNA, 26 bp, Homo sapiens
tgtaaatctcgcgccgggccgtaccc

SEQ ID NO: 23400 - DNA, 29 bp, Homo sapiens
tgtaaatctcgcgccgggccgtacccata

SEQ ID NO: 23401 - DNA, 31 bp, Homo sapiens; identical to SEQ ID NO: 5098

SEQ ID NO: 23402 - DNA, 32 bp, Homo sapiens
tgtaaatctcgcgccgggccgtacccatatcc

SEQ ID NO: 23403 - DNA, 18 bp, Homo sapiens
gtaaatctcgcgccgggc

SEQ ID NO: 23404 - DNA, 19 bp, Homo sapiens
gtaaatctcgcgccgggcc

SEQ ID NO: 23405 - DNA, 24 bp, Homo sapiens
gtaaatctcgcgccgggccgtacc

SEQ ID NO: 23406 - DNA, 30 bp, Homo sapiens; identical to SEQ ID NO: 5100

SEQ ID NO: 23407 - DNA, 17 bp, Homo sapiens
taaatctcgcgccgggc

SEQ ID NO: 23408 - DNA, 18 bp, Homo sapiens
taaatctcgcgccgggcc

SEQ ID NO: 23409 - DNA, 23 bp, Homo sapiens
taaatctcgcgccgggccgtacc

SEQ ID NO: 23410 - DNA, 24 bp, Homo sapiens
taaatctcgcgccgggccgtaccc

SEQ ID NO: 23411 - DNA, 27 bp, Homo sapiens
taaatctcgcgccgggccgtacccata

SEQ ID NO: 23412 - DNA, 28 bp, Homo sapiens
taaatctcgcgccgggccgtacccatat

SEQ ID NO: 23413 - DNA, 29 bp, Homo sapiens
taaatctcgcgccgggccgtacccatatc

SEQ ID NO: 23414 - DNA, 30 bp, Homo sapiens
taaatctcgcgccgggccgtacccatatcc

SEQ ID NO: 23415 - DNA, 31 bp, Homo sapiens
taaatctcgcgccgggccgtacccatatccg

SEQ ID NO: 23416 - DNA, 16 bp, Homo sapiens
aaatctcgcgccgggc

SEQ ID NO: 23417 - DNA, 17 bp, Homo sapiens
aaatctcgcgccgggcc

SEQ ID NO: 23418 - DNA, 18 bp, Homo sapiens
aaatctcgcgccgggccg

SEQ ID NO: 23419 - DNA, 19 bp, Homo sapiens
aaatctcgcgccgggccgt

SEQ ID NO: 23420 - DNA, 20 bp, Homo sapiens
aaatctcgcgccgggccgta

SEQ ID NO: 23421 - DNA, 22 bp, Homo sapiens
aaatctcgcgccgggccgtacc

SEQ ID NO: 23422 - DNA, 23 bp, Homo sapiens
aaatctcgcgccgggccgtaccc

SEQ ID NO: 23423 - DNA, 25 bp, Homo sapiens
aaatctcgcgccgggccgtacccat

SEQ ID NO: 23424 - DNA, 26 bp, Homo sapiens
aaatctcgcgccgggccgtacccata

SEQ ID NO: 23425 - DNA, 28 bp, Homo sapiens
aaatctcgcgccgggccgtacccatatc

SEQ ID NO: 23426 - DNA, 16 bp, Homo sapiens
aatctcgcgccgggcc

SEQ ID NO: 23427 - DNA, 17 bp, Homo sapiens
aatctcgcgccgggccg

SEQ ID NO: 23428 - DNA, 18 bp, Homo sapiens
aatctcgcgccgggccgt

SEQ ID NO: 23429 - DNA, 19 bp, Homo sapiens
aatctcgcgccgggccgta

SEQ ID NO: 23430 - DNA, 21 bp, Homo sapiens
aatctcgcgccgggccgtacc

SEQ ID NO: 23431 - DNA, 22 bp, Homo sapiens
aatctcgcgccgggccgtaccc

SEQ ID NO: 23432 - DNA, 23 bp, Homo sapiens
aatctcgcgccgggccgtaccca

SEQ ID NO: 23433 - DNA, 25 bp, Homo sapiens
aatctcgcgccgggccgtacccata

SEQ ID NO: 23434 - DNA, 27 bp, Homo sapiens
aatctcgcgccgggccgtacccatatc

SEQ ID NO: 23435 - DNA, 28 bp, Homo sapiens
aatctcgcgccgggccgtacccatatcc

SEQ ID NO: 23436 - DNA, 29 bp, Homo sapiens
aatctcgcgccgggccgtacccatatccg

SEQ ID NO: 23437 - DNA, 30 bp, Homo sapiens
aatctcgcgccgggccgtacccatatccgc

SEQ ID NO: 23438 - DNA, 31 bp, Homo sapiens
aatctcgcgccgggccgtacccatatccgca

SEQ ID NO: 23439 - DNA, 16 bp, Homo sapiens
atctcgcgccgggccg

SEQ ID NO: 23440 - DNA, 17 bp, Homo sapiens
atctcgcgccgggccgt

SEQ ID NO: 23441 - DNA, 18 bp, Homo sapiens
atctcgcgccgggccgta

SEQ ID NO: 23442 - DNA, 20 bp, Homo sapiens
atctcgcgccgggccgtacc

SEQ ID NO: 23443 - DNA, 21 bp, Homo sapiens
atctcgcgccgggccgtaccc

SEQ ID NO: 23444 - DNA, 22 bp, Homo sapiens
atctcgcgccgggccgtaccca

SEQ ID NO: 23445 - DNA, 23 bp, Homo sapiens
atctcgcgccgggccgtacccat

SEQ ID NO: 23446 - DNA, 24 bp, Homo sapiens
atctcgcgccgggccgtacccata

SEQ ID NO: 23447 - DNA, 26 bp, Homo sapiens
atctcgcgccgggccgtacccatatc

SEQ ID NO: 23448 - DNA, 27 bp, Homo sapiens
atctcgcgccgggccgtacccatatcc

SEQ ID NO: 23449 - DNA, 30 bp, Homo sapiens
atctcgcgccgggccgtacccatatccgca

SEQ ID NO: 23450 - DNA, 33 bp, Homo sapiens
atctcgcgccgggccgtacccatatccgcagca

SEQ ID NO: 23451 - DNA, 17 bp, Homo sapiens
tctcgcgccgggccgta

SEQ ID NO: 23452 - DNA, 19 bp, Homo sapiens
tctcgcgccgggccgtacc

SEQ ID NO: 23453 - DNA, 20 bp, Homo sapiens
tctcgcgccgggccgtaccc

SEQ ID NO: 23454 - DNA, 21 bp, Homo sapiens
tctcgcgccgggccgtaccca

SEQ ID NO: 23455 - DNA, 22 bp, Homo sapiens
tctcgcgccgggccgtacccat

SEQ ID NO: 23456 - DNA, 23 bp, Homo sapiens
tctcgcgccgggccgtacccata

SEQ ID NO: 23457 - DNA, 25 bp, Homo sapiens
tctcgcgccgggccgtacccatatc

SEQ ID NO: 23458 - DNA, 29 bp, Homo sapiens
tctcgcgccgggccgtacccatatccgca

SEQ ID NO: 23459 - DNA, 32 bp, Homo sapiens
tctcgcgccgggccgtacccatatccgcagca

SEQ ID NO: 23460 - DNA, 18 bp, Homo sapiens
ctcgcgccgggccgtacc

SEQ ID NO: 23461 - DNA, 21 bp, Homo sapiens
ctcgcgccgggccgtacccat

SEQ ID NO: 23462 - DNA, 22 bp, Homo sapiens
ctcgcgccgggccgtacccata

SEQ ID NO: 23463 - DNA, 24 bp, Homo sapiens
ctcgcgccgggccgtacccatatc

SEQ ID NO: 23464 - DNA, 17 bp, Homo sapiens
tcgcgccgggccgtacc

SEQ ID NO: 23465 - DNA, 18 bp, Homo sapiens
tcgcgccgggccgtaccc

SEQ ID NO: 23466 - DNA, 21 bp, Homo sapiens
tcgcgccgggccgtacccata

SEQ ID NO: 23467 - DNA, 16 bp, Homo sapiens
cgcgccgggccgtacc

SEQ ID NO: 23468 - DNA, 17 bp, Homo sapiens
cgcgccgggccgtaccc

SEQ ID NO: 23469 - DNA, 20 bp, Homo sapiens
cgcgccgggccgtacccata

SEQ ID NO: 23470 - DNA, 22 bp, Homo sapiens
cgcgccgggccgtacccatatc

SEQ ID NO: 23471 - DNA, 23 bp, Homo sapiens
cgcgccgggccgtacccatatcc

SEQ ID NO: 23472 - DNA, 24 bp, Homo sapiens
cgcgccgggccgtacccatatccg

SEQ ID NO: 23473 - DNA, 20 bp, Homo sapiens
cgccgggccgtacccatatc

SEQ ID NO: 23474 - DNA, 21 bp, Homo sapiens
cgccgggccgtacccatatcc

SEQ ID NO: 23475 - DNA, 19 bp, Homo sapiens
gccgggccgtacccatatc

SEQ ID NO: 23476 - DNA, 23 bp, Homo sapiens
acccatatccgcagcaggtctcc

SEQ ID NO: 23477 - DNA, 27 bp, Homo sapiens
acccatatccgcagcaggtctccaagg

SEQ ID NO: 23478 - DNA, 30 bp, Homo sapiens
acccatatccgcagcaggtctccaaggtga

SEQ ID NO: 23479 - DNA, 26 bp, Homo sapiens
catatccgcagcaggtctccaaggtg

SEQ ID NO: 23480 - DNA, 32 bp, Homo sapiens
catatccgcagcaggtctccaaggtgaacagc

SEQ ID NO: 23481 - DNA, 33 bp, Homo sapiens
catatccgcagcaggtctccaaggtgaacagcc

SEQ ID NO: 23482 - DNA, 22 bp, Homo sapiens
atccgcagcaggtctccaaggt

SEQ ID NO: 23483 - DNA, 21 bp, Homo sapiens
ccgcagcaggtctccaaggtg

SEQ ID NO: 23484 - DNA, 27 bp, Homo sapiens
ccgcagcaggtctccaaggtgaacagc

SEQ ID NO: 23485 - DNA, 28 bp, Homo sapiens
ccgcagcaggtctccaaggtgaacagcc

SEQ ID NO: 23486 - DNA, 32 bp, Homo sapiens
ccgcagcaggtctccaaggtgaacagcctctg

SEQ ID NO: 23487 - DNA, 20 bp, Homo sapiens
cgcagcaggtctccaaggtg

SEQ ID NO: 23488 - DNA, 22 bp, Homo sapiens
cgcagcaggtctccaaggtgaa

SEQ ID NO: 23489 - DNA, 26 bp, Homo sapiens
cgcagcaggtctccaaggtgaacagc

SEQ ID NO: 23490 - DNA, 27 bp, Homo sapiens
cgcagcaggtctccaaggtgaacagcc

SEQ ID NO: 23491 - DNA, 30 bp, Homo sapiens
cgcagcaggtctccaaggtgaacagcctct

SEQ ID NO: 23492 - DNA, 31 bp, Homo sapiens; identical to SEQ ID NO: 5126

SEQ ID NO: 23493 - DNA, 19 bp, Homo sapiens
gcagcaggtctccaaggtg

SEQ ID NO: 23494 - DNA, 21 bp, Homo sapiens
gcagcaggtctccaaggtgaa

SEQ ID NO: 23495 - DNA, 25 bp, Homo sapiens
gcagcaggtctccaaggtgaacagc

SEQ ID NO: 23496 - DNA, 26 bp, Homo sapiens
gcagcaggtctccaaggtgaacagcc

SEQ ID NO: 23497 - DNA, 30 bp, Homo sapiens; identical to SEQ ID NO: 5128

SEQ ID NO: 23498 - DNA, 16 bp, Homo sapiens
cagcaggtctccaagg

SEQ ID NO: 23499 - DNA, 18 bp, Homo sapiens
cagcaggtctccaaggtg

SEQ ID NO: 23500 - DNA, 24 bp, Homo sapiens
cagcaggtctccaaggtgaacagc

SEQ ID NO: 23501 - DNA, 25 bp, Homo sapiens
cagcaggtctccaaggtgaacagcc

SEQ ID NO: 23502 - DNA, 29 bp, Homo sapiens
cagcaggtctccaaggtgaacagcctctg

SEQ ID NO: 23503 - DNA, 17 bp, Homo sapiens
agcaggtctccaaggtg

SEQ ID NO: 23504 - DNA, 23 bp, Homo sapiens
agcaggtctccaaggtgaacagc

SEQ ID NO: 23505 - DNA, 24 bp, Homo sapiens
agcaggtctccaaggtgaacagcc

SEQ ID NO: 23506 - DNA, 28 bp, Homo sapiens
agcaggtctccaaggtgaacagcctctg

SEQ ID NO: 23507 - DNA, 16 bp, Homo sapiens
gcaggtctccaaggtg

SEQ ID NO: 23508 - DNA, 17 bp, Homo sapiens
gcaggtctccaaggtga

SEQ ID NO: 23509 - DNA, 18 bp, Homo sapiens
gcaggtctccaaggtgaa

SEQ ID NO: 23510 - DNA, 23 bp, Homo sapiens
gcaggtctccaaggtgaacagcc

SEQ ID NO: 23511 - DNA, 27 bp, Homo sapiens
gcaggtctccaaggtgaacagcctctg

SEQ ID NO: 23512 - DNA, 30 bp, Homo sapiens
gcaggtctccaaggtgaacagcctctggca

SEQ ID NO: 23513 - DNA, 33 bp, Homo sapiens; identical to SEQ ID NO: 5132

SEQ ID NO: 23514 - DNA, 22 bp, Homo sapiens
caggtctccaaggtgaacagcc

SEQ ID NO: 23515 - DNA, 32 bp, Homo sapiens; identical to SEQ ID NO: 5134

SEQ ID NO: 23516 - DNA, 31 bp, Homo sapiens; identical to SEQ ID NO: 5135

SEQ ID NO: 23517 - DNA, 20 bp, Homo sapiens
ggtctccaaggtgaacagcc

SEQ ID NO: 23518 - DNA, 23 bp, Homo sapiens
ggtctccaaggtgaacagcctct

SEQ ID NO: 23519 - DNA, 29 bp, Homo sapiens
aaggtgaacagcctctggcatgttggaac

SEQ ID NO: 23520 - DNA, 19 bp, Homo sapiens
aggtgaacagcctctggca

SEQ ID NO: 23521 - DNA, 28 bp, Homo sapiens
aggtgaacagcctctggcatgttggaac

SEQ ID NO: 23522 - DNA, 29 bp, Homo sapiens
aggtgaacagcctctggcatgttggaaca

SEQ ID NO: 23523 - DNA, 18 bp, Homo sapiens
ggtgaacagcctctggca

SEQ ID NO: 23524 - DNA, 28 bp, Homo sapiens
ggtgaacagcctctggcatgttggaaca

SEQ ID NO: 23525 - DNA, 33 bp, Homo sapiens
ggtgaacagcctctggcatgttggaacaatgta

SEQ ID NO: 23526 - DNA, 16 bp, Homo sapiens
tgaacagcctctggca

SEQ ID NO: 23527 - DNA, 18 bp, Homo sapiens
tgaacagcctctggcatg

SEQ ID NO: 23528 - DNA, 23 bp, Homo sapiens
aacagcctctggcatgttggaac

SEQ ID NO: 23529 - DNA, 20 bp, Homo sapiens
acagcctctggcatgttgga

SEQ ID NO: 23530 - DNA, 22 bp, Homo sapiens
acagcctctggcatgttggaac

SEQ ID NO: 23531 - DNA, 23 bp, Homo sapiens
acagcctctggcatgttggaaca

SEQ ID NO: 23532 - DNA, 28 bp, Homo sapiens
acagcctctggcatgttggaacaatgta

SEQ ID NO: 23533 - DNA, 30 bp, Homo sapiens
acagcctctggcatgttggaacaatgtagg

SEQ ID NO: 23534 - DNA, 31 bp, Homo sapiens
acagcctctggcatgttggaacaatgtaggt

SEQ ID NO: 23535 - DNA, 32 bp, Homo sapiens
acagcctctggcatgttggaacaatgtaggta

SEQ ID NO: 23536 - DNA, 33 bp, Homo sapiens
acagcctctggcatgttggaacaatgtaggtaa

SEQ ID NO: 23537 - DNA, 19 bp, Homo sapiens
cagcctctggcatgttgga

SEQ ID NO: 23538 - DNA, 20 bp, Homo sapiens
cagcctctggcatgttggaa

SEQ ID NO: 23539 - DNA, 21 bp, Homo sapiens
cagcctctggcatgttggaac

SEQ ID NO: 23540 - DNA, 22 bp, Homo sapiens
cagcctctggcatgttggaaca

SEQ ID NO: 23541 - DNA, 23 bp, Homo sapiens
cagcctctggcatgttggaacaa

SEQ ID NO: 23542 - DNA, 25 bp, Homo sapiens
cagcctctggcatgttggaacaatg

SEQ ID NO: 23543 - DNA, 26 bp, Homo sapiens
cagcctctggcatgttggaacaatgt

SEQ ID NO: 23544 - DNA, 27 bp, Homo sapiens
cagcctctggcatgttggaacaatgta

SEQ ID NO: 23545 - DNA, 28 bp, Homo sapiens
cagcctctggcatgttggaacaatgtag

SEQ ID NO: 23546 - DNA, 29 bp, Homo sapiens
cagcctctggcatgttggaacaatgtagg

SEQ ID NO: 23547 - DNA, 30 bp, Homo sapiens
cagcctctggcatgttggaacaatgtaggt

SEQ ID NO: 23548 - DNA, 31 bp, Homo sapiens
cagcctctggcatgttggaacaatgtaggta

SEQ ID NO: 23549 - DNA, 32 bp, Homo sapiens
cagcctctggcatgttggaacaatgtaggtaa

SEQ ID NO: 23550 - DNA, 33 bp, Homo sapiens
cagcctctggcatgttggaacaatgtaggtaag

SEQ ID NO: 23551 - DNA, 18 bp, Homo sapiens
agcctctggcatgttgga

SEQ ID NO: 23552 - DNA, 20 bp, Homo sapiens
agcctctggcatgttggaac

SEQ ID NO: 23553 - DNA, 21 bp, Homo sapiens
agcctctggcatgttggaaca

SEQ ID NO: 23554 - DNA, 26 bp, Homo sapiens
agcctctggcatgttggaacaatgta

SEQ ID NO: 23555 - DNA, 28 bp, Homo sapiens
agcctctggcatgttggaacaatgtagg

SEQ ID NO: 23556 - DNA, 29 bp, Homo sapiens
agcctctggcatgttggaacaatgtaggt

SEQ ID NO: 23557 - DNA, 30 bp, Homo sapiens
agcctctggcatgttggaacaatgtaggta

SEQ ID NO: 23558 - DNA, 33 bp, Homo sapiens
agcctctggcatgttggaacaatgtaggtaagg

SEQ ID NO: 23559 - DNA, 32 bp, Homo sapiens
gcctctggcatgttggaacaatgtaggtaagg

SEQ ID NO: 23560 - DNA, 18 bp, Homo sapiens
cctctggcatgttggaac

SEQ ID NO: 23561 - DNA, 19 bp, Homo sapiens
cctctggcatgttggaaca

SEQ ID NO: 23562 - DNA, 24 bp, Homo sapiens
cctctggcatgttggaacaatgta

SEQ ID NO: 23563 - DNA, 33 bp, Homo sapiens
cctctggcatgttggaacaatgtaggtaaggga

SEQ ID NO: 23564 - DNA, 17 bp, Homo sapiens
ctctggcatgttggaac

SEQ ID NO: 23565 - DNA, 18 bp, Homo sapiens
ctctggcatgttggaaca

SEQ ID NO: 23566 - DNA, 30 bp, Homo sapiens
ctctggcatgttggaacaatgtaggtaagg

SEQ ID NO: 23567 - DNA, 16 bp, Homo sapiens
tctggcatgttggaac

SEQ ID NO: 23568 - DNA, 17 bp, Homo sapiens
tctggcatgttggaaca

SEQ ID NO: 23569 - DNA, 29 bp, Homo sapiens
tctggcatgttggaacaatgtaggtaagg

SEQ ID NO: 23570 - DNA, 45 bp, Homo sapiens
tctggcatgttggaacaatgtaggtaagggaagtcggcaagccgg

SEQ ID NO: 23571 - DNA, 16 bp, Homo sapiens
ctggcatgttggaaca

SEQ ID NO: 23572 - DNA, 21 bp, Homo sapiens
ctggcatgttggaacaatgta

SEQ ID NO: 23573 - DNA, 19 bp, Homo sapiens
ggcatgttggaacaatgta

SEQ ID NO: 23574 - DNA, 23 bp, Homo sapiens
ggcatgttggaacaatgtaggta

SEQ ID NO: 23575 - DNA, 25 bp, Homo sapiens
ggcatgttggaacaatgtaggtaag

SEQ ID NO: 23576 - DNA, 28 bp, Homo sapiens
ggcatgttggaacaatgtaggtaaggga

SEQ ID NO: 23577 - DNA, 29 bp, Homo sapiens
ggcatgttggaacaatgtaggtaagggaa

SEQ ID NO: 23578 - DNA, 32 bp, Homo sapiens
ggcatgttggaacaatgtaggtaagggaagtc

SEQ ID NO: 23579 - DNA, 33 bp, Homo sapiens
ggcatgttggaacaatgtaggtaagggaagtcg

SEQ ID NO: 23580 - DNA, 18 bp, Homo sapiens
gcatgttggaacaatgta

SEQ ID NO: 23581 - DNA, 22 bp, Homo sapiens
gcatgttggaacaatgtaggta

SEQ ID NO: 23582 - DNA, 24 bp, Homo sapiens
gcatgttggaacaatgtaggtaag

SEQ ID NO: 23583 - DNA, 25 bp, Homo sapiens
gcatgttggaacaatgtaggtaagg

SEQ ID NO: 23584 - DNA, 26 bp, Homo sapiens
gcatgttggaacaatgtaggtaaggg

SEQ ID NO: 23585 - DNA, 28 bp, Homo sapiens
gcatgttggaacaatgtaggtaagggaa

SEQ ID NO: 23586 - DNA, 29 bp, Homo sapiens
gcatgttggaacaatgtaggtaagggaag

SEQ ID NO: 23587 - DNA, 30 bp, Homo sapiens
gcatgttggaacaatgtaggtaagggaagt

SEQ ID NO: 23588 - DNA, 31 bp, Homo sapiens; identical to SEQ ID NO: 5146

SEQ ID NO: 23589 - DNA, 32 bp, Homo sapiens; identical to SEQ ID NO: 5147

SEQ ID NO: 23590 - DNA, 33 bp, Homo sapiens
gcatgttggaacaatgtaggtaagggaagtcgg

SEQ ID NO: 23591 - DNA, 35 bp, Homo sapiens
gcatgttggaacaatgtaggtaagggaagtcggca

SEQ ID NO: 23592 - DNA, 41 bp, Homo sapiens
gcatgttggaacaatgtaggtaagggaagtcggcaagccgg

SEQ ID NO: 23593 - DNA, 21 bp, Homo sapiens
catgttggaacaatgtaggta

SEQ ID NO: 23594 - DNA, 24 bp, Homo sapiens
catgttggaacaatgtaggtaagg

SEQ ID NO: 23595 - DNA, 30 bp, Homo sapiens
catgttggaacaatgtaggtaagggaagtc

SEQ ID NO: 23596 - DNA, 31 bp, Homo sapiens
catgttggaacaatgtaggtaagggaagtcg

SEQ ID NO: 23597 - DNA, 33 bp, Homo sapiens
catgttggaacaatgtaggtaagggaagtcggc

SEQ ID NO: 23598 - DNA, 19 bp, Homo sapiens
tgttggaacaatgtaggta

SEQ ID NO: 23599 - DNA, 20 bp, Homo sapiens
tgttggaacaatgtaggtaa

SEQ ID NO: 23600 - DNA, 24 bp, Homo sapiens
tgttggaacaatgtaggtaaggga

SEQ ID NO: 23601 - DNA, 25 bp, Homo sapiens
tgttggaacaatgtaggtaagggaa

SEQ ID NO: 23602 - DNA, 32 bp, Homo sapiens
tgttggaacaatgtaggtaagggaagtcggca

SEQ ID NO: 23603 - DNA, 26 bp, Homo sapiens
ttggaacaatgtaggtaagggaagtc

SEQ ID NO: 23604 - DNA, 27 bp, Homo sapiens
ttggaacaatgtaggtaagggaagtcg

SEQ ID NO: 23605 - DNA, 29 bp, Homo sapiens
ttggaacaatgtaggtaagggaagtcggc

SEQ ID NO: 23606 - DNA, 30 bp, Homo sapiens
ttggaacaatgtaggtaagggaagtcggca

SEQ ID NO: 23607 - DNA, 33 bp, Homo sapiens
gaacaatgtaggtaagggaagtcggcaagccgg

SEQ ID NO: 23608 - DNA, 32 bp, Homo sapiens
aacaatgtaggtaagggaagtcggcaagccgg

SEQ ID NO: 23609 - DNA, 17 bp, Homo sapiens
acaatgtaggtaaggga

SEQ ID NO: 23610 - DNA, 18 bp, Homo sapiens
acaatgtaggtaagggaa

SEQ ID NO: 23611 - DNA, 25 bp, Homo sapiens
acaatgtaggtaagggaagtcggca

SEQ ID NO: 23612 - DNA, 26 bp, Homo sapiens
acaatgtaggtaagggaagtcggcaa

SEQ ID NO: 23613 - DNA, 16 bp, Homo sapiens
caatgtaggtaaggga

SEQ ID NO: 23614 - DNA, 17 bp, Homo sapiens
caatgtaggtaagggaa

SEQ ID NO: 23615 - DNA, 24 bp, Homo sapiens
caatgtaggtaagggaagtcggca

SEQ ID NO: 23616 - DNA, 25 bp, Homo sapiens
caatgtaggtaagggaagtcggcaa

SEQ ID NO: 23617 - DNA, 30 bp, Homo sapiens
caatgtaggtaagggaagtcggcaagccgg

SEQ ID NO: 23618 - DNA, 16 bp, Homo sapiens
aatgtaggtaagggaa

SEQ ID NO: 23619 - DNA, 17 bp, Homo sapiens
aatgtaggtaagggaag

SEQ ID NO: 23620 - DNA, 18 bp, Homo sapiens
aatgtaggtaagggaagt

SEQ ID NO: 23621 - DNA, 19 bp, Homo sapiens
aatgtaggtaagggaagtc

SEQ ID NO: 23622 - DNA, 22 bp, Homo sapiens
aatgtaggtaagggaagtcggc

SEQ ID NO: 23623 - DNA, 23 bp, Homo sapiens
aatgtaggtaagggaagtcggca

SEQ ID NO: 23624 - DNA, 26 bp, Homo sapiens
aatgtaggtaagggaagtcggcaagc

SEQ ID NO: 23625 - DNA, 28 bp, Homo sapiens
aatgtaggtaagggaagtcggcaagccg

SEQ ID NO: 23626 - DNA, 29 bp, Homo sapiens
aatgtaggtaagggaagtcggcaagccgg

SEQ ID NO: 23627 - DNA, 33 bp, Homo sapiens
aatgtaggtaagggaagtcggcaagccggatcc

SEQ ID NO: 23628 - DNA, 18 bp, Homo sapiens
atgtaggtaagggaagtc

SEQ ID NO: 23629 - DNA, 21 bp, Homo sapiens
atgtaggtaagggaagtcggc

SEQ ID NO: 23630 - DNA, 22 bp, Homo sapiens
atgtaggtaagggaagtcggca

SEQ ID NO: 23631 - DNA, 23 bp, Homo sapiens
atgtaggtaagggaagtcggcaa

SEQ ID NO: 23632 - DNA, 24 bp, Homo sapiens
atgtaggtaagggaagtcggcaag

SEQ ID NO: 23633 - DNA, 27 bp, Homo sapiens
atgtaggtaagggaagtcggcaagccg

SEQ ID NO: 23634 - DNA, 28 bp, Homo sapiens
atgtaggtaagggaagtcggcaagccgg

SEQ ID NO: 23635 - DNA, 29 bp, Homo sapiens
atgtaggtaagggaagtcggcaagccgga

SEQ ID NO: 23636 - DNA, 31 bp, Homo sapiens
atgtaggtaagggaagtcggcaagccggatc

SEQ ID NO: 23637 - DNA, 32 bp, Homo sapiens
atgtaggtaagggaagtcggcaagccggatcc

SEQ ID NO: 23638 - DNA, 33 bp, Homo sapiens
atgtaggtaagggaagtcggcaagccggatccg

SEQ ID NO: 23639 - DNA, 26 bp, Homo sapiens
tgtaggtaagggaagtcggcaagccg

SEQ ID NO: 23640 - DNA, 16 bp, Homo sapiens
ggtaagggaagtcggc

SEQ ID NO: 23641 - DNA, 17 bp, Homo sapiens
ggtaagggaagtcggca

SEQ ID NO: 23642 - DNA, 18 bp, Homo sapiens
ggtaagggaagtcggcaa

SEQ ID NO: 23643 - DNA, 19 bp, Homo sapiens
ggtaagggaagtcggcaag

SEQ ID NO: 23644 - DNA, 22 bp, Homo sapiens
ggtaagggaagtcggcaagccg

SEQ ID NO: 23645 - DNA, 18 bp, Homo sapiens
agggaagtcggcaagccg

SEQ ID NO: 23646 - DNA, 19 bp, Homo sapiens
agggaagtcggcaagccgg

SEQ ID NO: 23647 - DNA, 22 bp, Homo sapiens
agggaagtcggcaagccggatc

SEQ ID NO: 23648 - DNA, 17 bp, Homo sapiens
gggaagtcggcaagccg

SEQ ID NO: 23649 - DNA, 18 bp, Homo sapiens
gggaagtcggcaagccgg

SEQ ID NO: 23650 - DNA, 21 bp, Homo sapiens
gggaagtcggcaagccggatc

SEQ ID NO: 23651 - DNA, 17 bp, Homo sapiens
ggaagtcggcaagccgg

SEQ ID NO: 23652 - DNA, 20 bp, Homo sapiens
ggaagtcggcaagccggatc

SEQ ID NO: 23653 - DNA, 16 bp, Homo sapiens
gaagtcggcaagccgg

SEQ ID NO: 23654 - DNA, 19 bp, Homo sapiens
gaagtcggcaagccggatc

SEQ ID NO: 23655 - DNA, 24 bp, Homo sapiens
gaagtcggcaagccggatccgtaa

SEQ ID NO: 23656 - DNA, 25 bp, Homo sapiens
gaagtcggcaagccggatccgtaac

SEQ ID NO: 23657 - DNA, 26 bp, Homo sapiens
gaagtcggcaagccggatccgtaact

SEQ ID NO: 23658 - DNA, 31 bp, Homo sapiens
aagtcggcaagccggatccgtaacttcggga

SEQ ID NO: 23659 - DNA, 30 bp, Homo sapiens
agtcggcaagccggatccgtaacttcggga

SEQ ID NO: 23660 - DNA, 33 bp, Homo sapiens
agtcggcaagccggatccgtaacttcgggataa

SEQ ID NO: 23661 - DNA, 20 bp, Homo sapiens
gtcggcaagccggatccgta

SEQ ID NO: 23662 - DNA, 21 bp, Homo sapiens
gtcggcaagccggatccgtaa

SEQ ID NO: 23663 - DNA, 25 bp, Homo sapiens
gtcggcaagccggatccgtaacttc

SEQ ID NO: 23664 - DNA, 29 bp, Homo sapiens
gtcggcaagccggatccgtaacttcggga

SEQ ID NO: 23665 - DNA, 31 bp, Homo sapiens
gtcggcaagccggatccgtaacttcgggata

SEQ ID NO: 23666 - DNA, 32 bp, Homo sapiens
gtcggcaagccggatccgtaacttcgggataa

SEQ ID NO: 23667 - DNA, 21 bp, Homo sapiens
cggcaagccggatccgtaact

SEQ ID NO: 23668 - DNA, 33 bp, Homo sapiens
cggcaagccggatccgtaacttcgggataagga

SEQ ID NO: 23669 - DNA, 19 bp, Homo sapiens
ggcaagccggatccgtaac

SEQ ID NO: 23670 - DNA, 20 bp, Homo sapiens
ggcaagccggatccgtaact

SEQ ID NO: 23671 - DNA, 21 bp, Homo sapiens
ggcaagccggatccgtaactt

SEQ ID NO: 23672 - DNA, 22 bp, Homo sapiens
ggcaagccggatccgtaacttc

SEQ ID NO: 23673 - DNA, 30 bp, Homo sapiens; identical to SEQ ID NO: 5162

SEQ ID NO: 23674 - DNA, 31 bp, Homo sapiens; identical to SEQ ID NO: 5163

SEQ ID NO: 23675 - DNA, 32 bp, Homo sapiens; identical to SEQ ID NO: 5164

SEQ ID NO: 23676 - DNA, 33 bp, Homo sapiens; identical to SEQ ID NO: 5165

SEQ ID NO: 23677 - DNA, 35 bp, Homo sapiens
ggcaagccggatccgtaacttcgggataaggattg

SEQ ID NO: 23678 - DNA, 36 bp, Homo sapiens
ggcaagccggatccgtaacttcgggataaggattgg

SEQ ID NO: 23679 - DNA, 18 bp, Homo sapiens
gcaagccggatccgtaac

SEQ ID NO: 23680 - DNA, 19 bp, Homo sapiens
gcaagccggatccgtaact

SEQ ID NO: 23681 - DNA, 20 bp, Homo sapiens
gcaagccggatccgtaactt

SEQ ID NO: 23682 - DNA, 21 bp, Homo sapiens
gcaagccggatccgtaacttc

SEQ ID NO: 23683 - DNA, 25 bp, Homo sapiens
gcaagccggatccgtaacttcggga

SEQ ID NO: 23684 - DNA, 27 bp, Homo sapiens
gcaagccggatccgtaacttcgggata

SEQ ID NO: 23685 - DNA, 28 bp, Homo sapiens
gcaagccggatccgtaacttcgggataa

SEQ ID NO: 23686 - DNA, 29 bp, Homo sapiens
gcaagccggatccgtaacttcgggataag

SEQ ID NO: 23687 - DNA, 30 bp, Homo sapiens; identical to SEQ ID NO: 5169

SEQ ID NO: 23688 - DNA, 31 bp, Homo sapiens
gcaagccggatccgtaacttcgggataagga

SEQ ID NO: 23689 - DNA, 32 bp, Homo sapiens
gcaagccggatccgtaacttcgggataaggat

SEQ ID NO: 23690 - DNA, 16 bp, Homo sapiens
caagccggatccgtaa

SEQ ID NO: 23691 - DNA, 17 bp, Homo sapiens
caagccggatccgtaac

SEQ ID NO: 23692 - DNA, 18 bp, Homo sapiens
caagccggatccgtaact

SEQ ID NO: 23693 - DNA, 19 bp, Homo sapiens
caagccggatccgtaactt

SEQ ID NO: 23694 - DNA, 20 bp, Homo sapiens
caagccggatccgtaacttc

SEQ ID NO: 23695 - DNA, 24 bp, Homo sapiens
caagccggatccgtaacttcggga

SEQ ID NO: 23696 - DNA, 26 bp, Homo sapiens
caagccggatccgtaacttcgggata

SEQ ID NO: 23697 - DNA, 27 bp, Homo sapiens
caagccggatccgtaacttcgggataa

SEQ ID NO: 23698 - DNA, 29 bp, Homo sapiens
caagccggatccgtaacttcgggataagg

SEQ ID NO: 23699 - DNA, 30 bp, Homo sapiens
caagccggatccgtaacttcgggataagga

SEQ ID NO: 23700 - DNA, 17 bp, Homo sapiens
aagccggatccgtaact

SEQ ID NO: 23701 - DNA, 19 bp, Homo sapiens
aagccggatccgtaacttc

SEQ ID NO: 23702 - DNA, 23 bp, Homo sapiens
aagccggatccgtaacttcggga

SEQ ID NO: 23703 - DNA, 24 bp, Homo sapiens
aagccggatccgtaacttcgggat

SEQ ID NO: 23704 - DNA, 25 bp, Homo sapiens
aagccggatccgtaacttcgggata

SEQ ID NO: 23705 - DNA, 26 bp, Homo sapiens
aagccggatccgtaacttcgggataa

SEQ ID NO: 23706 - DNA, 28 bp, Homo sapiens
aagccggatccgtaacttcgggataagg

SEQ ID NO: 23707 - DNA, 29 bp, Homo sapiens
aagccggatccgtaacttcgggataagga

SEQ ID NO: 23708 - DNA, 32 bp, Homo sapiens
aagccggatccgtaacttcgggataaggattg

SEQ ID NO: 23709 - DNA, 33 bp, Homo sapiens; identical to SEQ ID NO: 5172

SEQ ID NO: 23710 - DNA, 16 bp, Homo sapiens
agccggatccgtaact

SEQ ID NO: 23711 - DNA, 17 bp, Homo sapiens
agccggatccgtaactt

SEQ ID NO: 23712 - DNA, 18 bp, Homo sapiens
agccggatccgtaacttc

SEQ ID NO: 23713 - DNA, 20 bp, Homo sapiens
agccggatccgtaacttcgg

SEQ ID NO: 23714 - DNA, 22 bp, Homo sapiens
agccggatccgtaacttcggga

SEQ ID NO: 23715 - DNA, 23 bp, Homo sapiens
agccggatccgtaacttcgggat

SEQ ID NO: 23716 - DNA, 24 bp, Homo sapiens
agccggatccgtaacttcgggata

SEQ ID NO: 23717 - DNA, 25 bp, Homo sapiens
agccggatccgtaacttcgggataa

SEQ ID NO: 23718 - DNA, 27 bp, Homo sapiens
agccggatccgtaacttcgggataagg

SEQ ID NO: 23719 - DNA, 28 bp, Homo sapiens
agccggatccgtaacttcgggataagga

SEQ ID NO: 23720 - DNA, 29 bp, Homo sapiens
agccggatccgtaacttcgggataaggat

SEQ ID NO: 23721 - DNA, 31 bp, Homo sapiens; identical to SEQ ID NO: 5178

SEQ ID NO: 23722 - DNA, 32 bp, Homo sapiens; identical to SEQ ID NO: 5179

SEQ ID NO: 23723 - DNA, 16 bp, Homo sapiens
gccggatccgtaactt

SEQ ID NO: 23724 - DNA, 17 bp, Homo sapiens
gccggatccgtaacttc

SEQ ID NO: 23725 - DNA, 19 bp, Homo sapiens
gccggatccgtaacttcgg

SEQ ID NO: 23726 - DNA, 21 bp, Homo sapiens
gccggatccgtaacttcggga

SEQ ID NO: 23727 - DNA, 22 bp, Homo sapiens
gccggatccgtaacttcgggat

SEQ ID NO: 23728 - DNA, 23 bp, Homo sapiens
gccggatccgtaacttcgggata

SEQ ID NO: 23729 - DNA, 24 bp, Homo sapiens
gccggatccgtaacttcgggataa

SEQ ID NO: 23730 - DNA, 26 bp, Homo sapiens
gccggatccgtaacttcgggataagg

SEQ ID NO: 23731 - DNA, 27 bp, Homo sapiens
gccggatccgtaacttcgggataagga

SEQ ID NO: 23732 - DNA, 28 bp, Homo sapiens
gccggatccgtaacttcgggataaggat

SEQ ID NO: 23733 - DNA, 30 bp, Homo sapiens; identical to SEQ ID NO: 5180

SEQ ID NO: 23734 - DNA, 31 bp, Homo sapiens; identical to SEQ ID NO: 5181

SEQ ID NO: 23735 - DNA, 16 bp, Homo sapiens
ccggatccgtaacttc

SEQ ID NO: 23736 - DNA, 20 bp, Homo sapiens
ccggatccgtaacttcggga

SEQ ID NO: 23737 - DNA, 25 bp, Homo sapiens
ccggatccgtaacttcgggataagg

SEQ ID NO: 23738 - DNA, 26 bp, Homo sapiens
ccggatccgtaacttcgggataagga

SEQ ID NO: 23739 - DNA, 27 bp, Homo sapiens
ccggatccgtaacttcgggataaggat

SEQ ID NO: 23740 - DNA, 28 bp, Homo sapiens
ccggatccgtaacttcgggataaggatt

SEQ ID NO: 23741 - DNA, 29 bp, Homo sapiens
ccggatccgtaacttcgggataaggattg

SEQ ID NO: 23742 - DNA, 30 bp, Homo sapiens
ccggatccgtaacttcgggataaggattgg

SEQ ID NO: 23743 - DNA, 31 bp, Homo sapiens
ccggatccgtaacttcgggataaggattggc

SEQ ID NO: 23744 - DNA, 32 bp, Homo sapiens; identical to SEQ ID NO: 5183

SEQ ID NO: 23745 - DNA, 33 bp, Homo sapiens; identical to SEQ ID NO: 5184

SEQ ID NO: 23746 - DNA, 34 bp, Homo sapiens
ccggatccgtaacttcgggataaggattggctct

SEQ ID NO: 23747 - DNA, 24 bp, Homo sapiens
cggatccgtaacttcgggataagg

SEQ ID NO: 23748 - DNA, 25 bp, Homo sapiens
cggatccgtaacttcgggataagga

SEQ ID NO: 23749 - DNA, 26 bp, Homo sapiens
cggatccgtaacttcgggataaggat

SEQ ID NO: 23750 - DNA, 28 bp, Homo sapiens
cggatccgtaacttcgggataaggattg

SEQ ID NO: 23751 - DNA, 31 bp, Homo sapiens; identical to SEQ ID NO: 5187

SEQ ID NO: 23752 - DNA, 32 bp, Homo sapiens; identical to SEQ ID NO: 5188

SEQ ID NO: 23753 - DNA, 33 bp, Homo sapiens
cggatccgtaacttcgggataaggattggctct

SEQ ID NO: 23754 - DNA, 27 bp, Homo sapiens
ggatccgtaacttcgggataaggattg

SEQ ID NO: 23755 - DNA, 28 bp, Homo sapiens
atccgtaacttcgggataaggattggct

SEQ ID NO: 23756 - DNA, 29 bp, Homo sapiens
atccgtaacttcgggataaggattggctc

SEQ ID NO: 23757 - DNA, 30 bp, Homo sapiens; identical to SEQ ID NO: 5191

SEQ ID NO: 23758 - DNA, 31 bp, Homo sapiens; identical to SEQ ID NO: 5192

SEQ ID NO: 23759 - DNA, 32 bp, Homo sapiens
atccgtaacttcgggataaggattggctctaa

SEQ ID NO: 23760 - DNA, 33 bp, Homo sapiens; identical to SEQ ID NO: 5193

SEQ ID NO: 23761 - DNA, 34 bp, Homo sapiens
atccgtaacttcgggataaggattggctctaagg

SEQ ID NO: 23762 - DNA, 28 bp, Homo sapiens
tccgtaacttcgggataaggattggctc

SEQ ID NO: 23763 - DNA, 29 bp, Homo sapiens
tccgtaacttcgggataaggattggctct

SEQ ID NO: 23764 - DNA, 30 bp, Homo sapiens
tccgtaacttcgggataaggattggctcta

SEQ ID NO: 23765 - DNA, 31 bp, Homo sapiens
tccgtaacttcgggataaggattggctctaa

SEQ ID NO: 23766 - DNA, 32 bp, Homo sapiens
tccgtaacttcgggataaggattggctctaag

SEQ ID NO: 23767 - DNA, 21 bp, Homo sapiens
ccgtaacttcgggataaggat

SEQ ID NO: 23768 - DNA, 25 bp, Homo sapiens
ccgtaacttcgggataaggattggc

SEQ ID NO: 23769 - DNA, 26 bp, Homo sapiens
ccgtaacttcgggataaggattggct

SEQ ID NO: 23770 - DNA, 27 bp, Homo sapiens
ccgtaacttcgggataaggattggctc

SEQ ID NO: 23771 - DNA, 28 bp, Homo sapiens
ccgtaacttcgggataaggattggctct

SEQ ID NO: 23772 - DNA, 29 bp, Homo sapiens
ccgtaacttcgggataaggattggctcta

SEQ ID NO: 23773 - DNA, 30 bp, Homo sapiens
ccgtaacttcgggataaggattggctctaa

SEQ ID NO: 23774 - DNA, 24 bp, Homo sapiens
cgtaacttcgggataaggattggc

SEQ ID NO: 23775 - DNA, 25 bp, Homo sapiens
cgtaacttcgggataaggattggct

SEQ ID NO: 23776 - DNA, 26 bp, Homo sapiens
cgtaacttcgggataaggattggctc

SEQ ID NO: 23777 - DNA, 27 bp, Homo sapiens
cgtaacttcgggataaggattggctct

SEQ ID NO: 23778 - DNA, 28 bp, Homo sapiens
cgtaacttcgggataaggattggctcta

SEQ ID NO: 23779 - DNA, 29 bp, Homo sapiens
cgtaacttcgggataaggattggctctaa

SEQ ID NO: 23780 - DNA, 30 bp, Homo sapiens
cgtaacttcgggataaggattggctctaag

SEQ ID NO: 23781 - DNA, 33 bp, Homo sapiens; identical to SEQ ID NO: 5204

SEQ ID NO: 23782 - DNA, 25 bp, Homo sapiens
gtaacttcgggataaggattggctc

SEQ ID NO: 23783 - DNA, 26 bp, Homo sapiens
gtaacttcgggataaggattggctct

SEQ ID NO: 23784 - DNA, 24 bp, Homo sapiens
taacttcgggataaggattggctc

SEQ ID NO: 23785 - DNA, 25 bp, Homo sapiens
taacttcgggataaggattggctct

SEQ ID NO: 23786 - DNA, 26 bp, Homo sapiens
taacttcgggataaggattggctcta

SEQ ID NO: 23787 - DNA, 23 bp, Homo sapiens
aacttcgggataaggattggctc

SEQ ID NO: 23788 - DNA, 24 bp, Homo sapiens
aacttcgggataaggattggctct

SEQ ID NO: 23789 - DNA, 25 bp, Homo sapiens
aacttcgggataaggattggctcta

SEQ ID NO: 23790 - DNA, 22 bp, Homo sapiens
acttcgggataaggattggctc

SEQ ID NO: 23791 - DNA, 23 bp, Homo sapiens
acttcgggataaggattggctct

SEQ ID NO: 23792 - DNA, 24 bp, Homo sapiens
acttcgggataaggattggctcta

SEQ ID NO: 23793 - DNA, 25 bp, Homo sapiens
acttcgggataaggattggctctaa

SEQ ID NO: 23794 - DNA, 29 bp, Homo sapiens
acttcgggataaggattggctctaagggc

SEQ ID NO: 23795 - DNA, 30 bp, Homo sapiens
acttcgggataaggattggctctaagggct

SEQ ID NO: 23796 - DNA, 31 bp, Homo sapiens
acttcgggataaggattggctctaagggctg

SEQ ID NO: 23797 - DNA, 32 bp, Homo sapiens
acttcgggataaggattggctctaagggctgg

SEQ ID NO: 23798 - DNA, 21 bp, Homo sapiens
cttcgggataaggattggctc

SEQ ID NO: 23799 - DNA, 22 bp, Homo sapiens
cttcgggataaggattggctct

SEQ ID NO: 23800 - DNA, 23 bp, Homo sapiens
cttcgggataaggattggctcta

SEQ ID NO: 23801 - DNA, 24 bp, Homo sapiens
cttcgggataaggattggctctaa

SEQ ID NO: 23802 - DNA, 29 bp, Homo sapiens
cttcgggataaggattggctctaagggct

SEQ ID NO: 23803 - DNA, 30 bp, Homo sapiens
cttcgggataaggattggctctaagggctg

SEQ ID NO: 23804 - DNA, 31 bp, Homo sapiens
cttcgggataaggattggctctaagggctgg

SEQ ID NO: 23805 - DNA, 19 bp, Homo sapiens
ttcgggataaggattggct

SEQ ID NO: 23806 - DNA, 20 bp, Homo sapiens
ttcgggataaggattggctc

SEQ ID NO: 23807 - DNA, 21 bp, Homo sapiens
ttcgggataaggattggctct

SEQ ID NO: 23808 - DNA, 22 bp, Homo sapiens
ttcgggataaggattggctcta

SEQ ID NO: 23809 - DNA, 27 bp, Homo sapiens
ttcgggataaggattggctctaagggc

SEQ ID NO: 23810 - DNA, 28 bp, Homo sapiens
ttcgggataaggattggctctaagggct

SEQ ID NO: 23811 - DNA, 29 bp, Homo sapiens
ttcgggataaggattggctctaagggctg

SEQ ID NO: 23812 - DNA, 30 bp, Homo sapiens
ttcgggataaggattggctctaagggctgg

SEQ ID NO: 23813 - DNA, 31 bp, Homo sapiens
ttcgggataaggattggctctaagggctggg

SEQ ID NO: 23814 - DNA, 32 bp, Homo sapiens
ttcgggataaggattggctctaagggctgggt

SEQ ID NO: 23815 - DNA, 33 bp, Homo sapiens
ttcgggataaggattggctctaagggctgggtc

SEQ ID NO: 23816 - DNA, 18 bp, Homo sapiens
tcgggataaggattggct

SEQ ID NO: 23817 - DNA, 19 bp, Homo sapiens
tcgggataaggattggctc

SEQ ID NO: 23818 - DNA, 20 bp, Homo sapiens
tcgggataaggattggctct

SEQ ID NO: 23819 - DNA, 21 bp, Homo sapiens
tcgggataaggattggctcta

SEQ ID NO: 23820 - DNA, 26 bp, Homo sapiens
tcgggataaggattggctctaagggc

SEQ ID NO: 23821 - DNA, 27 bp, Homo sapiens
tcgggataaggattggctctaagggct

SEQ ID NO: 23822 - DNA, 28 bp, Homo sapiens
tcgggataaggattggctctaagggctg

SEQ ID NO: 23823 - DNA, 29 bp, Homo sapiens
tcgggataaggattggctctaagggctgg

SEQ ID NO: 23824 - DNA, 30 bp, Homo sapiens
tcgggataaggattggctctaagggctggg

SEQ ID NO: 23825 - DNA, 32 bp, Homo sapiens
tcgggataaggattggctctaagggctgggtc

SEQ ID NO: 23826 - DNA, 18 bp, Homo sapiens
cgggataaggattggctc

SEQ ID NO: 23827 - DNA, 19 bp, Homo sapiens
cgggataaggattggctct

SEQ ID NO: 23828 - DNA, 20 bp, Homo sapiens
cgggataaggattggctcta

SEQ ID NO: 23829 - DNA, 28 bp, Homo sapiens
cgggataaggattggctctaagggctgg

SEQ ID NO: 23830 - DNA, 17 bp, Homo sapiens
gggataaggattggctc

SEQ ID NO: 23831 - DNA, 18 bp, Homo sapiens
gggataaggattggctct

SEQ ID NO: 23832 - DNA, 16 bp, Homo sapiens
ggataaggattggctc

SEQ ID NO: 23833 - DNA, 17 bp, Homo sapiens
ggataaggattggctct

SEQ ID NO: 23834 - DNA, 16 bp, Homo sapiens
gataaggattggctct

SEQ ID NO: 23835 - DNA, 17 bp, Homo sapiens
gataaggattggctcta

SEQ ID NO: 23836 - DNA, 18 bp, Homo sapiens
gataaggattggctctaa

SEQ ID NO: 23837 - DNA, 16 bp, Homo sapiens
ataaggattggctcta

SEQ ID NO: 23838 - DNA, 17 bp, Homo sapiens
ataaggattggctctaa

SEQ ID NO: 23839 - DNA, 18 bp, Homo sapiens
ataaggattggctctaag

SEQ ID NO: 23840 - DNA, 19 bp, Homo sapiens
ataaggattggctctaagg

SEQ ID NO: 23841 - DNA, 20 bp, Homo sapiens
ataaggattggctctaaggg

SEQ ID NO: 23842 - DNA, 21 bp, Homo sapiens
ataaggattggctctaagggc

SEQ ID NO: 23843 - DNA, 16 bp, Homo sapiens
taaggattggctctaa

SEQ ID NO: 23844 - DNA, 17 bp, Homo sapiens
taaggattggctctaag

SEQ ID NO: 23845 - DNA, 18 bp, Homo sapiens
taaggattggctctaagg

SEQ ID NO: 23846 - DNA, 19 bp, Homo sapiens
taaggattggctctaaggg

SEQ ID NO: 23847 - DNA, 20 bp, Homo sapiens
taaggattggctctaagggc

SEQ ID NO: 23848 - DNA, 21 bp, Homo sapiens
taaggattggctctaagggct

SEQ ID NO: 23849 - DNA, 22 bp, Homo sapiens
taaggattggctctaagggctg

SEQ ID NO: 23850 - DNA, 25 bp, Homo sapiens
taaggattggctctaagggctgggt

SEQ ID NO: 23851 - DNA, 26 bp, Homo sapiens
taaggattggctctaagggctgggtc

SEQ ID NO: 23852 - DNA, 29 bp, Homo sapiens
taaggattggctctaagggctgggtcggt

SEQ ID NO: 23853 - DNA, 30 bp, Homo sapiens
taaggattggctctaagggctgggtcggtc

SEQ ID NO: 23854 - DNA, 16 bp, Homo sapiens
aaggattggctctaag

SEQ ID NO: 23855 - DNA, 17 bp, Homo sapiens
aaggattggctctaagg

SEQ ID NO: 23856 - DNA, 18 bp, Homo sapiens
aaggattggctctaaggg

SEQ ID NO: 23857 - DNA, 19 bp, Homo sapiens
aaggattggctctaagggc

SEQ ID NO: 23858 - DNA, 25 bp, Homo sapiens
aaggattggctctaagggctgggtc

SEQ ID NO: 23859 - DNA, 33 bp, Homo sapiens; identical to SEQ ID NO: 5220

SEQ ID NO: 23860 - DNA, 16 bp, Homo sapiens
aggattggctctaagg

SEQ ID NO: 23861 - DNA, 17 bp, Homo sapiens
aggattggctctaaggg

SEQ ID NO: 23862 - DNA, 18 bp, Homo sapiens
aggattggctctaagggc

SEQ ID NO: 23863 - DNA, 19 bp, Homo sapiens
aggattggctctaagggct

SEQ ID NO: 23864 - DNA, 20 bp, Homo sapiens
aggattggctctaagggctg

SEQ ID NO: 23865 - DNA, 23 bp, Homo sapiens
aggattggctctaagggctgggt

SEQ ID NO: 23866 - DNA, 24 bp, Homo sapiens
aggattggctctaagggctgggtc

SEQ ID NO: 23867 - DNA, 27 bp, Homo sapiens
aggattggctctaagggctgggtcggt

SEQ ID NO: 23868 - DNA, 28 bp, Homo sapiens
aggattggctctaagggctgggtcggtc

SEQ ID NO: 23869 - DNA, 33 bp, Homo sapiens
aggattggctctaagggctgggtcggtcgggct

SEQ ID NO: 23870 - DNA, 17 bp, Homo sapiens
ggattggctctaagggc

SEQ ID NO: 23871 - DNA, 18 bp, Homo sapiens
ggattggctctaagggct

SEQ ID NO: 23872 - DNA, 19 bp, Homo sapiens
ggattggctctaagggctg

SEQ ID NO: 23873 - DNA, 23 bp, Homo sapiens
ggattggctctaagggctgggtc

SEQ ID NO: 23874 - DNA, 26 bp, Homo sapiens
ggattggctctaagggctgggtcggt

SEQ ID NO: 23875 - DNA, 27 bp, Homo sapiens
ggattggctctaagggctgggtcggtc

SEQ ID NO: 23876 - DNA, 32 bp, Homo sapiens
ggattggctctaagggctgggtcggtcgggct

SEQ ID NO: 23877 - DNA, 16 bp, Homo sapiens
gattggctctaagggc

SEQ ID NO: 23878 - DNA, 31 bp, Homo sapiens
gattggctctaagggctgggtcggtcgggct

SEQ ID NO: 23879 - DNA, 20 bp, Homo sapiens
ttggctctaagggctgggtc

SEQ ID NO: 23880 - DNA, 26 bp, Homo sapiens
tggctctaagggctgggtcggtcggg

SEQ ID NO: 23881 - DNA, 30 bp, Homo sapiens
tggctctaagggctgggtcggtcgggctgg

SEQ ID NO: 23882 - DNA, 31 bp, Homo sapiens
tggctctaagggctgggtcggtcgggctggg

SEQ ID NO: 23883 - DNA, 32 bp, Homo sapiens
tggctctaagggctgggtcggtcgggctgggg

SEQ ID NO: 23884 - DNA, 46 bp, Homo sapiens
tggctctaagggctgggtcggtcgggctggggcgcgaagcggggct

SEQ ID NO: 23885 - DNA, 25 bp, Homo sapiens
ggctctaagggctgggtcggtcggg

SEQ ID NO: 23886 - DNA, 27 bp, Homo sapiens
ggctctaagggctgggtcggtcgggct

SEQ ID NO: 23887 - DNA, 29 bp, Homo sapiens
ggctctaagggctgggtcggtcgggctgg

SEQ ID NO: 23888 - DNA, 31 bp, Homo sapiens
ggctctaagggctgggtcggtcgggctgggg

SEQ ID NO: 23889 - DNA, 32 bp, Homo sapiens
ggctctaagggctgggtcggtcgggctggggc

SEQ ID NO: 23890 - DNA, 45 bp, Homo sapiens
ggctctaagggctgggtcggtcgggctggggcgcgaagcggggct

SEQ ID NO: 23891 - DNA, 41 bp, Homo sapiens
ctaagggctgggtcggtcgggctggggcgcgaagcggggct

SEQ ID NO: 23892 - DNA, 16 bp, Homo sapiens
aagggctgggtcggtc

SEQ ID NO: 23893 - DNA, 19 bp, Homo sapiens
aagggctgggtcggtcggg

SEQ ID NO: 23894 - DNA, 20 bp, Homo sapiens
aagggctgggtcggtcgggc

SEQ ID NO: 23895 - DNA, 21 bp, Homo sapiens
aagggctgggtcggtcgggct

SEQ ID NO: 23896 - DNA, 22 bp, Homo sapiens
aagggctgggtcggtcgggctg

SEQ ID NO: 23897 - DNA, 23 bp, Homo sapiens
aagggctgggtcggtcgggctgg

SEQ ID NO: 23898 - DNA, 24 bp, Homo sapiens
aagggctgggtcggtcgggctggg

SEQ ID NO: 23899 - DNA, 25 bp, Homo sapiens
aagggctgggtcggtcgggctgggg

SEQ ID NO: 23900 - DNA, 26 bp, Homo sapiens
aagggctgggtcggtcgggctggggc

SEQ ID NO: 23901 - DNA, 27 bp, Homo sapiens
aagggctgggtcggtcgggctggggcg

SEQ ID NO: 23902 - DNA, 29 bp, Homo sapiens
aagggctgggtcggtcgggctggggcgcg

SEQ ID NO: 23903 - DNA, 38 bp, Homo sapiens
aagggctgggtcggtcgggctggggcgcgaagcggggc

SEQ ID NO: 23904 - DNA, 39 bp, Homo sapiens
aagggctgggtcggtcgggctggggcgcgaagcggggct

SEQ ID NO: 23905 - DNA, 20 bp, Homo sapiens
agggctgggtcggtcgggct

SEQ ID NO: 23906 - DNA, 21 bp, Homo sapiens
agggctgggtcggtcgggctg

SEQ ID NO: 23907 - DNA, 22 bp, Homo sapiens
agggctgggtcggtcgggctgg

SEQ ID NO: 23908 - DNA, 23 bp, Homo sapiens
agggctgggtcggtcgggctggg

SEQ ID NO: 23909 - DNA, 25 bp, Homo sapiens
agggctgggtcggtcgggctggggc

SEQ ID NO: 23910 - DNA, 26 bp, Homo sapiens
agggctgggtcggtcgggctggggcg

SEQ ID NO: 23911 - DNA, 27 bp, Homo sapiens
agggctgggtcggtcgggctggggcgc

SEQ ID NO: 23912 - DNA, 28 bp, Homo sapiens
agggctgggtcggtcgggctggggcgcg

SEQ ID NO: 23913 - DNA, 29 bp, Homo sapiens
agggctgggtcggtcgggctggggcgcga

SEQ ID NO: 23914 - DNA, 30 bp, Homo sapiens
agggctgggtcggtcgggctggggcgcgaa

SEQ ID NO: 23915 - DNA, 38 bp, Homo sapiens
agggctgggtcggtcgggctggggcgcgaagcggggct

SEQ ID NO: 23916 - DNA, 19 bp, Homo sapiens
gggctgggtcggtcgggct

SEQ ID NO: 23917 - DNA, 20 bp, Homo sapiens
gggctgggtcggtcgggctg

SEQ ID NO: 23918 - DNA, 21 bp, Homo sapiens
gggctgggtcggtcgggctgg

SEQ ID NO: 23919 - DNA, 28 bp, Homo sapiens
gggctgggtcggtcgggctggggcgcga

SEQ ID NO: 23920 - DNA, 29 bp, Homo sapiens
gggctgggtcggtcgggctggggcgcgaa

SEQ ID NO: 23921 - DNA, 20 bp, Homo sapiens
ggctgggtcggtcgggctgg

SEQ ID NO: 23922 - DNA, 27 bp, Homo sapiens
ggctgggtcggtcgggctggggcgcga

SEQ ID NO: 23923 - DNA, 36 bp, Homo sapiens
ggctgggtcggtcgggctggggcgcgaagcggggct

SEQ ID NO: 23924 - DNA, 19 bp, Homo sapiens
gctgggtcggtcgggctgg

SEQ ID NO: 23925 - DNA, 35 bp, Homo sapiens
gctgggtcggtcgggctggggcgcgaagcggggct

SEQ ID NO: 23926 - DNA, 20 bp, Homo sapiens
ctgggtcggtcgggctgggg

SEQ ID NO: 23927 - DNA, 21 bp, Homo sapiens
ctgggtcggtcgggctggggc

SEQ ID NO: 23928 - DNA, 22 bp, Homo sapiens
ctgggtcggtcgggctggggcg

SEQ ID NO: 23929 - DNA, 24 bp, Homo sapiens
ctgggtcggtcgggctggggcgcg

SEQ ID NO: 23930 - DNA, 33 bp, Homo sapiens
ctgggtcggtcgggctggggcgcgaagcggggc

SEQ ID NO: 23931 - DNA, 34 bp, Homo sapiens
ctgggtcggtcgggctggggcgcgaagcggggct

SEQ ID NO: 23932 - DNA, 33 bp, Homo sapiens
tgggtcggtcgggctggggcgcgaagcggggct

SEQ ID NO: 23933 - DNA, 32 bp, Homo sapiens
gggtcggtcgggctggggcgcgaagcggggct

SEQ ID NO: 23934 - DNA, 31 bp, Homo sapiens
ggtcggtcgggctggggcgcgaagcggggct

SEQ ID NO: 23935 - DNA, 18 bp, Homo sapiens
gtcggtcgggctggggcg

SEQ ID NO: 23936 - DNA, 21 bp, Homo sapiens
gtcggtcgggctggggcgcga

SEQ ID NO: 23937 - DNA, 22 bp, Homo sapiens
gtcggtcgggctggggcgcgaa

SEQ ID NO: 23938 - DNA, 29 bp, Homo sapiens
gtcggtcgggctggggcgcgaagcggggc

SEQ ID NO: 23939 - DNA, 30 bp, Homo sapiens; identical to SEQ ID NO: 5227

SEQ ID NO: 23940 - DNA, 17 bp, Homo sapiens
tcggtcgggctggggcg

SEQ ID NO: 23941 - DNA, 18 bp, Homo sapiens
tcggtcgggctggggcgc

SEQ ID NO: 23942 - DNA, 20 bp, Homo sapiens
tcggtcgggctggggcgcga

SEQ ID NO: 23943 - DNA, 21 bp, Homo sapiens
tcggtcgggctggggcgcgaa

SEQ ID NO: 23944 - DNA, 27 bp, Homo sapiens
tcggtcgggctggggcgcgaagcgggg

SEQ ID NO: 23945 - DNA, 28 bp, Homo sapiens
tcggtcgggctggggcgcgaagcggggc

SEQ ID NO: 23946 - DNA, 29 bp, Homo sapiens
tcggtcgggctggggcgcgaagcggggct

SEQ ID NO: 23947 - DNA, 16 bp, Homo sapiens
cggtcgggctggggcg

SEQ ID NO: 23948 - DNA, 17 bp, Homo sapiens
cggtcgggctggggcgc

SEQ ID NO: 23949 - DNA, 18 bp, Homo sapiens
cggtcgggctggggcgcg

SEQ ID NO: 23950 - DNA, 19 bp, Homo sapiens
cggtcgggctggggcgcga

SEQ ID NO: 23951 - DNA, 20 bp, Homo sapiens
cggtcgggctggggcgcgaa

SEQ ID NO: 23952 - DNA, 25 bp, Homo sapiens
cggtcgggctggggcgcgaagcggg

SEQ ID NO: 23953 - DNA, 26 bp, Homo sapiens
cggtcgggctggggcgcgaagcgggg

SEQ ID NO: 23954 - DNA, 27 bp, Homo sapiens
cggtcgggctggggcgcgaagcggggc

SEQ ID NO: 23955 - DNA, 28 bp, Homo sapiens
cggtcgggctggggcgcgaagcggggct

SEQ ID NO: 23956 - DNA, 22 bp, Homo sapiens
tcgggctggggcgcgaagcggg

SEQ ID NO: 23957 - DNA, 23 bp, Homo sapiens
tcgggctggggcgcgaagcgggg

SEQ ID NO: 23958 - DNA, 24 bp, Homo sapiens
tcgggctggggcgcgaagcggggc

SEQ ID NO: 23959 - DNA, 25 bp, Homo sapiens
tcgggctggggcgcgaagcggggct

SEQ ID NO: 23960 - DNA, 27 bp, Homo sapiens
tcgggctggggcgcgaagcggggctgg

SEQ ID NO: 23961 - DNA, 28 bp, Homo sapiens
tcgggctggggcgcgaagcggggctggg

SEQ ID NO: 23962 - DNA, 16 bp, Homo sapiens
cgggctggggcgcgaa

SEQ ID NO: 23963 - DNA, 23 bp, Homo sapiens
cgggctggggcgcgaagcggggc

SEQ ID NO: 23964 - DNA, 22 bp, Homo sapiens
gggctggggcgcgaagcggggc

SEQ ID NO: 23965 - DNA, 18 bp, Homo sapiens
tggggcgcgaagcggggc

SEQ ID NO: 23966 - DNA, 17 bp, Homo sapiens
ggggcgcgaagcggggc

SEQ ID NO: 23967 - DNA, 16 bp, Homo sapiens
ggcgcgaagcggggct

SEQ ID NO: 23968 - DNA, 20 bp, Homo sapiens
agcggggctgggcgcgcgcc

SEQ ID NO: 23969 - DNA, 29 bp, Homo sapiens
agcggggctgggcgcgcgccgcggctgga

SEQ ID NO: 23970 - DNA, 30 bp, Homo sapiens
agcggggctgggcgcgcgccgcggctggac

SEQ ID NO: 23971 - DNA, 32 bp, Homo sapiens
agcggggctgggcgcgcgccgcggctggacga

SEQ ID NO: 23972 - DNA, 33 bp, Homo sapiens
agcggggctgggcgcgcgccgcggctggacgag

SEQ ID NO: 23973 - DNA, 16 bp, Homo sapiens
gcggggctgggcgcgc

SEQ ID NO: 23974 - DNA, 19 bp, Homo sapiens
gcggggctgggcgcgcgcc

SEQ ID NO: 23975 - DNA, 28 bp, Homo sapiens
gcggggctgggcgcgcgccgcggctgga

SEQ ID NO: 23976 - DNA, 30 bp, Homo sapiens
gcggggctgggcgcgcgccgcggctggacg

SEQ ID NO: 23977 - DNA, 31 bp, Homo sapiens
gcggggctgggcgcgcgccgcggctggacga

SEQ ID NO: 23978 - DNA, 32 bp, Homo sapiens
gcggggctgggcgcgcgccgcggctggacgag

SEQ ID NO: 23979 - DNA, 33 bp, Homo sapiens
gcggggctgggcgcgcgccgcggctggacgagg

SEQ ID NO: 23980 - DNA, 22 bp, Homo sapiens
tgggcgcgcgccgcggctggac

SEQ ID NO: 23981 - DNA, 31 bp, Homo sapiens
tgggcgcgcgccgcggctggacgaggcgccg

SEQ ID NO: 23982 - DNA, 16 bp, Homo sapiens
gggcgcgcgccgcggc

SEQ ID NO: 23983 - DNA, 17 bp, Homo sapiens
gggcgcgcgccgcggct

SEQ ID NO: 23984 - DNA, 18 bp, Homo sapiens
gggcgcgcgccgcggctg

SEQ ID NO: 23985 - DNA, 20 bp, Homo sapiens
gggcgcgcgccgcggctgga

SEQ ID NO: 23986 - DNA, 21 bp, Homo sapiens
gggcgcgcgccgcggctggac

SEQ ID NO: 23987 - DNA, 22 bp, Homo sapiens
gggcgcgcgccgcggctggacg

SEQ ID NO: 23988 - DNA, 23 bp, Homo sapiens
gggcgcgcgccgcggctggacga

SEQ ID NO: 23989 - DNA, 24 bp, Homo sapiens
gggcgcgcgccgcggctggacgag

SEQ ID NO: 23990 - DNA, 25 bp, Homo sapiens
gggcgcgcgccgcggctggacgagg

SEQ ID NO: 23991 - DNA, 26 bp, Homo sapiens
gggcgcgcgccgcggctggacgaggc

SEQ ID NO: 23992 - DNA, 27 bp, Homo sapiens
gggcgcgcgccgcggctggacgaggcg

SEQ ID NO: 23993 - DNA, 29 bp, Homo sapiens
gggcgcgcgccgcggctggacgaggcgcc

SEQ ID NO: 23994 - DNA, 30 bp, Homo sapiens
gggcgcgcgccgcggctggacgaggcgccg

SEQ ID NO: 23995 - DNA, 17 bp, Homo sapiens
ggcgcgcgccgcggctg

SEQ ID NO: 23996 - DNA, 22 bp, Homo sapiens
ggcgcgcgccgcggctggacga

SEQ ID NO: 23997 - DNA, 20 bp, Homo sapiens
gcgcgcgccgcggctggacg

SEQ ID NO: 23998 - DNA, 21 bp, Homo sapiens
gcgcgcgccgcggctggacga

SEQ ID NO: 23999 - DNA, 20 bp, Homo sapiens
cgcgcgccgcggctggacga

SEQ ID NO: 24000 - DNA, 32 bp, Homo sapiens
cgcgcgccgcggctggacgaggcgccgccgcc

SEQ ID NO: 24001 - DNA, 19 bp, Homo sapiens
gcgcgccgcggctggacga

SEQ ID NO: 24002 - DNA, 16 bp, Homo sapiens
cgcgccgcggctggac

SEQ ID NO: 24003 - DNA, 18 bp, Homo sapiens
cgcgccgcggctggacga

SEQ ID NO: 24004 - DNA, 30 bp, Homo sapiens
cgcgccgcggctggacgaggcgccgccgcc

SEQ ID NO: 24005 - DNA, 17 bp, Homo sapiens
gcgccgcggctggacga

SEQ ID NO: 24006 - DNA, 16 bp, Homo sapiens
cgccgcggctggacga

SEQ ID NO: 24007 - DNA, 22 bp, Homo sapiens
cgccgcggctggacgaggcgcc

SEQ ID NO: 24008 - DNA, 20 bp, Homo sapiens
ccgcggctggacgaggcgcc

SEQ ID NO: 24009 - DNA, 21 bp, Homo sapiens
ccgcggctggacgaggcgccg

SEQ ID NO: 24010 - DNA, 20 bp, Homo sapiens
cgcggctggacgaggcgccg

SEQ ID NO: 24011 - DNA, 29 bp, Homo sapiens
cggctggacgaggcgccgccgcccccccc

SEQ ID NO: 24012 - DNA, 18 bp, Homo sapiens
gctggacgaggcgccgcc

SEQ ID NO: 24013 - DNA, 19 bp, Homo sapiens
gctggacgaggcgccgccg

SEQ ID NO: 24014 - DNA, 20 bp, Homo sapiens
gctggacgaggcgccgccgc

SEQ ID NO: 24015 - DNA, 21 bp, Homo sapiens
gctggacgaggcgccgccgcc

SEQ ID NO: 24016 - DNA, 22 bp, Homo sapiens
gctggacgaggcgccgccgccc

SEQ ID NO: 24017 - DNA, 23 bp, Homo sapiens
gctggacgaggcgccgccgcccc

SEQ ID NO: 24018 - DNA, 24 bp, Homo sapiens
gctggacgaggcgccgccgccccc

SEQ ID NO: 24019 - DNA, 25 bp, Homo sapiens
gctggacgaggcgccgccgcccccc

SEQ ID NO: 24020 - DNA, 27 bp, Homo sapiens
gctggacgaggcgccgccgcccccccc

SEQ ID NO: 24021 - DNA, 20 bp, Homo sapiens
ctggacgaggcgccgccgcc

SEQ ID NO: 24022 - DNA, 21 bp, Homo sapiens
ctggacgaggcgccgccgccc

SEQ ID NO: 24023 - DNA, 22 bp, Homo sapiens
ctggacgaggcgccgccgcccc

SEQ ID NO: 24024 - DNA, 23 bp, Homo sapiens
ctggacgaggcgccgccgccccc

SEQ ID NO: 24025 - DNA, 24 bp, Homo sapiens
ctggacgaggcgccgccgcccccc

SEQ ID NO: 24026 - DNA, 25 bp, Homo sapiens
ctggacgaggcgccgccgccccccc

SEQ ID NO: 24027 - DNA, 26 bp, Homo sapiens
ctggacgaggcgccgccgcccccccc

SEQ ID NO: 24028 - DNA, 17 bp, Homo sapiens
gacgaggcgccgccgcc

SEQ ID NO: 24029 - DNA, 22 bp, Homo sapiens
cgaggcgccgccgcccccccca

SEQ ID NO: 24030 - DNA, 29 bp, Homo sapiens
cgaggcgccgccgccccccccacgcccgg

SEQ ID NO: 24031 - DNA, 33 bp, Homo sapiens
cgaggcgccgccgccccccccacgcccggggca

SEQ ID NO: 24032 - DNA, 19 bp, Homo sapiens
aggcgccgccgcccccccc

SEQ ID NO: 24033 - DNA, 30 bp, Homo sapiens
aggcgccgccgccccccccacgcccggggc

SEQ ID NO: 24034 - DNA, 16 bp, Homo sapiens
cgccgccgcccccccc

SEQ ID NO: 24035 - DNA, 17 bp, Homo sapiens
cgccgccgcccccccca

SEQ ID NO: 24036 - DNA, 18 bp, Homo sapiens
cgccgccgccccccccac

SEQ ID NO: 24037 - DNA, 27 bp, Homo sapiens
cgccgccgccccccccacgcccggggc

SEQ ID NO: 24038 - DNA, 22 bp, Homo sapiens
cccggggcacccccctcgcggc

SEQ ID NO: 24039 - DNA, 23 bp, Homo sapiens
cccggggcacccccctcgcggcc

SEQ ID NO: 24040 - DNA, 21 bp, Homo sapiens
ccggggcacccccctcgcggc

SEQ ID NO: 24041 - DNA, 22 bp, Homo sapiens
ccggggcacccccctcgcggcc

SEQ ID NO: 24042 - DNA, 20 bp, Homo sapiens
cggggcacccccctcgcggc

SEQ ID NO: 24043 - DNA, 21 bp, Homo sapiens
cggggcacccccctcgcggcc

SEQ ID NO: 24044 - DNA, 20 bp, Homo sapiens
ggggcacccccctcgcggcc

SEQ ID NO: 24045 - DNA, 22 bp, Homo sapiens
ggggcacccccctcgcggccct

SEQ ID NO: 24046 - DNA, 31 bp, Homo sapiens
ggcacccccctcgcggccctcccccgcccca

SEQ ID NO: 24047 - DNA, 16 bp, Homo sapiens
cacccccctcgcggcc

SEQ ID NO: 24048 - DNA, 16 bp, Homo sapiens
acccccctcgcggccc

SEQ ID NO: 24049 - DNA, 20 bp, Homo sapiens
acccccctcgcggccctccc

SEQ ID NO: 24050 - DNA, 16 bp, Homo sapiens
cccccctcgcggccct

SEQ ID NO: 24051 - DNA, 24 bp, Homo sapiens
cccccctcgcggccctcccccgcc

SEQ ID NO: 24052 - DNA, 27 bp, Homo sapiens
cccccctcgcggccctcccccgcccca

SEQ ID NO: 24053 - DNA, 20 bp, Homo sapiens
cccctcgcggccctcccccg

SEQ ID NO: 24054 - DNA, 29 bp, Homo sapiens
ctcccccgccccaccccgcgcgcgccgct

SEQ ID NO: 24055 - DNA, 31 bp, Homo sapiens
ctcccccgccccaccccgcgcgcgccgctcg

SEQ ID NO: 24056 - DNA, 33 bp, Homo sapiens
ctcccccgccccaccccgcgcgcgccgctcgct

SEQ ID NO: 24057 - DNA, 28 bp, Homo sapiens
tcccccgccccaccccgcgcgcgccgct

SEQ ID NO: 24058 - DNA, 32 bp, Homo sapiens
tcccccgccccaccccgcgcgcgccgctcgct

SEQ ID NO: 24059 - DNA, 16 bp, Homo sapiens
cccccgccccaccccg

SEQ ID NO: 24060 - DNA, 18 bp, Homo sapiens
cccccgccccaccccgcg

SEQ ID NO: 24061 - DNA, 24 bp, Homo sapiens
cccccgccccaccccgcgcgcgcc

SEQ ID NO: 24062 - DNA, 25 bp, Homo sapiens
cccccgccccaccccgcgcgcgccg

SEQ ID NO: 24063 - DNA, 26 bp, Homo sapiens
cccccgccccaccccgcgcgcgccgc

SEQ ID NO: 24064 - DNA, 27 bp, Homo sapiens
cccccgccccaccccgcgcgcgccgct

SEQ ID NO: 24065 - DNA, 16 bp, Homo sapiens
accccgcgcgcgccgc

SEQ ID NO: 24066 - DNA, 23 bp, Homo sapiens
cccgcgcgcgccgctcgctccct

SEQ ID NO: 24067 - DNA, 25 bp, Homo sapiens
ctctctctctcccccgctccccgtc

SEQ ID NO: 24068 - DNA, 34 bp, Homo sapiens
ctctctctctcccccgctccccgtcctcccccct

SEQ ID NO: 24069 - DNA, 33 bp, Homo sapiens
tctctctctcccccgctccccgtcctcccccct

SEQ ID NO: 24070 - DNA, 32 bp, Homo sapiens
ctctctctcccccgctccccgtcctcccccct

SEQ ID NO: 24071 - DNA, 31 bp, Homo sapiens
tctctctcccccgctccccgtcctcccccct

SEQ ID NO: 24072 - DNA, 30 bp, Homo sapiens
ctctctcccccgctccccgtcctcccccct

SEQ ID NO: 24073 - DNA, 29 bp, Homo sapiens
tctctcccccgctccccgtcctcccccct

SEQ ID NO: 24074 - DNA, 28 bp, Homo sapiens
ctctcccccgctccccgtcctcccccct

SEQ ID NO: 24075 - DNA, 27 bp, Homo sapiens
tctcccccgctccccgtcctcccccct

SEQ ID NO: 24076 - DNA, 25 bp, Homo sapiens
ctcccccgctccccgtcctcccccc

SEQ ID NO: 24077 - DNA, 26 bp, Homo sapiens
ctcccccgctccccgtcctcccccct

SEQ ID NO: 24078 - DNA, 25 bp, Homo sapiens
tcccccgctccccgtcctcccccct

SEQ ID NO: 24079 - DNA, 24 bp, Homo sapiens
cccccgctccccgtcctcccccct

SEQ ID NO: 24080 - DNA, 22 bp, Homo sapiens
cccgctccccgtcctcccccct

SEQ ID NO: 24081 - DNA, 20 bp, Homo sapiens
cgctccccgtcctcccccct

SEQ ID NO: 24082 - DNA, 19 bp, Homo sapiens
gctccccgtcctcccccct

SEQ ID NO: 24083 - DNA, 33 bp, Homo sapiens
cccgtcctcccccctccccgggggagcgccgcg

SEQ ID NO: 24084 - DNA, 20 bp, Homo sapiens
tgggggcggcggcgggggga

SEQ ID NO: 24085 - DNA, 22 bp, Homo sapiens
tgggggcggcggcggggggaga

SEQ ID NO: 24086 - DNA, 19 bp, Homo sapiens
gggggcggcggcgggggga

SEQ ID NO: 24087 - DNA, 18 bp, Homo sapiens
ggggcggcggcgggggga

SEQ ID NO: 24088 - DNA, 19 bp, Homo sapiens
ggcggcggcggggggagaa

SEQ ID NO: 24089 - DNA, 17 bp, Homo sapiens
gcggcggcggggggaga

SEQ ID NO: 24090 - DNA, 18 bp, Homo sapiens
gcggcggcggggggagaa

SEQ ID NO: 24091 - DNA, 23 bp, Homo sapiens
ggggggagaagggtcggggcggc

SEQ ID NO: 24092 - DNA, 18 bp, Homo sapiens
gagaagggtcggggcggc

SEQ ID NO: 24093 - DNA, 16 bp, Homo sapiens
gaagggtcggggcggc

SEQ ID NO: 24094 - DNA, 17 bp, Homo sapiens
gaagggtcggggcggca

SEQ ID NO: 24095 - DNA, 33 bp, Homo sapiens
gaagggtcggggcggcaggggccggcggcggcc

SEQ ID NO: 24096 - DNA, 16 bp, Homo sapiens
aggggccggcggcggc

SEQ ID NO: 24097 - DNA, 21 bp, Homo sapiens
gcggcggcccgccgcggggcc

SEQ ID NO: 24098 - DNA, 20 bp, Homo sapiens
cggcggcccgccgcggggcc

SEQ ID NO: 24099 - DNA, 18 bp, Homo sapiens
gcggcccgccgcggggcc

SEQ ID NO: 24100 - DNA, 20 bp, Homo sapiens
cggcccgccgcggggccccg

SEQ ID NO: 24101 - DNA, 21 bp, Homo sapiens
cggcccgccgcggggccccgg

SEQ ID NO: 24102 - DNA, 22 bp, Homo sapiens
cggcccgccgcggggccccggc

SEQ ID NO: 24103 - DNA, 25 bp, Homo sapiens
cggcccgccgcggggccccggcggc

SEQ ID NO: 24104 - DNA, 17 bp, Homo sapiens
cccgccgcggggccccg

SEQ ID NO: 24105 - DNA, 26 bp, Homo sapiens
cgccgcggggccccggcggcgggggc

SEQ ID NO: 24106 - DNA, 19 bp, Homo sapiens
cccggcggcgggggcacgg

SEQ ID NO: 24107 - DNA, 27 bp, Homo sapiens
ccggcggcgggggcacggtcccccgcg

SEQ ID NO: 24108 - DNA, 26 bp, Homo sapiens
cggcggcgggggcacggtcccccgcg

SEQ ID NO: 24109 - DNA, 33 bp, Homo sapiens
ggcggcgggggcacggtcccccgcgaggggggc

SEQ ID NO: 24110 - DNA, 29 bp, Homo sapiens
gcgggggcacggtcccccgcgaggggggc

SEQ ID NO: 24111 - DNA, 30 bp, Homo sapiens
gcgggggcacggtcccccgcgaggggggcc

SEQ ID NO: 24112 - DNA, 29 bp, Homo sapiens
cgggggcacggtcccccgcgaggggggcc

SEQ ID NO: 24113 - DNA, 30 bp, Homo sapiens
ggcacggtcccccgcgaggggggcccgggc

SEQ ID NO: 24114 - DNA, 29 bp, Homo sapiens
gcacggtcccccgcgaggggggcccgggc

SEQ ID NO: 24115 - DNA, 27 bp, Homo sapiens
acggtcccccgcgaggggggcccgggc

SEQ ID NO: 24116 - DNA, 19 bp, Homo sapiens
cggtcccccgcgagggggg

SEQ ID NO: 24117 - DNA, 26 bp, Homo sapiens
cggtcccccgcgaggggggcccgggc

SEQ ID NO: 24118 - DNA, 27 bp, Homo sapiens
cggtcccccgcgaggggggcccgggca

SEQ ID NO: 24119 - DNA, 24 bp, Homo sapiens
gtcccccgcgaggggggcccgggc

SEQ ID NO: 24120 - DNA, 23 bp, Homo sapiens
tcccccgcgaggggggcccgggc

SEQ ID NO: 24121 - DNA, 17 bp, Homo sapiens
cccccgcgaggggggcc

SEQ ID NO: 24122 - DNA, 18 bp, Homo sapiens
cccccgcgaggggggccc

SEQ ID NO: 24123 - DNA, 20 bp, Homo sapiens
cccccgcgaggggggcccgg

SEQ ID NO: 24124 - DNA, 21 bp, Homo sapiens
cccccgcgaggggggcccggg

SEQ ID NO: 24125 - DNA, 22 bp, Homo sapiens
cccccgcgaggggggcccgggc

SEQ ID NO: 24126 - DNA, 23 bp, Homo sapiens
cccccgcgaggggggcccgggca

SEQ ID NO: 24127 - DNA, 24 bp, Homo sapiens
cccccgcgaggggggcccgggcac

SEQ ID NO: 24128 - DNA, 25 bp, Homo sapiens
cccccgcgaggggggcccgggcacc

SEQ ID NO: 24129 - DNA, 26 bp, Homo sapiens
cccccgcgaggggggcccgggcaccc

SEQ ID NO: 24130 - DNA, 16 bp, Homo sapiens
ccccgcgaggggggcc

SEQ ID NO: 24131 - DNA, 17 bp, Homo sapiens
ccccgcgaggggggccc

SEQ ID NO: 24132 - DNA, 20 bp, Homo sapiens
ccccgcgaggggggcccggg

SEQ ID NO: 24133 - DNA, 21 bp, Homo sapiens
ccccgcgaggggggcccgggc

SEQ ID NO: 24134 - DNA, 22 bp, Homo sapiens
ccccgcgaggggggcccgggca

SEQ ID NO: 24135 - DNA, 23 bp, Homo sapiens
ccccgcgaggggggcccgggcac

SEQ ID NO: 24136 - DNA, 24 bp, Homo sapiens
ccccgcgaggggggcccgggcacc

SEQ ID NO: 24137 - DNA, 16 bp, Homo sapiens
cccgcgaggggggccc

SEQ ID NO: 24138 - DNA, 17 bp, Homo sapiens
cccgcgaggggggcccg

SEQ ID NO: 24139 - DNA, 18 bp, Homo sapiens
cccgcgaggggggcccgg

SEQ ID NO: 24140 - DNA, 19 bp, Homo sapiens
cccgcgaggggggcccggg

SEQ ID NO: 24141 - DNA, 20 bp, Homo sapiens
cccgcgaggggggcccgggc

SEQ ID NO: 24142 - DNA, 21 bp, Homo sapiens
cccgcgaggggggcccgggca

SEQ ID NO: 24143 - DNA, 22 bp, Homo sapiens
cccgcgaggggggcccgggcac

SEQ ID NO: 24144 - DNA, 23 bp, Homo sapiens
cccgcgaggggggcccgggcacc

SEQ ID NO: 24145 - DNA, 24 bp, Homo sapiens
cccgcgaggggggcccgggcaccc

SEQ ID NO: 24146 - DNA, 25 bp, Homo sapiens
cccgcgaggggggcccgggcacccg

SEQ ID NO: 24147 - DNA, 16 bp, Homo sapiens
ccgcgaggggggcccg

SEQ ID NO: 24148 - DNA, 17 bp, Homo sapiens
ccgcgaggggggcccgg

SEQ ID NO: 24149 - DNA, 18 bp, Homo sapiens
ccgcgaggggggcccggg

SEQ ID NO: 24150 - DNA, 19 bp, Homo sapiens
ccgcgaggggggcccgggc

SEQ ID NO: 24151 - DNA, 20 bp, Homo sapiens
ccgcgaggggggcccgggca

SEQ ID NO: 24152 - DNA, 21 bp, Homo sapiens
ccgcgaggggggcccgggcac

SEQ ID NO: 24153 - DNA, 18 bp, Homo sapiens
cgcgaggggggcccgggc

SEQ ID NO: 24154 - DNA, 19 bp, Homo sapiens
cgcgaggggggcccgggca

SEQ ID NO: 24155 - DNA, 20 bp, Homo sapiens
cgcgaggggggcccgggcac

SEQ ID NO: 24156 - DNA, 16 bp, Homo sapiens
gcgaggggggcccggg

SEQ ID NO: 24157 - DNA, 17 bp, Homo sapiens
gcgaggggggcccgggc

SEQ ID NO: 24158 - DNA, 18 bp, Homo sapiens
gcgaggggggcccgggca

SEQ ID NO: 24159 - DNA, 16 bp, Homo sapiens
cgaggggggcccgggc

SEQ ID NO: 24160 - DNA, 26 bp, Homo sapiens
cccgggcacccggggggccggcggcg

SEQ ID NO: 24161 - DNA, 32 bp, Homo sapiens
cccgggcacccggggggccggcggcggcggcg

SEQ ID NO: 24162 - DNA, 32 bp, Homo sapiens
ggcacccggggggccggcggcggcggcgactc

SEQ ID NO: 24163 - DNA, 18 bp, Homo sapiens
cccggggggccggcggcg

SEQ ID NO: 24164 - DNA, 21 bp, Homo sapiens
cccggggggccggcggcggcg

SEQ ID NO: 24165 - DNA, 24 bp, Homo sapiens
cccggggggccggcggcggcggcg

SEQ ID NO: 24166 - DNA, 27 bp, Homo sapiens
cccggggggccggcggcggcggcgact

SEQ ID NO: 24167 - DNA, 28 bp, Homo sapiens
cccggggggccggcggcggcggcgactc

SEQ ID NO: 24168 - DNA, 32 bp, Homo sapiens
cccggggggccggcggcggcggcgactctgga

SEQ ID NO: 24169 - DNA, 33 bp, Homo sapiens
cccggggggccggcggcggcggcgactctggac

SEQ ID NO: 24170 - DNA, 36 bp, Homo sapiens
cccggggggccggcggcggcggcgactctggacgcg

SEQ ID NO: 24171 - DNA, 37 bp, Homo sapiens
cccggggggccggcggcggcggcgactctggacgcga

SEQ ID NO: 24172 - DNA, 38 bp, Homo sapiens
cccggggggccggcggcggcggcgactctggacgcgag

SEQ ID NO: 24173 - DNA, 41 bp, Homo sapiens
cccggggggccggcggcggcggcgactctggacgcgagccg

SEQ ID NO: 24174 - DNA, 43 bp, Homo sapiens
cccggggggccggcggcggcggcgactctggacgcgagccggg

SEQ ID NO: 24175 - DNA, 25 bp, Homo sapiens
cggggggccggcggcggcggcgact

SEQ ID NO: 24176 - DNA, 26 bp, Homo sapiens
cggggggccggcggcggcggcgactc

SEQ ID NO: 24177 - DNA, 30 bp, Homo sapiens
cggggggccggcggcggcggcgactctgga

SEQ ID NO: 24178 - DNA, 32 bp, Homo sapiens
cggggggccggcggcggcggcgactctggacg

SEQ ID NO: 24179 - DNA, 33 bp, Homo sapiens
cggggggccggcggcggcggcgactctggacgc

SEQ ID NO: 24180 - DNA, 24 bp, Homo sapiens
ggggggccggcggcggcggcgact

SEQ ID NO: 24181 - DNA, 25 bp, Homo sapiens
ggggggccggcggcggcggcgactc

SEQ ID NO: 24182 - DNA, 29 bp, Homo sapiens
ggggggccggcggcggcggcgactctgga

SEQ ID NO: 24183 - DNA, 30 bp, Homo sapiens
ggggggccggcggcggcggcgactctggac

SEQ ID NO: 24184 - DNA, 31 bp, Homo sapiens
ggggggccggcggcggcggcgactctggacg

SEQ ID NO: 24185 - DNA, 32 bp, Homo sapiens
ggggggccggcggcggcggcgactctggacgc

SEQ ID NO: 24186 - DNA, 33 bp, Homo sapiens
ggggggccggcggcggcggcgactctggacgcg

SEQ ID NO: 24187 - DNA, 35 bp, Homo sapiens
ggggggccggcggcggcggcgactctggacgcgag

SEQ ID NO: 24188 - DNA, 36 bp, Homo sapiens
ggggggccggcggcggcggcgactctggacgcgagc

SEQ ID NO: 24189 - DNA, 24 bp, Homo sapiens
gggggccggcggcggcggcgactc

SEQ ID NO: 24190 - DNA, 32 bp, Homo sapiens
gggggccggcggcggcggcgactctggacgcg

SEQ ID NO: 24191 - DNA, 33 bp, Homo sapiens
gggggccggcggcggcggcgactctggacgcga

SEQ ID NO: 24192 - DNA, 32 bp, Homo sapiens
ggggccggcggcggcggcgactctggacgcga

SEQ ID NO: 24193 - DNA, 33 bp, Homo sapiens
ggggccggcggcggcggcgactctggacgcgag

SEQ ID NO: 24194 - DNA, 26 bp, Homo sapiens
gggccggcggcggcggcgactctgga

SEQ ID NO: 24195 - DNA, 31 bp, Homo sapiens
gggccggcggcggcggcgactctggacgcga

SEQ ID NO: 24196 - DNA, 25 bp, Homo sapiens
ggccggcggcggcggcgactctgga

SEQ ID NO: 24197 - DNA, 24 bp, Homo sapiens
gccggcggcggcggcgactctgga

SEQ ID NO: 24198 - DNA, 23 bp, Homo sapiens
ccggcggcggcggcgactctgga

SEQ ID NO: 24199 - DNA, 26 bp, Homo sapiens
ccggcggcggcggcgactctggacgc

SEQ ID NO: 24200 - DNA, 37 bp, Homo sapiens
ccggcggcggcggcgactctggacgcgagccgggccc

SEQ ID NO: 24201 - DNA, 22 bp, Homo sapiens
cggcggcggcggcgactctgga

SEQ ID NO: 24202 - DNA, 33 bp, Homo sapiens
cggcggcggcggcgactctggacgcgagccggg

SEQ ID NO: 24203 - DNA, 24 bp, Homo sapiens
ggcggcggcggcgactctggacgc

SEQ ID NO: 24204 - DNA, 28 bp, Homo sapiens
ggcggcggcggcgactctggacgcgagc

SEQ ID NO: 24205 - DNA, 30 bp, Homo sapiens
ggcggcggcggcgactctggacgcgagccg

SEQ ID NO: 24206 - DNA, 32 bp, Homo sapiens
ggcggcggcggcgactctggacgcgagccggg

SEQ ID NO: 24207 - DNA, 33 bp, Homo sapiens
ggcggcggcggcgactctggacgcgagccgggc

SEQ ID NO: 24208 - DNA, 46 bp, Homo sapiens
ggcggcggcggcgactctggacgcgagccgggcccttcccgtggat

SEQ ID NO: 24209 - DNA, 20 bp, Homo sapiens
gcggcggcggcgactctgga

SEQ ID NO: 24210 - DNA, 27 bp, Homo sapiens
gcggcggcggcgactctggacgcgagc

SEQ ID NO: 24211 - DNA, 29 bp, Homo sapiens
gcggcggcggcgactctggacgcgagccg

SEQ ID NO: 24212 - DNA, 31 bp, Homo sapiens
gcggcggcggcgactctggacgcgagccggg

SEQ ID NO: 24213 - DNA, 32 bp, Homo sapiens
gcggcggcggcgactctggacgcgagccgggc

SEQ ID NO: 24214 - DNA, 33 bp, Homo sapiens; identical to SEQ ID NO: 5252

SEQ ID NO: 24215 - DNA, 34 bp, Homo sapiens
gcggcggcggcgactctggacgcgagccgggccc

SEQ ID NO: 24216 - DNA, 35 bp, Homo sapiens
gcggcggcggcgactctggacgcgagccgggccct

SEQ ID NO: 24217 - DNA, 45 bp, Homo sapiens
gcggcggcggcgactctggacgcgagccgggcccttcccgtggat

SEQ ID NO: 24218 - DNA, 19 bp, Homo sapiens
cggcggcggcgactctgga

SEQ ID NO: 24219 - DNA, 24 bp, Homo sapiens
cggcggcggcgactctggacgcga

SEQ ID NO: 24220 - DNA, 25 bp, Homo sapiens
cggcggcggcgactctggacgcgag

SEQ ID NO: 24221 - DNA, 26 bp, Homo sapiens
cggcggcggcgactctggacgcgagc

SEQ ID NO: 24222 - DNA, 27 bp, Homo sapiens
cggcggcggcgactctggacgcgagcc

SEQ ID NO: 24223 - DNA, 30 bp, Homo sapiens
cggcggcggcgactctggacgcgagccggg

SEQ ID NO: 24224 - DNA, 31 bp, Homo sapiens
cggcggcggcgactctggacgcgagccgggc

SEQ ID NO: 24225 - DNA, 32 bp, Homo sapiens; identical to SEQ ID NO: 5253

SEQ ID NO: 24226 - DNA, 33 bp, Homo sapiens; identical to SEQ ID NO: 5254

SEQ ID NO: 24227 - DNA, 34 bp, Homo sapiens
cggcggcggcgactctggacgcgagccgggccct

SEQ ID NO: 24228 - DNA, 44 bp, Homo sapiens
cggcggcggcgactctggacgcgagccgggcccttcccgtggat

SEQ ID NO: 24229 - DNA, 18 bp, Homo sapiens
ggcggcggcgactctgga

SEQ ID NO: 24230 - DNA, 25 bp, Homo sapiens
ggcggcggcgactctggacgcgagc

SEQ ID NO: 24231 - DNA, 29 bp, Homo sapiens
ggcggcggcgactctggacgcgagccggg

SEQ ID NO: 24232 - DNA, 31 bp, Homo sapiens
ggcggcggcgactctggacgcgagccgggcc

SEQ ID NO: 24233 - DNA, 32 bp, Homo sapiens; identical to SEQ ID NO: 5255

SEQ ID NO: 24234 - DNA, 33 bp, Homo sapiens; identical to SEQ ID NO: 5256

SEQ ID NO: 24235 - DNA, 43 bp, Homo sapiens
ggcggcggcgactctggacgcgagccgggcccttcccgtggat

SEQ ID NO: 24236 - DNA, 17 bp, Homo sapiens
gcggcggcgactctgga

SEQ ID NO: 24237 - DNA, 20 bp, Homo sapiens
gcggcggcgactctggacgc

SEQ ID NO: 24238 - DNA, 22 bp, Homo sapiens
gcggcggcgactctggacgcga

SEQ ID NO: 24239 - DNA, 24 bp, Homo sapiens
gcggcggcgactctggacgcgagc

SEQ ID NO: 24240 - DNA, 26 bp, Homo sapiens
gcggcggcgactctggacgcgagccg

SEQ ID NO: 24241 - DNA, 28 bp, Homo sapiens
gcggcggcgactctggacgcgagccggg

SEQ ID NO: 24242 - DNA, 29 bp, Homo sapiens
gcggcggcgactctggacgcgagccgggc

SEQ ID NO: 24243 - DNA, 30 bp, Homo sapiens; identical to SEQ ID NO: 5257

SEQ ID NO: 24244 - DNA, 31 bp, Homo sapiens; identical to SEQ ID NO: 5258

SEQ ID NO: 24245 - DNA, 32 bp, Homo sapiens; identical to SEQ ID NO: 5259

SEQ ID NO: 24246 - DNA, 33 bp, Homo sapiens
gcggcggcgactctggacgcgagccgggccctt

SEQ ID NO: 24247 - DNA, 42 bp, Homo sapiens
gcggcggcgactctggacgcgagccgggcccttcccgtggat

SEQ ID NO: 24248 - DNA, 16 bp, Homo sapiens
cggcggcgactctgga

SEQ ID NO: 24249 - DNA, 19 bp, Homo sapiens
cggcggcgactctggacgc

SEQ ID NO: 24250 - DNA, 21 bp, Homo sapiens
cggcggcgactctggacgcga

SEQ ID NO: 24251 - DNA, 23 bp, Homo sapiens
cggcggcgactctggacgcgagc

SEQ ID NO: 24252 - DNA, 24 bp, Homo sapiens
cggcggcgactctggacgcgagcc

SEQ ID NO: 24253 - DNA, 27 bp, Homo sapiens
cggcggcgactctggacgcgagccggg

SEQ ID NO: 24254 - DNA, 29 bp, Homo sapiens
cggcggcgactctggacgcgagccgggcc

SEQ ID NO: 24255 - DNA, 30 bp, Homo sapiens; identical to SEQ ID NO: 5260

SEQ ID NO: 24256 - DNA, 31 bp, Homo sapiens; identical to SEQ ID NO: 5261

SEQ ID NO: 24257 - DNA, 32 bp, Homo sapiens
cggcggcgactctggacgcgagccgggccctt

SEQ ID NO: 24258 - DNA, 41 bp, Homo sapiens
cggcggcgactctggacgcgagccgggcccttcccgtggat

SEQ ID NO: 24259 - DNA, 18 bp, Homo sapiens
ggcggcgactctggacgc

SEQ ID NO: 24260 - DNA, 22 bp, Homo sapiens
ggcggcgactctggacgcgagc

SEQ ID NO: 24261 - DNA, 28 bp, Homo sapiens
ggcggcgactctggacgcgagccgggcc

SEQ ID NO: 24262 - DNA, 29 bp, Homo sapiens
ggcggcgactctggacgcgagccgggccc

SEQ ID NO: 24263 - DNA, 30 bp, Homo sapiens
ggcggcgactctggacgcgagccgggccct

SEQ ID NO: 24264 - DNA, 31 bp, Homo sapiens
ggcggcgactctggacgcgagccgggccctt

SEQ ID NO: 24265 - DNA, 40 bp, Homo sapiens
ggcggcgactctggacgcgagccgggcccttcccgtggat

SEQ ID NO: 24266 - DNA, 17 bp, Homo sapiens
gcggcgactctggacgc

SEQ ID NO: 24267 - DNA, 18 bp, Homo sapiens
gcggcgactctggacgcg

SEQ ID NO: 24268 - DNA, 21 bp, Homo sapiens
gcggcgactctggacgcgagc

SEQ ID NO: 24269 - DNA, 22 bp, Homo sapiens
gcggcgactctggacgcgagcc

SEQ ID NO: 24270 - DNA, 23 bp, Homo sapiens
gcggcgactctggacgcgagccg

SEQ ID NO: 24271 - DNA, 25 bp, Homo sapiens
gcggcgactctggacgcgagccggg

SEQ ID NO: 24272 - DNA, 26 bp, Homo sapiens
gcggcgactctggacgcgagccgggc

SEQ ID NO: 24273 - DNA, 27 bp, Homo sapiens
gcggcgactctggacgcgagccgggcc

SEQ ID NO: 24274 - DNA, 28 bp, Homo sapiens
gcggcgactctggacgcgagccgggccc

SEQ ID NO: 24275 - DNA, 29 bp, Homo sapiens
gcggcgactctggacgcgagccgggccct

SEQ ID NO: 24276 - DNA, 30 bp, Homo sapiens; identical to SEQ ID NO: 5266

SEQ ID NO: 24277 - DNA, 16 bp, Homo sapiens
cggcgactctggacgc

SEQ ID NO: 24278 - DNA, 20 bp, Homo sapiens
cggcgactctggacgcgagc

SEQ ID NO: 24279 - DNA, 21 bp, Homo sapiens
cggcgactctggacgcgagcc

SEQ ID NO: 24280 - DNA, 24 bp, Homo sapiens
cggcgactctggacgcgagccggg

SEQ ID NO: 24281 - DNA, 25 bp, Homo sapiens
cggcgactctggacgcgagccgggc

SEQ ID NO: 24282 - DNA, 26 bp, Homo sapiens
cggcgactctggacgcgagccgggcc

SEQ ID NO: 24283 - DNA, 27 bp, Homo sapiens
cggcgactctggacgcgagccgggccc

SEQ ID NO: 24284 - DNA, 28 bp, Homo sapiens
cggcgactctggacgcgagccgggccct

SEQ ID NO: 24285 - DNA, 29 bp, Homo sapiens
cggcgactctggacgcgagccgggccctt

SEQ ID NO: 24286 - DNA, 33 bp, Homo sapiens; identical to SEQ ID NO: 5268

SEQ ID NO: 24287 - DNA, 38 bp, Homo sapiens
cggcgactctggacgcgagccgggcccttcccgtggat

SEQ ID NO: 24288 - DNA, 26 bp, Homo sapiens
ggcgactctggacgcgagccgggccc

SEQ ID NO: 24289 - DNA, 32 bp, Homo sapiens
ggcgactctggacgcgagccgggcccttcccg

SEQ ID NO: 24290 - DNA, 19 bp, Homo sapiens
gcgactctggacgcgagcc

SEQ ID NO: 24291 - DNA, 20 bp, Homo sapiens
gcgactctggacgcgagccg

SEQ ID NO: 24292 - DNA, 23 bp, Homo sapiens
gcgactctggacgcgagccgggc

SEQ ID NO: 24293 - DNA, 24 bp, Homo sapiens
gcgactctggacgcgagccgggcc

SEQ ID NO: 24294 - DNA, 25 bp, Homo sapiens
gcgactctggacgcgagccgggccc

SEQ ID NO: 24295 - DNA, 26 bp, Homo sapiens
gcgactctggacgcgagccgggccct

SEQ ID NO: 24296 - DNA, 24 bp, Homo sapiens
cgactctggacgcgagccgggccc

SEQ ID NO: 24297 - DNA, 25 bp, Homo sapiens
cgactctggacgcgagccgggccct

SEQ ID NO: 24298 - DNA, 30 bp, Homo sapiens
cgactctggacgcgagccgggcccttcccg

SEQ ID NO: 24299 - DNA, 22 bp, Homo sapiens
actctggacgcgagccgggccc

SEQ ID NO: 24300 - DNA, 23 bp, Homo sapiens
actctggacgcgagccgggccct

SEQ ID NO: 24301 - DNA, 32 bp, Homo sapiens
actctggacgcgagccgggcccttcccgtgga

SEQ ID NO: 24302 - DNA, 20 bp, Homo sapiens
ctctggacgcgagccgggcc

SEQ ID NO: 24303 - DNA, 21 bp, Homo sapiens
ctctggacgcgagccgggccc

SEQ ID NO: 24304 - DNA, 22 bp, Homo sapiens
ctctggacgcgagccgggccct

SEQ ID NO: 24305 - DNA, 23 bp, Homo sapiens
ctctggacgcgagccgggccctt

SEQ ID NO: 24306 - DNA, 27 bp, Homo sapiens
ctctggacgcgagccgggcccttcccg

SEQ ID NO: 24307 - DNA, 31 bp, Homo sapiens
ctctggacgcgagccgggcccttcccgtgga

SEQ ID NO: 24308 - DNA, 32 bp, Homo sapiens
ctctggacgcgagccgggcccttcccgtggat

SEQ ID NO: 24309 - DNA, 33 bp, Homo sapiens
ctctggacgcgagccgggcccttcccgtggatc

SEQ ID NO: 24310 - DNA, 18 bp, Homo sapiens
tctggacgcgagccgggc

SEQ ID NO: 24311 - DNA, 19 bp, Homo sapiens
tctggacgcgagccgggcc

SEQ ID NO: 24312 - DNA, 20 bp, Homo sapiens
tctggacgcgagccgggccc

SEQ ID NO: 24313 - DNA, 21 bp, Homo sapiens
tctggacgcgagccgggccct

SEQ ID NO: 24314 - DNA, 22 bp, Homo sapiens
tctggacgcgagccgggccctt

SEQ ID NO: 24315 - DNA, 23 bp, Homo sapiens
tctggacgcgagccgggcccttc

SEQ ID NO: 24316 - DNA, 26 bp, Homo sapiens
tctggacgcgagccgggcccttcccg

SEQ ID NO: 24317 - DNA, 28 bp, Homo sapiens
tctggacgcgagccgggcccttcccgtg

SEQ ID NO: 24318 - DNA, 30 bp, Homo sapiens; identical to SEQ ID NO: 5275

SEQ ID NO: 24319 - DNA, 31 bp, Homo sapiens; identical to SEQ ID NO: 5276

SEQ ID NO: 24320 - DNA, 32 bp, Homo sapiens
tctggacgcgagccgggcccttcccgtggatc

SEQ ID NO: 24321 - DNA, 33 bp, Homo sapiens
tctggacgcgagccgggcccttcccgtggatcg

SEQ ID NO: 24322 - DNA, 17 bp, Homo sapiens
ctggacgcgagccgggc

SEQ ID NO: 24323 - DNA, 18 bp, Homo sapiens
ctggacgcgagccgggcc

SEQ ID NO: 24324 - DNA, 19 bp, Homo sapiens
ctggacgcgagccgggccc

SEQ ID NO: 24325 - DNA, 20 bp, Homo sapiens
ctggacgcgagccgggccct

SEQ ID NO: 24326 - DNA, 21 bp, Homo sapiens
ctggacgcgagccgggccctt

SEQ ID NO: 24327 - DNA, 22 bp, Homo sapiens
ctggacgcgagccgggcccttc

SEQ ID NO: 24328 - DNA, 23 bp, Homo sapiens
ctggacgcgagccgggcccttcc

SEQ ID NO: 24329 - DNA, 25 bp, Homo sapiens
ctggacgcgagccgggcccttcccg

SEQ ID NO: 24330 - DNA, 26 bp, Homo sapiens
ctggacgcgagccgggcccttcccgt

SEQ ID NO: 24331 - DNA, 27 bp, Homo sapiens
ctggacgcgagccgggcccttcccgtg

SEQ ID NO: 24332 - DNA, 28 bp, Homo sapiens
ctggacgcgagccgggcccttcccgtgg

SEQ ID NO: 24333 - DNA, 29 bp, Homo sapiens
ctggacgcgagccgggcccttcccgtgga

SEQ ID NO: 24334 - DNA, 30 bp, Homo sapiens; identical to SEQ ID NO: 5285

SEQ ID NO: 24335 - DNA, 31 bp, Homo sapiens; identical to SEQ ID NO: 5286

SEQ ID NO: 24336 - DNA, 32 bp, Homo sapiens; identical to SEQ ID NO: 5287

SEQ ID NO: 24337 - DNA, 33 bp, Homo sapiens
ctggacgcgagccgggcccttcccgtggatcgc

SEQ ID NO: 24338 - DNA, 17 bp, Homo sapiens
tggacgcgagccgggcc

SEQ ID NO: 24339 - DNA, 18 bp, Homo sapiens
tggacgcgagccgggccc

SEQ ID NO: 24340 - DNA, 19 bp, Homo sapiens
tggacgcgagccgggccct

SEQ ID NO: 24341 - DNA, 24 bp, Homo sapiens
tggacgcgagccgggcccttcccg

SEQ ID NO: 24342 - DNA, 28 bp, Homo sapiens
tggacgcgagccgggcccttcccgtgga

SEQ ID NO: 24343 - DNA, 29 bp, Homo sapiens
tggacgcgagccgggcccttcccgtggat

SEQ ID NO: 24344 - DNA, 30 bp, Homo sapiens; identical to SEQ ID NO: 5289

SEQ ID NO: 24345 - DNA, 31 bp, Homo sapiens
tggacgcgagccgggcccttcccgtggatcg

SEQ ID NO: 24346 - DNA, 16 bp, Homo sapiens
ggacgcgagccgggcc

SEQ ID NO: 24347 - DNA, 17 bp, Homo sapiens
ggacgcgagccgggccc

SEQ ID NO: 24348 - DNA, 28 bp, Homo sapiens
ggacgcgagccgggcccttcccgtggat

SEQ ID NO: 24349 - DNA, 16 bp, Homo sapiens
gacgcgagccgggccc

SEQ ID NO: 24350 - DNA, 17 bp, Homo sapiens
gacgcgagccgggccct

SEQ ID NO: 24351 - DNA, 16 bp, Homo sapiens
acgcgagccgggccct

SEQ ID NO: 24352 - DNA, 24 bp, Homo sapiens
cgcgagccgggcccttcccgtgga

SEQ ID NO: 24353 - DNA, 27 bp, Homo sapiens
cgcgagccgggcccttcccgtggatcg

SEQ ID NO: 24354 - DNA, 32 bp, Homo sapiens
gagccgggcccttcccgtggatcgccccagct

SEQ ID NO: 24355 - DNA, 30 bp, Homo sapiens
agccgggcccttcccgtggatcgccccagc

SEQ ID NO: 24356 - DNA, 24 bp, Homo sapiens
gccgggcccttcccgtggatcgcc

SEQ ID NO: 24357 - DNA, 29 bp, Homo sapiens
gccgggcccttcccgtggatcgccccagc

SEQ ID NO: 24358 - DNA, 23 bp, Homo sapiens
ccgggcccttcccgtggatcgcc

SEQ ID NO: 24359 - DNA, 29 bp, Homo sapiens
ccgggcccttcccgtggatcgccccagct

SEQ ID NO: 24360 - DNA, 33 bp, Homo sapiens
ccgggcccttcccgtggatcgccccagctgcgg

SEQ ID NO: 24361 - DNA, 28 bp, Homo sapiens
cgggcccttcccgtggatcgccccagct

SEQ ID NO: 24362 - DNA, 30 bp, Homo sapiens
cgggcccttcccgtggatcgccccagctgc

SEQ ID NO: 24363 - DNA, 27 bp, Homo sapiens
ggcccttcccgtggatcgccccagctg

SEQ ID NO: 24364 - DNA, 26 bp, Homo sapiens
gcccttcccgtggatcgccccagctg

SEQ ID NO: 24365 - DNA, 25 bp, Homo sapiens
cccttcccgtggatcgccccagctg

SEQ ID NO: 24366 - DNA, 26 bp, Homo sapiens
cccttcccgtggatcgccccagctgc

SEQ ID NO: 24367 - DNA, 22 bp, Homo sapiens
ccttcccgtggatcgccccagc

SEQ ID NO: 24368 - DNA, 24 bp, Homo sapiens
ccttcccgtggatcgccccagctg

SEQ ID NO: 24369 - DNA, 25 bp, Homo sapiens
ccttcccgtggatcgccccagctgc

SEQ ID NO: 24370 - DNA, 21 bp, Homo sapiens
cttcccgtggatcgccccagc

SEQ ID NO: 24371 - DNA, 22 bp, Homo sapiens
cttcccgtggatcgccccagct

SEQ ID NO: 24372 - DNA, 23 bp, Homo sapiens
cttcccgtggatcgccccagctg

SEQ ID NO: 24373 - DNA, 24 bp, Homo sapiens
cttcccgtggatcgccccagctgc

SEQ ID NO: 24374 - DNA, 25 bp, Homo sapiens
cttcccgtggatcgccccagctgcg

SEQ ID NO: 24375 - DNA, 20 bp, Homo sapiens
ttcccgtggatcgccccagc

SEQ ID NO: 24376 - DNA, 21 bp, Homo sapiens
ttcccgtggatcgccccagct

SEQ ID NO: 24377 - DNA, 22 bp, Homo sapiens
ttcccgtggatcgccccagctg

SEQ ID NO: 24378 - DNA, 23 bp, Homo sapiens
ttcccgtggatcgccccagctgc

SEQ ID NO: 24379 - DNA, 19 bp, Homo sapiens
tcccgtggatcgccccagc

SEQ ID NO: 24380 - DNA, 20 bp, Homo sapiens
tcccgtggatcgccccagct

SEQ ID NO: 24381 - DNA, 21 bp, Homo sapiens
tcccgtggatcgccccagctg

SEQ ID NO: 24382 - DNA, 22 bp, Homo sapiens
tcccgtggatcgccccagctgc

SEQ ID NO: 24383 - DNA, 23 bp, Homo sapiens
tcccgtggatcgccccagctgcg

SEQ ID NO: 24384 - DNA, 18 bp, Homo sapiens
cccgtggatcgccccagc

SEQ ID NO: 24385 - DNA, 20 bp, Homo sapiens
cccgtggatcgccccagctg

SEQ ID NO: 24386 - DNA, 21 bp, Homo sapiens
cccgtggatcgccccagctgc

SEQ ID NO: 24387 - DNA, 22 bp, Homo sapiens
cccgtggatcgccccagctgcg

SEQ ID NO: 24388 - DNA, 17 bp, Homo sapiens
ccgtggatcgccccagc

SEQ ID NO: 24389 - DNA, 18 bp, Homo sapiens
ccgtggatcgccccagct

SEQ ID NO: 24390 - DNA, 20 bp, Homo sapiens
ccgtggatcgccccagctgc

SEQ ID NO: 24391 - DNA, 21 bp, Homo sapiens
ccgtggatcgccccagctgcg

SEQ ID NO: 24392 - DNA, 27 bp, Homo sapiens
ccgtggatcgccccagctgcggcgggc

SEQ ID NO: 24393 - DNA, 16 bp, Homo sapiens
cgtggatcgccccagc

SEQ ID NO: 24394 - DNA, 17 bp, Homo sapiens
cgtggatcgccccagct

SEQ ID NO: 24395 - DNA, 18 bp, Homo sapiens
cgtggatcgccccagctg

SEQ ID NO: 24396 - DNA, 19 bp, Homo sapiens
cgtggatcgccccagctgc

SEQ ID NO: 24397 - DNA, 26 bp, Homo sapiens
cgtggatcgccccagctgcggcgggc

SEQ ID NO: 24398 - DNA, 17 bp, Homo sapiens
gtggatcgccccagctg

SEQ ID NO: 24399 - DNA, 18 bp, Homo sapiens
gtggatcgccccagctgc

SEQ ID NO: 24400 - DNA, 29 bp, Homo sapiens
tcgccccagctgcggcgggcgtcgcggcc

SEQ ID NO: 24401 - DNA, 19 bp, Homo sapiens
cgccccagctgcggcgggc

SEQ ID NO: 24402 - DNA, 19 bp, Homo sapiens
gcggcgggcgtcgcggccg

SEQ ID NO: 24403 - DNA, 16 bp, Homo sapiens
ggcgggcgtcgcggcc

SEQ ID NO: 24404 - DNA, 16 bp, Homo sapiens
gcgggcgtcgcggccg

SEQ ID NO: 24405 - DNA, 25 bp, Homo sapiens
cgggcgtcgcggccgcccccgggga

SEQ ID NO: 24406 - DNA, 22 bp, Homo sapiens
gcgtcgcggccgcccccgggga

SEQ ID NO: 24407 - DNA, 21 bp, Homo sapiens
cgtcgcggccgcccccgggga

SEQ ID NO: 24408 - DNA, 30 bp, Homo sapiens
tcgcggccgcccccggggagcccggcgggc

SEQ ID NO: 24409 - DNA, 18 bp, Homo sapiens
cgcggccgcccccgggga

SEQ ID NO: 24410 - DNA, 28 bp, Homo sapiens
cgcggccgcccccggggagcccggcggg

SEQ ID NO: 24411 - DNA, 29 bp, Homo sapiens
cgcggccgcccccggggagcccggcgggc

SEQ ID NO: 24412 - DNA, 17 bp, Homo sapiens
gcggccgcccccgggga

SEQ ID NO: 24413 - DNA, 28 bp, Homo sapiens
gcggccgcccccggggagcccggcgggc

SEQ ID NO: 24414 - DNA, 16 bp, Homo sapiens
cggccgcccccgggga

SEQ ID NO: 24415 - DNA, 21 bp, Homo sapiens
cccccggggagcccggcgggc

SEQ ID NO: 24416 - DNA, 22 bp, Homo sapiens
cccccggggagcccggcgggcg

SEQ ID NO: 24417 - DNA, 20 bp, Homo sapiens
ccccggggagcccggcgggc

SEQ ID NO: 24418 - DNA, 21 bp, Homo sapiens
ccccggggagcccggcgggcg

SEQ ID NO: 24419 - DNA, 24 bp, Homo sapiens
ccccggggagcccggcgggcgccg

SEQ ID NO: 24420 - DNA, 19 bp, Homo sapiens
cccggggagcccggcgggc

SEQ ID NO: 24421 - DNA, 20 bp, Homo sapiens
cccggggagcccggcgggcg

SEQ ID NO: 24422 - DNA, 17 bp, Homo sapiens
ccggggagcccggcggg

SEQ ID NO: 24423 - DNA, 18 bp, Homo sapiens
ccggggagcccggcgggc

SEQ ID NO: 24424 - DNA, 16 bp, Homo sapiens
cggggagcccggcggg

SEQ ID NO: 24425 - DNA, 17 bp, Homo sapiens
cggggagcccggcgggc

SEQ ID NO: 24426 - DNA, 16 bp, Homo sapiens
ggggagcccggcgggc

SEQ ID NO: 24427 - DNA, 20 bp, Homo sapiens
ggggagcccggcgggcgccg

SEQ ID NO: 24428 - DNA, 19 bp, Homo sapiens
gggagcccggcgggcgccg

SEQ ID NO: 24429 - DNA, 17 bp, Homo sapiens
gagcccggcgggcgccg

SEQ ID NO: 24430 - DNA, 16 bp, Homo sapiens
agcccggcgggcgccg

SEQ ID NO: 24431 - DNA, 22 bp, Homo sapiens
cccggcgggcgccggcgcgccc

SEQ ID NO: 24432 - DNA, 29 bp, Homo sapiens
cccccccaccccacgtctcgtcgcgcgcg

SEQ ID NO: 24433 - DNA, 28 bp, Homo sapiens
ccccccaccccacgtctcgtcgcgcgcg

SEQ ID NO: 24434 - DNA, 29 bp, Homo sapiens
ccccccaccccacgtctcgtcgcgcgcgc

SEQ ID NO: 24435 - DNA, 24 bp, Homo sapiens
cccccaccccacgtctcgtcgcgc

SEQ ID NO: 24436 - DNA, 25 bp, Homo sapiens
cccccaccccacgtctcgtcgcgcg

SEQ ID NO: 24437 - DNA, 26 bp, Homo sapiens
cccccaccccacgtctcgtcgcgcgc

SEQ ID NO: 24438 - DNA, 27 bp, Homo sapiens
cccccaccccacgtctcgtcgcgcgcg

SEQ ID NO: 24439 - DNA, 28 bp, Homo sapiens
cccccaccccacgtctcgtcgcgcgcgc

SEQ ID NO: 24440 - DNA, 29 bp, Homo sapiens
cccccaccccacgtctcgtcgcgcgcgcg

SEQ ID NO: 24441 - DNA, 24 bp, Homo sapiens
ccccaccccacgtctcgtcgcgcg

SEQ ID NO: 24442 - DNA, 25 bp, Homo sapiens
ccccaccccacgtctcgtcgcgcgc

SEQ ID NO: 24443 - DNA, 26 bp, Homo sapiens
ccccaccccacgtctcgtcgcgcgcg

SEQ ID NO: 24444 - DNA, 27 bp, Homo sapiens
ccccaccccacgtctcgtcgcgcgcgc

SEQ ID NO: 24445 - DNA, 28 bp, Homo sapiens
ccccaccccacgtctcgtcgcgcgcgcg

SEQ ID NO: 24446 - DNA, 22 bp, Homo sapiens
cccaccccacgtctcgtcgcgc

SEQ ID NO: 24447 - DNA, 23 bp, Homo sapiens
cccaccccacgtctcgtcgcgcg

SEQ ID NO: 24448 - DNA, 24 bp, Homo sapiens
cccaccccacgtctcgtcgcgcgc

SEQ ID NO: 24449 - DNA, 25 bp, Homo sapiens
cccaccccacgtctcgtcgcgcgcg

SEQ ID NO: 24450 - DNA, 26 bp, Homo sapiens
cccaccccacgtctcgtcgcgcgcgc

SEQ ID NO: 24451 - DNA, 27 bp, Homo sapiens
cccaccccacgtctcgtcgcgcgcgcg

SEQ ID NO: 24452 - DNA, 20 bp, Homo sapiens
ccaccccacgtctcgtcgcg

SEQ ID NO: 24453 - DNA, 21 bp, Homo sapiens
ccaccccacgtctcgtcgcgc

SEQ ID NO: 24454 - DNA, 22 bp, Homo sapiens
ccaccccacgtctcgtcgcgcg

SEQ ID NO: 24455 - DNA, 23 bp, Homo sapiens
ccaccccacgtctcgtcgcgcgc

SEQ ID NO: 24456 - DNA, 24 bp, Homo sapiens
ccaccccacgtctcgtcgcgcgcg

SEQ ID NO: 24457 - DNA, 25 bp, Homo sapiens
ccaccccacgtctcgtcgcgcgcgc

SEQ ID NO: 24458 - DNA, 26 bp, Homo sapiens
ccaccccacgtctcgtcgcgcgcgcg

SEQ ID NO: 24459 - DNA, 29 bp, Homo sapiens
ccaccccacgtctcgtcgcgcgcgcgtcc

SEQ ID NO: 24460 - DNA, 18 bp, Homo sapiens
caccccacgtctcgtcgc

SEQ ID NO: 24461 - DNA, 19 bp, Homo sapiens
caccccacgtctcgtcgcg

SEQ ID NO: 24462 - DNA, 20 bp, Homo sapiens
caccccacgtctcgtcgcgc

SEQ ID NO: 24463 - DNA, 21 bp, Homo sapiens
caccccacgtctcgtcgcgcg

SEQ ID NO: 24464 - DNA, 23 bp, Homo sapiens
caccccacgtctcgtcgcgcgcg

SEQ ID NO: 24465 - DNA, 24 bp, Homo sapiens
caccccacgtctcgtcgcgcgcgc

SEQ ID NO: 24466 - DNA, 25 bp, Homo sapiens
caccccacgtctcgtcgcgcgcgcg

SEQ ID NO: 24467 - DNA, 27 bp, Homo sapiens
caccccacgtctcgtcgcgcgcgcgtc

SEQ ID NO: 24468 - DNA, 31 bp, Homo sapiens
caccccacgtctcgtcgcgcgcgcgtccgct

SEQ ID NO: 24469 - DNA, 32 bp, Homo sapiens
caccccacgtctcgtcgcgcgcgcgtccgctg

SEQ ID NO: 24470 - DNA, 18 bp, Homo sapiens
accccacgtctcgtcgcg

SEQ ID NO: 24471 - DNA, 19 bp, Homo sapiens
accccacgtctcgtcgcgc

SEQ ID NO: 24472 - DNA, 20 bp, Homo sapiens
accccacgtctcgtcgcgcg

SEQ ID NO: 24473 - DNA, 22 bp, Homo sapiens
accccacgtctcgtcgcgcgcg

SEQ ID NO: 24474 - DNA, 23 bp, Homo sapiens
accccacgtctcgtcgcgcgcgc

SEQ ID NO: 24475 - DNA, 24 bp, Homo sapiens
accccacgtctcgtcgcgcgcgcg

SEQ ID NO: 24476 - DNA, 26 bp, Homo sapiens
accccacgtctcgtcgcgcgcgcgtc

SEQ ID NO: 24477 - DNA, 29 bp, Homo sapiens
accccacgtctcgtcgcgcgcgcgtccgc

SEQ ID NO: 24478 - DNA, 17 bp, Homo sapiens
ccccacgtctcgtcgcg

SEQ ID NO: 24479 - DNA, 19 bp, Homo sapiens
ccccacgtctcgtcgcgcg

SEQ ID NO: 24480 - DNA, 21 bp, Homo sapiens
ccccacgtctcgtcgcgcgcg

SEQ ID NO: 24481 - DNA, 22 bp, Homo sapiens
ccccacgtctcgtcgcgcgcgc

SEQ ID NO: 24482 - DNA, 23 bp, Homo sapiens
ccccacgtctcgtcgcgcgcgcg

SEQ ID NO: 24483 - DNA, 24 bp, Homo sapiens
ccccacgtctcgtcgcgcgcgcgt

SEQ ID NO: 24484 - DNA, 25 bp, Homo sapiens
ccccacgtctcgtcgcgcgcgcgtc

SEQ ID NO: 24485 - DNA, 28 bp, Homo sapiens
ccccacgtctcgtcgcgcgcgcgtccgc

SEQ ID NO: 24486 - DNA, 30 bp, Homo sapiens
ccccacgtctcgtcgcgcgcgcgtccgctg

SEQ ID NO: 24487 - DNA, 31 bp, Homo sapiens
ccccacgtctcgtcgcgcgcgcgtccgctgg

SEQ ID NO: 24488 - DNA, 16 bp, Homo sapiens
cccacgtctcgtcgcg

SEQ ID NO: 24489 - DNA, 18 bp, Homo sapiens
cccacgtctcgtcgcgcg

SEQ ID NO: 24490 - DNA, 20 bp, Homo sapiens
cccacgtctcgtcgcgcgcg

SEQ ID NO: 24491 - DNA, 21 bp, Homo sapiens
cccacgtctcgtcgcgcgcgc

SEQ ID NO: 24492 - DNA, 22 bp, Homo sapiens
cccacgtctcgtcgcgcgcgcg

SEQ ID NO: 24493 - DNA, 27 bp, Homo sapiens
cccacgtctcgtcgcgcgcgcgtccgc

SEQ ID NO: 24494 - DNA, 17 bp, Homo sapiens
ccacgtctcgtcgcgcg

SEQ ID NO: 24495 - DNA, 19 bp, Homo sapiens
ccacgtctcgtcgcgcgcg

SEQ ID NO: 24496 - DNA, 20 bp, Homo sapiens
ccacgtctcgtcgcgcgcgc

SEQ ID NO: 24497 - DNA, 21 bp, Homo sapiens
ccacgtctcgtcgcgcgcgcg

SEQ ID NO: 24498 - DNA, 26 bp, Homo sapiens
ccacgtctcgtcgcgcgcgcgtccgc

SEQ ID NO: 24499 - DNA, 16 bp, Homo sapiens
cacgtctcgtcgcgcg

SEQ ID NO: 24500 - DNA, 18 bp, Homo sapiens
cacgtctcgtcgcgcgcg

SEQ ID NO: 24501 - DNA, 19 bp, Homo sapiens
cacgtctcgtcgcgcgcgc

SEQ ID NO: 24502 - DNA, 20 bp, Homo sapiens
cacgtctcgtcgcgcgcgcg

SEQ ID NO: 24503 - DNA, 21 bp, Homo sapiens
cacgtctcgtcgcgcgcgcgt

SEQ ID NO: 24504 - DNA, 22 bp, Homo sapiens
cacgtctcgtcgcgcgcgcgtc

SEQ ID NO: 24505 - DNA, 25 bp, Homo sapiens
cacgtctcgtcgcgcgcgcgtccgc

SEQ ID NO: 24506 - DNA, 26 bp, Homo sapiens
cacgtctcgtcgcgcgcgcgtccgct

SEQ ID NO: 24507 - DNA, 17 bp, Homo sapiens
acgtctcgtcgcgcgcg

SEQ ID NO: 24508 - DNA, 18 bp, Homo sapiens
acgtctcgtcgcgcgcgc

SEQ ID NO: 24509 - DNA, 19 bp, Homo sapiens
acgtctcgtcgcgcgcgcg

SEQ ID NO: 24510 - DNA, 20 bp, Homo sapiens
acgtctcgtcgcgcgcgcgt

SEQ ID NO: 24511 - DNA, 22 bp, Homo sapiens
acgtctcgtcgcgcgcgcgtcc

SEQ ID NO: 24512 - DNA, 23 bp, Homo sapiens
acgtctcgtcgcgcgcgcgtccg

SEQ ID NO: 24513 - DNA, 24 bp, Homo sapiens
acgtctcgtcgcgcgcgcgtccgc

SEQ ID NO: 24514 - DNA, 25 bp, Homo sapiens
acgtctcgtcgcgcgcgcgtccgct

SEQ ID NO: 24515 - DNA, 16 bp, Homo sapiens
cgtctcgtcgcgcgcg

SEQ ID NO: 24516 - DNA, 17 bp, Homo sapiens
cgtctcgtcgcgcgcgc

SEQ ID NO: 24517 - DNA, 18 bp, Homo sapiens
cgtctcgtcgcgcgcgcg

SEQ ID NO: 24518 - DNA, 19 bp, Homo sapiens
cgtctcgtcgcgcgcgcgt

SEQ ID NO: 24519 - DNA, 20 bp, Homo sapiens
cgtctcgtcgcgcgcgcgtc

SEQ ID NO: 24520 - DNA, 22 bp, Homo sapiens
cgtctcgtcgcgcgcgcgtccg

SEQ ID NO: 24521 - DNA, 23 bp, Homo sapiens
cgtctcgtcgcgcgcgcgtccgc

SEQ ID NO: 24522 - DNA, 24 bp, Homo sapiens
cgtctcgtcgcgcgcgcgtccgct

SEQ ID NO: 24523 - DNA, 27 bp, Homo sapiens
cgtctcgtcgcgcgcgcgtccgctggg

SEQ ID NO: 24524 - DNA, 28 bp, Homo sapiens
cgtctcgtcgcgcgcgcgtccgctgggg

SEQ ID NO: 24525 - DNA, 30 bp, Homo sapiens
cgtctcgtcgcgcgcgcgtccgctgggggc

SEQ ID NO: 24526 - DNA, 16 bp, Homo sapiens
gtctcgtcgcgcgcgc

SEQ ID NO: 24527 - DNA, 17 bp, Homo sapiens
gtctcgtcgcgcgcgcg

SEQ ID NO: 24528 - DNA, 19 bp, Homo sapiens
gtctcgtcgcgcgcgcgtc

SEQ ID NO: 24529 - DNA, 22 bp, Homo sapiens
gtctcgtcgcgcgcgcgtccgc

SEQ ID NO: 24530 - DNA, 16 bp, Homo sapiens
tctcgtcgcgcgcgcg

SEQ ID NO: 24531 - DNA, 18 bp, Homo sapiens
tctcgtcgcgcgcgcgtc

SEQ ID NO: 24532 - DNA, 21 bp, Homo sapiens
tctcgtcgcgcgcgcgtccgc

SEQ ID NO: 24533 - DNA, 22 bp, Homo sapiens
tctcgtcgcgcgcgcgtccgct

SEQ ID NO: 24534 - DNA, 17 bp, Homo sapiens
ctcgtcgcgcgcgcgtc

SEQ ID NO: 24535 - DNA, 18 bp, Homo sapiens
ctcgtcgcgcgcgcgtcc

SEQ ID NO: 24536 - DNA, 20 bp, Homo sapiens
ctcgtcgcgcgcgcgtccgc

SEQ ID NO: 24537 - DNA, 21 bp, Homo sapiens
ctcgtcgcgcgcgcgtccgct

SEQ ID NO: 24538 - DNA, 19 bp, Homo sapiens
cgcgcgtccgctgggggcg

SEQ ID NO: 24539 - DNA, 26 bp, Homo sapiens
cgcgcgtccgctgggggcggggagcg

SEQ ID NO: 24540 - DNA, 33 bp, Homo sapiens
cgcgcgtccgctgggggcggggagcggtcgggc

SEQ ID NO: 24541 - DNA, 18 bp, Homo sapiens
gggggcggggagcggtcg

SEQ ID NO: 24542 - DNA, 31 bp, Homo sapiens
ggagcggtcgggcggcggcggtcggcgggcg

SEQ ID NO: 24543 - DNA, 33 bp, Homo sapiens
ggagcggtcgggcggcggcggtcggcgggcggc

SEQ ID NO: 24544 - DNA, 29 bp, Homo sapiens
gagcggtcgggcggcggcggtcggcgggc

SEQ ID NO: 24545 - DNA, 30 bp, Homo sapiens
gagcggtcgggcggcggcggtcggcgggcg

SEQ ID NO: 24546 - DNA, 32 bp, Homo sapiens
gagcggtcgggcggcggcggtcggcgggcggc

SEQ ID NO: 24547 - DNA, 29 bp, Homo sapiens
agcggtcgggcggcggcggtcggcgggcg

SEQ ID NO: 24548 - DNA, 31 bp, Homo sapiens
agcggtcgggcggcggcggtcggcgggcggc

SEQ ID NO: 24549 - DNA, 21 bp, Homo sapiens
gcggtcgggcggcggcggtcg

SEQ ID NO: 24550 - DNA, 23 bp, Homo sapiens
gcggtcgggcggcggcggtcggc

SEQ ID NO: 24551 - DNA, 24 bp, Homo sapiens
gcggtcgggcggcggcggtcggcg

SEQ ID NO: 24552 - DNA, 25 bp, Homo sapiens
gcggtcgggcggcggcggtcggcgg

SEQ ID NO: 24553 - DNA, 27 bp, Homo sapiens
gcggtcgggcggcggcggtcggcgggc

SEQ ID NO: 24554 - DNA, 28 bp, Homo sapiens
gcggtcgggcggcggcggtcggcgggcg

SEQ ID NO: 24555 - DNA, 30 bp, Homo sapiens
gcggtcgggcggcggcggtcggcgggcggc

SEQ ID NO: 24556 - DNA, 31 bp, Homo sapiens
gcggtcgggcggcggcggtcggcgggcggcg

SEQ ID NO: 24557 - DNA, 33 bp, Homo sapiens
gcggtcgggcggcggcggtcggcgggcggcggg

SEQ ID NO: 24558 - DNA, 22 bp, Homo sapiens
cggtcgggcggcggcggtcggc

SEQ ID NO: 24559 - DNA, 25 bp, Homo sapiens
ggtcgggcggcggcggtcggcgggc

SEQ ID NO: 24560 - DNA, 21 bp, Homo sapiens
gggcggcggcggtcggcgggc

SEQ ID NO: 24561 - DNA, 24 bp, Homo sapiens
gggcggcggcggtcggcgggcggc

SEQ ID NO: 24562 - DNA, 16 bp, Homo sapiens
ggcggcggcggtcggc

SEQ ID NO: 24563 - DNA, 17 bp, Homo sapiens
ggcggcggcggtcggcg

SEQ ID NO: 24564 - DNA, 20 bp, Homo sapiens
ggcggcggcggtcggcgggc

SEQ ID NO: 24565 - DNA, 21 bp, Homo sapiens
ggcggcggcggtcggcgggcg

SEQ ID NO: 24566 - DNA, 23 bp, Homo sapiens
ggcggcggcggtcggcgggcggc

SEQ ID NO: 24567 - DNA, 24 bp, Homo sapiens
ggcggcggcggtcggcgggcggcg

SEQ ID NO: 24568 - DNA, 28 bp, Homo sapiens
ggcggcggcggtcggcgggcggcggggc

SEQ ID NO: 24569 - DNA, 29 bp, Homo sapiens
ggcggcggcggtcggcgggcggcggggcg

SEQ ID NO: 24570 - DNA, 16 bp, Homo sapiens
gcggcggcggtcggcg

SEQ ID NO: 24571 - DNA, 20 bp, Homo sapiens
gcggcggcggtcggcgggcg

SEQ ID NO: 24572 - DNA, 21 bp, Homo sapiens
gcggcggcggtcggcgggcgg

SEQ ID NO: 24573 - DNA, 22 bp, Homo sapiens
gcggcggcggtcggcgggcggc

SEQ ID NO: 24574 - DNA, 28 bp, Homo sapiens
gcggcggcggtcggcgggcggcggggcg

SEQ ID NO: 24575 - DNA, 31 bp, Homo sapiens
gcggcggcggtcggcgggcggcggggcgggg

SEQ ID NO: 24576 - DNA, 21 bp, Homo sapiens
cggcggcggtcggcgggcggc

SEQ ID NO: 24577 - DNA, 30 bp, Homo sapiens
cggcggcggtcggcgggcggcggggcgggg

SEQ ID NO: 24578 - DNA, 20 bp, Homo sapiens
ggcggcggtcggcgggcggc

SEQ ID NO: 24579 - DNA, 29 bp, Homo sapiens
ggcggcggtcggcgggcggcggggcgggg

SEQ ID NO: 24580 - DNA, 19 bp, Homo sapiens
gcggcggtcggcgggcggc

SEQ ID NO: 24581 - DNA, 29 bp, Homo sapiens
gcggcggtcggcgggcggcggggcggggc

SEQ ID NO: 24582 - DNA, 18 bp, Homo sapiens
cggcggtcggcgggcggc

SEQ ID NO: 24583 - DNA, 27 bp, Homo sapiens
cggcggtcggcgggcggcggggcgggg

SEQ ID NO: 24584 - DNA, 17 bp, Homo sapiens
ggcggtcggcgggcggc

SEQ ID NO: 24585 - DNA, 24 bp, Homo sapiens
cggtcggcgggcggcggggcgggg

SEQ ID NO: 24586 - DNA, 25 bp, Homo sapiens
cggtcggcgggcggcggggcggggc

SEQ ID NO: 24587 - DNA, 26 bp, Homo sapiens
cggtcggcgggcggcggggcggggcg

SEQ ID NO: 24588 - DNA, 27 bp, Homo sapiens
cggtcggcgggcggcggggcggggcgg

SEQ ID NO: 24589 - DNA, 17 bp, Homo sapiens
cgggcggcggggcgggg

SEQ ID NO: 24590 - DNA, 18 bp, Homo sapiens
cgggcggcggggcggggc

SEQ ID NO: 24591 - DNA, 19 bp, Homo sapiens
cgggcggcggggcggggcg

SEQ ID NO: 24592 - DNA, 25 bp, Homo sapiens
ccccccgccctacccccccggcccc

SEQ ID NO: 24593 - DNA, 26 bp, Homo sapiens
ccccccgccctacccccccggccccg

SEQ ID NO: 24594 - DNA, 24 bp, Homo sapiens
cccccgccctacccccccggcccc

SEQ ID NO: 24595 - DNA, 25 bp, Homo sapiens
cccccgccctacccccccggccccg

SEQ ID NO: 24596 - DNA, 16 bp, Homo sapiens
ccccgccctacccccc

SEQ ID NO: 24597 - DNA, 17 bp, Homo sapiens
ccccgccctaccccccc

SEQ ID NO: 24598 - DNA, 18 bp, Homo sapiens
ccccgccctacccccccg

SEQ ID NO: 24599 - DNA, 22 bp, Homo sapiens
ccccgccctacccccccggccc

SEQ ID NO: 24600 - DNA, 23 bp, Homo sapiens
ccccgccctacccccccggcccc

SEQ ID NO: 24601 - DNA, 24 bp, Homo sapiens
ccccgccctacccccccggccccg

SEQ ID NO: 24602 - DNA, 23 bp, Homo sapiens
cccgccctacccccccggccccg

SEQ ID NO: 24603 - DNA, 16 bp, Homo sapiens
ccgccctacccccccg

SEQ ID NO: 24604 - DNA, 20 bp, Homo sapiens
ccgccctacccccccggccc

SEQ ID NO: 24605 - DNA, 21 bp, Homo sapiens
ccgccctacccccccggcccc

SEQ ID NO: 24606 - DNA, 22 bp, Homo sapiens
ccgccctacccccccggccccg

SEQ ID NO: 24607 - DNA, 20 bp, Homo sapiens
cgccctacccccccggcccc

SEQ ID NO: 24608 - DNA, 21 bp, Homo sapiens
cgccctacccccccggccccg

SEQ ID NO: 24609 - DNA, 20 bp, Homo sapiens
gccctacccccccggccccg

SEQ ID NO: 24610 - DNA, 18 bp, Homo sapiens
ccctacccccccggcccc

SEQ ID NO: 24611 - DNA, 19 bp, Homo sapiens
ccctacccccccggccccg

SEQ ID NO: 24612 - DNA, 21 bp, Homo sapiens
ccctacccccccggccccgtc

SEQ ID NO: 24613 - DNA, 25 bp, Homo sapiens
ccctacccccccggccccgtccgcc

SEQ ID NO: 24614 - DNA, 18 bp, Homo sapiens
cctacccccccggccccg

SEQ ID NO: 24615 - DNA, 17 bp, Homo sapiens
ctacccccccggccccg

SEQ ID NO: 24616 - DNA, 28 bp, Homo sapiens
cccggccccgtccgccccccgttccccc

SEQ ID NO: 24617 - DNA, 29 bp, Homo sapiens
cccggccccgtccgccccccgttcccccc

SEQ ID NO: 24618 - DNA, 26 bp, Homo sapiens
ccggccccgtccgccccccgttcccc

SEQ ID NO: 24619 - DNA, 27 bp, Homo sapiens
ccggccccgtccgccccccgttccccc

SEQ ID NO: 24620 - DNA, 28 bp, Homo sapiens
ccggccccgtccgccccccgttcccccc

SEQ ID NO: 24621 - DNA, 31 bp, Homo sapiens
ccggccccgtccgccccccgttcccccctcc

SEQ ID NO: 24622 - DNA, 25 bp, Homo sapiens
cggccccgtccgccccccgttcccc

SEQ ID NO: 24623 - DNA, 26 bp, Homo sapiens
cggccccgtccgccccccgttccccc

SEQ ID NO: 24624 - DNA, 27 bp, Homo sapiens
cggccccgtccgccccccgttcccccc

SEQ ID NO: 24625 - DNA, 25 bp, Homo sapiens
ggccccgtccgccccccgttccccc

SEQ ID NO: 24626 - DNA, 26 bp, Homo sapiens
ggccccgtccgccccccgttcccccc

SEQ ID NO: 24627 - DNA, 25 bp, Homo sapiens
gccccgtccgccccccgttcccccc

SEQ ID NO: 24628 - DNA, 23 bp, Homo sapiens
ccccgtccgccccccgttccccc

SEQ ID NO: 24629 - DNA, 24 bp, Homo sapiens
ccccgtccgccccccgttcccccc

SEQ ID NO: 24630 - DNA, 21 bp, Homo sapiens
cccgtccgccccccgttcccc

SEQ ID NO: 24631 - DNA, 22 bp, Homo sapiens
cccgtccgccccccgttccccc

SEQ ID NO: 24632 - DNA, 23 bp, Homo sapiens
cccgtccgccccccgttcccccc

SEQ ID NO: 24633 - DNA, 26 bp, Homo sapiens
cccgtccgccccccgttcccccctcc

SEQ ID NO: 24634 - DNA, 22 bp, Homo sapiens
ccgtccgccccccgttcccccc

SEQ ID NO: 24635 - DNA, 21 bp, Homo sapiens
cgtccgccccccgttcccccc

SEQ ID NO: 24636 - DNA, 19 bp, Homo sapiens
tccgccccccgttcccccc

SEQ ID NO: 24637 - DNA, 17 bp, Homo sapiens
ccgccccccgttccccc

SEQ ID NO: 24638 - DNA, 18 bp, Homo sapiens
ccgccccccgttcccccc

SEQ ID NO: 24639 - DNA, 16 bp, Homo sapiens
cgccccccgttccccc

SEQ ID NO: 24640 - DNA, 17 bp, Homo sapiens
cgccccccgttcccccc

SEQ ID NO: 24641 - DNA, 16 bp, Homo sapiens
gccccccgttcccccc

SEQ ID NO: 24642 - DNA, 18 bp, Homo sapiens
gccccccgttcccccctc

SEQ ID NO: 24643 - DNA, 21 bp, Homo sapiens
gccccccgttcccccctcctc

SEQ ID NO: 24644 - DNA, 16 bp, Homo sapiens
ctcggcgcgcggcggc

SEQ ID NO: 24645 - DNA, 19 bp, Homo sapiens
ctcggcgcgcggcggcggc

SEQ ID NO: 24646 - DNA, 22 bp, Homo sapiens
ctcggcgcgcggcggcggcggc

SEQ ID NO: 24647 - DNA, 26 bp, Homo sapiens
ctcggcgcgcggcggcggcggcgggc

SEQ ID NO: 24648 - DNA, 16 bp, Homo sapiens
tcggcgcgcggcggcg

SEQ ID NO: 24649 - DNA, 18 bp, Homo sapiens
tcggcgcgcggcggcggc

SEQ ID NO: 24650 - DNA, 25 bp, Homo sapiens
tcggcgcgcggcggcggcggcgggc

SEQ ID NO: 24651 - DNA, 17 bp, Homo sapiens
cggcgcgcggcggcggc

SEQ ID NO: 24652 - DNA, 24 bp, Homo sapiens
cggcgcgcggcggcggcggcgggc

SEQ ID NO: 24653 - DNA, 16 bp, Homo sapiens
ggcgcgcggcggcggc

SEQ ID NO: 24654 - DNA, 23 bp, Homo sapiens
ggcgcgcggcggcggcggcgggc

SEQ ID NO: 24655 - DNA, 18 bp, Homo sapiens
cgcgcggcggcggcggcg

SEQ ID NO: 24656 - DNA, 22 bp, Homo sapiens
gcggcggaggggccgcgggccg

SEQ ID NO: 24657 - DNA, 25 bp, Homo sapiens
gcggcggaggggccgcgggccggtc

SEQ ID NO: 24658 - DNA, 33 bp, Homo sapiens
gaggggccgcgggccggtcccccccgccgggtc

SEQ ID NO: 24659 - DNA, 19 bp, Homo sapiens
cgggccggtcccccccgcc

SEQ ID NO: 24660 - DNA, 24 bp, Homo sapiens
cgggccggtcccccccgccgggtc

SEQ ID NO: 24661 - DNA, 17 bp, Homo sapiens
cggtcccccccgccggg

SEQ ID NO: 24662 - DNA, 19 bp, Homo sapiens
cggtcccccccgccgggtc

SEQ ID NO: 24663 - DNA, 20 bp, Homo sapiens
cggtcccccccgccgggtcc

SEQ ID NO: 24664 - DNA, 17 bp, Homo sapiens
gtcccccccgccgggtc

SEQ ID NO: 24665 - DNA, 33 bp, Homo sapiens
cccccgccgggtccgcccccggggccgcggttc

SEQ ID NO: 24666 - DNA, 28 bp, Homo sapiens
cccgccgggtccgcccccggggccgcgg

SEQ ID NO: 24667 - DNA, 30 bp, Homo sapiens
cccgccgggtccgcccccggggccgcggtt

SEQ ID NO: 24668 - DNA, 31 bp, Homo sapiens; identical to SEQ ID NO: 5343

SEQ ID NO: 24669 - DNA, 33 bp, Homo sapiens; identical to SEQ ID NO: 5344

SEQ ID NO: 24670 - DNA, 21 bp, Homo sapiens
ccgccgggtccgcccccgggg

SEQ ID NO: 24671 - DNA, 27 bp, Homo sapiens
ccgccgggtccgcccccggggccgcgg

SEQ ID NO: 24672 - DNA, 31 bp, Homo sapiens
ccgccgggtccgcccccggggccgcggttcc

SEQ ID NO: 24673 - DNA, 32 bp, Homo sapiens
ccgccgggtccgcccccggggccgcggttccg

SEQ ID NO: 24674 - DNA, 26 bp, Homo sapiens
cgccgggtccgcccccggggccgcgg

SEQ ID NO: 24675 - DNA, 29 bp, Homo sapiens
ccgggtccgcccccggggccgcggttccg

SEQ ID NO: 24676 - DNA, 18 bp, Homo sapiens
cgggtccgcccccggggc

SEQ ID NO: 24677 - DNA, 18 bp, Homo sapiens
cccccggggccgcggttc

SEQ ID NO: 24678 - DNA, 19 bp, Homo sapiens
cccccggggccgcggttcc

SEQ ID NO: 24679 - DNA, 17 bp, Homo sapiens
cccggggccgcggttcc

SEQ ID NO: 24680 - DNA, 26 bp, Homo sapiens
ttccgcgcggcgcctcgcctcggccg

SEQ ID NO: 24681 - DNA, 18 bp, Homo sapiens
ccgcgcggcgcctcgcct

SEQ ID NO: 24682 - DNA, 17 bp, Homo sapiens
cgcgcggcgcctcgcct

SEQ ID NO: 24683 - DNA, 25 bp, Homo sapiens
cgcgcggcgcctcgcctcggccggc

SEQ ID NO: 24684 - DNA, 26 bp, Homo sapiens
cgcgcggcgcctcgcctcggccggcg

SEQ ID NO: 24685 - DNA, 16 bp, Homo sapiens
gcgcggcgcctcgcct

SEQ ID NO: 24686 - DNA, 20 bp, Homo sapiens
gcgcggcgcctcgcctcggc

SEQ ID NO: 24687 - DNA, 24 bp, Homo sapiens
gcgcggcgcctcgcctcggccggc

SEQ ID NO: 24688 - DNA, 25 bp, Homo sapiens
gcgcggcgcctcgcctcggccggcg

SEQ ID NO: 24689 - DNA, 19 bp, Homo sapiens
cgcggcgcctcgcctcggc

SEQ ID NO: 24690 - DNA, 21 bp, Homo sapiens
cgcggcgcctcgcctcggccg

SEQ ID NO: 24691 - DNA, 22 bp, Homo sapiens
cgcggcgcctcgcctcggccgg

SEQ ID NO: 24692 - DNA, 23 bp, Homo sapiens
cgcggcgcctcgcctcggccggc

SEQ ID NO: 24693 - DNA, 24 bp, Homo sapiens
cgcggcgcctcgcctcggccggcg

SEQ ID NO: 24694 - DNA, 44 bp, Homo sapiens
cgcggcgcctcgcctcggccggcgcctagcagccgacttagaac

SEQ ID NO: 24695 - DNA, 45 bp, Homo sapiens
cgcggcgcctcgcctcggccggcgcctagcagccgacttagaact

SEQ ID NO: 24696 - DNA, 20 bp, Homo sapiens
gcggcgcctcgcctcggccg

SEQ ID NO: 24697 - DNA, 22 bp, Homo sapiens
gcggcgcctcgcctcggccggc

SEQ ID NO: 24698 - DNA, 43 bp, Homo sapiens
gcggcgcctcgcctcggccggcgcctagcagccgacttagaac

SEQ ID NO: 24699 - DNA, 17 bp, Homo sapiens
cggcgcctcgcctcggc

SEQ ID NO: 24700 - DNA, 18 bp, Homo sapiens
cggcgcctcgcctcggcc

SEQ ID NO: 24701 - DNA, 21 bp, Homo sapiens
cggcgcctcgcctcggccggc

SEQ ID NO: 24702 - DNA, 22 bp, Homo sapiens
cggcgcctcgcctcggccggcg

SEQ ID NO: 24703 - DNA, 42 bp, Homo sapiens
cggcgcctcgcctcggccggcgcctagcagccgacttagaac

SEQ ID NO: 24704 - DNA, 43 bp, Homo sapiens
cggcgcctcgcctcggccggcgcctagcagccgacttagaact

SEQ ID NO: 24705 - DNA, 16 bp, Homo sapiens
cctcgcctcggccggc

SEQ ID NO: 24706 - DNA, 17 bp, Homo sapiens
cctcgcctcggccggcg

SEQ ID NO: 24707 - DNA, 16 bp, Homo sapiens
cgcctcggccggcgcc

SEQ ID NO: 24708 - DNA, 17 bp, Homo sapiens
cgcctcggccggcgcct

SEQ ID NO: 24709 - DNA, 33 bp, Homo sapiens; identical to SEQ ID NO: 5352

SEQ ID NO: 24710 - DNA, 44 bp, Homo sapiens
gcctcggccggcgcctagcagccgacttagaactggtgcggacc

SEQ ID NO: 24711 - DNA, 16 bp, Homo sapiens
cctcggccggcgccta

SEQ ID NO: 24712 - DNA, 17 bp, Homo sapiens
cctcggccggcgcctag

SEQ ID NO: 24713 - DNA, 18 bp, Homo sapiens
cctcggccggcgcctagc

SEQ ID NO: 24714 - DNA, 19 bp, Homo sapiens
cctcggccggcgcctagca

SEQ ID NO: 24715 - DNA, 21 bp, Homo sapiens
cctcggccggcgcctagcagc

SEQ ID NO: 24716 - DNA, 22 bp, Homo sapiens
cctcggccggcgcctagcagcc

SEQ ID NO: 24717 - DNA, 23 bp, Homo sapiens
cctcggccggcgcctagcagccg

SEQ ID NO: 24718 - DNA, 29 bp, Homo sapiens
cctcggccggcgcctagcagccgacttag

SEQ ID NO: 24719 - DNA, 32 bp, Homo sapiens; identical to SEQ ID NO: 5358

SEQ ID NO: 24720 - DNA, 33 bp, Homo sapiens; identical to SEQ ID NO: 5359

SEQ ID NO: 24721 - DNA, 43 bp, Homo sapiens
cctcggccggcgcctagcagccgacttagaactggtgcggacc

SEQ ID NO: 24722 - DNA, 16 bp, Homo sapiens
ctcggccggcgcctag

SEQ ID NO: 24723 - DNA, 21 bp, Homo sapiens
ctcggccggcgcctagcagcc

SEQ ID NO: 24724 - DNA, 42 bp, Homo sapiens
ctcggccggcgcctagcagccgacttagaactggtgcggacc

SEQ ID NO: 24725 - DNA, 26 bp, Homo sapiens
cggcgcctagcagccgacttagaact

SEQ ID NO: 24726 - DNA, 25 bp, Homo sapiens
ggcgcctagcagccgacttagaact

SEQ ID NO: 24727 - DNA, 26 bp, Homo sapiens
ggcgcctagcagccgacttagaactg

SEQ ID NO: 24728 - DNA, 24 bp, Homo sapiens
gcgcctagcagccgacttagaact

SEQ ID NO: 24729 - DNA, 23 bp, Homo sapiens
cgcctagcagccgacttagaact

SEQ ID NO: 24730 - DNA, 28 bp, Homo sapiens
cgcctagcagccgacttagaactggtgc

SEQ ID NO: 24731 - DNA, 31 bp, Homo sapiens
cgcctagcagccgacttagaactggtgcgga

SEQ ID NO: 24732 - DNA, 21 bp, Homo sapiens
gcctagcagccgacttagaac

SEQ ID NO: 24733 - DNA, 22 bp, Homo sapiens
gcctagcagccgacttagaact

SEQ ID NO: 24734 - DNA, 25 bp, Homo sapiens
gcctagcagccgacttagaactggt

SEQ ID NO: 24735 - DNA, 27 bp, Homo sapiens
gcctagcagccgacttagaactggtgc

SEQ ID NO: 24736 - DNA, 31 bp, Homo sapiens
gcctagcagccgacttagaactggtgcggac

SEQ ID NO: 24737 - DNA, 32 bp, Homo sapiens; identical to SEQ ID NO: 5364

SEQ ID NO: 24738 - DNA, 33 bp, Homo sapiens
gcctagcagccgacttagaactggtgcggacca

SEQ ID NO: 24739 - DNA, 38 bp, Homo sapiens
gcctagcagccgacttagaactggtgcggaccagggga

SEQ ID NO: 24740 - DNA, 41 bp, Homo sapiens
gcctagcagccgacttagaactggtgcggaccaggggaatc

SEQ ID NO: 24741 - DNA, 20 bp, Homo sapiens
cctagcagccgacttagaac

SEQ ID NO: 24742 - DNA, 21 bp, Homo sapiens
cctagcagccgacttagaact

SEQ ID NO: 24743 - DNA, 26 bp, Homo sapiens
cctagcagccgacttagaactggtgc

SEQ ID NO: 24744 - DNA, 19 bp, Homo sapiens
ctagcagccgacttagaac

SEQ ID NO: 24745 - DNA, 20 bp, Homo sapiens
ctagcagccgacttagaact

SEQ ID NO: 24746 - DNA, 32 bp, Homo sapiens
ctagcagccgacttagaactggtgcggaccag

SEQ ID NO: 24747 - DNA, 16 bp, Homo sapiens
tagcagccgacttaga

SEQ ID NO: 24748 - DNA, 17 bp, Homo sapiens
tagcagccgacttagaa

SEQ ID NO: 24749 - DNA, 18 bp, Homo sapiens
tagcagccgacttagaac

SEQ ID NO: 24750 - DNA, 19 bp, Homo sapiens
tagcagccgacttagaact

SEQ ID NO: 24751 - DNA, 20 bp, Homo sapiens
tagcagccgacttagaactg

SEQ ID NO: 24752 - DNA, 22 bp, Homo sapiens
tagcagccgacttagaactggt

SEQ ID NO: 24753 - DNA, 24 bp, Homo sapiens
tagcagccgacttagaactggtgc

SEQ ID NO: 24754 - DNA, 29 bp, Homo sapiens
tagcagccgacttagaactggtgcggacc

SEQ ID NO: 24755 - DNA, 30 bp, Homo sapiens
tagcagccgacttagaactggtgcggacca

SEQ ID NO: 24756 - DNA, 31 bp, Homo sapiens; identical to SEQ ID NO: 5374

SEQ ID NO: 24757 - DNA, 32 bp, Homo sapiens
tagcagccgacttagaactggtgcggaccagg

SEQ ID NO: 24758 - DNA, 35 bp, Homo sapiens
tagcagccgacttagaactggtgcggaccagggga

SEQ ID NO: 24759 - DNA, 36 bp, Homo sapiens
tagcagccgacttagaactggtgcggaccaggggaa

SEQ ID NO: 24760 - DNA, 37 bp, Homo sapiens
tagcagccgacttagaactggtgcggaccaggggaat

SEQ ID NO: 24761 - DNA, 38 bp, Homo sapiens
tagcagccgacttagaactggtgcggaccaggggaatc

SEQ ID NO: 24762 - DNA, 42 bp, Homo sapiens
tagcagccgacttagaactggtgcggaccaggggaatccgac

SEQ ID NO: 24763 - DNA, 43 bp, Homo sapiens
tagcagccgacttagaactggtgcggaccaggggaatccgact

SEQ ID NO: 24764 - DNA, 46 bp, Homo sapiens
tagcagccgacttagaactggtgcggaccaggggaatccgactgtt

SEQ ID NO: 24765 - DNA, 16 bp, Homo sapiens
agcagccgacttagaa

SEQ ID NO: 24766 - DNA, 17 bp, Homo sapiens
agcagccgacttagaac

SEQ ID NO: 24767 - DNA, 18 bp, Homo sapiens
agcagccgacttagaact

SEQ ID NO: 24768 - DNA, 19 bp, Homo sapiens
agcagccgacttagaactg

SEQ ID NO: 24769 - DNA, 20 bp, Homo sapiens
agcagccgacttagaactgg

SEQ ID NO: 24770 - DNA, 21 bp, Homo sapiens
agcagccgacttagaactggt

SEQ ID NO: 24771 - DNA, 22 bp, Homo sapiens
agcagccgacttagaactggtg

SEQ ID NO: 24772 - DNA, 23 bp, Homo sapiens
agcagccgacttagaactggtgc

SEQ ID NO: 24773 - DNA, 27 bp, Homo sapiens
agcagccgacttagaactggtgcggac

SEQ ID NO: 24774 - DNA, 28 bp, Homo sapiens
agcagccgacttagaactggtgcggacc

SEQ ID NO: 24775 - DNA, 29 bp, Homo sapiens
agcagccgacttagaactggtgcggacca

SEQ ID NO: 24776 - DNA, 30 bp, Homo sapiens; identical to SEQ ID NO: 5383

SEQ ID NO: 24777 - DNA, 31 bp, Homo sapiens
agcagccgacttagaactggtgcggaccagg

SEQ ID NO: 24778 - DNA, 32 bp, Homo sapiens
agcagccgacttagaactggtgcggaccaggg

SEQ ID NO: 24779 - DNA, 33 bp, Homo sapiens; identical to SEQ ID NO: 5384

SEQ ID NO: 24780 - DNA, 34 bp, Homo sapiens
agcagccgacttagaactggtgcggaccagggga

SEQ ID NO: 24781 - DNA, 35 bp, Homo sapiens
agcagccgacttagaactggtgcggaccaggggaa

SEQ ID NO: 24782 - DNA, 36 bp, Homo sapiens
agcagccgacttagaactggtgcggaccaggggaat

SEQ ID NO: 24783 - DNA, 37 bp, Homo sapiens
agcagccgacttagaactggtgcggaccaggggaatc

SEQ ID NO: 24784 - DNA, 38 bp, Homo sapiens
agcagccgacttagaactggtgcggaccaggggaatcc

SEQ ID NO: 24785 - DNA, 41 bp, Homo sapiens
agcagccgacttagaactggtgcggaccaggggaatccgac

SEQ ID NO: 24786 - DNA, 42 bp, Homo sapiens
agcagccgacttagaactggtgcggaccaggggaatccgact

SEQ ID NO: 24787 - DNA, 43 bp, Homo sapiens
agcagccgacttagaactggtgcggaccaggggaatccgactg

SEQ ID NO: 24788 - DNA, 45 bp, Homo sapiens
agcagccgacttagaactggtgcggaccaggggaatccgactgtt

SEQ ID NO: 24789 - DNA, 16 bp, Homo sapiens
gcagccgacttagaac

SEQ ID NO: 24790 - DNA, 17 bp, Homo sapiens
gcagccgacttagaact

SEQ ID NO: 24791 - DNA, 18 bp, Homo sapiens
gcagccgacttagaactg

SEQ ID NO: 24792 - DNA, 19 bp, Homo sapiens
gcagccgacttagaactgg

SEQ ID NO: 24793 - DNA, 20 bp, Homo sapiens
gcagccgacttagaactggt

SEQ ID NO: 24794 - DNA, 21 bp, Homo sapiens
gcagccgacttagaactggtg

SEQ ID NO: 24795 - DNA, 22 bp, Homo sapiens
gcagccgacttagaactggtgc

SEQ ID NO: 24796 - DNA, 24 bp, Homo sapiens
gcagccgacttagaactggtgcgg

SEQ ID NO: 24797 - DNA, 25 bp, Homo sapiens
gcagccgacttagaactggtgcgga

SEQ ID NO: 24798 - DNA, 27 bp, Homo sapiens
gcagccgacttagaactggtgcggacc

SEQ ID NO: 24799 - DNA, 28 bp, Homo sapiens
gcagccgacttagaactggtgcggacca

SEQ ID NO: 24800 - DNA, 29 bp, Homo sapiens
gcagccgacttagaactggtgcggaccag

SEQ ID NO: 24801 - DNA, 30 bp, Homo sapiens
gcagccgacttagaactggtgcggaccagg

SEQ ID NO: 24802 - DNA, 31 bp, Homo sapiens
gcagccgacttagaactggtgcggaccaggg

SEQ ID NO: 24803 - DNA, 32 bp, Homo sapiens; identical to SEQ ID NO: 5391

SEQ ID NO: 24804 - DNA, 33 bp, Homo sapiens; identical to SEQ ID NO: 5392

SEQ ID NO: 24805 - DNA, 34 bp, Homo sapiens
gcagccgacttagaactggtgcggaccaggggaa

SEQ ID NO: 24806 - DNA, 35 bp, Homo sapiens
gcagccgacttagaactggtgcggaccaggggaat

SEQ ID NO: 24807 - DNA, 36 bp, Homo sapiens
gcagccgacttagaactggtgcggaccaggggaatc

SEQ ID NO: 24808 - DNA, 40 bp, Homo sapiens
gcagccgacttagaactggtgcggaccaggggaatccgac

SEQ ID NO: 24809 - DNA, 41 bp, Homo sapiens
gcagccgacttagaactggtgcggaccaggggaatccgact

SEQ ID NO: 24810 - DNA, 42 bp, Homo sapiens
gcagccgacttagaactggtgcggaccaggggaatccgactg

SEQ ID NO: 24811 - DNA, 44 bp, Homo sapiens
gcagccgacttagaactggtgcggaccaggggaatccgactgtt

SEQ ID NO: 24812 - DNA, 16 bp, Homo sapiens
cagccgacttagaact

SEQ ID NO: 24813 - DNA, 19 bp, Homo sapiens
cagccgacttagaactggt

SEQ ID NO: 24814 - DNA, 20 bp, Homo sapiens
cagccgacttagaactggtg

SEQ ID NO: 24815 - DNA, 26 bp, Homo sapiens
cagccgacttagaactggtgcggacc

SEQ ID NO: 24816 - DNA, 28 bp, Homo sapiens
cagccgacttagaactggtgcggaccag

SEQ ID NO: 24817 - DNA, 29 bp, Homo sapiens
cagccgacttagaactggtgcggaccagg

SEQ ID NO: 24818 - DNA, 31 bp, Homo sapiens
cagccgacttagaactggtgcggaccagggg

SEQ ID NO: 24819 - DNA, 32 bp, Homo sapiens; identical to SEQ ID NO: 5395

SEQ ID NO: 24820 - DNA, 33 bp, Homo sapiens
cagccgacttagaactggtgcggaccaggggaa

SEQ ID NO: 24821 - DNA, 18 bp, Homo sapiens
agccgacttagaactggt

SEQ ID NO: 24822 - DNA, 22 bp, Homo sapiens
agccgacttagaactggtgcgg

SEQ ID NO: 24823 - DNA, 25 bp, Homo sapiens
agccgacttagaactggtgcggacc

SEQ ID NO: 24824 - DNA, 27 bp, Homo sapiens
agccgacttagaactggtgcggaccag

SEQ ID NO: 24825 - DNA, 31 bp, Homo sapiens
agccgacttagaactggtgcggaccagggga

SEQ ID NO: 24826 - DNA, 32 bp, Homo sapiens
agccgacttagaactggtgcggaccaggggaa

SEQ ID NO: 24827 - DNA, 33 bp, Homo sapiens
agccgacttagaactggtgcggaccaggggaat

SEQ ID NO: 24828 - DNA, 16 bp, Homo sapiens
gccgacttagaactgg

SEQ ID NO: 24829 - DNA, 17 bp, Homo sapiens
gccgacttagaactggt

SEQ ID NO: 24830 - DNA, 18 bp, Homo sapiens
gccgacttagaactggtg

SEQ ID NO: 24831 - DNA, 20 bp, Homo sapiens
gccgacttagaactggtgcg

SEQ ID NO: 24832 - DNA, 21 bp, Homo sapiens
gccgacttagaactggtgcgg

SEQ ID NO: 24833 - DNA, 22 bp, Homo sapiens
gccgacttagaactggtgcgga

SEQ ID NO: 24834 - DNA, 23 bp, Homo sapiens
gccgacttagaactggtgcggac

SEQ ID NO: 24835 - DNA, 24 bp, Homo sapiens
gccgacttagaactggtgcggacc

SEQ ID NO: 24836 - DNA, 25 bp, Homo sapiens
gccgacttagaactggtgcggacca

SEQ ID NO: 24837 - DNA, 26 bp, Homo sapiens
gccgacttagaactggtgcggaccag

SEQ ID NO: 24838 - DNA, 27 bp, Homo sapiens
gccgacttagaactggtgcggaccagg

SEQ ID NO: 24839 - DNA, 29 bp, Homo sapiens
gccgacttagaactggtgcggaccagggg

SEQ ID NO: 24840 - DNA, 30 bp, Homo sapiens; identical to SEQ ID NO: 5401

SEQ ID NO: 24841 - DNA, 31 bp, Homo sapiens; identical to SEQ ID NO: 5402

SEQ ID NO: 24842 - DNA, 32 bp, Homo sapiens; identical to SEQ ID NO: 5403

SEQ ID NO: 24843 - DNA, 33 bp, Homo sapiens; identical to SEQ ID NO: 5404

SEQ ID NO: 24844 - DNA, 34 bp, Homo sapiens
gccgacttagaactggtgcggaccaggggaatcc

SEQ ID NO: 24845 - DNA, 37 bp, Homo sapiens
gccgacttagaactggtgcggaccaggggaatccgac

SEQ ID NO: 24846 - DNA, 38 bp, Homo sapiens
gccgacttagaactggtgcggaccaggggaatccgact

SEQ ID NO: 24847 - DNA, 39 bp, Homo sapiens
gccgacttagaactggtgcggaccaggggaatccgactg

SEQ ID NO: 24848 - DNA, 41 bp, Homo sapiens
gccgacttagaactggtgcggaccaggggaatccgactgtt

SEQ ID NO: 24849 - DNA, 42 bp, Homo sapiens
gccgacttagaactggtgcggaccaggggaatccgactgttt

SEQ ID NO: 24850 - DNA, 43 bp, Homo sapiens
gccgacttagaactggtgcggaccaggggaatccgactgttta

SEQ ID NO: 24851 - DNA, 46 bp, Homo sapiens
gccgacttagaactggtgcggaccaggggaatccgactgtttaatt

SEQ ID NO: 24852 - DNA, 16 bp, Homo sapiens
ccgacttagaactggt

SEQ ID NO: 24853 - DNA, 22 bp, Homo sapiens
ccgacttagaactggtgcggac

SEQ ID NO: 24854 - DNA, 23 bp, Homo sapiens
ccgacttagaactggtgcggacc

SEQ ID NO: 24855 - DNA, 33 bp, Homo sapiens
ccgacttagaactggtgcggaccaggggaatcc

SEQ ID NO: 24856 - DNA, 37 bp, Homo sapiens
ccgacttagaactggtgcggaccaggggaatccgact

SEQ ID NO: 24857 - DNA, 18 bp, Homo sapiens
cgacttagaactggtgcg

SEQ ID NO: 24858 - DNA, 22 bp, Homo sapiens
cgacttagaactggtgcggacc

SEQ ID NO: 24859 - DNA, 31 bp, Homo sapiens
cgacttagaactggtgcggaccaggggaatc

SEQ ID NO: 24860 - DNA, 32 bp, Homo sapiens
cgacttagaactggtgcggaccaggggaatcc

SEQ ID NO: 24861 - DNA, 19 bp, Homo sapiens
acttagaactggtgcggac

SEQ ID NO: 24862 - DNA, 20 bp, Homo sapiens
acttagaactggtgcggacc

SEQ ID NO: 24863 - DNA, 21 bp, Homo sapiens
acttagaactggtgcggacca

SEQ ID NO: 24864 - DNA, 30 bp, Homo sapiens
acttagaactggtgcggaccaggggaatcc

SEQ ID NO: 24865 - DNA, 32 bp, Homo sapiens
acttagaactggtgcggaccaggggaatccga

SEQ ID NO: 24866 - DNA, 33 bp, Homo sapiens; identical to SEQ ID NO: 5408

SEQ ID NO: 24867 - DNA, 34 bp, Homo sapiens
acttagaactggtgcggaccaggggaatccgact

SEQ ID NO: 24868 - DNA, 17 bp, Homo sapiens
cttagaactggtgcgga

SEQ ID NO: 24869 - DNA, 19 bp, Homo sapiens
cttagaactggtgcggacc

SEQ ID NO: 24870 - DNA, 20 bp, Homo sapiens
cttagaactggtgcggacca

SEQ ID NO: 24871 - DNA, 28 bp, Homo sapiens
cttagaactggtgcggaccaggggaatc

SEQ ID NO: 24872 - DNA, 31 bp, Homo sapiens
cttagaactggtgcggaccaggggaatccga

SEQ ID NO: 24873 - DNA, 32 bp, Homo sapiens
cttagaactggtgcggaccaggggaatccgac

SEQ ID NO: 24874 - DNA, 33 bp, Homo sapiens; identical to SEQ ID NO: 5410

SEQ ID NO: 24875 - DNA, 18 bp, Homo sapiens
ttagaactggtgcggacc

SEQ ID NO: 24876 - DNA, 31 bp, Homo sapiens
ttagaactggtgcggaccaggggaatccgac

SEQ ID NO: 24877 - DNA, 32 bp, Homo sapiens; identical to SEQ ID NO: 5412

SEQ ID NO: 24878 - DNA, 16 bp, Homo sapiens
tagaactggtgcggac

SEQ ID NO: 24879 - DNA, 17 bp, Homo sapiens
tagaactggtgcggacc

SEQ ID NO: 24880 - DNA, 27 bp, Homo sapiens
tagaactggtgcggaccaggggaatcc

SEQ ID NO: 24881 - DNA, 29 bp, Homo sapiens
tagaactggtgcggaccaggggaatccga

SEQ ID NO: 24882 - DNA, 30 bp, Homo sapiens; identical to SEQ ID NO: 5414

SEQ ID NO: 24883 - DNA, 31 bp, Homo sapiens; identical to SEQ ID NO: 5415

SEQ ID NO: 24884 - DNA, 32 bp, Homo sapiens
tagaactggtgcggaccaggggaatccgactg

SEQ ID NO: 24885 - DNA, 16 bp, Homo sapiens
agaactggtgcggacc

SEQ ID NO: 24886 - DNA, 17 bp, Homo sapiens
agaactggtgcggacca

SEQ ID NO: 24887 - DNA, 26 bp, Homo sapiens
agaactggtgcggaccaggggaatcc

SEQ ID NO: 24888 - DNA, 28 bp, Homo sapiens
agaactggtgcggaccaggggaatccga

SEQ ID NO: 24889 - DNA, 29 bp, Homo sapiens
agaactggtgcggaccaggggaatccgac

SEQ ID NO: 24890 - DNA, 30 bp, Homo sapiens; identical to SEQ ID NO: 5418

SEQ ID NO: 24891 - DNA, 31 bp, Homo sapiens
agaactggtgcggaccaggggaatccgactg

SEQ ID NO: 24892 - DNA, 32 bp, Homo sapiens
agaactggtgcggaccaggggaatccgactgt

SEQ ID NO: 24893 - DNA, 33 bp, Homo sapiens; identical to SEQ ID NO: 5419

SEQ ID NO: 24894 - DNA, 34 bp, Homo sapiens
agaactggtgcggaccaggggaatccgactgttt

SEQ ID NO: 24895 - DNA, 16 bp, Homo sapiens
gaactggtgcggacca

SEQ ID NO: 24896 - DNA, 17 bp, Homo sapiens
gaactggtgcggaccag

SEQ ID NO: 24897 - DNA, 22 bp, Homo sapiens
gaactggtgcggaccaggggaa

SEQ ID NO: 24898 - DNA, 24 bp, Homo sapiens
gaactggtgcggaccaggggaatc

SEQ ID NO: 24899 - DNA, 25 bp, Homo sapiens
gaactggtgcggaccaggggaatcc

SEQ ID NO: 24900 - DNA, 27 bp, Homo sapiens
gaactggtgcggaccaggggaatccga

SEQ ID NO: 24901 - DNA, 28 bp, Homo sapiens
gaactggtgcggaccaggggaatccgac

SEQ ID NO: 24902 - DNA, 29 bp, Homo sapiens
gaactggtgcggaccaggggaatccgact

SEQ ID NO: 24903 - DNA, 30 bp, Homo sapiens
gaactggtgcggaccaggggaatccgactg

SEQ ID NO: 24904 - DNA, 32 bp, Homo sapiens; identical to SEQ ID NO: 5423

SEQ ID NO: 24905 - DNA, 33 bp, Homo sapiens
gaactggtgcggaccaggggaatccgactgttt

SEQ ID NO: 24906 - DNA, 34 bp, Homo sapiens
gaactggtgcggaccaggggaatccgactgttta

SEQ ID NO: 24907 - DNA, 23 bp, Homo sapiens
aactggtgcggaccaggggaatc

SEQ ID NO: 24908 - DNA, 24 bp, Homo sapiens
aactggtgcggaccaggggaatcc

SEQ ID NO: 24909 - DNA, 25 bp, Homo sapiens
aactggtgcggaccaggggaatccg

SEQ ID NO: 24910 - DNA, 26 bp, Homo sapiens
aactggtgcggaccaggggaatccga

SEQ ID NO: 24911 - DNA, 27 bp, Homo sapiens
aactggtgcggaccaggggaatccgac

SEQ ID NO: 24912 - DNA, 28 bp, Homo sapiens
aactggtgcggaccaggggaatccgact

SEQ ID NO: 24913 - DNA, 29 bp, Homo sapiens
aactggtgcggaccaggggaatccgactg

SEQ ID NO: 24914 - DNA, 30 bp, Homo sapiens; identical to SEQ ID NO: 5429

SEQ ID NO: 24915 - DNA, 31 bp, Homo sapiens; identical to SEQ ID NO: 5430

SEQ ID NO: 24916 - DNA, 32 bp, Homo sapiens; identical to SEQ ID NO: 5431

SEQ ID NO: 24917 - DNA, 33 bp, Homo sapiens
aactggtgcggaccaggggaatccgactgttta

SEQ ID NO: 24918 - DNA, 36 bp, Homo sapiens
aactggtgcggaccaggggaatccgactgtttaatt

SEQ ID NO: 24919 - DNA, 19 bp, Homo sapiens
actggtgcggaccagggga

SEQ ID NO: 24920 - DNA, 20 bp, Homo sapiens
actggtgcggaccaggggaa

SEQ ID NO: 24921 - DNA, 21 bp, Homo sapiens
actggtgcggaccaggggaat

SEQ ID NO: 24922 - DNA, 23 bp, Homo sapiens
actggtgcggaccaggggaatcc

SEQ ID NO: 24923 - DNA, 24 bp, Homo sapiens
actggtgcggaccaggggaatccg

SEQ ID NO: 24924 - DNA, 25 bp, Homo sapiens
actggtgcggaccaggggaatccga

SEQ ID NO: 24925 - DNA, 26 bp, Homo sapiens
actggtgcggaccaggggaatccgac

SEQ ID NO: 24926 - DNA, 27 bp, Homo sapiens
actggtgcggaccaggggaatccgact

SEQ ID NO: 24927 - DNA, 28 bp, Homo sapiens
actggtgcggaccaggggaatccgactg

SEQ ID NO: 24928 - DNA, 29 bp, Homo sapiens
actggtgcggaccaggggaatccgactgt

SEQ ID NO: 24929 - DNA, 30 bp, Homo sapiens; identical to SEQ ID NO: 5436

SEQ ID NO: 24930 - DNA, 31 bp, Homo sapiens; identical to SEQ ID NO: 5437

SEQ ID NO: 24931 - DNA, 32 bp, Homo sapiens
actggtgcggaccaggggaatccgactgttta

SEQ ID NO: 24932 - DNA, 33 bp, Homo sapiens
actggtgcggaccaggggaatccgactgtttaa

SEQ ID NO: 24933 - DNA, 35 bp, Homo sapiens
actggtgcggaccaggggaatccgactgtttaatt

SEQ ID NO: 24934 - DNA, 18 bp, Homo sapiens
ctggtgcggaccagggga

SEQ ID NO: 24935 - DNA, 19 bp, Homo sapiens
ctggtgcggaccaggggaa

SEQ ID NO: 24936 - DNA, 20 bp, Homo sapiens
ctggtgcggaccaggggaat

SEQ ID NO: 24937 - DNA, 21 bp, Homo sapiens
ctggtgcggaccaggggaatc

SEQ ID NO: 24938 - DNA, 23 bp, Homo sapiens
ctggtgcggaccaggggaatccg

SEQ ID NO: 24939 - DNA, 24 bp, Homo sapiens
ctggtgcggaccaggggaatccga

SEQ ID NO: 24940 - DNA, 25 bp, Homo sapiens
ctggtgcggaccaggggaatccgac

SEQ ID NO: 24941 - DNA, 26 bp, Homo sapiens
ctggtgcggaccaggggaatccgact

SEQ ID NO: 24942 - DNA, 27 bp, Homo sapiens
ctggtgcggaccaggggaatccgactg

SEQ ID NO: 24943 - DNA, 28 bp, Homo sapiens
ctggtgcggaccaggggaatccgactgt

SEQ ID NO: 24944 - DNA, 29 bp, Homo sapiens
ctggtgcggaccaggggaatccgactgtt

SEQ ID NO: 24945 - DNA, 30 bp, Homo sapiens; identical to SEQ ID NO: 5445

SEQ ID NO: 24946 - DNA, 31 bp, Homo sapiens; identical to SEQ ID NO: 5446

SEQ ID NO: 24947 - DNA, 32 bp, Homo sapiens; identical to SEQ ID NO: 5447

SEQ ID NO: 24948 - DNA, 33 bp, Homo sapiens; identical to SEQ ID NO: 5448

SEQ ID NO: 24949 - DNA, 34 bp, Homo sapiens
ctggtgcggaccaggggaatccgactgtttaatt

SEQ ID NO: 24950 - DNA, 35 bp, Homo sapiens
ctggtgcggaccaggggaatccgactgtttaatta

SEQ ID NO: 24951 - DNA, 17 bp, Homo sapiens
tggtgcggaccagggga

SEQ ID NO: 24952 - DNA, 18 bp, Homo sapiens
tggtgcggaccaggggaa

SEQ ID NO: 24953 - DNA, 19 bp, Homo sapiens
tggtgcggaccaggggaat

SEQ ID NO: 24954 - DNA, 20 bp, Homo sapiens
tggtgcggaccaggggaatc

SEQ ID NO: 24955 - DNA, 21 bp, Homo sapiens
tggtgcggaccaggggaatcc

SEQ ID NO: 24956 - DNA, 23 bp, Homo sapiens
tggtgcggaccaggggaatccga

SEQ ID NO: 24957 - DNA, 24 bp, Homo sapiens
tggtgcggaccaggggaatccgac

SEQ ID NO: 24958 - DNA, 25 bp, Homo sapiens
tggtgcggaccaggggaatccgact

SEQ ID NO: 24959 - DNA, 26 bp, Homo sapiens
tggtgcggaccaggggaatccgactg

SEQ ID NO: 24960 - DNA, 28 bp, Homo sapiens
tggtgcggaccaggggaatccgactgtt

SEQ ID NO: 24961 - DNA, 29 bp, Homo sapiens
tggtgcggaccaggggaatccgactgttt

SEQ ID NO: 24962 - DNA, 33 bp, Homo sapiens
tggtgcggaccaggggaatccgactgtttaatt

SEQ ID NO: 24963 - DNA, 16 bp, Homo sapiens
ggtgcggaccagggga

SEQ ID NO: 24964 - DNA, 17 bp, Homo sapiens
ggtgcggaccaggggaa

SEQ ID NO: 24965 - DNA, 18 bp, Homo sapiens
ggtgcggaccaggggaat

SEQ ID NO: 24966 - DNA, 19 bp, Homo sapiens
ggtgcggaccaggggaatc

SEQ ID NO: 24967 - DNA, 20 bp, Homo sapiens
ggtgcggaccaggggaatcc

SEQ ID NO: 24968 - DNA, 22 bp, Homo sapiens
ggtgcggaccaggggaatccga

SEQ ID NO: 24969 - DNA, 23 bp, Homo sapiens
ggtgcggaccaggggaatccgac

SEQ ID NO: 24970 - DNA, 24 bp, Homo sapiens
ggtgcggaccaggggaatccgact

SEQ ID NO: 24971 - DNA, 25 bp, Homo sapiens
ggtgcggaccaggggaatccgactg

SEQ ID NO: 24972 - DNA, 27 bp, Homo sapiens
ggtgcggaccaggggaatccgactgtt

SEQ ID NO: 24973 - DNA, 28 bp, Homo sapiens
ggtgcggaccaggggaatccgactgttt

SEQ ID NO: 24974 - DNA, 29 bp, Homo sapiens
ggtgcggaccaggggaatccgactgttta

SEQ ID NO: 24975 - DNA, 31 bp, Homo sapiens
ggtgcggaccaggggaatccgactgtttaat

SEQ ID NO: 24976 - DNA, 32 bp, Homo sapiens; identical to SEQ ID NO: 5465

SEQ ID NO: 24977 - DNA, 33 bp, Homo sapiens; identical to SEQ ID NO: 5466

SEQ ID NO: 24978 - DNA, 16 bp, Homo sapiens
gtgcggaccaggggaa

SEQ ID NO: 24979 - DNA, 17 bp, Homo sapiens
gtgcggaccaggggaat

SEQ ID NO: 24980 - DNA, 18 bp, Homo sapiens
gtgcggaccaggggaatc

SEQ ID NO: 24981 - DNA, 19 bp, Homo sapiens
gtgcggaccaggggaatcc

SEQ ID NO: 24982 - DNA, 21 bp, Homo sapiens
gtgcggaccaggggaatccga

SEQ ID NO: 24983 - DNA, 22 bp, Homo sapiens
gtgcggaccaggggaatccgac

SEQ ID NO: 24984 - DNA, 23 bp, Homo sapiens
gtgcggaccaggggaatccgact

SEQ ID NO: 24985 - DNA, 24 bp, Homo sapiens
gtgcggaccaggggaatccgactg

SEQ ID NO: 24986 - DNA, 26 bp, Homo sapiens
gtgcggaccaggggaatccgactgtt

SEQ ID NO: 24987 - DNA, 27 bp, Homo sapiens
gtgcggaccaggggaatccgactgttt

SEQ ID NO: 24988 - DNA, 28 bp, Homo sapiens
gtgcggaccaggggaatccgactgttta

SEQ ID NO: 24989 - DNA, 30 bp, Homo sapiens
gtgcggaccaggggaatccgactgtttaat

SEQ ID NO: 24990 - DNA, 31 bp, Homo sapiens; identical to SEQ ID NO: 5474

SEQ ID NO: 24991 - DNA, 32 bp, Homo sapiens; identical to SEQ ID NO: 5475

SEQ ID NO: 24992 - DNA, 33 bp, Homo sapiens
gtgcggaccaggggaatccgactgtttaattaa

SEQ ID NO: 24993 - DNA, 16 bp, Homo sapiens
tgcggaccaggggaat

SEQ ID NO: 24994 - DNA, 17 bp, Homo sapiens
tgcggaccaggggaatc

SEQ ID NO: 24995 - DNA, 18 bp, Homo sapiens
tgcggaccaggggaatcc

SEQ ID NO: 24996 - DNA, 19 bp, Homo sapiens
tgcggaccaggggaatccg

SEQ ID NO: 24997 - DNA, 20 bp, Homo sapiens
tgcggaccaggggaatccga

SEQ ID NO: 24998 - DNA, 21 bp, Homo sapiens
tgcggaccaggggaatccgac

SEQ ID NO: 24999 - DNA, 22 bp, Homo sapiens
tgcggaccaggggaatccgact

SEQ ID NO: 25000 - DNA, 23 bp, Homo sapiens
tgcggaccaggggaatccgactg

SEQ ID NO: 25001 - DNA, 25 bp, Homo sapiens
tgcggaccaggggaatccgactgtt

SEQ ID NO: 25002 - DNA, 26 bp, Homo sapiens
tgcggaccaggggaatccgactgttt

SEQ ID NO: 25003 - DNA, 27 bp, Homo sapiens
tgcggaccaggggaatccgactgttta

SEQ ID NO: 25004 - DNA, 28 bp, Homo sapiens
tgcggaccaggggaatccgactgtttaa

SEQ ID NO: 25005 - DNA, 29 bp, Homo sapiens
tgcggaccaggggaatccgactgtttaat

SEQ ID NO: 25006 - DNA, 30 bp, Homo sapiens; identical to SEQ ID NO: 5483

SEQ ID NO: 25007 - DNA, 31 bp, Homo sapiens; identical to SEQ ID NO: 5484

SEQ ID NO: 25008 - DNA, 32 bp, Homo sapiens
tgcggaccaggggaatccgactgtttaattaa

SEQ ID NO: 25009 - DNA, 33 bp, Homo sapiens
tgcggaccaggggaatccgactgtttaattaaa

SEQ ID NO: 25010 - DNA, 16 bp, Homo sapiens
gcggaccaggggaatc

SEQ ID NO: 25011 - DNA, 17 bp, Homo sapiens
gcggaccaggggaatcc

SEQ ID NO: 25012 - DNA, 18 bp, Homo sapiens
gcggaccaggggaatccg

SEQ ID NO: 25013 - DNA, 19 bp, Homo sapiens
gcggaccaggggaatccga

SEQ ID NO: 25014 - DNA, 20 bp, Homo sapiens
gcggaccaggggaatccgac

SEQ ID NO: 25015 - DNA, 21 bp, Homo sapiens
gcggaccaggggaatccgact

SEQ ID NO: 25016 - DNA, 22 bp, Homo sapiens
gcggaccaggggaatccgactg

SEQ ID NO: 25017 - DNA, 23 bp, Homo sapiens
gcggaccaggggaatccgactgt

SEQ ID NO: 25018 - DNA, 24 bp, Homo sapiens
gcggaccaggggaatccgactgtt

SEQ ID NO: 25019 - DNA, 25 bp, Homo sapiens
gcggaccaggggaatccgactgttt

SEQ ID NO: 25020 - DNA, 26 bp, Homo sapiens
gcggaccaggggaatccgactgttta

SEQ ID NO: 25021 - DNA, 27 bp, Homo sapiens
gcggaccaggggaatccgactgtttaa

SEQ ID NO: 25022 - DNA, 28 bp, Homo sapiens
gcggaccaggggaatccgactgtttaat

SEQ ID NO: 25023 - DNA, 29 bp, Homo sapiens
gcggaccaggggaatccgactgtttaatt

SEQ ID NO: 25024 - DNA, 30 bp, Homo sapiens; identical to SEQ ID NO: 5494

SEQ ID NO: 25025 - DNA, 31 bp, Homo sapiens
gcggaccaggggaatccgactgtttaattaa

SEQ ID NO: 25026 - DNA, 32 bp, Homo sapiens
gcggaccaggggaatccgactgtttaattaaa

SEQ ID NO: 25027 - DNA, 33 bp, Homo sapiens
gcggaccaggggaatccgactgtttaattaaaa

SEQ ID NO: 25028 - DNA, 16 bp, Homo sapiens
cggaccaggggaatcc

SEQ ID NO: 25029 - DNA, 19 bp, Homo sapiens
cggaccaggggaatccgac

SEQ ID NO: 25030 - DNA, 20 bp, Homo sapiens
cggaccaggggaatccgact

SEQ ID NO: 25031 - DNA, 22 bp, Homo sapiens
cggaccaggggaatccgactgt

SEQ ID NO: 25032 - DNA, 23 bp, Homo sapiens
cggaccaggggaatccgactgtt

SEQ ID NO: 25033 - DNA, 24 bp, Homo sapiens
cggaccaggggaatccgactgttt

SEQ ID NO: 25034 - DNA, 25 bp, Homo sapiens
cggaccaggggaatccgactgttta

SEQ ID NO: 25035 - DNA, 26 bp, Homo sapiens
cggaccaggggaatccgactgtttaa

SEQ ID NO: 25036 - DNA, 27 bp, Homo sapiens
cggaccaggggaatccgactgtttaat

SEQ ID NO: 25037 - DNA, 28 bp, Homo sapiens
cggaccaggggaatccgactgtttaatt

SEQ ID NO: 25038 - DNA, 29 bp, Homo sapiens
cggaccaggggaatccgactgtttaatta

SEQ ID NO: 25039 - DNA, 30 bp, Homo sapiens; identical to SEQ ID NO: 5504

SEQ ID NO: 25040 - DNA, 31 bp, Homo sapiens
cggaccaggggaatccgactgtttaattaaa

SEQ ID NO: 25041 - DNA, 32 bp, Homo sapiens
cggaccaggggaatccgactgtttaattaaaa

SEQ ID NO: 25042 - DNA, 33 bp, Homo sapiens
cggaccaggggaatccgactgtttaattaaaac

SEQ ID NO: 25043 - DNA, 20 bp, Homo sapiens
ggaccaggggaatccgactg

SEQ ID NO: 25044 - DNA, 22 bp, Homo sapiens
ggaccaggggaatccgactgtt

SEQ ID NO: 25045 - DNA, 19 bp, Homo sapiens
gaccaggggaatccgactg

SEQ ID NO: 25046 - DNA, 20 bp, Homo sapiens
gaccaggggaatccgactgt

SEQ ID NO: 25047 - DNA, 21 bp, Homo sapiens
gaccaggggaatccgactgtt

SEQ ID NO: 25048 - DNA, 22 bp, Homo sapiens
gaccaggggaatccgactgttt

SEQ ID NO: 25049 - DNA, 23 bp, Homo sapiens
gaccaggggaatccgactgttta

SEQ ID NO: 25050 - DNA, 24 bp, Homo sapiens
gaccaggggaatccgactgtttaa

SEQ ID NO: 25051 - DNA, 26 bp, Homo sapiens
gaccaggggaatccgactgtttaatt

SEQ ID NO: 25052 - DNA, 27 bp, Homo sapiens
gaccaggggaatccgactgtttaatta

SEQ ID NO: 25053 - DNA, 18 bp, Homo sapiens
accaggggaatccgactg

SEQ ID NO: 25054 - DNA, 19 bp, Homo sapiens
accaggggaatccgactgt

SEQ ID NO: 25055 - DNA, 20 bp, Homo sapiens
accaggggaatccgactgtt

SEQ ID NO: 25056 - DNA, 21 bp, Homo sapiens
accaggggaatccgactgttt

SEQ ID NO: 25057 - DNA, 26 bp, Homo sapiens
accaggggaatccgactgtttaatta

SEQ ID NO: 25058 - DNA, 17 bp, Homo sapiens
ccaggggaatccgactg

SEQ ID NO: 25059 - DNA, 19 bp, Homo sapiens
ccaggggaatccgactgtt

SEQ ID NO: 25060 - DNA, 20 bp, Homo sapiens
ccaggggaatccgactgttt

SEQ ID NO: 25061 - DNA, 21 bp, Homo sapiens
ccaggggaatccgactgttta

SEQ ID NO: 25062 - DNA, 22 bp, Homo sapiens
ccaggggaatccgactgtttaa

SEQ ID NO: 25063 - DNA, 23 bp, Homo sapiens
ccaggggaatccgactgtttaat

SEQ ID NO: 25064 - DNA, 24 bp, Homo sapiens
ccaggggaatccgactgtttaatt

SEQ ID NO: 25065 - DNA, 25 bp, Homo sapiens
ccaggggaatccgactgtttaatta

SEQ ID NO: 25066 - DNA, 26 bp, Homo sapiens
ccaggggaatccgactgtttaattaa

SEQ ID NO: 25067 - DNA, 27 bp, Homo sapiens
ccaggggaatccgactgtttaattaaa

SEQ ID NO: 25068 - DNA, 28 bp, Homo sapiens
ccaggggaatccgactgtttaattaaaa

SEQ ID NO: 25069 - DNA, 16 bp, Homo sapiens
caggggaatccgactg

SEQ ID NO: 25070 - DNA, 17 bp, Homo sapiens
caggggaatccgactgt

SEQ ID NO: 25071 - DNA, 18 bp, Homo sapiens
caggggaatccgactgtt

SEQ ID NO: 25072 - DNA, 19 bp, Homo sapiens
caggggaatccgactgttt

SEQ ID NO: 25073 - DNA, 20 bp, Homo sapiens
caggggaatccgactgttta

SEQ ID NO: 25074 - DNA, 21 bp, Homo sapiens
caggggaatccgactgtttaa

SEQ ID NO: 25075 - DNA, 22 bp, Homo sapiens
caggggaatccgactgtttaat

SEQ ID NO: 25076 - DNA, 23 bp, Homo sapiens
caggggaatccgactgtttaatt

SEQ ID NO: 25077 - DNA, 24 bp, Homo sapiens
caggggaatccgactgtttaatta

SEQ ID NO: 25078 - DNA, 25 bp, Homo sapiens
caggggaatccgactgtttaattaa

SEQ ID NO: 25079 - DNA, 16 bp, Homo sapiens
aggggaatccgactgt

SEQ ID NO: 25080 - DNA, 17 bp, Homo sapiens
aggggaatccgactgtt

SEQ ID NO: 25081 - DNA, 18 bp, Homo sapiens
aggggaatccgactgttt

SEQ ID NO: 25082 - DNA, 19 bp, Homo sapiens
aggggaatccgactgttta

SEQ ID NO: 25083 - DNA, 20 bp, Homo sapiens
aggggaatccgactgtttaa

SEQ ID NO: 25084 - DNA, 21 bp, Homo sapiens
aggggaatccgactgtttaat

SEQ ID NO: 25085 - DNA, 22 bp, Homo sapiens
aggggaatccgactgtttaatt

SEQ ID NO: 25086 - DNA, 23 bp, Homo sapiens
aggggaatccgactgtttaatta

SEQ ID NO: 25087 - DNA, 24 bp, Homo sapiens
aggggaatccgactgtttaattaa

SEQ ID NO: 25088 - DNA, 25 bp, Homo sapiens
aggggaatccgactgtttaattaaa

SEQ ID NO: 25089 - DNA, 26 bp, Homo sapiens
aggggaatccgactgtttaattaaaa

SEQ ID NO: 25090 - DNA, 16 bp, Homo sapiens
ggggaatccgactgtt

SEQ ID NO: 25091 - DNA, 17 bp, Homo sapiens
ggggaatccgactgttt

SEQ ID NO: 25092 - DNA, 18 bp, Homo sapiens
ggggaatccgactgttta

SEQ ID NO: 25093 - DNA, 19 bp, Homo sapiens
ggggaatccgactgtttaa

SEQ ID NO: 25094 - DNA, 20 bp, Homo sapiens
ggggaatccgactgtttaat

SEQ ID NO: 25095 - DNA, 21 bp, Homo sapiens
ggggaatccgactgtttaatt

SEQ ID NO: 25096 - DNA, 22 bp, Homo sapiens
ggggaatccgactgtttaatta

SEQ ID NO: 25097 - DNA, 23 bp, Homo sapiens
ggggaatccgactgtttaattaa

SEQ ID NO: 25098 - DNA, 24 bp, Homo sapiens
ggggaatccgactgtttaattaaa

SEQ ID NO: 25099 - DNA, 25 bp, Homo sapiens
ggggaatccgactgtttaattaaaa

SEQ ID NO: 25100 - DNA, 28 bp, Homo sapiens
ggggaatccgactgtttaattaaaacaa

SEQ ID NO: 25101 - DNA, 16 bp, Homo sapiens
gggaatccgactgttt

SEQ ID NO: 25102 - DNA, 17 bp, Homo sapiens
gggaatccgactgttta

SEQ ID NO: 25103 - DNA, 18 bp, Homo sapiens
gggaatccgactgtttaa

SEQ ID NO: 25104 - DNA, 19 bp, Homo sapiens
gggaatccgactgtttaat

SEQ ID NO: 25105 - DNA, 20 bp, Homo sapiens
gggaatccgactgtttaatt

SEQ ID NO: 25106 - DNA, 21 bp, Homo sapiens
gggaatccgactgtttaatta

SEQ ID NO: 25107 - DNA, 22 bp, Homo sapiens
gggaatccgactgtttaattaa

SEQ ID NO: 25108 - DNA, 23 bp, Homo sapiens
gggaatccgactgtttaattaaa

SEQ ID NO: 25109 - DNA, 16 bp, Homo sapiens
ggaatccgactgttta

SEQ ID NO: 25110 - DNA, 17 bp, Homo sapiens
ggaatccgactgtttaa

SEQ ID NO: 25111 - DNA, 18 bp, Homo sapiens
ggaatccgactgtttaat

SEQ ID NO: 25112 - DNA, 19 bp, Homo sapiens
ggaatccgactgtttaatt

SEQ ID NO: 25113 - DNA, 20 bp, Homo sapiens
ggaatccgactgtttaatta

SEQ ID NO: 25114 - DNA, 21 bp, Homo sapiens
ggaatccgactgtttaattaa

SEQ ID NO: 25115 - DNA, 22 bp, Homo sapiens
ggaatccgactgtttaattaaa

SEQ ID NO: 25116 - DNA, 23 bp, Homo sapiens
ggaatccgactgtttaattaaaa

SEQ ID NO: 25117 - DNA, 18 bp, Homo sapiens
gaatccgactgtttaatt

SEQ ID NO: 25118 - DNA, 16 bp, Homo sapiens
aatccgactgtttaat

SEQ ID NO: 25119 - DNA, 17 bp, Homo sapiens
aatccgactgtttaatt

SEQ ID NO: 25120 - DNA, 18 bp, Homo sapiens
aatccgactgtttaatta

SEQ ID NO: 25121 - DNA, 19 bp, Homo sapiens
aatccgactgtttaattaa

SEQ ID NO: 25122 - DNA, 20 bp, Homo sapiens
aatccgactgtttaattaaa

SEQ ID NO: 25123 - DNA, 21 bp, Homo sapiens
aatccgactgtttaattaaaa

SEQ ID NO: 25124 - DNA, 22 bp, Homo sapiens
aatccgactgtttaattaaaac

SEQ ID NO: 25125 - DNA, 23 bp, Homo sapiens
aatccgactgtttaattaaaaca

SEQ ID NO: 25126 - DNA, 24 bp, Homo sapiens
aatccgactgtttaattaaaacaa

SEQ ID NO: 25127 - DNA, 25 bp, Homo sapiens
aatccgactgtttaattaaaacaaa

SEQ ID NO: 25128 - DNA, 26 bp, Homo sapiens
aatccgactgtttaattaaaacaaag

SEQ ID NO: 25129 - DNA, 28 bp, Homo sapiens
aatccgactgtttaattaaaacaaagca

SEQ ID NO: 25130 - DNA, 29 bp, Homo sapiens
aatccgactgtttaattaaaacaaagcat

SEQ ID NO: 25131 - DNA, 30 bp, Homo sapiens
aatccgactgtttaattaaaacaaagcatc

SEQ ID NO: 25132 - DNA, 16 bp, Homo sapiens
atccgactgtttaatt

SEQ ID NO: 25133 - DNA, 17 bp, Homo sapiens
atccgactgtttaatta

SEQ ID NO: 25134 - DNA, 18 bp, Homo sapiens
atccgactgtttaattaa

SEQ ID NO: 25135 - DNA, 19 bp, Homo sapiens
atccgactgtttaattaaa

SEQ ID NO: 25136 - DNA, 20 bp, Homo sapiens
atccgactgtttaattaaaa

SEQ ID NO: 25137 - DNA, 21 bp, Homo sapiens
atccgactgtttaattaaaac

SEQ ID NO: 25138 - DNA, 22 bp, Homo sapiens
atccgactgtttaattaaaaca

SEQ ID NO: 25139 - DNA, 23 bp, Homo sapiens
atccgactgtttaattaaaacaa

SEQ ID NO: 25140 - DNA, 24 bp, Homo sapiens
atccgactgtttaattaaaacaaa

SEQ ID NO: 25141 - DNA, 25 bp, Homo sapiens
atccgactgtttaattaaaacaaag

SEQ ID NO: 25142 - DNA, 26 bp, Homo sapiens
atccgactgtttaattaaaacaaagc

SEQ ID NO: 25143 - DNA, 27 bp, Homo sapiens
atccgactgtttaattaaaacaaagca

SEQ ID NO: 25144 - DNA, 28 bp, Homo sapiens
atccgactgtttaattaaaacaaagcat

SEQ ID NO: 25145 - DNA, 29 bp, Homo sapiens
atccgactgtttaattaaaacaaagcatc

SEQ ID NO: 25146 - DNA, 39 bp, Homo sapiens
atccgactgtttaattaaaacaaagcatcgcgaaggccc

SEQ ID NO: 25147 - DNA, 16 bp, Homo sapiens
tccgactgtttaatta

SEQ ID NO: 25148 - DNA, 17 bp, Homo sapiens
tccgactgtttaattaa

SEQ ID NO: 25149 - DNA, 18 bp, Homo sapiens
tccgactgtttaattaaa

SEQ ID NO: 25150 - DNA, 19 bp, Homo sapiens
tccgactgtttaattaaaa

SEQ ID NO: 25151 - DNA, 20 bp, Homo sapiens
tccgactgtttaattaaaac

SEQ ID NO: 25152 - DNA, 21 bp, Homo sapiens
tccgactgtttaattaaaaca

SEQ ID NO: 25153 - DNA, 22 bp, Homo sapiens
tccgactgtttaattaaaacaa

SEQ ID NO: 25154 - DNA, 23 bp, Homo sapiens
tccgactgtttaattaaaacaaa

SEQ ID NO: 25155 - DNA, 24 bp, Homo sapiens
tccgactgtttaattaaaacaaag

SEQ ID NO: 25156 - DNA, 25 bp, Homo sapiens
tccgactgtttaattaaaacaaagc

SEQ ID NO: 25157 - DNA, 26 bp, Homo sapiens
tccgactgtttaattaaaacaaagca

SEQ ID NO: 25158 - DNA, 27 bp, Homo sapiens
tccgactgtttaattaaaacaaagcat

SEQ ID NO: 25159 - DNA, 28 bp, Homo sapiens
tccgactgtttaattaaaacaaagcatc

SEQ ID NO: 25160 - DNA, 16 bp, Homo sapiens
ccgactgtttaattaa

SEQ ID NO: 25161 - DNA, 17 bp, Homo sapiens
ccgactgtttaattaaa

SEQ ID NO: 25162 - DNA, 18 bp, Homo sapiens
ccgactgtttaattaaaa

SEQ ID NO: 25163 - DNA, 19 bp, Homo sapiens
ccgactgtttaattaaaac

SEQ ID NO: 25164 - DNA, 20 bp, Homo sapiens
ccgactgtttaattaaaaca

SEQ ID NO: 25165 - DNA, 21 bp, Homo sapiens
ccgactgtttaattaaaacaa

SEQ ID NO: 25166 - DNA, 22 bp, Homo sapiens
ccgactgtttaattaaaacaaa

SEQ ID NO: 25167 - DNA, 25 bp, Homo sapiens
ccgactgtttaattaaaacaaagca

SEQ ID NO: 25168 - DNA, 37 bp, Homo sapiens
ccgactgtttaattaaaacaaagcatcgcgaaggccc

SEQ ID NO: 25169 - DNA, 16 bp, Homo sapiens
cgactgtttaattaaa

SEQ ID NO: 25170 - DNA, 17 bp, Homo sapiens
cgactgtttaattaaaa

SEQ ID NO: 25171 - DNA, 18 bp, Homo sapiens
cgactgtttaattaaaac

SEQ ID NO: 25172 - DNA, 19 bp, Homo sapiens
cgactgtttaattaaaaca

SEQ ID NO: 25173 - DNA, 21 bp, Homo sapiens
cgactgtttaattaaaacaaa

SEQ ID NO: 25174 - DNA, 24 bp, Homo sapiens
cgactgtttaattaaaacaaagca

SEQ ID NO: 25175 - DNA, 34 bp, Homo sapiens
gactgtttaattaaaacaaagcatcgcgaaggcc

SEQ ID NO: 25176 - DNA, 36 bp, Homo sapiens
gactgtttaattaaaacaaagcatcgcgaaggcccg

SEQ ID NO: 25177 - DNA, 33 bp, Homo sapiens; identical to SEQ ID NO: 5560

SEQ ID NO: 25178 - DNA, 32 bp, Homo sapiens
ctgtttaattaaaacaaagcatcgcgaaggcc

SEQ ID NO: 25179 - DNA, 30 bp, Homo sapiens
tgtttaattaaaacaaagcatcgcgaaggc

SEQ ID NO: 25180 - DNA, 31 bp, Homo sapiens
tgtttaattaaaacaaagcatcgcgaaggcc

SEQ ID NO: 25181 - DNA, 29 bp, Homo sapiens
gtttaattaaaacaaagcatcgcgaaggc

SEQ ID NO: 25182 - DNA, 30 bp, Homo sapiens; identical to SEQ ID NO: 5562

SEQ ID NO: 25183 - DNA, 31 bp, Homo sapiens
gtttaattaaaacaaagcatcgcgaaggccc

SEQ ID NO: 25184 - DNA, 32 bp, Homo sapiens
gtttaattaaaacaaagcatcgcgaaggcccg

SEQ ID NO: 25185 - DNA, 29 bp, Homo sapiens
tttaattaaaacaaagcatcgcgaaggcc

SEQ ID NO: 25186 - DNA, 30 bp, Homo sapiens; identical to SEQ ID NO: 5564

SEQ ID NO: 25187 - DNA, 31 bp, Homo sapiens
tttaattaaaacaaagcatcgcgaaggcccg

SEQ ID NO: 25188 - DNA, 27 bp, Homo sapiens
ttaattaaaacaaagcatcgcgaaggc

SEQ ID NO: 25189 - DNA, 28 bp, Homo sapiens
ttaattaaaacaaagcatcgcgaaggcc

SEQ ID NO: 25190 - DNA, 29 bp, Homo sapiens
ttaattaaaacaaagcatcgcgaaggccc

SEQ ID NO: 25191 - DNA, 30 bp, Homo sapiens
ttaattaaaacaaagcatcgcgaaggcccg

SEQ ID NO: 25192 - DNA, 24 bp, Homo sapiens
taattaaaacaaagcatcgcgaag

SEQ ID NO: 25193 - DNA, 25 bp, Homo sapiens
taattaaaacaaagcatcgcgaagg

SEQ ID NO: 25194 - DNA, 26 bp, Homo sapiens
taattaaaacaaagcatcgcgaaggc

SEQ ID NO: 25195 - DNA, 27 bp, Homo sapiens
taattaaaacaaagcatcgcgaaggcc

SEQ ID NO: 25196 - DNA, 28 bp, Homo sapiens
taattaaaacaaagcatcgcgaaggccc

SEQ ID NO: 25197 - DNA, 29 bp, Homo sapiens
taattaaaacaaagcatcgcgaaggcccg

SEQ ID NO: 25198 - DNA, 23 bp, Homo sapiens
aattaaaacaaagcatcgcgaag

SEQ ID NO: 25199 - DNA, 24 bp, Homo sapiens
aattaaaacaaagcatcgcgaagg

SEQ ID NO: 25200 - DNA, 25 bp, Homo sapiens
aattaaaacaaagcatcgcgaaggc

SEQ ID NO: 25201 - DNA, 26 bp, Homo sapiens
aattaaaacaaagcatcgcgaaggcc

SEQ ID NO: 25202 - DNA, 27 bp, Homo sapiens
aattaaaacaaagcatcgcgaaggccc

SEQ ID NO: 25203 - DNA, 28 bp, Homo sapiens
aattaaaacaaagcatcgcgaaggcccg

SEQ ID NO: 25204 - DNA, 22 bp, Homo sapiens
attaaaacaaagcatcgcgaag

SEQ ID NO: 25205 - DNA, 23 bp, Homo sapiens
attaaaacaaagcatcgcgaagg

SEQ ID NO: 25206 - DNA, 24 bp, Homo sapiens
attaaaacaaagcatcgcgaaggc

SEQ ID NO: 25207 - DNA, 25 bp, Homo sapiens
attaaaacaaagcatcgcgaaggcc

SEQ ID NO: 25208 - DNA, 26 bp, Homo sapiens
attaaaacaaagcatcgcgaaggccc

SEQ ID NO: 25209 - DNA, 27 bp, Homo sapiens
attaaaacaaagcatcgcgaaggcccg

SEQ ID NO: 25210 - DNA, 23 bp, Homo sapiens
ttaaaacaaagcatcgcgaaggc

SEQ ID NO: 25211 - DNA, 24 bp, Homo sapiens
ttaaaacaaagcatcgcgaaggcc

SEQ ID NO: 25212 - DNA, 25 bp, Homo sapiens
ttaaaacaaagcatcgcgaaggccc

SEQ ID NO: 25213 - DNA, 26 bp, Homo sapiens
ttaaaacaaagcatcgcgaaggcccg

SEQ ID NO: 25214 - DNA, 22 bp, Homo sapiens
taaaacaaagcatcgcgaaggc

SEQ ID NO: 25215 - DNA, 23 bp, Homo sapiens
taaaacaaagcatcgcgaaggcc

SEQ ID NO: 25216 - DNA, 24 bp, Homo sapiens
taaaacaaagcatcgcgaaggccc

SEQ ID NO: 25217 - DNA, 25 bp, Homo sapiens
taaaacaaagcatcgcgaaggcccg

SEQ ID NO: 25218 - DNA, 19 bp, Homo sapiens
aaaacaaagcatcgcgaag

SEQ ID NO: 25219 - DNA, 20 bp, Homo sapiens
aaaacaaagcatcgcgaagg

SEQ ID NO: 25220 - DNA, 21 bp, Homo sapiens
aaaacaaagcatcgcgaaggc

SEQ ID NO: 25221 - DNA, 22 bp, Homo sapiens
aaaacaaagcatcgcgaaggcc

SEQ ID NO: 25222 - DNA, 23 bp, Homo sapiens
aaaacaaagcatcgcgaaggccc

SEQ ID NO: 25223 - DNA, 24 bp, Homo sapiens
aaaacaaagcatcgcgaaggcccg

SEQ ID NO: 25224 - DNA, 25 bp, Homo sapiens
aaaacaaagcatcgcgaaggcccgc

SEQ ID NO: 25225 - DNA, 18 bp, Homo sapiens
aaacaaagcatcgcgaag

SEQ ID NO: 25226 - DNA, 19 bp, Homo sapiens
aaacaaagcatcgcgaagg

SEQ ID NO: 25227 - DNA, 20 bp, Homo sapiens
aaacaaagcatcgcgaaggc

SEQ ID NO: 25228 - DNA, 21 bp, Homo sapiens
aaacaaagcatcgcgaaggcc

SEQ ID NO: 25229 - DNA, 22 bp, Homo sapiens
aaacaaagcatcgcgaaggccc

SEQ ID NO: 25230 - DNA, 23 bp, Homo sapiens
aaacaaagcatcgcgaaggcccg

SEQ ID NO: 25231 - DNA, 27 bp, Homo sapiens
aaacaaagcatcgcgaaggcccgcggc

SEQ ID NO: 25232 - DNA, 17 bp, Homo sapiens
aacaaagcatcgcgaag

SEQ ID NO: 25233 - DNA, 18 bp, Homo sapiens
aacaaagcatcgcgaagg

SEQ ID NO: 25234 - DNA, 19 bp, Homo sapiens
aacaaagcatcgcgaaggc

SEQ ID NO: 25235 - DNA, 20 bp, Homo sapiens
aacaaagcatcgcgaaggcc

SEQ ID NO: 25236 - DNA, 21 bp, Homo sapiens
aacaaagcatcgcgaaggccc

SEQ ID NO: 25237 - DNA, 22 bp, Homo sapiens
aacaaagcatcgcgaaggcccg

SEQ ID NO: 25238 - DNA, 26 bp, Homo sapiens
aacaaagcatcgcgaaggcccgcggc

SEQ ID NO: 25239 - DNA, 27 bp, Homo sapiens
aacaaagcatcgcgaaggcccgcggcg

SEQ ID NO: 25240 - DNA, 16 bp, Homo sapiens
acaaagcatcgcgaag

SEQ ID NO: 25241 - DNA, 17 bp, Homo sapiens
acaaagcatcgcgaagg

SEQ ID NO: 25242 - DNA, 18 bp, Homo sapiens
acaaagcatcgcgaaggc

SEQ ID NO: 25243 - DNA, 19 bp, Homo sapiens
acaaagcatcgcgaaggcc

SEQ ID NO: 25244 - DNA, 20 bp, Homo sapiens
acaaagcatcgcgaaggccc

SEQ ID NO: 25245 - DNA, 21 bp, Homo sapiens
acaaagcatcgcgaaggcccg

SEQ ID NO: 25246 - DNA, 25 bp, Homo sapiens
acaaagcatcgcgaaggcccgcggc

SEQ ID NO: 25247 - DNA, 16 bp, Homo sapiens
caaagcatcgcgaagg

SEQ ID NO: 25248 - DNA, 17 bp, Homo sapiens
caaagcatcgcgaaggc

SEQ ID NO: 25249 - DNA, 18 bp, Homo sapiens
caaagcatcgcgaaggcc

SEQ ID NO: 25250 - DNA, 19 bp, Homo sapiens
caaagcatcgcgaaggccc

SEQ ID NO: 25251 - DNA, 20 bp, Homo sapiens
caaagcatcgcgaaggcccg

SEQ ID NO: 25252 - DNA, 24 bp, Homo sapiens
caaagcatcgcgaaggcccgcggc

SEQ ID NO: 25253 - DNA, 16 bp, Homo sapiens
aaagcatcgcgaaggc

SEQ ID NO: 25254 - DNA, 17 bp, Homo sapiens
aaagcatcgcgaaggcc

SEQ ID NO: 25255 - DNA, 18 bp, Homo sapiens
aaagcatcgcgaaggccc

SEQ ID NO: 25256 - DNA, 19 bp, Homo sapiens
aaagcatcgcgaaggcccg

SEQ ID NO: 25257 - DNA, 20 bp, Homo sapiens
aaagcatcgcgaaggcccgc

SEQ ID NO: 25258 - DNA, 21 bp, Homo sapiens
aaagcatcgcgaaggcccgcg

SEQ ID NO: 25259 - DNA, 23 bp, Homo sapiens
aaagcatcgcgaaggcccgcggc

SEQ ID NO: 25260 - DNA, 24 bp, Homo sapiens
aaagcatcgcgaaggcccgcggcg

SEQ ID NO: 25261 - DNA, 25 bp, Homo sapiens
aaagcatcgcgaaggcccgcggcgg

SEQ ID NO: 25262 - DNA, 16 bp, Homo sapiens
aagcatcgcgaaggcc

SEQ ID NO: 25263 - DNA, 17 bp, Homo sapiens
aagcatcgcgaaggccc

SEQ ID NO: 25264 - DNA, 18 bp, Homo sapiens
aagcatcgcgaaggcccg

SEQ ID NO: 25265 - DNA, 22 bp, Homo sapiens
aagcatcgcgaaggcccgcggc

SEQ ID NO: 25266 - DNA, 17 bp, Homo sapiens
agcatcgcgaaggcccg

SEQ ID NO: 25267 - DNA, 16 bp, Homo sapiens
gcatcgcgaaggcccg

SEQ ID NO: 25268 - DNA, 16 bp, Homo sapiens
gaaggcccgcggcggg

SEQ ID NO: 25269 - DNA, 17 bp, Homo sapiens
gaaggcccgcggcgggt

SEQ ID NO: 25270 - DNA, 19 bp, Homo sapiens
ccgcggcgggtgttgacgc

SEQ ID NO: 25271 - DNA, 31 bp, Homo sapiens
ccgcggcgggtgttgacgcgatgtgatttct

SEQ ID NO: 25272 - DNA, 18 bp, Homo sapiens
cgcggcgggtgttgacgc

SEQ ID NO: 25273 - DNA, 25 bp, Homo sapiens
gcggcgggtgttgacgcgatgtgat

SEQ ID NO: 25274 - DNA, 26 bp, Homo sapiens
gcggcgggtgttgacgcgatgtgatt

SEQ ID NO: 25275 - DNA, 29 bp, Homo sapiens
gcggcgggtgttgacgcgatgtgatttct

SEQ ID NO: 25276 - DNA, 22 bp, Homo sapiens
ggtgttgacgcgatgtgatttc

SEQ ID NO: 25277 - DNA, 26 bp, Homo sapiens
ggtgttgacgcgatgtgatttctgcc

SEQ ID NO: 25278 - DNA, 32 bp, Homo sapiens
ggtgttgacgcgatgtgatttctgcccagtgc

SEQ ID NO: 25279 - DNA, 33 bp, Homo sapiens
ggtgttgacgcgatgtgatttctgcccagtgct

SEQ ID NO: 25280 - DNA, 35 bp, Homo sapiens
ggtgttgacgcgatgtgatttctgcccagtgctct

SEQ ID NO: 25281 - DNA, 21 bp, Homo sapiens
gtgttgacgcgatgtgatttc

SEQ ID NO: 25282 - DNA, 22 bp, Homo sapiens
gtgttgacgcgatgtgatttct

SEQ ID NO: 25283 - DNA, 27 bp, Homo sapiens
gtgttgacgcgatgtgatttctgccca

SEQ ID NO: 25284 - DNA, 28 bp, Homo sapiens
gtgttgacgcgatgtgatttctgcccag

SEQ ID NO: 25285 - DNA, 29 bp, Homo sapiens
gtgttgacgcgatgtgatttctgcccagt

SEQ ID NO: 25286 - DNA, 32 bp, Homo sapiens; identical to SEQ ID NO: 5613

SEQ ID NO: 25287 - DNA, 20 bp, Homo sapiens
tgttgacgcgatgtgatttc

SEQ ID NO: 25288 - DNA, 26 bp, Homo sapiens
tgttgacgcgatgtgatttctgccca

SEQ ID NO: 25289 - DNA, 31 bp, Homo sapiens
tgttgacgcgatgtgatttctgcccagtgct

SEQ ID NO: 25290 - DNA, 33 bp, Homo sapiens
tgttgacgcgatgtgatttctgcccagtgctct

SEQ ID NO: 25291 - DNA, 25 bp, Homo sapiens
gttgacgcgatgtgatttctgccca

SEQ ID NO: 25292 - DNA, 30 bp, Homo sapiens
gttgacgcgatgtgatttctgcccagtgct

SEQ ID NO: 25293 - DNA, 32 bp, Homo sapiens
gttgacgcgatgtgatttctgcccagtgctct

SEQ ID NO: 25294 - DNA, 18 bp, Homo sapiens
ttgacgcgatgtgatttc

SEQ ID NO: 25295 - DNA, 19 bp, Homo sapiens
ttgacgcgatgtgatttct

SEQ ID NO: 25296 - DNA, 24 bp, Homo sapiens
ttgacgcgatgtgatttctgccca

SEQ ID NO: 25297 - DNA, 26 bp, Homo sapiens
ttgacgcgatgtgatttctgcccagt

SEQ ID NO: 25298 - DNA, 28 bp, Homo sapiens
ttgacgcgatgtgatttctgcccagtgc

SEQ ID NO: 25299 - DNA, 29 bp, Homo sapiens
ttgacgcgatgtgatttctgcccagtgct

SEQ ID NO: 25300 - DNA, 31 bp, Homo sapiens
ttgacgcgatgtgatttctgcccagtgctct

SEQ ID NO: 25301 - DNA, 17 bp, Homo sapiens
tgacgcgatgtgatttc

SEQ ID NO: 25302 - DNA, 23 bp, Homo sapiens
tgacgcgatgtgatttctgccca

SEQ ID NO: 25303 - DNA, 16 bp, Homo sapiens
gacgcgatgtgatttc

SEQ ID NO: 25304 - DNA, 22 bp, Homo sapiens
gacgcgatgtgatttctgccca

SEQ ID NO: 25305 - DNA, 23 bp, Homo sapiens
gacgcgatgtgatttctgcccag

SEQ ID NO: 25306 - DNA, 24 bp, Homo sapiens
gacgcgatgtgatttctgcccagt

SEQ ID NO: 25307 - DNA, 26 bp, Homo sapiens
gacgcgatgtgatttctgcccagtgc

SEQ ID NO: 25308 - DNA, 27 bp, Homo sapiens
gacgcgatgtgatttctgcccagtgct

SEQ ID NO: 25309 - DNA, 28 bp, Homo sapiens
gacgcgatgtgatttctgcccagtgctc

SEQ ID NO: 25310 - DNA, 29 bp, Homo sapiens
gacgcgatgtgatttctgcccagtgctct

SEQ ID NO: 25311 - DNA, 33 bp, Homo sapiens; identical to SEQ ID NO: 5618

SEQ ID NO: 25312 - DNA, 21 bp, Homo sapiens
acgcgatgtgatttctgccca

SEQ ID NO: 25313 - DNA, 23 bp, Homo sapiens
acgcgatgtgatttctgcccagt

SEQ ID NO: 25314 - DNA, 25 bp, Homo sapiens
acgcgatgtgatttctgcccagtgc

SEQ ID NO: 25315 - DNA, 26 bp, Homo sapiens
acgcgatgtgatttctgcccagtgct

SEQ ID NO: 25316 - DNA, 27 bp, Homo sapiens
acgcgatgtgatttctgcccagtgctc

SEQ ID NO: 25317 - DNA, 28 bp, Homo sapiens
acgcgatgtgatttctgcccagtgctct

SEQ ID NO: 25318 - DNA, 29 bp, Homo sapiens
acgcgatgtgatttctgcccagtgctctg

SEQ ID NO: 25319 - DNA, 30 bp, Homo sapiens
acgcgatgtgatttctgcccagtgctctga

SEQ ID NO: 25320 - DNA, 31 bp, Homo sapiens
acgcgatgtgatttctgcccagtgctctgaa

SEQ ID NO: 25321 - DNA, 32 bp, Homo sapiens; identical to SEQ ID NO: 5621

SEQ ID NO: 25322 - DNA, 33 bp, Homo sapiens; identical to SEQ ID NO: 5622

SEQ ID NO: 25323 - DNA, 36 bp, Homo sapiens
acgcgatgtgatttctgcccagtgctctgaatgtca

SEQ ID NO: 25324 - DNA, 17 bp, Homo sapiens
cgcgatgtgatttctgc

SEQ ID NO: 25325 - DNA, 18 bp, Homo sapiens
cgcgatgtgatttctgcc

SEQ ID NO: 25326 - DNA, 20 bp, Homo sapiens
cgcgatgtgatttctgccca

SEQ ID NO: 25327 - DNA, 22 bp, Homo sapiens
cgcgatgtgatttctgcccagt

SEQ ID NO: 25328 - DNA, 24 bp, Homo sapiens
cgcgatgtgatttctgcccagtgc

SEQ ID NO: 25329 - DNA, 25 bp, Homo sapiens
cgcgatgtgatttctgcccagtgct

SEQ ID NO: 25330 - DNA, 26 bp, Homo sapiens
cgcgatgtgatttctgcccagtgctc

SEQ ID NO: 25331 - DNA, 27 bp, Homo sapiens
cgcgatgtgatttctgcccagtgctct

SEQ ID NO: 25332 - DNA, 29 bp, Homo sapiens
cgcgatgtgatttctgcccagtgctctga

SEQ ID NO: 25333 - DNA, 30 bp, Homo sapiens
cgcgatgtgatttctgcccagtgctctgaa

SEQ ID NO: 25334 - DNA, 31 bp, Homo sapiens
cgcgatgtgatttctgcccagtgctctgaat

SEQ ID NO: 25335 - DNA, 32 bp, Homo sapiens
cgcgatgtgatttctgcccagtgctctgaatg

SEQ ID NO: 25336 - DNA, 34 bp, Homo sapiens
cgcgatgtgatttctgcccagtgctctgaatgtc

SEQ ID NO: 25337 - DNA, 26 bp, Homo sapiens
gcgatgtgatttctgcccagtgctct

SEQ ID NO: 25338 - DNA, 30 bp, Homo sapiens
gcgatgtgatttctgcccagtgctctgaat

SEQ ID NO: 25339 - DNA, 33 bp, Homo sapiens; identical to SEQ ID NO: 5623

SEQ ID NO: 25340 - DNA, 18 bp, Homo sapiens
cgatgtgatttctgccca

SEQ ID NO: 25341 - DNA, 32 bp, Homo sapiens
cgatgtgatttctgcccagtgctctgaatgtc

SEQ ID NO: 25342 - DNA, 33 bp, Homo sapiens
cgatgtgatttctgcccagtgctctgaatgtca

SEQ ID NO: 25343 - DNA, 17 bp, Homo sapiens
gatgtgatttctgccca

SEQ ID NO: 25344 - DNA, 28 bp, Homo sapiens
gatgtgatttctgcccagtgctctgaat

SEQ ID NO: 25345 - DNA, 31 bp, Homo sapiens
gatgtgatttctgcccagtgctctgaatgtc

SEQ ID NO: 25346 - DNA, 32 bp, Homo sapiens
gatgtgatttctgcccagtgctctgaatgtca

SEQ ID NO: 25347 - DNA, 16 bp, Homo sapiens
atgtgatttctgccca

SEQ ID NO: 25348 - DNA, 30 bp, Homo sapiens
atgtgatttctgcccagtgctctgaatgtc

SEQ ID NO: 25349 - DNA, 31 bp, Homo sapiens; identical to SEQ ID NO: 5624

SEQ ID NO: 25350 - DNA, 21 bp, Homo sapiens
tgtgatttctgcccagtgctc

SEQ ID NO: 25351 - DNA, 24 bp, Homo sapiens
tgtgatttctgcccagtgctctga

SEQ ID NO: 25352 - DNA, 25 bp, Homo sapiens
tgtgatttctgcccagtgctctgaa

SEQ ID NO: 25353 - DNA, 30 bp, Homo sapiens
tgtgatttctgcccagtgctctgaatgtca

SEQ ID NO: 25354 - DNA, 32 bp, Homo sapiens
tgtgatttctgcccagtgctctgaatgtcaaa

SEQ ID NO: 25355 - DNA, 25 bp, Homo sapiens
gtgatttctgcccagtgctctgaat

SEQ ID NO: 25356 - DNA, 28 bp, Homo sapiens
gtgatttctgcccagtgctctgaatgtc

SEQ ID NO: 25357 - DNA, 29 bp, Homo sapiens
gtgatttctgcccagtgctctgaatgtca

SEQ ID NO: 25358 - DNA, 27 bp, Homo sapiens
tgatttctgcccagtgctctgaatgtc

SEQ ID NO: 25359 - DNA, 31 bp, Homo sapiens
tgatttctgcccagtgctctgaatgtcaaag

SEQ ID NO: 25360 - DNA, 21 bp, Homo sapiens
gatttctgcccagtgctctga

SEQ ID NO: 25361 - DNA, 22 bp, Homo sapiens
gatttctgcccagtgctctgaa

SEQ ID NO: 25362 - DNA, 23 bp, Homo sapiens
gatttctgcccagtgctctgaat

SEQ ID NO: 25363 - DNA, 26 bp, Homo sapiens
gatttctgcccagtgctctgaatgtc

SEQ ID NO: 25364 - DNA, 20 bp, Homo sapiens
atttctgcccagtgctctga

SEQ ID NO: 25365 - DNA, 25 bp, Homo sapiens
atttctgcccagtgctctgaatgtc

SEQ ID NO: 25366 - DNA, 29 bp, Homo sapiens
atttctgcccagtgctctgaatgtcaaag

SEQ ID NO: 25367 - DNA, 31 bp, Homo sapiens
atttctgcccagtgctctgaatgtcaaagtg

SEQ ID NO: 25368 - DNA, 19 bp, Homo sapiens
tttctgcccagtgctctga

SEQ ID NO: 25369 - DNA, 20 bp, Homo sapiens
tttctgcccagtgctctgaa

SEQ ID NO: 25370 - DNA, 22 bp, Homo sapiens
tttctgcccagtgctctgaatg

SEQ ID NO: 25371 - DNA, 24 bp, Homo sapiens
tttctgcccagtgctctgaatgtc

SEQ ID NO: 25372 - DNA, 25 bp, Homo sapiens
tttctgcccagtgctctgaatgtca

SEQ ID NO: 25373 - DNA, 27 bp, Homo sapiens
tttctgcccagtgctctgaatgtcaaa

SEQ ID NO: 25374 - DNA, 28 bp, Homo sapiens
tttctgcccagtgctctgaatgtcaaag

SEQ ID NO: 25375 - DNA, 31 bp, Homo sapiens
tttctgcccagtgctctgaatgtcaaagtga

SEQ ID NO: 25376 - DNA, 33 bp, Homo sapiens
tttctgcccagtgctctgaatgtcaaagtgaag

SEQ ID NO: 25377 - DNA, 20 bp, Homo sapiens
ttctgcccagtgctctgaat

SEQ ID NO: 25378 - DNA, 21 bp, Homo sapiens
ttctgcccagtgctctgaatg

SEQ ID NO: 25379 - DNA, 23 bp, Homo sapiens
ttctgcccagtgctctgaatgtc

SEQ ID NO: 25380 - DNA, 24 bp, Homo sapiens
ttctgcccagtgctctgaatgtca

SEQ ID NO: 25381 - DNA, 27 bp, Homo sapiens
ttctgcccagtgctctgaatgtcaaag

SEQ ID NO: 25382 - DNA, 28 bp, Homo sapiens
ttctgcccagtgctctgaatgtcaaagt

SEQ ID NO: 25383 - DNA, 29 bp, Homo sapiens
ttctgcccagtgctctgaatgtcaaagtg

SEQ ID NO: 25384 - DNA, 32 bp, Homo sapiens; identical to SEQ ID NO: 5632

SEQ ID NO: 25385 - DNA, 33 bp, Homo sapiens; identical to SEQ ID NO: 5633

SEQ ID NO: 25386 - DNA, 38 bp, Homo sapiens
ttctgcccagtgctctgaatgtcaaagtgaagaaattc

SEQ ID NO: 25387 - DNA, 39 bp, Homo sapiens
ttctgcccagtgctctgaatgtcaaagtgaagaaattca

SEQ ID NO: 25388 - DNA, 16 bp, Homo sapiens
tctgcccagtgctctg

SEQ ID NO: 25389 - DNA, 17 bp, Homo sapiens
tctgcccagtgctctga

SEQ ID NO: 25390 - DNA, 18 bp, Homo sapiens
tctgcccagtgctctgaa

SEQ ID NO: 25391 - DNA, 19 bp, Homo sapiens
tctgcccagtgctctgaat

SEQ ID NO: 25392 - DNA, 20 bp, Homo sapiens
tctgcccagtgctctgaatg

SEQ ID NO: 25393 - DNA, 22 bp, Homo sapiens
tctgcccagtgctctgaatgtc

SEQ ID NO: 25394 - DNA, 23 bp, Homo sapiens
tctgcccagtgctctgaatgtca

SEQ ID NO: 25395 - DNA, 25 bp, Homo sapiens
tctgcccagtgctctgaatgtcaaa

SEQ ID NO: 25396 - DNA, 26 bp, Homo sapiens
tctgcccagtgctctgaatgtcaaag

SEQ ID NO: 25397 - DNA, 27 bp, Homo sapiens
tctgcccagtgctctgaatgtcaaagt

SEQ ID NO: 25398 - DNA, 28 bp, Homo sapiens
tctgcccagtgctctgaatgtcaaagtg

SEQ ID NO: 25399 - DNA, 29 bp, Homo sapiens
tctgcccagtgctctgaatgtcaaagtga

SEQ ID NO: 25400 - DNA, 31 bp, Homo sapiens; identical to SEQ ID NO: 5639

SEQ ID NO: 25401 - DNA, 32 bp, Homo sapiens; identical to SEQ ID NO: 5640

SEQ ID NO: 25402 - DNA, 38 bp, Homo sapiens
tctgcccagtgctctgaatgtcaaagtgaagaaattca

SEQ ID NO: 25403 - DNA, 17 bp, Homo sapiens
ctgcccagtgctctgaa

SEQ ID NO: 25404 - DNA, 18 bp, Homo sapiens
ctgcccagtgctctgaat

SEQ ID NO: 25405 - DNA, 19 bp, Homo sapiens
ctgcccagtgctctgaatg

SEQ ID NO: 25406 - DNA, 20 bp, Homo sapiens
ctgcccagtgctctgaatgt

SEQ ID NO: 25407 - DNA, 21 bp, Homo sapiens
ctgcccagtgctctgaatgtc

SEQ ID NO: 25408 - DNA, 22 bp, Homo sapiens
ctgcccagtgctctgaatgtca

SEQ ID NO: 25409 - DNA, 25 bp, Homo sapiens
ctgcccagtgctctgaatgtcaaag

SEQ ID NO: 25410 - DNA, 26 bp, Homo sapiens
ctgcccagtgctctgaatgtcaaagt

SEQ ID NO: 25411 - DNA, 27 bp, Homo sapiens
ctgcccagtgctctgaatgtcaaagtg

SEQ ID NO: 25412 - DNA, 30 bp, Homo sapiens; identical to SEQ ID NO: 5646

SEQ ID NO: 25413 - DNA, 31 bp, Homo sapiens; identical to SEQ ID NO: 5647

SEQ ID NO: 25414 - DNA, 32 bp, Homo sapiens
ctgcccagtgctctgaatgtcaaagtgaagaa

SEQ ID NO: 25415 - DNA, 35 bp, Homo sapiens
ctgcccagtgctctgaatgtcaaagtgaagaaatt

SEQ ID NO: 25416 - DNA, 36 bp, Homo sapiens
ctgcccagtgctctgaatgtcaaagtgaagaaattc

SEQ ID NO: 25417 - DNA, 40 bp, Homo sapiens
ctgcccagtgctctgaatgtcaaagtgaagaaattcaatg

SEQ ID NO: 25418 - DNA, 16 bp, Homo sapiens
tgcccagtgctctgaa

SEQ ID NO: 25419 - DNA, 17 bp, Homo sapiens
tgcccagtgctctgaat

SEQ ID NO: 25420 - DNA, 18 bp, Homo sapiens
tgcccagtgctctgaatg

SEQ ID NO: 25421 - DNA, 19 bp, Homo sapiens
tgcccagtgctctgaatgt

SEQ ID NO: 25422 - DNA, 20 bp, Homo sapiens
tgcccagtgctctgaatgtc

SEQ ID NO: 25423 - DNA, 21 bp, Homo sapiens
tgcccagtgctctgaatgtca

SEQ ID NO: 25424 - DNA, 23 bp, Homo sapiens
tgcccagtgctctgaatgtcaaa

SEQ ID NO: 25425 - DNA, 24 bp, Homo sapiens
tgcccagtgctctgaatgtcaaag

SEQ ID NO: 25426 - DNA, 25 bp, Homo sapiens
tgcccagtgctctgaatgtcaaagt

SEQ ID NO: 25427 - DNA, 26 bp, Homo sapiens
tgcccagtgctctgaatgtcaaagtg

SEQ ID NO: 25428 - DNA, 27 bp, Homo sapiens
tgcccagtgctctgaatgtcaaagtga

SEQ ID NO: 25429 - DNA, 29 bp, Homo sapiens
tgcccagtgctctgaatgtcaaagtgaag

SEQ ID NO: 25430 - DNA, 30 bp, Homo sapiens; identical to SEQ ID NO: 5659

SEQ ID NO: 25431 - DNA, 31 bp, Homo sapiens; identical to SEQ ID NO: 5660

SEQ ID NO: 25432 - DNA, 32 bp, Homo sapiens; identical to SEQ ID NO: 5661

SEQ ID NO: 25433 - DNA, 33 bp, Homo sapiens; identical to SEQ ID NO: 5662

SEQ ID NO: 25434 - DNA, 34 bp, Homo sapiens
tgcccagtgctctgaatgtcaaagtgaagaaatt

SEQ ID NO: 25435 - DNA, 35 bp, Homo sapiens
tgcccagtgctctgaatgtcaaagtgaagaaattc

SEQ ID NO: 25436 - DNA, 36 bp, Homo sapiens
tgcccagtgctctgaatgtcaaagtgaagaaattca

SEQ ID NO: 25437 - DNA, 37 bp, Homo sapiens
tgcccagtgctctgaatgtcaaagtgaagaaattcaa

SEQ ID NO: 25438 - DNA, 38 bp, Homo sapiens
tgcccagtgctctgaatgtcaaagtgaagaaattcaat

SEQ ID NO: 25439 - DNA, 39 bp, Homo sapiens
tgcccagtgctctgaatgtcaaagtgaagaaattcaatg

SEQ ID NO: 25440 - DNA, 40 bp, Homo sapiens
tgcccagtgctctgaatgtcaaagtgaagaaattcaatga

SEQ ID NO: 25441 - DNA, 42 bp, Homo sapiens
tgcccagtgctctgaatgtcaaagtgaagaaattcaatgaag

SEQ ID NO: 25442 - DNA, 43 bp, Homo sapiens
tgcccagtgctctgaatgtcaaagtgaagaaattcaatgaagc

SEQ ID NO: 25443 - DNA, 16 bp, Homo sapiens
gcccagtgctctgaat

SEQ ID NO: 25444 - DNA, 17 bp, Homo sapiens
gcccagtgctctgaatg

SEQ ID NO: 25445 - DNA, 18 bp, Homo sapiens
gcccagtgctctgaatgt

SEQ ID NO: 25446 - DNA, 19 bp, Homo sapiens
gcccagtgctctgaatgtc

SEQ ID NO: 25447 - DNA, 20 bp, Homo sapiens
gcccagtgctctgaatgtca

SEQ ID NO: 25448 - DNA, 22 bp, Homo sapiens
gcccagtgctctgaatgtcaaa

SEQ ID NO: 25449 - DNA, 23 bp, Homo sapiens
gcccagtgctctgaatgtcaaag

SEQ ID NO: 25450 - DNA, 24 bp, Homo sapiens
gcccagtgctctgaatgtcaaagt

SEQ ID NO: 25451 - DNA, 25 bp, Homo sapiens
gcccagtgctctgaatgtcaaagtg

SEQ ID NO: 25452 - DNA, 28 bp, Homo sapiens
gcccagtgctctgaatgtcaaagtgaag

SEQ ID NO: 25453 - DNA, 29 bp, Homo sapiens
gcccagtgctctgaatgtcaaagtgaaga

SEQ ID NO: 25454 - DNA, 30 bp, Homo sapiens; identical to SEQ ID NO: 5672

SEQ ID NO: 25455 - DNA, 31 bp, Homo sapiens; identical to SEQ ID NO: 5673

SEQ ID NO: 25456 - DNA, 32 bp, Homo sapiens; identical to SEQ ID NO: 5674

SEQ ID NO: 25457 - DNA, 33 bp, Homo sapiens; identical to SEQ ID NO: 5675

SEQ ID NO: 25458 - DNA, 34 bp, Homo sapiens
gcccagtgctctgaatgtcaaagtgaagaaattc

SEQ ID NO: 25459 - DNA, 35 bp, Homo sapiens
gcccagtgctctgaatgtcaaagtgaagaaattca

SEQ ID NO: 25460 - DNA, 38 bp, Homo sapiens
gcccagtgctctgaatgtcaaagtgaagaaattcaatg

SEQ ID NO: 25461 - DNA, 41 bp, Homo sapiens
gcccagtgctctgaatgtcaaagtgaagaaattcaatgaag

SEQ ID NO: 25462 - DNA, 18 bp, Homo sapiens
cccagtgctctgaatgtc

SEQ ID NO: 25463 - DNA, 19 bp, Homo sapiens
cccagtgctctgaatgtca

SEQ ID NO: 25464 - DNA, 22 bp, Homo sapiens
cccagtgctctgaatgtcaaag

SEQ ID NO: 25465 - DNA, 24 bp, Homo sapiens
cccagtgctctgaatgtcaaagtg

SEQ ID NO: 25466 - DNA, 27 bp, Homo sapiens
cccagtgctctgaatgtcaaagtgaag

SEQ ID NO: 25467 - DNA, 28 bp, Homo sapiens
cccagtgctctgaatgtcaaagtgaaga

SEQ ID NO: 25468 - DNA, 29 bp, Homo sapiens
cccagtgctctgaatgtcaaagtgaagaa

SEQ ID NO: 25469 - DNA, 32 bp, Homo sapiens
cccagtgctctgaatgtcaaagtgaagaaatt

SEQ ID NO: 25470 - DNA, 33 bp, Homo sapiens; identical to SEQ ID NO: 5679

SEQ ID NO: 25471 - DNA, 17 bp, Homo sapiens
ccagtgctctgaatgtc

SEQ ID NO: 25472 - DNA, 23 bp, Homo sapiens
ccagtgctctgaatgtcaaagtg

SEQ ID NO: 25473 - DNA, 32 bp, Homo sapiens
ccagtgctctgaatgtcaaagtgaagaaattc

SEQ ID NO: 25474 - DNA, 16 bp, Homo sapiens
cagtgctctgaatgtc

SEQ ID NO: 25475 - DNA, 17 bp, Homo sapiens
cagtgctctgaatgtca

SEQ ID NO: 25476 - DNA, 20 bp, Homo sapiens
cagtgctctgaatgtcaaag

SEQ ID NO: 25477 - DNA, 22 bp, Homo sapiens
cagtgctctgaatgtcaaagtg

SEQ ID NO: 25478 - DNA, 31 bp, Homo sapiens
cagtgctctgaatgtcaaagtgaagaaattc

SEQ ID NO: 25479 - DNA, 33 bp, Homo sapiens
cagtgctctgaatgtcaaagtgaagaaattcaa

SEQ ID NO: 25480 - DNA, 17 bp, Homo sapiens
gtgctctgaatgtcaaa

SEQ ID NO: 25481 - DNA, 21 bp, Homo sapiens
gtgctctgaatgtcaaagtga

SEQ ID NO: 25482 - DNA, 24 bp, Homo sapiens
gtgctctgaatgtcaaagtgaaga

SEQ ID NO: 25483 - DNA, 25 bp, Homo sapiens
gtgctctgaatgtcaaagtgaagaa

SEQ ID NO: 25484 - DNA, 26 bp, Homo sapiens
gtgctctgaatgtcaaagtgaagaaa

SEQ ID NO: 25485 - DNA, 30 bp, Homo sapiens
gtgctctgaatgtcaaagtgaagaaattca

SEQ ID NO: 25486 - DNA, 31 bp, Homo sapiens
gtgctctgaatgtcaaagtgaagaaattcaa

SEQ ID NO: 25487 - DNA, 19 bp, Homo sapiens
tgctctgaatgtcaaagtg

SEQ ID NO: 25488 - DNA, 23 bp, Homo sapiens
tgctctgaatgtcaaagtgaaga

SEQ ID NO: 25489 - DNA, 27 bp, Homo sapiens
tgctctgaatgtcaaagtgaagaaatt

SEQ ID NO: 25490 - DNA, 28 bp, Homo sapiens
tgctctgaatgtcaaagtgaagaaattc

SEQ ID NO: 25491 - DNA, 29 bp, Homo sapiens
tgctctgaatgtcaaagtgaagaaattca

SEQ ID NO: 25492 - DNA, 30 bp, Homo sapiens
tgctctgaatgtcaaagtgaagaaattcaa

SEQ ID NO: 25493 - DNA, 32 bp, Homo sapiens; identical to SEQ ID NO: 5683

SEQ ID NO: 25494 - DNA, 33 bp, Homo sapiens; identical to SEQ ID NO: 5684

SEQ ID NO: 25495 - DNA, 29 bp, Homo sapiens
gctctgaatgtcaaagtgaagaaattcaa

SEQ ID NO: 25496 - DNA, 28 bp, Homo sapiens
ctctgaatgtcaaagtgaagaaattcaa

SEQ ID NO: 25497 - DNA, 27 bp, Homo sapiens
tctgaatgtcaaagtgaagaaattcaa

SEQ ID NO: 25498 - DNA, 24 bp, Homo sapiens
ctgaatgtcaaagtgaagaaattc

SEQ ID NO: 25499 - DNA, 28 bp, Homo sapiens
ctgaatgtcaaagtgaagaaattcaatg

SEQ ID NO: 25500 - DNA, 32 bp, Homo sapiens
ctgaatgtcaaagtgaagaaattcaatgaagc

SEQ ID NO: 25501 - DNA, 22 bp, Homo sapiens
tgaatgtcaaagtgaagaaatt

SEQ ID NO: 25502 - DNA, 23 bp, Homo sapiens
tgaatgtcaaagtgaagaaattc

SEQ ID NO: 25503 - DNA, 21 bp, Homo sapiens
gaatgtcaaagtgaagaaatt

SEQ ID NO: 25504 - DNA, 22 bp, Homo sapiens
gaatgtcaaagtgaagaaattc

SEQ ID NO: 25505 - DNA, 26 bp, Homo sapiens
gaatgtcaaagtgaagaaattcaatg

SEQ ID NO: 25506 - DNA, 25 bp, Homo sapiens
aatgtcaaagtgaagaaattcaatg

SEQ ID NO: 25507 - DNA, 22 bp, Homo sapiens
atgtcaaagtgaagaaattcaa

SEQ ID NO: 25508 - DNA, 24 bp, Homo sapiens
atgtcaaagtgaagaaattcaatg

SEQ ID NO: 25509 - DNA, 34 bp, Homo sapiens
aaagtgaagaaattcaatgaagcgcgggtaaacg

SEQ ID NO: 25510 - DNA, 33 bp, Homo sapiens
aagtgaagaaattcaatgaagcgcgggtaaacg

SEQ ID NO: 25511 - DNA, 27 bp, Homo sapiens
gtgaagaaattcaatgaagcgcgggta

SEQ ID NO: 25512 - DNA, 30 bp, Homo sapiens
tgaagaaattcaatgaagcgcgggtaaacg

SEQ ID NO: 25513 - DNA, 24 bp, Homo sapiens
aagaaattcaatgaagcgcgggta

SEQ ID NO: 25514 - DNA, 27 bp, Homo sapiens
aagaaattcaatgaagcgcgggtaaac

SEQ ID NO: 25515 - DNA, 28 bp, Homo sapiens
aagaaattcaatgaagcgcgggtaaacg

SEQ ID NO: 25516 - DNA, 30 bp, Homo sapiens
aagaaattcaatgaagcgcgggtaaacggc

SEQ ID NO: 25517 - DNA, 31 bp, Homo sapiens
aagaaattcaatgaagcgcgggtaaacggcg

SEQ ID NO: 25518 - DNA, 33 bp, Homo sapiens
aagaaattcaatgaagcgcgggtaaacggcggg

SEQ ID NO: 25519 - DNA, 23 bp, Homo sapiens
agaaattcaatgaagcgcgggta

SEQ ID NO: 25520 - DNA, 27 bp, Homo sapiens
agaaattcaatgaagcgcgggtaaacg

SEQ ID NO: 25521 - DNA, 26 bp, Homo sapiens
gaaattcaatgaagcgcgggtaaacg

SEQ ID NO: 25522 - DNA, 20 bp, Homo sapiens
aattcaatgaagcgcgggta

SEQ ID NO: 25523 - DNA, 24 bp, Homo sapiens
aattcaatgaagcgcgggtaaacg

SEQ ID NO: 25524 - DNA, 19 bp, Homo sapiens
attcaatgaagcgcgggta

SEQ ID NO: 25525 - DNA, 23 bp, Homo sapiens
attcaatgaagcgcgggtaaacg

SEQ ID NO: 25526 - DNA, 20 bp, Homo sapiens
caatgaagcgcgggtaaacg

SEQ ID NO: 25527 - DNA, 18 bp, Homo sapiens
aatgaagcgcgggtaaac

SEQ ID NO: 25528 - DNA, 19 bp, Homo sapiens
aatgaagcgcgggtaaacg

SEQ ID NO: 25529 - DNA, 21 bp, Homo sapiens
aatgaagcgcgggtaaacggc

SEQ ID NO: 25530 - DNA, 24 bp, Homo sapiens
aatgaagcgcgggtaaacggcggg

SEQ ID NO: 25531 - DNA, 25 bp, Homo sapiens
aatgaagcgcgggtaaacggcggga

SEQ ID NO: 25532 - DNA, 28 bp, Homo sapiens
aatgaagcgcgggtaaacggcgggagta

SEQ ID NO: 25533 - DNA, 30 bp, Homo sapiens
aatgaagcgcgggtaaacggcgggagtaac

SEQ ID NO: 25534 - DNA, 32 bp, Homo sapiens
aatgaagcgcgggtaaacggcgggagtaacta

SEQ ID NO: 25535 - DNA, 18 bp, Homo sapiens
atgaagcgcgggtaaacg

SEQ ID NO: 25536 - DNA, 27 bp, Homo sapiens
atgaagcgcgggtaaacggcgggagta

SEQ ID NO: 25537 - DNA, 17 bp, Homo sapiens
tgaagcgcgggtaaacg

SEQ ID NO: 25538 - DNA, 16 bp, Homo sapiens
gaagcgcgggtaaacg

SEQ ID NO: 25539 - DNA, 24 bp, Homo sapiens
aagcgcgggtaaacggcgggagta

SEQ ID NO: 25540 - DNA, 26 bp, Homo sapiens
aagcgcgggtaaacggcgggagtaac

SEQ ID NO: 25541 - DNA, 28 bp, Homo sapiens
aagcgcgggtaaacggcgggagtaacta

SEQ ID NO: 25542 - DNA, 30 bp, Homo sapiens
aagcgcgggtaaacggcgggagtaactatg

SEQ ID NO: 25543 - DNA, 23 bp, Homo sapiens
agcgcgggtaaacggcgggagta

SEQ ID NO: 25544 - DNA, 27 bp, Homo sapiens
agcgcgggtaaacggcgggagtaacta

SEQ ID NO: 25545 - DNA, 29 bp, Homo sapiens
agcgcgggtaaacggcgggagtaactatg

SEQ ID NO: 25546 - DNA, 22 bp, Homo sapiens
gcgcgggtaaacggcgggagta

SEQ ID NO: 25547 - DNA, 20 bp, Homo sapiens
cgcgggtaaacggcgggagt

SEQ ID NO: 25548 - DNA, 21 bp, Homo sapiens
cgcgggtaaacggcgggagta

SEQ ID NO: 25549 - DNA, 25 bp, Homo sapiens
cgcgggtaaacggcgggagtaacta

SEQ ID NO: 25550 - DNA, 27 bp, Homo sapiens
cgcgggtaaacggcgggagtaactatg

SEQ ID NO: 25551 - DNA, 19 bp, Homo sapiens
gcgggtaaacggcgggagt

SEQ ID NO: 25552 - DNA, 20 bp, Homo sapiens
gcgggtaaacggcgggagta

SEQ ID NO: 25553 - DNA, 24 bp, Homo sapiens
gcgggtaaacggcgggagtaacta

SEQ ID NO: 25554 - DNA, 27 bp, Homo sapiens
cgggtaaacggcgggagtaactatgac

SEQ ID NO: 25555 - DNA, 30 bp, Homo sapiens
cgggtaaacggcgggagtaactatgactct

SEQ ID NO: 25556 - DNA, 32 bp, Homo sapiens
cgggtaaacggcgggagtaactatgactctct

SEQ ID NO: 25557 - DNA, 29 bp, Homo sapiens
gggtaaacggcgggagtaactatgactct

SEQ ID NO: 25558 - DNA, 31 bp, Homo sapiens
gggtaaacggcgggagtaactatgactctct

SEQ ID NO: 25559 - DNA, 25 bp, Homo sapiens
ggtaaacggcgggagtaactatgac

SEQ ID NO: 25560 - DNA, 26 bp, Homo sapiens
ggtaaacggcgggagtaactatgact

SEQ ID NO: 25561 - DNA, 27 bp, Homo sapiens
ggtaaacggcgggagtaactatgactc

SEQ ID NO: 25562 - DNA, 28 bp, Homo sapiens
ggtaaacggcgggagtaactatgactct

SEQ ID NO: 25563 - DNA, 29 bp, Homo sapiens
ggtaaacggcgggagtaactatgactctc

SEQ ID NO: 25564 - DNA, 30 bp, Homo sapiens; identical to SEQ ID NO: 5696

SEQ ID NO: 25565 - DNA, 31 bp, Homo sapiens
ggtaaacggcgggagtaactatgactctctt

SEQ ID NO: 25566 - DNA, 32 bp, Homo sapiens
ggtaaacggcgggagtaactatgactctctta

SEQ ID NO: 25567 - DNA, 39 bp, Homo sapiens
ggtaaacggcgggagtaactatgactctcttaaggtagc

SEQ ID NO: 25568 - DNA, 27 bp, Homo sapiens
gtaaacggcgggagtaactatgactct

SEQ ID NO: 25569 - DNA, 29 bp, Homo sapiens
gtaaacggcgggagtaactatgactctct

SEQ ID NO: 25570 - DNA, 26 bp, Homo sapiens
taaacggcgggagtaactatgactct

SEQ ID NO: 25571 - DNA, 17 bp, Homo sapiens
aaacggcgggagtaact

SEQ ID NO: 25572 - DNA, 27 bp, Homo sapiens
aaacggcgggagtaactatgactctct

SEQ ID NO: 25573 - DNA, 28 bp, Homo sapiens
aaacggcgggagtaactatgactctctt

SEQ ID NO: 25574 - DNA, 17 bp, Homo sapiens
aacggcgggagtaacta

SEQ ID NO: 25575 - DNA, 20 bp, Homo sapiens
aacggcgggagtaactatga

SEQ ID NO: 25576 - DNA, 21 bp, Homo sapiens
aacggcgggagtaactatgac

SEQ ID NO: 25577 - DNA, 22 bp, Homo sapiens
aacggcgggagtaactatgact

SEQ ID NO: 25578 - DNA, 23 bp, Homo sapiens
aacggcgggagtaactatgactc

SEQ ID NO: 25579 - DNA, 24 bp, Homo sapiens
aacggcgggagtaactatgactct

SEQ ID NO: 25580 - DNA, 25 bp, Homo sapiens
aacggcgggagtaactatgactctc

SEQ ID NO: 25581 - DNA, 26 bp, Homo sapiens
aacggcgggagtaactatgactctct

SEQ ID NO: 25582 - DNA, 28 bp, Homo sapiens
aacggcgggagtaactatgactctctta

SEQ ID NO: 25583 - DNA, 19 bp, Homo sapiens
acggcgggagtaactatga

SEQ ID NO: 25584 - DNA, 20 bp, Homo sapiens
acggcgggagtaactatgac

SEQ ID NO: 25585 - DNA, 22 bp, Homo sapiens
acggcgggagtaactatgactc

SEQ ID NO: 25586 - DNA, 23 bp, Homo sapiens
acggcgggagtaactatgactct

SEQ ID NO: 25587 - DNA, 24 bp, Homo sapiens
acggcgggagtaactatgactctc

SEQ ID NO: 25588 - DNA, 25 bp, Homo sapiens
acggcgggagtaactatgactctct

SEQ ID NO: 25589 - DNA, 27 bp, Homo sapiens
acggcgggagtaactatgactctctta

SEQ ID NO: 25590 - DNA, 18 bp, Homo sapiens
cggcgggagtaactatga

SEQ ID NO: 25591 - DNA, 19 bp, Homo sapiens
cggcgggagtaactatgac

SEQ ID NO: 25592 - DNA, 22 bp, Homo sapiens
cggcgggagtaactatgactct

SEQ ID NO: 25593 - DNA, 23 bp, Homo sapiens
cggcgggagtaactatgactctc

SEQ ID NO: 25594 - DNA, 26 bp, Homo sapiens
cggcgggagtaactatgactctctta

SEQ ID NO: 25595 - DNA, 29 bp, Homo sapiens
cggcgggagtaactatgactctcttaagg

SEQ ID NO: 25596 - DNA, 18 bp, Homo sapiens
ggcgggagtaactatgac

SEQ ID NO: 25597 - DNA, 19 bp, Homo sapiens
ggcgggagtaactatgact

SEQ ID NO: 25598 - DNA, 20 bp, Homo sapiens
ggcgggagtaactatgactc

SEQ ID NO: 25599 - DNA, 21 bp, Homo sapiens
ggcgggagtaactatgactct

SEQ ID NO: 25600 - DNA, 17 bp, Homo sapiens
gcgggagtaactatgac

SEQ ID NO: 25601 - DNA, 18 bp, Homo sapiens
gcgggagtaactatgact

SEQ ID NO: 25602 - DNA, 19 bp, Homo sapiens
gcgggagtaactatgactc

SEQ ID NO: 25603 - DNA, 20 bp, Homo sapiens
gcgggagtaactatgactct

SEQ ID NO: 25604 - DNA, 32 bp, Homo sapiens; identical to SEQ ID NO: 5705

SEQ ID NO: 25605 - DNA, 16 bp, Homo sapiens
cgggagtaactatgac

SEQ ID NO: 25606 - DNA, 18 bp, Homo sapiens
cgggagtaactatgactc

SEQ ID NO: 25607 - DNA, 19 bp, Homo sapiens
cgggagtaactatgactct

SEQ ID NO: 25608 - DNA, 17 bp, Homo sapiens
gggagtaactatgactc

SEQ ID NO: 25609 - DNA, 16 bp, Homo sapiens
ggagtaactatgactc

SEQ ID NO: 25610 - DNA, 28 bp, Homo sapiens
gagtaactatgactctcttaaggtagcc

SEQ ID NO: 25611 - DNA, 16 bp, Homo sapiens
agtaactatgactctc

SEQ ID NO: 25612 - DNA, 17 bp, Homo sapiens
agtaactatgactctct

SEQ ID NO: 25613 - DNA, 18 bp, Homo sapiens
agtaactatgactctctt

SEQ ID NO: 25614 - DNA, 19 bp, Homo sapiens
agtaactatgactctctta

SEQ ID NO: 25615 - DNA, 23 bp, Homo sapiens
agtaactatgactctcttaaggt

SEQ ID NO: 25616 - DNA, 24 bp, Homo sapiens
agtaactatgactctcttaaggta

SEQ ID NO: 25617 - DNA, 26 bp, Homo sapiens
agtaactatgactctcttaaggtagc

SEQ ID NO: 25618 - DNA, 27 bp, Homo sapiens
agtaactatgactctcttaaggtagcc

SEQ ID NO: 25619 - DNA, 28 bp, Homo sapiens
agtaactatgactctcttaaggtagcca

SEQ ID NO: 25620 - DNA, 32 bp, Homo sapiens
agtaactatgactctcttaaggtagccaaatg

SEQ ID NO: 25621 - DNA, 33 bp, Homo sapiens; identical to SEQ ID NO: 5717

SEQ ID NO: 25622 - DNA, 34 bp, Homo sapiens
agtaactatgactctcttaaggtagccaaatgcc

SEQ ID NO: 25623 - DNA, 35 bp, Homo sapiens
agtaactatgactctcttaaggtagccaaatgcct

SEQ ID NO: 25624 - DNA, 16 bp, Homo sapiens
gtaactatgactctct

SEQ ID NO: 25625 - DNA, 18 bp, Homo sapiens
gtaactatgactctctta

SEQ ID NO: 25626 - DNA, 19 bp, Homo sapiens
gtaactatgactctcttaa

SEQ ID NO: 25627 - DNA, 23 bp, Homo sapiens
gtaactatgactctcttaaggta

SEQ ID NO: 25628 - DNA, 26 bp, Homo sapiens
gtaactatgactctcttaaggtagcc

SEQ ID NO: 25629 - DNA, 27 bp, Homo sapiens
gtaactatgactctcttaaggtagcca

SEQ ID NO: 25630 - DNA, 33 bp, Homo sapiens
gtaactatgactctcttaaggtagccaaatgcc

SEQ ID NO: 25631 - DNA, 34 bp, Homo sapiens
gtaactatgactctcttaaggtagccaaatgcct

SEQ ID NO: 25632 - DNA, 17 bp, Homo sapiens
taactatgactctctta

SEQ ID NO: 25633 - DNA, 20 bp, Homo sapiens
taactatgactctcttaagg

SEQ ID NO: 25634 - DNA, 21 bp, Homo sapiens
taactatgactctcttaaggt

SEQ ID NO: 25635 - DNA, 22 bp, Homo sapiens
taactatgactctcttaaggta

SEQ ID NO: 25636 - DNA, 24 bp, Homo sapiens
taactatgactctcttaaggtagc

SEQ ID NO: 25637 - DNA, 25 bp, Homo sapiens
taactatgactctcttaaggtagcc

SEQ ID NO: 25638 - DNA, 26 bp, Homo sapiens
taactatgactctcttaaggtagcca

SEQ ID NO: 25639 - DNA, 32 bp, Homo sapiens; identical to SEQ ID NO: 5719

SEQ ID NO: 25640 - DNA, 33 bp, Homo sapiens; identical to SEQ ID NO: 5720

SEQ ID NO: 25641 - DNA, 16 bp, Homo sapiens
aactatgactctctta

SEQ ID NO: 25642 - DNA, 19 bp, Homo sapiens
aactatgactctcttaagg

SEQ ID NO: 25643 - DNA, 20 bp, Homo sapiens
aactatgactctcttaaggt

SEQ ID NO: 25644 - DNA, 21 bp, Homo sapiens
aactatgactctcttaaggta

SEQ ID NO: 25645 - DNA, 18 bp, Homo sapiens
actatgactctcttaagg

SEQ ID NO: 25646 - DNA, 19 bp, Homo sapiens
actatgactctcttaaggt

SEQ ID NO: 25647 - DNA, 20 bp, Homo sapiens
actatgactctcttaaggta

SEQ ID NO: 25648 - DNA, 18 bp, Homo sapiens
tgactctcttaaggtagc

SEQ ID NO: 25649 - DNA, 19 bp, Homo sapiens
cttaaggtagccaaatgcc

SEQ ID NO: 25650 - DNA, 20 bp, Homo sapiens
cttaaggtagccaaatgcct

SEQ ID NO: 25651 - DNA, 27 bp, Homo sapiens
cttaaggtagccaaatgcctcgtcatc

SEQ ID NO: 25652 - DNA, 28 bp, Homo sapiens
cttaaggtagccaaatgcctcgtcatct

SEQ ID NO: 25653 - DNA, 26 bp, Homo sapiens
ttaaggtagccaaatgcctcgtcatc

SEQ ID NO: 25654 - DNA, 27 bp, Homo sapiens
ttaaggtagccaaatgcctcgtcatct

SEQ ID NO: 25655 - DNA, 22 bp, Homo sapiens
taaggtagccaaatgcctcgtc

SEQ ID NO: 25656 - DNA, 25 bp, Homo sapiens
taaggtagccaaatgcctcgtcatc

SEQ ID NO: 25657 - DNA, 26 bp, Homo sapiens
taaggtagccaaatgcctcgtcatct

SEQ ID NO: 25658 - DNA, 27 bp, Homo sapiens
taaggtagccaaatgcctcgtcatcta

SEQ ID NO: 25659 - DNA, 21 bp, Homo sapiens
aaggtagccaaatgcctcgtc

SEQ ID NO: 25660 - DNA, 24 bp, Homo sapiens
aaggtagccaaatgcctcgtcatc

SEQ ID NO: 25661 - DNA, 25 bp, Homo sapiens
aaggtagccaaatgcctcgtcatct

SEQ ID NO: 25662 - DNA, 23 bp, Homo sapiens
aggtagccaaatgcctcgtcatc

SEQ ID NO: 25663 - DNA, 24 bp, Homo sapiens
aggtagccaaatgcctcgtcatct

SEQ ID NO: 25664 - DNA, 22 bp, Homo sapiens
ggtagccaaatgcctcgtcatc

SEQ ID NO: 25665 - DNA, 21 bp, Homo sapiens
gtagccaaatgcctcgtcatc

SEQ ID NO: 25666 - DNA, 22 bp, Homo sapiens
gtagccaaatgcctcgtcatct

SEQ ID NO: 25667 - DNA, 23 bp, Homo sapiens
gtagccaaatgcctcgtcatcta

SEQ ID NO: 25668 - DNA, 20 bp, Homo sapiens
tagccaaatgcctcgtcatc

SEQ ID NO: 25669 - DNA, 21 bp, Homo sapiens
tagccaaatgcctcgtcatct

SEQ ID NO: 25670 - DNA, 22 bp, Homo sapiens
tagccaaatgcctcgtcatcta

SEQ ID NO: 25671 - DNA, 19 bp, Homo sapiens
agccaaatgcctcgtcatc

SEQ ID NO: 25672 - DNA, 20 bp, Homo sapiens
agccaaatgcctcgtcatct

SEQ ID NO: 25673 - DNA, 21 bp, Homo sapiens
agccaaatgcctcgtcatcta

SEQ ID NO: 25674 - DNA, 17 bp, Homo sapiens
gccaaatgcctcgtcat

SEQ ID NO: 25675 - DNA, 18 bp, Homo sapiens
gccaaatgcctcgtcatc

SEQ ID NO: 25676 - DNA, 19 bp, Homo sapiens
gccaaatgcctcgtcatct

SEQ ID NO: 25677 - DNA, 20 bp, Homo sapiens
gccaaatgcctcgtcatcta

SEQ ID NO: 25678 - DNA, 21 bp, Homo sapiens
gccaaatgcctcgtcatctaa

SEQ ID NO: 25679 - DNA, 23 bp, Homo sapiens
gccaaatgcctcgtcatctaatt

SEQ ID NO: 25680 - DNA, 24 bp, Homo sapiens
gccaaatgcctcgtcatctaatta

SEQ ID NO: 25681 - DNA, 26 bp, Homo sapiens
gccaaatgcctcgtcatctaattagt

SEQ ID NO: 25682 - DNA, 28 bp, Homo sapiens
gccaaatgcctcgtcatctaattagtga

SEQ ID NO: 25683 - DNA, 17 bp, Homo sapiens
ccaaatgcctcgtcatc

SEQ ID NO: 25684 - DNA, 18 bp, Homo sapiens
ccaaatgcctcgtcatct

SEQ ID NO: 25685 - DNA, 19 bp, Homo sapiens
ccaaatgcctcgtcatcta

SEQ ID NO: 25686 - DNA, 16 bp, Homo sapiens
caaatgcctcgtcatc

SEQ ID NO: 25687 - DNA, 17 bp, Homo sapiens
caaatgcctcgtcatct

SEQ ID NO: 25688 - DNA, 18 bp, Homo sapiens
caaatgcctcgtcatcta

SEQ ID NO: 25689 - DNA, 16 bp, Homo sapiens
aaatgcctcgtcatct

SEQ ID NO: 25690 - DNA, 17 bp, Homo sapiens
aaatgcctcgtcatcta

SEQ ID NO: 25691 - DNA, 16 bp, Homo sapiens
aatgcctcgtcatcta

SEQ ID NO: 25692 - DNA, 17 bp, Homo sapiens
aatgcctcgtcatctaa

SEQ ID NO: 25693 - DNA, 20 bp, Homo sapiens
aatgcctcgtcatctaatta

SEQ ID NO: 25694 - DNA, 22 bp, Homo sapiens
aatgcctcgtcatctaattagt

SEQ ID NO: 25695 - DNA, 24 bp, Homo sapiens
aatgcctcgtcatctaattagtga

SEQ ID NO: 25696 - DNA, 28 bp, Homo sapiens
aatgcctcgtcatctaattagtgacgcg

SEQ ID NO: 25697 - DNA, 16 bp, Homo sapiens
atgcctcgtcatctaa

SEQ ID NO: 25698 - DNA, 19 bp, Homo sapiens
atgcctcgtcatctaatta

SEQ ID NO: 25699 - DNA, 21 bp, Homo sapiens
atgcctcgtcatctaattagt

SEQ ID NO: 25700 - DNA, 23 bp, Homo sapiens
atgcctcgtcatctaattagtga

SEQ ID NO: 25701 - DNA, 33 bp, Homo sapiens
atgcctcgtcatctaattagtgacgcgcatgaa

SEQ ID NO: 25702 - DNA, 25 bp, Homo sapiens
atctaattagtgacgcgcatgaatg

SEQ ID NO: 25703 - DNA, 38 bp, Homo sapiens
atctaattagtgacgcgcatgaatggatgaacgagatt

SEQ ID NO: 25704 - DNA, 43 bp, Homo sapiens
atctaattagtgacgcgcatgaatggatgaacgagattcccac

SEQ ID NO: 25705 - DNA, 44 bp, Homo sapiens
atctaattagtgacgcgcatgaatggatgaacgagattcccact

SEQ ID NO: 25706 - DNA, 18 bp, Homo sapiens
tctaattagtgacgcgca

SEQ ID NO: 25707 - DNA, 37 bp, Homo sapiens
tctaattagtgacgcgcatgaatggatgaacgagatt

SEQ ID NO: 25708 - DNA, 42 bp, Homo sapiens
tctaattagtgacgcgcatgaatggatgaacgagattcccac

SEQ ID NO: 25709 - DNA, 43 bp, Homo sapiens
tctaattagtgacgcgcatgaatggatgaacgagattcccact

SEQ ID NO: 25710 - DNA, 42 bp, Homo sapiens
ctaattagtgacgcgcatgaatggatgaacgagattcccact

SEQ ID NO: 25711 - DNA, 16 bp, Homo sapiens
taattagtgacgcgca

SEQ ID NO: 25712 - DNA, 18 bp, Homo sapiens
taattagtgacgcgcatg

SEQ ID NO: 25713 - DNA, 22 bp, Homo sapiens
taattagtgacgcgcatgaatg

SEQ ID NO: 25714 - DNA, 26 bp, Homo sapiens
taattagtgacgcgcatgaatggatg

SEQ ID NO: 25715 - DNA, 35 bp, Homo sapiens
taattagtgacgcgcatgaatggatgaacgagatt

SEQ ID NO: 25716 - DNA, 40 bp, Homo sapiens
taattagtgacgcgcatgaatggatgaacgagattcccac

SEQ ID NO: 25717 - DNA, 41 bp, Homo sapiens
taattagtgacgcgcatgaatggatgaacgagattcccact

SEQ ID NO: 25718 - DNA, 42 bp, Homo sapiens
taattagtgacgcgcatgaatggatgaacgagattcccactg

SEQ ID NO: 25719 - DNA, 17 bp, Homo sapiens
aattagtgacgcgcatg

SEQ ID NO: 25720 - DNA, 21 bp, Homo sapiens
aattagtgacgcgcatgaatg

SEQ ID NO: 25721 - DNA, 22 bp, Homo sapiens
aattagtgacgcgcatgaatgg

SEQ ID NO: 25722 - DNA, 24 bp, Homo sapiens
aattagtgacgcgcatgaatggat

SEQ ID NO: 25723 - DNA, 25 bp, Homo sapiens
aattagtgacgcgcatgaatggatg

SEQ ID NO: 25724 - DNA, 29 bp, Homo sapiens
aattagtgacgcgcatgaatggatgaacg

SEQ ID NO: 25725 - DNA, 33 bp, Homo sapiens; identical to SEQ ID NO: 5755

SEQ ID NO: 25726 - DNA, 34 bp, Homo sapiens
aattagtgacgcgcatgaatggatgaacgagatt

SEQ ID NO: 25727 - DNA, 35 bp, Homo sapiens
aattagtgacgcgcatgaatggatgaacgagattc

SEQ ID NO: 25728 - DNA, 36 bp, Homo sapiens
aattagtgacgcgcatgaatggatgaacgagattcc

SEQ ID NO: 25729 - DNA, 37 bp, Homo sapiens
aattagtgacgcgcatgaatggatgaacgagattccc

SEQ ID NO: 25730 - DNA, 38 bp, Homo sapiens
aattagtgacgcgcatgaatggatgaacgagattccca

SEQ ID NO: 25731 - DNA, 39 bp, Homo sapiens
aattagtgacgcgcatgaatggatgaacgagattcccac

SEQ ID NO: 25732 - DNA, 40 bp, Homo sapiens
aattagtgacgcgcatgaatggatgaacgagattcccact

SEQ ID NO: 25733 - DNA, 41 bp, Homo sapiens
aattagtgacgcgcatgaatggatgaacgagattcccactg

SEQ ID NO: 25734 - DNA, 16 bp, Homo sapiens
attagtgacgcgcatg

SEQ ID NO: 25735 - DNA, 17 bp, Homo sapiens
attagtgacgcgcatga

SEQ ID NO: 25736 - DNA, 20 bp, Homo sapiens
attagtgacgcgcatgaatg

SEQ ID NO: 25737 - DNA, 21 bp, Homo sapiens
attagtgacgcgcatgaatgg

SEQ ID NO: 25738 - DNA, 22 bp, Homo sapiens
attagtgacgcgcatgaatgga

SEQ ID NO: 25739 - DNA, 24 bp, Homo sapiens
attagtgacgcgcatgaatggatg

SEQ ID NO: 25740 - DNA, 25 bp, Homo sapiens
attagtgacgcgcatgaatggatga

SEQ ID NO: 25741 - DNA, 28 bp, Homo sapiens
attagtgacgcgcatgaatggatgaacg

SEQ ID NO: 25742 - DNA, 29 bp, Homo sapiens
attagtgacgcgcatgaatggatgaacga

SEQ ID NO: 25743 - DNA, 32 bp, Homo sapiens
attagtgacgcgcatgaatggatgaacgagat

SEQ ID NO: 25744 - DNA, 33 bp, Homo sapiens; identical to SEQ ID NO: 5758

SEQ ID NO: 25745 - DNA, 38 bp, Homo sapiens
attagtgacgcgcatgaatggatgaacgagattcccac

SEQ ID NO: 25746 - DNA, 39 bp, Homo sapiens
attagtgacgcgcatgaatggatgaacgagattcccact

SEQ ID NO: 25747 - DNA, 40 bp, Homo sapiens
attagtgacgcgcatgaatggatgaacgagattcccactg

SEQ ID NO: 25748 - DNA, 16 bp, Homo sapiens
ttagtgacgcgcatga

SEQ ID NO: 25749 - DNA, 19 bp, Homo sapiens
ttagtgacgcgcatgaatg

SEQ ID NO: 25750 - DNA, 21 bp, Homo sapiens
ttagtgacgcgcatgaatgga

SEQ ID NO: 25751 - DNA, 23 bp, Homo sapiens
ttagtgacgcgcatgaatggatg

SEQ ID NO: 25752 - DNA, 24 bp, Homo sapiens
ttagtgacgcgcatgaatggatga

SEQ ID NO: 25753 - DNA, 28 bp, Homo sapiens
ttagtgacgcgcatgaatggatgaacga

SEQ ID NO: 25754 - DNA, 31 bp, Homo sapiens
ttagtgacgcgcatgaatggatgaacgagat

SEQ ID NO: 25755 - DNA, 32 bp, Homo sapiens; identical to SEQ ID NO: 5760

SEQ ID NO: 25756 - DNA, 33 bp, Homo sapiens
ttagtgacgcgcatgaatggatgaacgagattc

SEQ ID NO: 25757 - DNA, 37 bp, Homo sapiens
ttagtgacgcgcatgaatggatgaacgagattcccac

SEQ ID NO: 25758 - DNA, 38 bp, Homo sapiens
ttagtgacgcgcatgaatggatgaacgagattcccact

SEQ ID NO: 25759 - DNA, 39 bp, Homo sapiens
ttagtgacgcgcatgaatggatgaacgagattcccactg

SEQ ID NO: 25760 - DNA, 18 bp, Homo sapiens
tagtgacgcgcatgaatg

SEQ ID NO: 25761 - DNA, 22 bp, Homo sapiens
tagtgacgcgcatgaatggatg

SEQ ID NO: 25762 - DNA, 30 bp, Homo sapiens
tagtgacgcgcatgaatggatgaacgagat

SEQ ID NO: 25763 - DNA, 31 bp, Homo sapiens; identical to SEQ ID NO: 5762

SEQ ID NO: 25764 - DNA, 32 bp, Homo sapiens
tagtgacgcgcatgaatggatgaacgagattc

SEQ ID NO: 25765 - DNA, 33 bp, Homo sapiens; identical to SEQ ID NO: 5763

SEQ ID NO: 25766 - DNA, 36 bp, Homo sapiens
tagtgacgcgcatgaatggatgaacgagattcccac

SEQ ID NO: 25767 - DNA, 37 bp, Homo sapiens
tagtgacgcgcatgaatggatgaacgagattcccact

SEQ ID NO: 25768 - DNA, 38 bp, Homo sapiens
tagtgacgcgcatgaatggatgaacgagattcccactg

SEQ ID NO: 25769 - DNA, 17 bp, Homo sapiens
agtgacgcgcatgaatg

SEQ ID NO: 25770 - DNA, 20 bp, Homo sapiens
agtgacgcgcatgaatggat

SEQ ID NO: 25771 - DNA, 21 bp, Homo sapiens
agtgacgcgcatgaatggatg

SEQ ID NO: 25772 - DNA, 25 bp, Homo sapiens
agtgacgcgcatgaatggatgaacg

SEQ ID NO: 25773 - DNA, 29 bp, Homo sapiens
agtgacgcgcatgaatggatgaacgagat

SEQ ID NO: 25774 - DNA, 30 bp, Homo sapiens; identical to SEQ ID NO: 5767

SEQ ID NO: 25775 - DNA, 31 bp, Homo sapiens; identical to SEQ ID NO: 5768

SEQ ID NO: 25776 - DNA, 32 bp, Homo sapiens; identical to SEQ ID NO: 5769

SEQ ID NO: 25777 - DNA, 33 bp, Homo sapiens; identical to SEQ ID NO: 5770

SEQ ID NO: 25778 - DNA, 35 bp, Homo sapiens
agtgacgcgcatgaatggatgaacgagattcccac

SEQ ID NO: 25779 - DNA, 36 bp, Homo sapiens
agtgacgcgcatgaatggatgaacgagattcccact

SEQ ID NO: 25780 - DNA, 37 bp, Homo sapiens
agtgacgcgcatgaatggatgaacgagattcccactg

SEQ ID NO: 25781 - DNA, 46 bp, Homo sapiens
agtgacgcgcatgaatggatgaacgagattcccactgtccctacct

SEQ ID NO: 25782 - DNA, 16 bp, Homo sapiens
gtgacgcgcatgaatg

SEQ ID NO: 25783 - DNA, 20 bp, Homo sapiens
gtgacgcgcatgaatggatg

SEQ ID NO: 25784 - DNA, 21 bp, Homo sapiens
gtgacgcgcatgaatggatga

SEQ ID NO: 25785 - DNA, 24 bp, Homo sapiens
gtgacgcgcatgaatggatgaacg

SEQ ID NO: 25786 - DNA, 25 bp, Homo sapiens
gtgacgcgcatgaatggatgaacga

SEQ ID NO: 25787 - DNA, 28 bp, Homo sapiens
gtgacgcgcatgaatggatgaacgagat

SEQ ID NO: 25788 - DNA, 29 bp, Homo sapiens
gtgacgcgcatgaatggatgaacgagatt

SEQ ID NO: 25789 - DNA, 30 bp, Homo sapiens
gtgacgcgcatgaatggatgaacgagattc

SEQ ID NO: 25790 - DNA, 31 bp, Homo sapiens; identical to SEQ ID NO: 5773

SEQ ID NO: 25791 - DNA, 32 bp, Homo sapiens; identical to SEQ ID NO: 5774

SEQ ID NO: 25792 - DNA, 33 bp, Homo sapiens; identical to SEQ ID NO: 5775

SEQ ID NO: 25793 - DNA, 34 bp, Homo sapiens
gtgacgcgcatgaatggatgaacgagattcccac

SEQ ID NO: 25794 - DNA, 35 bp, Homo sapiens
gtgacgcgcatgaatggatgaacgagattcccact

SEQ ID NO: 25795 - DNA, 36 bp, Homo sapiens
gtgacgcgcatgaatggatgaacgagattcccactg

SEQ ID NO: 25796 - DNA, 18 bp, Homo sapiens
tgacgcgcatgaatggat

SEQ ID NO: 25797 - DNA, 19 bp, Homo sapiens
tgacgcgcatgaatggatg

SEQ ID NO: 25798 - DNA, 23 bp, Homo sapiens
tgacgcgcatgaatggatgaacg

SEQ ID NO: 25799 - DNA, 27 bp, Homo sapiens
tgacgcgcatgaatggatgaacgagat

SEQ ID NO: 25800 - DNA, 28 bp, Homo sapiens
tgacgcgcatgaatggatgaacgagatt

SEQ ID NO: 25801 - DNA, 29 bp, Homo sapiens
tgacgcgcatgaatggatgaacgagattc

SEQ ID NO: 25802 - DNA, 30 bp, Homo sapiens; identical to SEQ ID NO: 5778

SEQ ID NO: 25803 - DNA, 31 bp, Homo sapiens; identical to SEQ ID NO: 5779

SEQ ID NO: 25804 - DNA, 32 bp, Homo sapiens; identical to SEQ ID NO: 5780

SEQ ID NO: 25805 - DNA, 33 bp, Homo sapiens; identical to SEQ ID NO: 5781

SEQ ID NO: 25806 - DNA, 34 bp, Homo sapiens
tgacgcgcatgaatggatgaacgagattcccact

SEQ ID NO: 25807 - DNA, 35 bp, Homo sapiens
tgacgcgcatgaatggatgaacgagattcccactg

SEQ ID NO: 25808 - DNA, 18 bp, Homo sapiens
gacgcgcatgaatggatg

SEQ ID NO: 25809 - DNA, 27 bp, Homo sapiens
gacgcgcatgaatggatgaacgagatt

SEQ ID NO: 25810 - DNA, 28 bp, Homo sapiens
gacgcgcatgaatggatgaacgagattc

SEQ ID NO: 25811 - DNA, 29 bp, Homo sapiens
gacgcgcatgaatggatgaacgagattcc

SEQ ID NO: 25812 - DNA, 30 bp, Homo sapiens; identical to SEQ ID NO: 5784

SEQ ID NO: 25813 - DNA, 31 bp, Homo sapiens; identical to SEQ ID NO: 5785

SEQ ID NO: 25814 - DNA, 32 bp, Homo sapiens; identical to SEQ ID NO: 5786

SEQ ID NO: 25815 - DNA, 33 bp, Homo sapiens; identical to SEQ ID NO: 5787

SEQ ID NO: 25816 - DNA, 17 bp, Homo sapiens
acgcgcatgaatggatg

SEQ ID NO: 25817 - DNA, 25 bp, Homo sapiens
acgcgcatgaatggatgaacgagat

SEQ ID NO: 25818 - DNA, 26 bp, Homo sapiens
acgcgcatgaatggatgaacgagatt

SEQ ID NO: 25819 - DNA, 27 bp, Homo sapiens
acgcgcatgaatggatgaacgagattc

SEQ ID NO: 25820 - DNA, 28 bp, Homo sapiens
acgcgcatgaatggatgaacgagattcc

SEQ ID NO: 25821 - DNA, 29 bp, Homo sapiens
acgcgcatgaatggatgaacgagattccc

SEQ ID NO: 25822 - DNA, 30 bp, Homo sapiens; identical to SEQ ID NO: 5791

SEQ ID NO: 25823 - DNA, 31 bp, Homo sapiens; identical to SEQ ID NO: 5792

SEQ ID NO: 25824 - DNA, 32 bp, Homo sapiens; identical to SEQ ID NO: 5793

SEQ ID NO: 25825 - DNA, 33 bp, Homo sapiens; identical to SEQ ID NO: 5794

SEQ ID NO: 25826 - DNA, 36 bp, Homo sapiens
acgcgcatgaatggatgaacgagattcccactgtcc

SEQ ID NO: 25827 - DNA, 16 bp, Homo sapiens
cgcgcatgaatggatg

SEQ ID NO: 25828 - DNA, 17 bp, Homo sapiens
cgcgcatgaatggatga

SEQ ID NO: 25829 - DNA, 19 bp, Homo sapiens
cgcgcatgaatggatgaac

SEQ ID NO: 25830 - DNA, 20 bp, Homo sapiens
cgcgcatgaatggatgaacg

SEQ ID NO: 25831 - DNA, 21 bp, Homo sapiens
cgcgcatgaatggatgaacga

SEQ ID NO: 25832 - DNA, 24 bp, Homo sapiens
cgcgcatgaatggatgaacgagat

SEQ ID NO: 25833 - DNA, 25 bp, Homo sapiens
cgcgcatgaatggatgaacgagatt

SEQ ID NO: 25834 - DNA, 26 bp, Homo sapiens
cgcgcatgaatggatgaacgagattc

SEQ ID NO: 25835 - DNA, 27 bp, Homo sapiens
cgcgcatgaatggatgaacgagattcc

SEQ ID NO: 25836 - DNA, 28 bp, Homo sapiens
cgcgcatgaatggatgaacgagattccc

SEQ ID NO: 25837 - DNA, 29 bp, Homo sapiens
cgcgcatgaatggatgaacgagattccca

SEQ ID NO: 25838 - DNA, 30 bp, Homo sapiens; identical to SEQ ID NO: 5796

SEQ ID NO: 25839 - DNA, 31 bp, Homo sapiens; identical to SEQ ID NO: 5797

SEQ ID NO: 25840 - DNA, 32 bp, Homo sapiens; identical to SEQ ID NO: 5798

SEQ ID NO: 25841 - DNA, 33 bp, Homo sapiens
cgcgcatgaatggatgaacgagattcccactgt

SEQ ID NO: 25842 - DNA, 35 bp, Homo sapiens
cgcgcatgaatggatgaacgagattcccactgtcc

SEQ ID NO: 25843 - DNA, 36 bp, Homo sapiens
cgcgcatgaatggatgaacgagattcccactgtccc

SEQ ID NO: 25844 - DNA, 30 bp, Homo sapiens
gcgcatgaatggatgaacgagattcccact

SEQ ID NO: 25845 - DNA, 22 bp, Homo sapiens
cgcatgaatggatgaacgagat

SEQ ID NO: 25846 - DNA, 27 bp, Homo sapiens
cgcatgaatggatgaacgagattccca

SEQ ID NO: 25847 - DNA, 29 bp, Homo sapiens
cgcatgaatggatgaacgagattcccact

SEQ ID NO: 25848 - DNA, 33 bp, Homo sapiens
cgcatgaatggatgaacgagattcccactgtcc

SEQ ID NO: 25849 - DNA, 28 bp, Homo sapiens
gcatgaatggatgaacgagattcccact

SEQ ID NO: 25850 - DNA, 32 bp, Homo sapiens
gcatgaatggatgaacgagattcccactgtcc

SEQ ID NO: 25851 - DNA, 33 bp, Homo sapiens
gcatgaatggatgaacgagattcccactgtccc

SEQ ID NO: 25852 - DNA, 20 bp, Homo sapiens
catgaatggatgaacgagat

SEQ ID NO: 25853 - DNA, 21 bp, Homo sapiens
catgaatggatgaacgagatt

SEQ ID NO: 25854 - DNA, 22 bp, Homo sapiens
catgaatggatgaacgagattc

SEQ ID NO: 25855 - DNA, 23 bp, Homo sapiens
catgaatggatgaacgagattcc

SEQ ID NO: 25856 - DNA, 24 bp, Homo sapiens
catgaatggatgaacgagattccc

SEQ ID NO: 25857 - DNA, 25 bp, Homo sapiens
catgaatggatgaacgagattccca

SEQ ID NO: 25858 - DNA, 26 bp, Homo sapiens
catgaatggatgaacgagattcccac

SEQ ID NO: 25859 - DNA, 27 bp, Homo sapiens
catgaatggatgaacgagattcccact

SEQ ID NO: 25860 - DNA, 28 bp, Homo sapiens
catgaatggatgaacgagattcccactg

SEQ ID NO: 25861 - DNA, 31 bp, Homo sapiens
catgaatggatgaacgagattcccactgtcc

SEQ ID NO: 25862 - DNA, 32 bp, Homo sapiens
catgaatggatgaacgagattcccactgtccc

SEQ ID NO: 25863 - DNA, 33 bp, Homo sapiens
catgaatggatgaacgagattcccactgtccct

SEQ ID NO: 25864 - DNA, 36 bp, Homo sapiens
catgaatggatgaacgagattcccactgtccctacc

SEQ ID NO: 25865 - DNA, 37 bp, Homo sapiens
catgaatggatgaacgagattcccactgtccctacct

SEQ ID NO: 25866 - DNA, 19 bp, Homo sapiens
atgaatggatgaacgagat

SEQ ID NO: 25867 - DNA, 20 bp, Homo sapiens
atgaatggatgaacgagatt

SEQ ID NO: 25868 - DNA, 25 bp, Homo sapiens
atgaatggatgaacgagattcccac

SEQ ID NO: 25869 - DNA, 26 bp, Homo sapiens
atgaatggatgaacgagattcccact

SEQ ID NO: 25870 - DNA, 31 bp, Homo sapiens
atgaatggatgaacgagattcccactgtccc

SEQ ID NO: 25871 - DNA, 33 bp, Homo sapiens
atgaatggatgaacgagattcccactgtcccta

SEQ ID NO: 25872 - DNA, 18 bp, Homo sapiens
tgaatggatgaacgagat

SEQ ID NO: 25873 - DNA, 19 bp, Homo sapiens
tgaatggatgaacgagatt

SEQ ID NO: 25874 - DNA, 23 bp, Homo sapiens
tgaatggatgaacgagattccca

SEQ ID NO: 25875 - DNA, 24 bp, Homo sapiens
tgaatggatgaacgagattcccac

SEQ ID NO: 25876 - DNA, 25 bp, Homo sapiens
tgaatggatgaacgagattcccact

SEQ ID NO: 25877 - DNA, 32 bp, Homo sapiens
tgaatggatgaacgagattcccactgtcccta

SEQ ID NO: 25878 - DNA, 16 bp, Homo sapiens
aatggatgaacgagat

SEQ ID NO: 25879 - DNA, 33 bp, Homo sapiens
aatggatgaacgagattcccactgtccctacct

SEQ ID NO: 25880 - DNA, 29 bp, Homo sapiens
atggatgaacgagattcccactgtcccta

SEQ ID NO: 25881 - DNA, 33 bp, Homo sapiens
atggatgaacgagattcccactgtccctaccta

SEQ ID NO: 25882 - DNA, 21 bp, Homo sapiens
tggatgaacgagattcccact

SEQ ID NO: 25883 - DNA, 28 bp, Homo sapiens
tgaacgagattcccactgtccctaccta

SEQ ID NO: 25884 - DNA, 31 bp, Homo sapiens
tgaacgagattcccactgtccctacctacta

SEQ ID NO: 25885 - DNA, 32 bp, Homo sapiens
gaacgagattcccactgtccctacctactatc

SEQ ID NO: 25886 - DNA, 33 bp, Homo sapiens
gaacgagattcccactgtccctacctactatcc

SEQ ID NO: 25887 - DNA, 30 bp, Homo sapiens
aacgagattcccactgtccctacctactat

SEQ ID NO: 25888 - DNA, 31 bp, Homo sapiens; identical to SEQ ID NO: 5808

SEQ ID NO: 25889 - DNA, 32 bp, Homo sapiens; identical to SEQ ID NO: 5809

SEQ ID NO: 25890 - DNA, 32 bp, Homo sapiens
acgagattcccactgtccctacctactatcca

SEQ ID NO: 25891 - DNA, 17 bp, Homo sapiens
gattcccactgtcccta

SEQ ID NO: 25892 - DNA, 21 bp, Homo sapiens
gattcccactgtccctaccta

SEQ ID NO: 25893 - DNA, 24 bp, Homo sapiens
gattcccactgtccctacctacta

SEQ ID NO: 25894 - DNA, 28 bp, Homo sapiens
gattcccactgtccctacctactatcca

SEQ ID NO: 25895 - DNA, 32 bp, Homo sapiens
gattcccactgtccctacctactatccagcga

SEQ ID NO: 25896 - DNA, 33 bp, Homo sapiens
gattcccactgtccctacctactatccagcgaa

SEQ ID NO: 25897 - DNA, 20 bp, Homo sapiens
cactgtccctacctactatc

SEQ ID NO: 25898 - DNA, 30 bp, Homo sapiens
cactgtccctacctactatccagcgaaacc

SEQ ID NO: 25899 - DNA, 16 bp, Homo sapiens
ctgtccctacctacta

SEQ ID NO: 25900 - DNA, 18 bp, Homo sapiens
ctgtccctacctactatc

SEQ ID NO: 25901 - DNA, 20 bp, Homo sapiens
ctgtccctacctactatcca

SEQ ID NO: 25902 - DNA, 24 bp, Homo sapiens
ctgtccctacctactatccagcga

SEQ ID NO: 25903 - DNA, 25 bp, Homo sapiens
ctgtccctacctactatccagcgaa

SEQ ID NO: 25904 - DNA, 27 bp, Homo sapiens
ctgtccctacctactatccagcgaaac

SEQ ID NO: 25905 - DNA, 28 bp, Homo sapiens
ctgtccctacctactatccagcgaaacc

SEQ ID NO: 25906 - DNA, 16 bp, Homo sapiens
gtccctacctactatc

SEQ ID NO: 25907 - DNA, 17 bp, Homo sapiens
gtccctacctactatcc

SEQ ID NO: 25908 - DNA, 30 bp, Homo sapiens
ccctacctactatccagcgaaaccacagcc

SEQ ID NO: 25909 - DNA, 22 bp, Homo sapiens
ctatccagcgaaaccacagcca

SEQ ID NO: 25910 - DNA, 19 bp, Homo sapiens
agggaacgggcttggcgga

SEQ ID NO: 25911 - DNA, 20 bp, Homo sapiens
agggaacgggcttggcggaa

SEQ ID NO: 25912 - DNA, 18 bp, Homo sapiens
gggaacgggcttggcgga

SEQ ID NO: 25913 - DNA, 19 bp, Homo sapiens
gggaacgggcttggcggaa

SEQ ID NO: 25914 - DNA, 17 bp, Homo sapiens
ggaacgggcttggcgga

SEQ ID NO: 25915 - DNA, 16 bp, Homo sapiens
aacgggcttggcggaa

SEQ ID NO: 25916 - DNA, 18 bp, Homo sapiens
aacgggcttggcggaatc

SEQ ID NO: 25917 - DNA, 26 bp, Homo sapiens
aacgggcttggcggaatcagcgggga

SEQ ID NO: 25918 - DNA, 17 bp, Homo sapiens
acgggcttggcggaatc

SEQ ID NO: 25919 - DNA, 18 bp, Homo sapiens
acgggcttggcggaatca

SEQ ID NO: 25920 - DNA, 25 bp, Homo sapiens
acgggcttggcggaatcagcgggga

SEQ ID NO: 25921 - DNA, 26 bp, Homo sapiens
acgggcttggcggaatcagcggggaa

SEQ ID NO: 25922 - DNA, 27 bp, Homo sapiens
acgggcttggcggaatcagcggggaaa

SEQ ID NO: 25923 - DNA, 29 bp, Homo sapiens
acgggcttggcggaatcagcggggaaaga

SEQ ID NO: 25924 - DNA, 30 bp, Homo sapiens
acgggcttggcggaatcagcggggaaagaa

SEQ ID NO: 25925 - DNA, 16 bp, Homo sapiens
cgggcttggcggaatc

SEQ ID NO: 25926 - DNA, 17 bp, Homo sapiens
cgggcttggcggaatca

SEQ ID NO: 25927 - DNA, 24 bp, Homo sapiens
cgggcttggcggaatcagcgggga

SEQ ID NO: 25928 - DNA, 25 bp, Homo sapiens
cgggcttggcggaatcagcggggaa

SEQ ID NO: 25929 - DNA, 26 bp, Homo sapiens
cgggcttggcggaatcagcggggaaa

SEQ ID NO: 25930 - DNA, 28 bp, Homo sapiens
cgggcttggcggaatcagcggggaaaga

SEQ ID NO: 25931 - DNA, 29 bp, Homo sapiens
cgggcttggcggaatcagcggggaaagaa

SEQ ID NO: 25932 - DNA, 31 bp, Homo sapiens
cgggcttggcggaatcagcggggaaagaaga

SEQ ID NO: 25933 - DNA, 16 bp, Homo sapiens
atcagcggggaaagaa

SEQ ID NO: 25934 - DNA, 16 bp, Homo sapiens
cggggaaagaagaccc

SEQ ID NO: 25935 - DNA, 25 bp, Homo sapiens
ggggaaagaagaccctgttgagctt

SEQ ID NO: 25936 - DNA, 28 bp, Homo sapiens
aaagaagaccctgttgagcttgactcta

SEQ ID NO: 25937 - DNA, 17 bp, Homo sapiens
aagaagaccctgttgag

SEQ ID NO: 25938 - DNA, 18 bp, Homo sapiens
aagaagaccctgttgagc

SEQ ID NO: 25939 - DNA, 19 bp, Homo sapiens
aagaagaccctgttgagct

SEQ ID NO: 25940 - DNA, 20 bp, Homo sapiens
aagaagaccctgttgagctt

SEQ ID NO: 25941 - DNA, 21 bp, Homo sapiens
aagaagaccctgttgagcttg

SEQ ID NO: 25942 - DNA, 22 bp, Homo sapiens
aagaagaccctgttgagcttga

SEQ ID NO: 25943 - DNA, 26 bp, Homo sapiens
aagaagaccctgttgagcttgactct

SEQ ID NO: 25944 - DNA, 27 bp, Homo sapiens
aagaagaccctgttgagcttgactcta

SEQ ID NO: 25945 - DNA, 28 bp, Homo sapiens
aagaagaccctgttgagcttgactctag

SEQ ID NO: 25946 - DNA, 29 bp, Homo sapiens
aagaagaccctgttgagcttgactctagt

SEQ ID NO: 25947 - DNA, 31 bp, Homo sapiens
aagaagaccctgttgagcttgactctagtct

SEQ ID NO: 25948 - DNA, 33 bp, Homo sapiens
aagaagaccctgttgagcttgactctagtctgg

SEQ ID NO: 25949 - DNA, 16 bp, Homo sapiens
agaagaccctgttgag

SEQ ID NO: 25950 - DNA, 17 bp, Homo sapiens
agaagaccctgttgagc

SEQ ID NO: 25951 - DNA, 18 bp, Homo sapiens
agaagaccctgttgagct

SEQ ID NO: 25952 - DNA, 19 bp, Homo sapiens
agaagaccctgttgagctt

SEQ ID NO: 25953 - DNA, 20 bp, Homo sapiens
agaagaccctgttgagcttg

SEQ ID NO: 25954 - DNA, 21 bp, Homo sapiens
agaagaccctgttgagcttga

SEQ ID NO: 25955 - DNA, 24 bp, Homo sapiens
agaagaccctgttgagcttgactc

SEQ ID NO: 25956 - DNA, 25 bp, Homo sapiens
agaagaccctgttgagcttgactct

SEQ ID NO: 25957 - DNA, 26 bp, Homo sapiens
agaagaccctgttgagcttgactcta

SEQ ID NO: 25958 - DNA, 27 bp, Homo sapiens
agaagaccctgttgagcttgactctag

SEQ ID NO: 25959 - DNA, 28 bp, Homo sapiens
agaagaccctgttgagcttgactctagt

SEQ ID NO: 25960 - DNA, 29 bp, Homo sapiens
agaagaccctgttgagcttgactctagtc

SEQ ID NO: 25961 - DNA, 30 bp, Homo sapiens
agaagaccctgttgagcttgactctagtct

SEQ ID NO: 25962 - DNA, 32 bp, Homo sapiens
agaagaccctgttgagcttgactctagtctgg

SEQ ID NO: 25963 - DNA, 16 bp, Homo sapiens
gaagaccctgttgagc

SEQ ID NO: 25964 - DNA, 17 bp, Homo sapiens
gaagaccctgttgagct

SEQ ID NO: 25965 - DNA, 18 bp, Homo sapiens
gaagaccctgttgagctt

SEQ ID NO: 25966 - DNA, 19 bp, Homo sapiens
gaagaccctgttgagcttg

SEQ ID NO: 25967 - DNA, 20 bp, Homo sapiens
gaagaccctgttgagcttga

SEQ ID NO: 25968 - DNA, 23 bp, Homo sapiens
gaagaccctgttgagcttgactc

SEQ ID NO: 25969 - DNA, 24 bp, Homo sapiens
gaagaccctgttgagcttgactct

SEQ ID NO: 25970 - DNA, 25 bp, Homo sapiens
gaagaccctgttgagcttgactcta

SEQ ID NO: 25971 - DNA, 26 bp, Homo sapiens
gaagaccctgttgagcttgactctag

SEQ ID NO: 25972 - DNA, 27 bp, Homo sapiens
gaagaccctgttgagcttgactctagt

SEQ ID NO: 25973 - DNA, 28 bp, Homo sapiens
gaagaccctgttgagcttgactctagtc

SEQ ID NO: 25974 - DNA, 29 bp, Homo sapiens
gaagaccctgttgagcttgactctagtct

SEQ ID NO: 25975 - DNA, 31 bp, Homo sapiens
gaagaccctgttgagcttgactctagtctgg

SEQ ID NO: 25976 - DNA, 33 bp, Homo sapiens
gaagaccctgttgagcttgactctagtctggca

SEQ ID NO: 25977 - DNA, 16 bp, Homo sapiens
aagaccctgttgagct

SEQ ID NO: 25978 - DNA, 17 bp, Homo sapiens
aagaccctgttgagctt

SEQ ID NO: 25979 - DNA, 20 bp, Homo sapiens
aagaccctgttgagcttgac

SEQ ID NO: 25980 - DNA, 22 bp, Homo sapiens
aagaccctgttgagcttgactc

SEQ ID NO: 25981 - DNA, 23 bp, Homo sapiens
aagaccctgttgagcttgactct

SEQ ID NO: 25982 - DNA, 24 bp, Homo sapiens
aagaccctgttgagcttgactcta

SEQ ID NO: 25983 - DNA, 25 bp, Homo sapiens
aagaccctgttgagcttgactctag

SEQ ID NO: 25984 - DNA, 26 bp, Homo sapiens
aagaccctgttgagcttgactctagt

SEQ ID NO: 25985 - DNA, 28 bp, Homo sapiens
aagaccctgttgagcttgactctagtct

SEQ ID NO: 25986 - DNA, 30 bp, Homo sapiens
aagaccctgttgagcttgactctagtctgg

SEQ ID NO: 25987 - DNA, 32 bp, Homo sapiens
aagaccctgttgagcttgactctagtctggca

SEQ ID NO: 25988 - DNA, 16 bp, Homo sapiens
agaccctgttgagctt

SEQ ID NO: 25989 - DNA, 17 bp, Homo sapiens
agaccctgttgagcttg

SEQ ID NO: 25990 - DNA, 18 bp, Homo sapiens
agaccctgttgagcttga

SEQ ID NO: 25991 - DNA, 21 bp, Homo sapiens
agaccctgttgagcttgactc

SEQ ID NO: 25992 - DNA, 22 bp, Homo sapiens
agaccctgttgagcttgactct

SEQ ID NO: 25993 - DNA, 23 bp, Homo sapiens
agaccctgttgagcttgactcta

SEQ ID NO: 25994 - DNA, 24 bp, Homo sapiens
agaccctgttgagcttgactctag

SEQ ID NO: 25995 - DNA, 25 bp, Homo sapiens
agaccctgttgagcttgactctagt

SEQ ID NO: 25996 - DNA, 26 bp, Homo sapiens
agaccctgttgagcttgactctagtc

SEQ ID NO: 25997 - DNA, 27 bp, Homo sapiens
agaccctgttgagcttgactctagtct

SEQ ID NO: 25998 - DNA, 29 bp, Homo sapiens
agaccctgttgagcttgactctagtctgg

SEQ ID NO: 25999 - DNA, 30 bp, Homo sapiens
agaccctgttgagcttgactctagtctggc

SEQ ID NO: 26000 - DNA, 31 bp, Homo sapiens
agaccctgttgagcttgactctagtctggca

SEQ ID NO: 26001 - DNA, 32 bp, Homo sapiens
agaccctgttgagcttgactctagtctggcac

SEQ ID NO: 26002 - DNA, 33 bp, Homo sapiens
agaccctgttgagcttgactctagtctggcacg

SEQ ID NO: 26003 - DNA, 16 bp, Homo sapiens
gaccctgttgagcttg

SEQ ID NO: 26004 - DNA, 17 bp, Homo sapiens
gaccctgttgagcttga

SEQ ID NO: 26005 - DNA, 18 bp, Homo sapiens
gaccctgttgagcttgac

SEQ ID NO: 26006 - DNA, 20 bp, Homo sapiens
gaccctgttgagcttgactc

SEQ ID NO: 26007 - DNA, 21 bp, Homo sapiens
gaccctgttgagcttgactct

SEQ ID NO: 26008 - DNA, 22 bp, Homo sapiens
gaccctgttgagcttgactcta

SEQ ID NO: 26009 - DNA, 23 bp, Homo sapiens
gaccctgttgagcttgactctag

SEQ ID NO: 26010 - DNA, 24 bp, Homo sapiens
gaccctgttgagcttgactctagt

SEQ ID NO: 26011 - DNA, 25 bp, Homo sapiens
gaccctgttgagcttgactctagtc

SEQ ID NO: 26012 - DNA, 26 bp, Homo sapiens
gaccctgttgagcttgactctagtct

SEQ ID NO: 26013 - DNA, 27 bp, Homo sapiens
gaccctgttgagcttgactctagtctg

SEQ ID NO: 26014 - DNA, 28 bp, Homo sapiens
gaccctgttgagcttgactctagtctgg

SEQ ID NO: 26015 - DNA, 29 bp, Homo sapiens
gaccctgttgagcttgactctagtctggc

SEQ ID NO: 26016 - DNA, 30 bp, Homo sapiens
gaccctgttgagcttgactctagtctggca

SEQ ID NO: 26017 - DNA, 31 bp, Homo sapiens
gaccctgttgagcttgactctagtctggcac

SEQ ID NO: 26018 - DNA, 32 bp, Homo sapiens
gaccctgttgagcttgactctagtctggcacg

SEQ ID NO: 26019 - DNA, 33 bp, Homo sapiens
gaccctgttgagcttgactctagtctggcacgg

SEQ ID NO: 26020 - DNA, 16 bp, Homo sapiens
accctgttgagcttga

SEQ ID NO: 26021 - DNA, 19 bp, Homo sapiens
accctgttgagcttgactc

SEQ ID NO: 26022 - DNA, 20 bp, Homo sapiens
accctgttgagcttgactct

SEQ ID NO: 26023 - DNA, 21 bp, Homo sapiens
accctgttgagcttgactcta

SEQ ID NO: 26024 - DNA, 23 bp, Homo sapiens
accctgttgagcttgactctagt

SEQ ID NO: 26025 - DNA, 24 bp, Homo sapiens
accctgttgagcttgactctagtc

SEQ ID NO: 26026 - DNA, 25 bp, Homo sapiens
accctgttgagcttgactctagtct

SEQ ID NO: 26027 - DNA, 26 bp, Homo sapiens
accctgttgagcttgactctagtctg

SEQ ID NO: 26028 - DNA, 27 bp, Homo sapiens
accctgttgagcttgactctagtctgg

SEQ ID NO: 26029 - DNA, 29 bp, Homo sapiens
accctgttgagcttgactctagtctggca

SEQ ID NO: 26030 - DNA, 32 bp, Homo sapiens
accctgttgagcttgactctagtctggcacgg

SEQ ID NO: 26031 - DNA, 18 bp, Homo sapiens
ccctgttgagcttgactc

SEQ ID NO: 26032 - DNA, 19 bp, Homo sapiens
ccctgttgagcttgactct

SEQ ID NO: 26033 - DNA, 20 bp, Homo sapiens
ccctgttgagcttgactcta

SEQ ID NO: 26034 - DNA, 23 bp, Homo sapiens
ccctgttgagcttgactctagtc

SEQ ID NO: 26035 - DNA, 24 bp, Homo sapiens
ccctgttgagcttgactctagtct

SEQ ID NO: 26036 - DNA, 26 bp, Homo sapiens
ccctgttgagcttgactctagtctgg

SEQ ID NO: 26037 - DNA, 27 bp, Homo sapiens
ccctgttgagcttgactctagtctggc

SEQ ID NO: 26038 - DNA, 28 bp, Homo sapiens
ccctgttgagcttgactctagtctggca

SEQ ID NO: 26039 - DNA, 29 bp, Homo sapiens
ccctgttgagcttgactctagtctggcac

SEQ ID NO: 26040 - DNA, 30 bp, Homo sapiens
ccctgttgagcttgactctagtctggcacg

SEQ ID NO: 26041 - DNA, 31 bp, Homo sapiens
ccctgttgagcttgactctagtctggcacgg

SEQ ID NO: 26042 - DNA, 17 bp, Homo sapiens
cctgttgagcttgactc

SEQ ID NO: 26043 - DNA, 18 bp, Homo sapiens
cctgttgagcttgactct

SEQ ID NO: 26044 - DNA, 19 bp, Homo sapiens
cctgttgagcttgactcta

SEQ ID NO: 26045 - DNA, 23 bp, Homo sapiens
cctgttgagcttgactctagtct

SEQ ID NO: 26046 - DNA, 33 bp, Homo sapiens
cctgttgagcttgactctagtctggcacggtga

SEQ ID NO: 26047 - DNA, 16 bp, Homo sapiens
ctgttgagcttgactc

SEQ ID NO: 26048 - DNA, 17 bp, Homo sapiens
ctgttgagcttgactct

SEQ ID NO: 26049 - DNA, 32 bp, Homo sapiens
ctgttgagcttgactctagtctggcacggtga

SEQ ID NO: 26050 - DNA, 33 bp, Homo sapiens
ctgttgagcttgactctagtctggcacggtgaa

SEQ ID NO: 26051 - DNA, 16 bp, Homo sapiens
tgttgagcttgactct

SEQ ID NO: 26052 - DNA, 31 bp, Homo sapiens
tgttgagcttgactctagtctggcacggtga

SEQ ID NO: 26053 - DNA, 32 bp, Homo sapiens
tgttgagcttgactctagtctggcacggtgaa

SEQ ID NO: 26054 - DNA, 29 bp, Homo sapiens
ttgagcttgactctagtctggcacggtga

SEQ ID NO: 26055 - DNA, 30 bp, Homo sapiens
ttgagcttgactctagtctggcacggtgaa

SEQ ID NO: 26056 - DNA, 32 bp, Homo sapiens
ttgagcttgactctagtctggcacggtgaaga

SEQ ID NO: 26057 - DNA, 28 bp, Homo sapiens
tgagcttgactctagtctggcacggtga

SEQ ID NO: 26058 - DNA, 29 bp, Homo sapiens
tgagcttgactctagtctggcacggtgaa

SEQ ID NO: 26059 - DNA, 31 bp, Homo sapiens
tgagcttgactctagtctggcacggtgaaga

SEQ ID NO: 26060 - DNA, 33 bp, Homo sapiens
tgagcttgactctagtctggcacggtgaagaga

SEQ ID NO: 26061 - DNA, 27 bp, Homo sapiens
agcttgactctagtctggcacggtgaa

SEQ ID NO: 26062 - DNA, 16 bp, Homo sapiens
gcttgactctagtctg

SEQ ID NO: 26063 - DNA, 17 bp, Homo sapiens
gcttgactctagtctgg

SEQ ID NO: 26064 - DNA, 25 bp, Homo sapiens
gcttgactctagtctggcacggtga

SEQ ID NO: 26065 - DNA, 26 bp, Homo sapiens
gcttgactctagtctggcacggtgaa

SEQ ID NO: 26066 - DNA, 30 bp, Homo sapiens
gcttgactctagtctggcacggtgaagaga

SEQ ID NO: 26067 - DNA, 21 bp, Homo sapiens
cttgactctagtctggcacgg

SEQ ID NO: 26068 - DNA, 24 bp, Homo sapiens
cttgactctagtctggcacggtga

SEQ ID NO: 26069 - DNA, 25 bp, Homo sapiens
cttgactctagtctggcacggtgaa

SEQ ID NO: 26070 - DNA, 27 bp, Homo sapiens
cttgactctagtctggcacggtgaaga

SEQ ID NO: 26071 - DNA, 29 bp, Homo sapiens
cttgactctagtctggcacggtgaagaga

SEQ ID NO: 26072 - DNA, 20 bp, Homo sapiens
ttgactctagtctggcacgg

SEQ ID NO: 26073 - DNA, 21 bp, Homo sapiens
ttgactctagtctggcacggt

SEQ ID NO: 26074 - DNA, 23 bp, Homo sapiens
ttgactctagtctggcacggtga

SEQ ID NO: 26075 - DNA, 24 bp, Homo sapiens
ttgactctagtctggcacggtgaa

SEQ ID NO: 26076 - DNA, 26 bp, Homo sapiens
ttgactctagtctggcacggtgaaga

SEQ ID NO: 26077 - DNA, 28 bp, Homo sapiens
ttgactctagtctggcacggtgaagaga

SEQ ID NO: 26078 - DNA, 17 bp, Homo sapiens
gactctagtctggcacg

SEQ ID NO: 26079 - DNA, 18 bp, Homo sapiens
gactctagtctggcacgg

SEQ ID NO: 26080 - DNA, 19 bp, Homo sapiens
gactctagtctggcacggt

SEQ ID NO: 26081 - DNA, 16 bp, Homo sapiens
actctagtctggcacg

SEQ ID NO: 26082 - DNA, 17 bp, Homo sapiens
actctagtctggcacgg

SEQ ID NO: 26083 - DNA, 16 bp, Homo sapiens
ctctagtctggcacgg

SEQ ID NO: 26084 - DNA, 17 bp, Homo sapiens
ctctagtctggcacggt

SEQ ID NO: 26085 - DNA, 19 bp, Homo sapiens
ctctagtctggcacggtga

SEQ ID NO: 26086 - DNA, 20 bp, Homo sapiens
ctctagtctggcacggtgaa

SEQ ID NO: 26087 - DNA, 22 bp, Homo sapiens
ctctagtctggcacggtgaaga

SEQ ID NO: 26088 - DNA, 23 bp, Homo sapiens
cacggtgaagagacatgagaggt

SEQ ID NO: 26089 - DNA, 29 bp, Homo sapiens
cacggtgaagagacatgagaggtgtagaa

SEQ ID NO: 26090 - DNA, 33 bp, Homo sapiens
cacggtgaagagacatgagaggtgtagaataag

SEQ ID NO: 26091 - DNA, 16 bp, Homo sapiens
cggtgaagagacatga

SEQ ID NO: 26092 - DNA, 18 bp, Homo sapiens
cggtgaagagacatgaga

SEQ ID NO: 26093 - DNA, 20 bp, Homo sapiens
cggtgaagagacatgagagg

SEQ ID NO: 26094 - DNA, 21 bp, Homo sapiens
cggtgaagagacatgagaggt

SEQ ID NO: 26095 - DNA, 24 bp, Homo sapiens
cggtgaagagacatgagaggtgta

SEQ ID NO: 26096 - DNA, 26 bp, Homo sapiens
cggtgaagagacatgagaggtgtaga

SEQ ID NO: 26097 - DNA, 27 bp, Homo sapiens
cggtgaagagacatgagaggtgtagaa

SEQ ID NO: 26098 - DNA, 29 bp, Homo sapiens
cggtgaagagacatgagaggtgtagaata

SEQ ID NO: 26099 - DNA, 21 bp, Homo sapiens
agagacatgagaggtgtagaa

SEQ ID NO: 26100 - DNA, 23 bp, Homo sapiens
agagacatgagaggtgtagaata

SEQ ID NO: 26101 - DNA, 30 bp, Homo sapiens
agagacatgagaggtgtagaataagtggga

SEQ ID NO: 26102 - DNA, 20 bp, Homo sapiens
gagacatgagaggtgtagaa

SEQ ID NO: 26103 - DNA, 22 bp, Homo sapiens
gagacatgagaggtgtagaata

SEQ ID NO: 26104 - DNA, 29 bp, Homo sapiens
gagacatgagaggtgtagaataagtggga

SEQ ID NO: 26105 - DNA, 17 bp, Homo sapiens
gacatgagaggtgtaga

SEQ ID NO: 26106 - DNA, 18 bp, Homo sapiens
gacatgagaggtgtagaa

SEQ ID NO: 26107 - DNA, 20 bp, Homo sapiens
gacatgagaggtgtagaata

SEQ ID NO: 26108 - DNA, 27 bp, Homo sapiens
gacatgagaggtgtagaataagtggga

SEQ ID NO: 26109 - DNA, 32 bp, Homo sapiens
gacatgagaggtgtagaataagtgggaggccc

SEQ ID NO: 26110 - DNA, 17 bp, Homo sapiens
acatgagaggtgtagaa

SEQ ID NO: 26111 - DNA, 26 bp, Homo sapiens
acatgagaggtgtagaataagtggga

SEQ ID NO: 26112 - DNA, 31 bp, Homo sapiens
acatgagaggtgtagaataagtgggaggccc

SEQ ID NO: 26113 - DNA, 33 bp, Homo sapiens
acatgagaggtgtagaataagtgggaggccccc

SEQ ID NO: 26114 - DNA, 16 bp, Homo sapiens
catgagaggtgtagaa

SEQ ID NO: 26115 - DNA, 17 bp, Homo sapiens
catgagaggtgtagaat

SEQ ID NO: 26116 - DNA, 18 bp, Homo sapiens
catgagaggtgtagaata

SEQ ID NO: 26117 - DNA, 19 bp, Homo sapiens
catgagaggtgtagaataa

SEQ ID NO: 26118 - DNA, 20 bp, Homo sapiens
catgagaggtgtagaataag

SEQ ID NO: 26119 - DNA, 21 bp, Homo sapiens
catgagaggtgtagaataagt

SEQ ID NO: 26120 - DNA, 24 bp, Homo sapiens
catgagaggtgtagaataagtggg

SEQ ID NO: 26121 - DNA, 25 bp, Homo sapiens
catgagaggtgtagaataagtggga

SEQ ID NO: 26122 - DNA, 29 bp, Homo sapiens
catgagaggtgtagaataagtgggaggcc

SEQ ID NO: 26123 - DNA, 30 bp, Homo sapiens
catgagaggtgtagaataagtgggaggccc

SEQ ID NO: 26124 - DNA, 31 bp, Homo sapiens
catgagaggtgtagaataagtgggaggcccc

SEQ ID NO: 26125 - DNA, 32 bp, Homo sapiens
catgagaggtgtagaataagtgggaggccccc

SEQ ID NO: 26126 - DNA, 28 bp, Homo sapiens
atgagaggtgtagaataagtgggaggcc

SEQ ID NO: 26127 - DNA, 29 bp, Homo sapiens
atgagaggtgtagaataagtgggaggccc

SEQ ID NO: 26128 - DNA, 31 bp, Homo sapiens
atgagaggtgtagaataagtgggaggccccc

SEQ ID NO: 26129 - DNA, 32 bp, Homo sapiens
atgagaggtgtagaataagtgggaggcccccg

SEQ ID NO: 26130 - DNA, 33 bp, Homo sapiens
atgagaggtgtagaataagtgggaggcccccgg

SEQ ID NO: 26131 - DNA, 34 bp, Homo sapiens
atgagaggtgtagaataagtgggaggcccccggc

SEQ ID NO: 26132 - DNA, 16 bp, Homo sapiens
tgagaggtgtagaata

SEQ ID NO: 26133 - DNA, 17 bp, Homo sapiens
tgagaggtgtagaataa

SEQ ID NO: 26134 - DNA, 19 bp, Homo sapiens
tgagaggtgtagaataagt

SEQ ID NO: 26135 - DNA, 20 bp, Homo sapiens
tgagaggtgtagaataagtg

SEQ ID NO: 26136 - DNA, 23 bp, Homo sapiens
tgagaggtgtagaataagtggga

SEQ ID NO: 26137 - DNA, 28 bp, Homo sapiens
tgagaggtgtagaataagtgggaggccc

SEQ ID NO: 26138 - DNA, 31 bp, Homo sapiens
tgagaggtgtagaataagtgggaggcccccg

SEQ ID NO: 26139 - DNA, 33 bp, Homo sapiens
tgagaggtgtagaataagtgggaggcccccggc

SEQ ID NO: 26140 - DNA, 27 bp, Homo sapiens
gagaggtgtagaataagtgggaggccc

SEQ ID NO: 26141 - DNA, 29 bp, Homo sapiens
gagaggtgtagaataagtgggaggccccc

SEQ ID NO: 26142 - DNA, 30 bp, Homo sapiens
gagaggtgtagaataagtgggaggcccccg

SEQ ID NO: 26143 - DNA, 31 bp, Homo sapiens
gagaggtgtagaataagtgggaggcccccgg

SEQ ID NO: 26144 - DNA, 32 bp, Homo sapiens
gagaggtgtagaataagtgggaggcccccggc

SEQ ID NO: 26145 - DNA, 24 bp, Homo sapiens
agaggtgtagaataagtgggaggc

SEQ ID NO: 26146 - DNA, 25 bp, Homo sapiens
agaggtgtagaataagtgggaggcc

SEQ ID NO: 26147 - DNA, 26 bp, Homo sapiens
agaggtgtagaataagtgggaggccc

SEQ ID NO: 26148 - DNA, 27 bp, Homo sapiens
agaggtgtagaataagtgggaggcccc

SEQ ID NO: 26149 - DNA, 28 bp, Homo sapiens
agaggtgtagaataagtgggaggccccc

SEQ ID NO: 26150 - DNA, 29 bp, Homo sapiens
agaggtgtagaataagtgggaggcccccg

SEQ ID NO: 26151 - DNA, 30 bp, Homo sapiens
agaggtgtagaataagtgggaggcccccgg

SEQ ID NO: 26152 - DNA, 16 bp, Homo sapiens
gaggtgtagaataagt

SEQ ID NO: 26153 - DNA, 18 bp, Homo sapiens
gaggtgtagaataagtgg

SEQ ID NO: 26154 - DNA, 19 bp, Homo sapiens
gaggtgtagaataagtggg

SEQ ID NO: 26155 - DNA, 20 bp, Homo sapiens
gaggtgtagaataagtggga

SEQ ID NO: 26156 - DNA, 24 bp, Homo sapiens
gaggtgtagaataagtgggaggcc

SEQ ID NO: 26157 - DNA, 25 bp, Homo sapiens
gaggtgtagaataagtgggaggccc

SEQ ID NO: 26158 - DNA, 27 bp, Homo sapiens
gaggtgtagaataagtgggaggccccc

SEQ ID NO: 26159 - DNA, 33 bp, Homo sapiens
gaggtgtagaataagtgggaggcccccggcgcc

SEQ ID NO: 26160 - DNA, 24 bp, Homo sapiens
aggtgtagaataagtgggaggccc

SEQ ID NO: 26161 - DNA, 25 bp, Homo sapiens
aggtgtagaataagtgggaggcccc

SEQ ID NO: 26162 - DNA, 18 bp, Homo sapiens
ggtgtagaataagtggga

SEQ ID NO: 26163 - DNA, 25 bp, Homo sapiens
ggtgtagaataagtgggaggccccc

SEQ ID NO: 26164 - DNA, 22 bp, Homo sapiens
gtgtagaataagtgggaggccc

SEQ ID NO: 26165 - DNA, 20 bp, Homo sapiens
gtagaataagtgggaggccc

SEQ ID NO: 26166 - DNA, 16 bp, Homo sapiens
aataagtgggaggccc

SEQ ID NO: 26167 - DNA, 22 bp, Homo sapiens
taagtgggaggcccccggcgcc

SEQ ID NO: 26168 - DNA, 23 bp, Homo sapiens
taagtgggaggcccccggcgccc

SEQ ID NO: 26169 - DNA, 17 bp, Homo sapiens
aggcccccggcgccccc

SEQ ID NO: 26170 - DNA, 31 bp, Homo sapiens
ggcccccggcgcccccccggtgtccccgcga

SEQ ID NO: 26171 - DNA, 16 bp, Homo sapiens
gcccccggcgcccccc

SEQ ID NO: 26172 - DNA, 17 bp, Homo sapiens
gcccccggcgccccccc

SEQ ID NO: 26173 - DNA, 23 bp, Homo sapiens
gcgcccccccggtgtccccgcga

SEQ ID NO: 26174 - DNA, 20 bp, Homo sapiens
ccccgcgaggggcccggggc

SEQ ID NO: 26175 - DNA, 21 bp, Homo sapiens
cccgcgaggggcccggggcgg

SEQ ID NO: 26176 - DNA, 30 bp, Homo sapiens
cgcgaggggcccggggcggggtccgccggc

SEQ ID NO: 26177 - DNA, 29 bp, Homo sapiens
gcgaggggcccggggcggggtccgccggc

SEQ ID NO: 26178 - DNA, 28 bp, Homo sapiens
cgaggggcccggggcggggtccgccggc

SEQ ID NO: 26179 - DNA, 26 bp, Homo sapiens
gaggggcccggggcggggtccgccgg

SEQ ID NO: 26180 - DNA, 27 bp, Homo sapiens
gaggggcccggggcggggtccgccggc

SEQ ID NO: 26181 - DNA, 28 bp, Homo sapiens
gaggggcccggggcggggtccgccggcc

SEQ ID NO: 26182 - DNA, 25 bp, Homo sapiens
aggggcccggggcggggtccgccgg

SEQ ID NO: 26183 - DNA, 26 bp, Homo sapiens
aggggcccggggcggggtccgccggc

SEQ ID NO: 26184 - DNA, 27 bp, Homo sapiens
aggggcccggggcggggtccgccggcc

SEQ ID NO: 26185 - DNA, 25 bp, Homo sapiens
ggggcccggggcggggtccgccggc

SEQ ID NO: 26186 - DNA, 26 bp, Homo sapiens
ggggcccggggcggggtccgccggcc

SEQ ID NO: 26187 - DNA, 20 bp, Homo sapiens
ccggggcggggtccgccggc

SEQ ID NO: 26188 - DNA, 21 bp, Homo sapiens
ccggggcggggtccgccggcc

SEQ ID NO: 26189 - DNA, 20 bp, Homo sapiens
ggcggggtccgccggccctg

SEQ ID NO: 26190 - DNA, 16 bp, Homo sapiens
gcggggtccgccggcc

SEQ ID NO: 26191 - DNA, 19 bp, Homo sapiens
gcggggtccgccggccctg

SEQ ID NO: 26192 - DNA, 18 bp, Homo sapiens
cggggtccgccggccctg

SEQ ID NO: 26193 - DNA, 16 bp, Homo sapiens
ggtccgccggccctgc

SEQ ID NO: 26194 - DNA, 20 bp, Homo sapiens
ggccctgcgggccgccggtg

SEQ ID NO: 26195 - DNA, 33 bp, Homo sapiens
ctgcgggccgccggtgaaataccactactctga

SEQ ID NO: 26196 - DNA, 22 bp, Homo sapiens
tgcgggccgccggtgaaatacc

SEQ ID NO: 26197 - DNA, 27 bp, Homo sapiens
tgcgggccgccggtgaaataccactac

SEQ ID NO: 26198 - DNA, 28 bp, Homo sapiens
tgcgggccgccggtgaaataccactact

SEQ ID NO: 26199 - DNA, 29 bp, Homo sapiens
tgcgggccgccggtgaaataccactactc

SEQ ID NO: 26200 - DNA, 30 bp, Homo sapiens
tgcgggccgccggtgaaataccactactct

SEQ ID NO: 26201 - DNA, 31 bp, Homo sapiens
tgcgggccgccggtgaaataccactactctg

SEQ ID NO: 26202 - DNA, 32 bp, Homo sapiens; identical to SEQ ID NO: 5835

SEQ ID NO: 26203 - DNA, 33 bp, Homo sapiens; identical to SEQ ID NO: 5836

SEQ ID NO: 26204 - DNA, 35 bp, Homo sapiens
tgcgggccgccggtgaaataccactactctgatcg

SEQ ID NO: 26205 - DNA, 26 bp, Homo sapiens
gcgggccgccggtgaaataccactac

SEQ ID NO: 26206 - DNA, 27 bp, Homo sapiens
gcgggccgccggtgaaataccactact

SEQ ID NO: 26207 - DNA, 28 bp, Homo sapiens
gcgggccgccggtgaaataccactactc

SEQ ID NO: 26208 - DNA, 29 bp, Homo sapiens
gcgggccgccggtgaaataccactactct

SEQ ID NO: 26209 - DNA, 30 bp, Homo sapiens; identical to SEQ ID NO: 5841

SEQ ID NO: 26210 - DNA, 31 bp, Homo sapiens; identical to SEQ ID NO: 5842

SEQ ID NO: 26211 - DNA, 32 bp, Homo sapiens; identical to SEQ ID NO: 5843

SEQ ID NO: 26212 - DNA, 33 bp, Homo sapiens
gcgggccgccggtgaaataccactactctgatc

SEQ ID NO: 26213 - DNA, 25 bp, Homo sapiens
cgggccgccggtgaaataccactac

SEQ ID NO: 26214 - DNA, 26 bp, Homo sapiens
cgggccgccggtgaaataccactact

SEQ ID NO: 26215 - DNA, 27 bp, Homo sapiens
cgggccgccggtgaaataccactactc

SEQ ID NO: 26216 - DNA, 28 bp, Homo sapiens
cgggccgccggtgaaataccactactct

SEQ ID NO: 26217 - DNA, 29 bp, Homo sapiens
cgggccgccggtgaaataccactactctg

SEQ ID NO: 26218 - DNA, 30 bp, Homo sapiens; identical to SEQ ID NO: 5848

SEQ ID NO: 26219 - DNA, 31 bp, Homo sapiens; identical to SEQ ID NO: 5849

SEQ ID NO: 26220 - DNA, 32 bp, Homo sapiens
cgggccgccggtgaaataccactactctgatc

SEQ ID NO: 26221 - DNA, 33 bp, Homo sapiens; identical to SEQ ID NO: 5850

SEQ ID NO: 26222 - DNA, 24 bp, Homo sapiens
gggccgccggtgaaataccactac

SEQ ID NO: 26223 - DNA, 25 bp, Homo sapiens
gggccgccggtgaaataccactact

SEQ ID NO: 26224 - DNA, 28 bp, Homo sapiens
gggccgccggtgaaataccactactctg

SEQ ID NO: 26225 - DNA, 29 bp, Homo sapiens
gggccgccggtgaaataccactactctga

SEQ ID NO: 26226 - DNA, 30 bp, Homo sapiens; identical to SEQ ID NO: 5852

SEQ ID NO: 26227 - DNA, 31 bp, Homo sapiens
gggccgccggtgaaataccactactctgatc

SEQ ID NO: 26228 - DNA, 33 bp, Homo sapiens
gggccgccggtgaaataccactactctgatcgt

SEQ ID NO: 26229 - DNA, 23 bp, Homo sapiens
ggccgccggtgaaataccactac

SEQ ID NO: 26230 - DNA, 24 bp, Homo sapiens
ggccgccggtgaaataccactact

SEQ ID NO: 26231 - DNA, 25 bp, Homo sapiens
ggccgccggtgaaataccactactc

SEQ ID NO: 26232 - DNA, 26 bp, Homo sapiens
ggccgccggtgaaataccactactct

SEQ ID NO: 26233 - DNA, 27 bp, Homo sapiens
ggccgccggtgaaataccactactctg

SEQ ID NO: 26234 - DNA, 28 bp, Homo sapiens
ggccgccggtgaaataccactactctga

SEQ ID NO: 26235 - DNA, 29 bp, Homo sapiens
ggccgccggtgaaataccactactctgat

SEQ ID NO: 26236 - DNA, 30 bp, Homo sapiens; identical to SEQ ID NO: 5857

SEQ ID NO: 26237 - DNA, 31 bp, Homo sapiens; identical to SEQ ID NO: 5858

SEQ ID NO: 26238 - DNA, 32 bp, Homo sapiens; identical to SEQ ID NO: 5859

SEQ ID NO: 26239 - DNA, 33 bp, Homo sapiens
ggccgccggtgaaataccactactctgatcgtt

SEQ ID NO: 26240 - DNA, 22 bp, Homo sapiens
gccgccggtgaaataccactac

SEQ ID NO: 26241 - DNA, 23 bp, Homo sapiens
gccgccggtgaaataccactact

SEQ ID NO: 26242 - DNA, 24 bp, Homo sapiens
gccgccggtgaaataccactactc

SEQ ID NO: 26243 - DNA, 25 bp, Homo sapiens
gccgccggtgaaataccactactct

SEQ ID NO: 26244 - DNA, 26 bp, Homo sapiens
gccgccggtgaaataccactactctg

SEQ ID NO: 26245 - DNA, 27 bp, Homo sapiens
gccgccggtgaaataccactactctga

SEQ ID NO: 26246 - DNA, 28 bp, Homo sapiens
gccgccggtgaaataccactactctgat

SEQ ID NO: 26247 - DNA, 29 bp, Homo sapiens
gccgccggtgaaataccactactctgatc

SEQ ID NO: 26248 - DNA, 30 bp, Homo sapiens; identical to SEQ ID NO: 5864

SEQ ID NO: 26249 - DNA, 31 bp, Homo sapiens; identical to SEQ ID NO: 5865

SEQ ID NO: 26250 - DNA, 32 bp, Homo sapiens
gccgccggtgaaataccactactctgatcgtt

SEQ ID NO: 26251 - DNA, 33 bp, Homo sapiens; identical to SEQ ID NO: 5866

SEQ ID NO: 26252 - DNA, 26 bp, Homo sapiens
ccgccggtgaaataccactactctga

SEQ ID NO: 26253 - DNA, 27 bp, Homo sapiens
ccgccggtgaaataccactactctgat

SEQ ID NO: 26254 - DNA, 20 bp, Homo sapiens
aaataccactactctgatcg

SEQ ID NO: 26255 - DNA, 16 bp, Homo sapiens
aataccactactctga

SEQ ID NO: 26256 - DNA, 17 bp, Homo sapiens
aataccactactctgat

SEQ ID NO: 26257 - DNA, 19 bp, Homo sapiens
aataccactactctgatcg

SEQ ID NO: 26258 - DNA, 20 bp, Homo sapiens
aataccactactctgatcgt

SEQ ID NO: 26259 - DNA, 22 bp, Homo sapiens
aataccactactctgatcgttt

SEQ ID NO: 26260 - DNA, 27 bp, Homo sapiens
aataccactactctgatcgttttttca

SEQ ID NO: 26261 - DNA, 29 bp, Homo sapiens
aataccactactctgatcgttttttcact

SEQ ID NO: 26262 - DNA, 30 bp, Homo sapiens
aataccactactctgatcgttttttcactg

SEQ ID NO: 26263 - DNA, 31 bp, Homo sapiens
aataccactactctgatcgttttttcactga

SEQ ID NO: 26264 - DNA, 16 bp, Homo sapiens
ataccactactctgat

SEQ ID NO: 26265 - DNA, 18 bp, Homo sapiens
ataccactactctgatcg

SEQ ID NO: 26266 - DNA, 19 bp, Homo sapiens
ataccactactctgatcgt

SEQ ID NO: 26267 - DNA, 21 bp, Homo sapiens
ataccactactctgatcgttt

SEQ ID NO: 26268 - DNA, 26 bp, Homo sapiens
ataccactactctgatcgttttttca

SEQ ID NO: 26269 - DNA, 28 bp, Homo sapiens
ataccactactctgatcgttttttcact

SEQ ID NO: 26270 - DNA, 29 bp, Homo sapiens
ataccactactctgatcgttttttcactg

SEQ ID NO: 26271 - DNA, 30 bp, Homo sapiens
ataccactactctgatcgttttttcactga

SEQ ID NO: 26272 - DNA, 17 bp, Homo sapiens
taccactactctgatcg

SEQ ID NO: 26273 - DNA, 20 bp, Homo sapiens
taccactactctgatcgttt

SEQ ID NO: 26274 - DNA, 25 bp, Homo sapiens
taccactactctgatcgttttttca

SEQ ID NO: 26275 - DNA, 27 bp, Homo sapiens
taccactactctgatcgttttttcact

SEQ ID NO: 26276 - DNA, 28 bp, Homo sapiens
taccactactctgatcgttttttcactg

SEQ ID NO: 26277 - DNA, 29 bp, Homo sapiens
taccactactctgatcgttttttcactga

SEQ ID NO: 26278 - DNA, 33 bp, Homo sapiens
taccactactctgatcgttttttcactgacccg

SEQ ID NO: 26279 - DNA, 16 bp, Homo sapiens
accactactctgatcg

SEQ ID NO: 26280 - DNA, 28 bp, Homo sapiens
accactactctgatcgttttttcactga

SEQ ID NO: 26281 - DNA, 31 bp, Homo sapiens
accactactctgatcgttttttcactgaccc

SEQ ID NO: 26282 - DNA, 32 bp, Homo sapiens; identical to SEQ ID NO: 5867

SEQ ID NO: 26283 - DNA, 33 bp, Homo sapiens
accactactctgatcgttttttcactgacccgg

SEQ ID NO: 26284 - DNA, 25 bp, Homo sapiens
ccactactctgatcgttttttcact

SEQ ID NO: 26285 - DNA, 26 bp, Homo sapiens
ccactactctgatcgttttttcactg

SEQ ID NO: 26286 - DNA, 27 bp, Homo sapiens
ccactactctgatcgttttttcactga

SEQ ID NO: 26287 - DNA, 31 bp, Homo sapiens
ccactactctgatcgttttttcactgacccg

SEQ ID NO: 26288 - DNA, 32 bp, Homo sapiens
ccactactctgatcgttttttcactgacccgg

SEQ ID NO: 26289 - DNA, 33 bp, Homo sapiens
ccactactctgatcgttttttcactgacccggt

SEQ ID NO: 26290 - DNA, 30 bp, Homo sapiens
cactactctgatcgttttttcactgacccg

SEQ ID NO: 26291 - DNA, 27 bp, Homo sapiens
actactctgatcgttttttcactgacc

SEQ ID NO: 26292 - DNA, 28 bp, Homo sapiens
actactctgatcgttttttcactgaccc

SEQ ID NO: 26293 - DNA, 29 bp, Homo sapiens
actactctgatcgttttttcactgacccg

SEQ ID NO: 26294 - DNA, 30 bp, Homo sapiens
actactctgatcgttttttcactgacccgg

SEQ ID NO: 26295 - DNA, 31 bp, Homo sapiens
actactctgatcgttttttcactgacccggt

SEQ ID NO: 26296 - DNA, 20 bp, Homo sapiens
ctactctgatcgttttttca

SEQ ID NO: 26297 - DNA, 22 bp, Homo sapiens
ctactctgatcgttttttcact

SEQ ID NO: 26298 - DNA, 24 bp, Homo sapiens
ctactctgatcgttttttcactga

SEQ ID NO: 26299 - DNA, 27 bp, Homo sapiens
ctactctgatcgttttttcactgaccc

SEQ ID NO: 26300 - DNA, 28 bp, Homo sapiens
ctactctgatcgttttttcactgacccg

SEQ ID NO: 26301 - DNA, 29 bp, Homo sapiens
ctactctgatcgttttttcactgacccgg

SEQ ID NO: 26302 - DNA, 30 bp, Homo sapiens
ctactctgatcgttttttcactgacccggt

SEQ ID NO: 26303 - DNA, 31 bp, Homo sapiens
ctactctgatcgttttttcactgacccggtg

SEQ ID NO: 26304 - DNA, 32 bp, Homo sapiens
ctactctgatcgttttttcactgacccggtga

SEQ ID NO: 26305 - DNA, 27 bp, Homo sapiens
actctgatcgttttttcactgacccgg

SEQ ID NO: 26306 - DNA, 28 bp, Homo sapiens
actctgatcgttttttcactgacccggt

SEQ ID NO: 26307 - DNA, 17 bp, Homo sapiens
ctctgatcgttttttca

SEQ ID NO: 26308 - DNA, 19 bp, Homo sapiens
ctctgatcgttttttcact

SEQ ID NO: 26309 - DNA, 21 bp, Homo sapiens
ctctgatcgttttttcactga

SEQ ID NO: 26310 - DNA, 24 bp, Homo sapiens
ctctgatcgttttttcactgaccc

SEQ ID NO: 26311 - DNA, 25 bp, Homo sapiens
ctctgatcgttttttcactgacccg

SEQ ID NO: 26312 - DNA, 26 bp, Homo sapiens
ctctgatcgttttttcactgacccgg

SEQ ID NO: 26313 - DNA, 27 bp, Homo sapiens
ctctgatcgttttttcactgacccggt

SEQ ID NO: 26314 - DNA, 28 bp, Homo sapiens
ctctgatcgttttttcactgacccggtg

SEQ ID NO: 26315 - DNA, 29 bp, Homo sapiens
ctctgatcgttttttcactgacccggtga

SEQ ID NO: 26316 - DNA, 32 bp, Homo sapiens
ctctgatcgttttttcactgacccggtgaggc

SEQ ID NO: 26317 - DNA, 33 bp, Homo sapiens
ctctgatcgttttttcactgacccggtgaggcg

SEQ ID NO: 26318 - DNA, 24 bp, Homo sapiens
tctgatcgttttttcactgacccg

SEQ ID NO: 26319 - DNA, 25 bp, Homo sapiens
ctgacccggtgaggcgggggggcga

SEQ ID NO: 26320 - DNA, 21 bp, Homo sapiens
cccggtgaggcgggggggcga

SEQ ID NO: 26321 - DNA, 20 bp, Homo sapiens
gaggcgggggggcgagcccc

SEQ ID NO: 26322 - DNA, 30 bp, Homo sapiens
gaggcgggggggcgagccccgaggggctct

SEQ ID NO: 26323 - DNA, 31 bp, Homo sapiens
gaggcgggggggcgagccccgaggggctctc

SEQ ID NO: 26324 - DNA, 29 bp, Homo sapiens
agccccgaggggctctcgcttctggcgcc

SEQ ID NO: 26325 - DNA, 25 bp, Homo sapiens
gccccgaggggctctcgcttctggc

SEQ ID NO: 26326 - DNA, 23 bp, Homo sapiens
ccccgaggggctctcgcttctgg

SEQ ID NO: 26327 - DNA, 24 bp, Homo sapiens
ccccgaggggctctcgcttctggc

SEQ ID NO: 26328 - DNA, 27 bp, Homo sapiens
ccccgaggggctctcgcttctggcgcc

SEQ ID NO: 26329 - DNA, 28 bp, Homo sapiens
ccccgaggggctctcgcttctggcgcca

SEQ ID NO: 26330 - DNA, 29 bp, Homo sapiens
ccccgaggggctctcgcttctggcgccaa

SEQ ID NO: 26331 - DNA, 36 bp, Homo sapiens
ccccgaggggctctcgcttctggcgccaagcgcccg

SEQ ID NO: 26332 - DNA, 37 bp, Homo sapiens
ccccgaggggctctcgcttctggcgccaagcgcccgg

SEQ ID NO: 26333 - DNA, 38 bp, Homo sapiens
ccccgaggggctctcgcttctggcgccaagcgcccggc

SEQ ID NO: 26334 - DNA, 39 bp, Homo sapiens
ccccgaggggctctcgcttctggcgccaagcgcccggcc

SEQ ID NO: 26335 - DNA, 40 bp, Homo sapiens
ccccgaggggctctcgcttctggcgccaagcgcccggccg

SEQ ID NO: 26336 - DNA, 23 bp, Homo sapiens
cccgaggggctctcgcttctggc

SEQ ID NO: 26337 - DNA, 26 bp, Homo sapiens
cccgaggggctctcgcttctggcgcc

SEQ ID NO: 26338 - DNA, 27 bp, Homo sapiens
cccgaggggctctcgcttctggcgcca

SEQ ID NO: 26339 - DNA, 28 bp, Homo sapiens
cccgaggggctctcgcttctggcgccaa

SEQ ID NO: 26340 - DNA, 29 bp, Homo sapiens
cccgaggggctctcgcttctggcgccaag

SEQ ID NO: 26341 - DNA, 33 bp, Homo sapiens
cccgaggggctctcgcttctggcgccaagcgcc

SEQ ID NO: 26342 - DNA, 35 bp, Homo sapiens
cccgaggggctctcgcttctggcgccaagcgcccg

SEQ ID NO: 26343 - DNA, 36 bp, Homo sapiens
cccgaggggctctcgcttctggcgccaagcgcccgg

SEQ ID NO: 26344 - DNA, 37 bp, Homo sapiens
cccgaggggctctcgcttctggcgccaagcgcccggc

SEQ ID NO: 26345 - DNA, 38 bp, Homo sapiens
cccgaggggctctcgcttctggcgccaagcgcccggcc

SEQ ID NO: 26346 - DNA, 39 bp, Homo sapiens
cccgaggggctctcgcttctggcgccaagcgcccggccg

SEQ ID NO: 26347 - DNA, 16 bp, Homo sapiens
ccgaggggctctcgct

SEQ ID NO: 26348 - DNA, 21 bp, Homo sapiens
ccgaggggctctcgcttctgg

SEQ ID NO: 26349 - DNA, 22 bp, Homo sapiens
ccgaggggctctcgcttctggc

SEQ ID NO: 26350 - DNA, 23 bp, Homo sapiens
ccgaggggctctcgcttctggcg

SEQ ID NO: 26351 - DNA, 24 bp, Homo sapiens
ccgaggggctctcgcttctggcgc

SEQ ID NO: 26352 - DNA, 25 bp, Homo sapiens
ccgaggggctctcgcttctggcgcc

SEQ ID NO: 26353 - DNA, 26 bp, Homo sapiens
ccgaggggctctcgcttctggcgcca

SEQ ID NO: 26354 - DNA, 27 bp, Homo sapiens
ccgaggggctctcgcttctggcgccaa

SEQ ID NO: 26355 - DNA, 28 bp, Homo sapiens
ccgaggggctctcgcttctggcgccaag

SEQ ID NO: 26356 - DNA, 29 bp, Homo sapiens
ccgaggggctctcgcttctggcgccaagc

SEQ ID NO: 26357 - DNA, 32 bp, Homo sapiens; identical to SEQ ID NO: 5878

SEQ ID NO: 26358 - DNA, 33 bp, Homo sapiens; identical to SEQ ID NO: 5879

SEQ ID NO: 26359 - DNA, 34 bp, Homo sapiens
ccgaggggctctcgcttctggcgccaagcgcccg

SEQ ID NO: 26360 - DNA, 35 bp, Homo sapiens
ccgaggggctctcgcttctggcgccaagcgcccgg

SEQ ID NO: 26361 - DNA, 36 bp, Homo sapiens
ccgaggggctctcgcttctggcgccaagcgcccggc

SEQ ID NO: 26362 - DNA, 37 bp, Homo sapiens
ccgaggggctctcgcttctggcgccaagcgcccggcc

SEQ ID NO: 26363 - DNA, 38 bp, Homo sapiens
ccgaggggctctcgcttctggcgccaagcgcccggccg

SEQ ID NO: 26364 - DNA, 23 bp, Homo sapiens
cgaggggctctcgcttctggcgc

SEQ ID NO: 26365 - DNA, 24 bp, Homo sapiens
cgaggggctctcgcttctggcgcc

SEQ ID NO: 26366 - DNA, 25 bp, Homo sapiens
cgaggggctctcgcttctggcgcca

SEQ ID NO: 26367 - DNA, 32 bp, Homo sapiens
cgaggggctctcgcttctggcgccaagcgccc

SEQ ID NO: 26368 - DNA, 33 bp, Homo sapiens
cgaggggctctcgcttctggcgccaagcgcccg

SEQ ID NO: 26369 - DNA, 36 bp, Homo sapiens
cgaggggctctcgcttctggcgccaagcgcccggcc

SEQ ID NO: 26370 - DNA, 23 bp, Homo sapiens
gaggggctctcgcttctggcgcc

SEQ ID NO: 26371 - DNA, 24 bp, Homo sapiens
gaggggctctcgcttctggcgcca

SEQ ID NO: 26372 - DNA, 32 bp, Homo sapiens
gaggggctctcgcttctggcgccaagcgcccg

SEQ ID NO: 26373 - DNA, 33 bp, Homo sapiens; identical to SEQ ID NO: 5882

SEQ ID NO: 26374 - DNA, 35 bp, Homo sapiens
gaggggctctcgcttctggcgccaagcgcccggcc

SEQ ID NO: 26375 - DNA, 36 bp, Homo sapiens
gaggggctctcgcttctggcgccaagcgcccggccg

SEQ ID NO: 26376 - DNA, 22 bp, Homo sapiens
aggggctctcgcttctggcgcc

SEQ ID NO: 26377 - DNA, 23 bp, Homo sapiens
aggggctctcgcttctggcgcca

SEQ ID NO: 26378 - DNA, 24 bp, Homo sapiens
aggggctctcgcttctggcgccaa

SEQ ID NO: 26379 - DNA, 31 bp, Homo sapiens
aggggctctcgcttctggcgccaagcgcccg

SEQ ID NO: 26380 - DNA, 32 bp, Homo sapiens; identical to SEQ ID NO: 5884

SEQ ID NO: 26381 - DNA, 33 bp, Homo sapiens; identical to SEQ ID NO: 5885

SEQ ID NO: 26382 - DNA, 34 bp, Homo sapiens
aggggctctcgcttctggcgccaagcgcccggcc

SEQ ID NO: 26383 - DNA, 35 bp, Homo sapiens
aggggctctcgcttctggcgccaagcgcccggccg

SEQ ID NO: 26384 - DNA, 21 bp, Homo sapiens
ggggctctcgcttctggcgcc

SEQ ID NO: 26385 - DNA, 22 bp, Homo sapiens
ggggctctcgcttctggcgcca

SEQ ID NO: 26386 - DNA, 23 bp, Homo sapiens
ggggctctcgcttctggcgccaa

SEQ ID NO: 26387 - DNA, 30 bp, Homo sapiens
ggggctctcgcttctggcgccaagcgcccg

SEQ ID NO: 26388 - DNA, 31 bp, Homo sapiens
ggggctctcgcttctggcgccaagcgcccgg

SEQ ID NO: 26389 - DNA, 32 bp, Homo sapiens
ggggctctcgcttctggcgccaagcgcccggc

SEQ ID NO: 26390 - DNA, 33 bp, Homo sapiens; identical to SEQ ID NO: 5886

SEQ ID NO: 26391 - DNA, 21 bp, Homo sapiens
gggctctcgcttctggcgcca

SEQ ID NO: 26392 - DNA, 16 bp, Homo sapiens
gctctcgcttctggcg

SEQ ID NO: 26393 - DNA, 26 bp, Homo sapiens
gctctcgcttctggcgccaagcgccc

SEQ ID NO: 26394 - DNA, 27 bp, Homo sapiens
gctctcgcttctggcgccaagcgcccg

SEQ ID NO: 26395 - DNA, 28 bp, Homo sapiens
gctctcgcttctggcgccaagcgcccgg

SEQ ID NO: 26396 - DNA, 29 bp, Homo sapiens
gctctcgcttctggcgccaagcgcccggc

SEQ ID NO: 26397 - DNA, 30 bp, Homo sapiens
gctctcgcttctggcgccaagcgcccggcc

SEQ ID NO: 26398 - DNA, 26 bp, Homo sapiens
ctctcgcttctggcgccaagcgcccg

SEQ ID NO: 26399 - DNA, 27 bp, Homo sapiens
ctctcgcttctggcgccaagcgcccgg

SEQ ID NO: 26400 - DNA, 28 bp, Homo sapiens
ctctcgcttctggcgccaagcgcccggc

SEQ ID NO: 26401 - DNA, 29 bp, Homo sapiens
ctctcgcttctggcgccaagcgcccggcc

SEQ ID NO: 26402 - DNA, 26 bp, Homo sapiens
tctcgcttctggcgccaagcgcccgg

SEQ ID NO: 26403 - DNA, 27 bp, Homo sapiens
tctcgcttctggcgccaagcgcccggc

SEQ ID NO: 26404 - DNA, 23 bp, Homo sapiens
ctcgcttctggcgccaagcgccc

SEQ ID NO: 26405 - DNA, 24 bp, Homo sapiens
ctcgcttctggcgccaagcgcccg

SEQ ID NO: 26406 - DNA, 25 bp, Homo sapiens
ctcgcttctggcgccaagcgcccgg

SEQ ID NO: 26407 - DNA, 26 bp, Homo sapiens
ctcgcttctggcgccaagcgcccggc

SEQ ID NO: 26408 - DNA, 27 bp, Homo sapiens
ctcgcttctggcgccaagcgcccggcc

SEQ ID NO: 26409 - DNA, 24 bp, Homo sapiens
cgcttctggcgccaagcgcccggc

SEQ ID NO: 26410 - DNA, 22 bp, Homo sapiens
cttctggcgccaagcgcccggc

SEQ ID NO: 26411 - DNA, 23 bp, Homo sapiens
cttctggcgccaagcgcccggcc

SEQ ID NO: 26412 - DNA, 24 bp, Homo sapiens
cttctggcgccaagcgcccggccg

SEQ ID NO: 26413 - DNA, 23 bp, Homo sapiens
ttctggcgccaagcgcccggccg

SEQ ID NO: 26414 - DNA, 20 bp, Homo sapiens
tctggcgccaagcgcccggc

SEQ ID NO: 26415 - DNA, 22 bp, Homo sapiens
tctggcgccaagcgcccggccg

SEQ ID NO: 26416 - DNA, 21 bp, Homo sapiens
ctggcgccaagcgcccggccg

SEQ ID NO: 26417 - DNA, 19 bp, Homo sapiens
tggcgccaagcgcccggcc

SEQ ID NO: 26418 - DNA, 20 bp, Homo sapiens
tggcgccaagcgcccggccg

SEQ ID NO: 26419 - DNA, 25 bp, Homo sapiens
cggccgcgcgccggccgggcgcgac

SEQ ID NO: 26420 - DNA, 17 bp, Homo sapiens
ccgcgcgccggccgggc

SEQ ID NO: 26421 - DNA, 18 bp, Homo sapiens
ccgcgcgccggccgggcg

SEQ ID NO: 26422 - DNA, 16 bp, Homo sapiens
cgcgcgccggccgggc

SEQ ID NO: 26423 - DNA, 17 bp, Homo sapiens
cgcgcgccggccgggcg

SEQ ID NO: 26424 - DNA, 16 bp, Homo sapiens
gcgcgccggccgggcg

SEQ ID NO: 26425 - DNA, 31 bp, Homo sapiens
gcgccggccgggcgcgacccgctccggggac

SEQ ID NO: 26426 - DNA, 30 bp, Homo sapiens
cgccggccgggcgcgacccgctccggggac

SEQ ID NO: 26427 - DNA, 16 bp, Homo sapiens
gccggccgggcgcgac

SEQ ID NO: 26428 - DNA, 29 bp, Homo sapiens
gccggccgggcgcgacccgctccggggac

SEQ ID NO: 26429 - DNA, 16 bp, Homo sapiens
ccggccgggcgcgacc

SEQ ID NO: 26430 - DNA, 17 bp, Homo sapiens
ccggccgggcgcgaccc

SEQ ID NO: 26431 - DNA, 18 bp, Homo sapiens
ccggccgggcgcgacccg

SEQ ID NO: 26432 - DNA, 21 bp, Homo sapiens
ccggccgggcgcgacccgctc

SEQ ID NO: 26433 - DNA, 16 bp, Homo sapiens
cggccgggcgcgaccc

SEQ ID NO: 26434 - DNA, 18 bp, Homo sapiens
cggccgggcgcgacccgc

SEQ ID NO: 26435 - DNA, 27 bp, Homo sapiens
cggccgggcgcgacccgctccggggac

SEQ ID NO: 26436 - DNA, 22 bp, Homo sapiens
cgggcgcgacccgctccgggga

SEQ ID NO: 26437 - DNA, 23 bp, Homo sapiens
cgggcgcgacccgctccggggac

SEQ ID NO: 26438 - DNA, 22 bp, Homo sapiens
gggcgcgacccgctccggggac

SEQ ID NO: 26439 - DNA, 16 bp, Homo sapiens
gacccgctccggggac

SEQ ID NO: 26440 - DNA, 17 bp, Homo sapiens
ggtggggagtttgactg

SEQ ID NO: 26441 - DNA, 31 bp, Homo sapiens
tggggagtttgactggggcggtacacctgtc

SEQ ID NO: 26442 - DNA, 32 bp, Homo sapiens
tggggagtttgactggggcggtacacctgtca

SEQ ID NO: 26443 - DNA, 29 bp, Homo sapiens
gggagtttgactggggcggtacacctgtc

SEQ ID NO: 26444 - DNA, 30 bp, Homo sapiens
gggagtttgactggggcggtacacctgtca

SEQ ID NO: 26445 - DNA, 17 bp, Homo sapiens
gtttgactggggcggta

SEQ ID NO: 26446 - DNA, 24 bp, Homo sapiens
gtttgactggggcggtacacctgt

SEQ ID NO: 26447 - DNA, 26 bp, Homo sapiens
gtttgactggggcggtacacctgtca

SEQ ID NO: 26448 - DNA, 19 bp, Homo sapiens
ctggggcggtacacctgtc

SEQ ID NO: 26449 - DNA, 20 bp, Homo sapiens
ctggggcggtacacctgtca

SEQ ID NO: 26450 - DNA, 22 bp, Homo sapiens
ctggggcggtacacctgtcaaa

SEQ ID NO: 26451 - DNA, 26 bp, Homo sapiens
ctggggcggtacacctgtcaaacggt

SEQ ID NO: 26452 - DNA, 27 bp, Homo sapiens
ctggggcggtacacctgtcaaacggta

SEQ ID NO: 26453 - DNA, 32 bp, Homo sapiens
ctggggcggtacacctgtcaaacggtaacgca

SEQ ID NO: 26454 - DNA, 25 bp, Homo sapiens
aacggtaacgcaggtgtcctaaggc

SEQ ID NO: 26455 - DNA, 26 bp, Homo sapiens
aacggtaacgcaggtgtcctaaggcg

SEQ ID NO: 26456 - DNA, 16 bp, Homo sapiens
gtaacgcaggtgtcct

SEQ ID NO: 26457 - DNA, 21 bp, Homo sapiens
gtaacgcaggtgtcctaaggc

SEQ ID NO: 26458 - DNA, 22 bp, Homo sapiens
gtaacgcaggtgtcctaaggcg

SEQ ID NO: 26459 - DNA, 25 bp, Homo sapiens
gtaacgcaggtgtcctaaggcgagc

SEQ ID NO: 26460 - DNA, 26 bp, Homo sapiens
gtaacgcaggtgtcctaaggcgagct

SEQ ID NO: 26461 - DNA, 27 bp, Homo sapiens
gtaacgcaggtgtcctaaggcgagctc

SEQ ID NO: 26462 - DNA, 30 bp, Homo sapiens
gtaacgcaggtgtcctaaggcgagctcagg

SEQ ID NO: 26463 - DNA, 31 bp, Homo sapiens
gtaacgcaggtgtcctaaggcgagctcaggg

SEQ ID NO: 26464 - DNA, 32 bp, Homo sapiens; identical to SEQ ID NO: 5902

SEQ ID NO: 26465 - DNA, 33 bp, Homo sapiens
gtaacgcaggtgtcctaaggcgagctcagggag

SEQ ID NO: 26466 - DNA, 19 bp, Homo sapiens
aacgcaggtgtcctaaggc

SEQ ID NO: 26467 - DNA, 30 bp, Homo sapiens
aacgcaggtgtcctaaggcgagctcaggga

SEQ ID NO: 26468 - DNA, 18 bp, Homo sapiens
acgcaggtgtcctaaggc

SEQ ID NO: 26469 - DNA, 19 bp, Homo sapiens
acgcaggtgtcctaaggcg

SEQ ID NO: 26470 - DNA, 20 bp, Homo sapiens
acgcaggtgtcctaaggcga

SEQ ID NO: 26471 - DNA, 24 bp, Homo sapiens
acgcaggtgtcctaaggcgagctc

SEQ ID NO: 26472 - DNA, 25 bp, Homo sapiens
acgcaggtgtcctaaggcgagctca

SEQ ID NO: 26473 - DNA, 28 bp, Homo sapiens
acgcaggtgtcctaaggcgagctcaggg

SEQ ID NO: 26474 - DNA, 29 bp, Homo sapiens
acgcaggtgtcctaaggcgagctcaggga

SEQ ID NO: 26475 - DNA, 31 bp, Homo sapiens
acgcaggtgtcctaaggcgagctcagggagg

SEQ ID NO: 26476 - DNA, 32 bp, Homo sapiens
acgcaggtgtcctaaggcgagctcagggagga

SEQ ID NO: 26477 - DNA, 30 bp, Homo sapiens
caggtgtcctaaggcgagctcagggaggac

SEQ ID NO: 26478 - DNA, 20 bp, Homo sapiens
ggtgtcctaaggcgagctca

SEQ ID NO: 26479 - DNA, 24 bp, Homo sapiens
ggtgtcctaaggcgagctcaggga

SEQ ID NO: 26480 - DNA, 29 bp, Homo sapiens
ggtgtcctaaggcgagctcagggaggaca

SEQ ID NO: 26481 - DNA, 22 bp, Homo sapiens
ctaaggcgagctcagggaggac

SEQ ID NO: 26482 - DNA, 30 bp, Homo sapiens
ctaaggcgagctcagggaggacagaaacct

SEQ ID NO: 26483 - DNA, 17 bp, Homo sapiens
taaggcgagctcaggga

SEQ ID NO: 26484 - DNA, 22 bp, Homo sapiens
taaggcgagctcagggaggaca

SEQ ID NO: 26485 - DNA, 26 bp, Homo sapiens
taaggcgagctcagggaggacagaaa

SEQ ID NO: 26486 - DNA, 27 bp, Homo sapiens
taaggcgagctcagggaggacagaaac

SEQ ID NO: 26487 - DNA, 28 bp, Homo sapiens
taaggcgagctcagggaggacagaaacc

SEQ ID NO: 26488 - DNA, 29 bp, Homo sapiens
taaggcgagctcagggaggacagaaacct

SEQ ID NO: 26489 - DNA, 30 bp, Homo sapiens
taaggcgagctcagggaggacagaaacctc

SEQ ID NO: 26490 - DNA, 31 bp, Homo sapiens
taaggcgagctcagggaggacagaaacctcc

SEQ ID NO: 26491 - DNA, 33 bp, Homo sapiens; identical to SEQ ID NO: 5904

SEQ ID NO: 26492 - DNA, 16 bp, Homo sapiens
aaggcgagctcaggga

SEQ ID NO: 26493 - DNA, 18 bp, Homo sapiens
aaggcgagctcagggagg

SEQ ID NO: 26494 - DNA, 19 bp, Homo sapiens
aaggcgagctcagggagga

SEQ ID NO: 26495 - DNA, 20 bp, Homo sapiens
aaggcgagctcagggaggac

SEQ ID NO: 26496 - DNA, 21 bp, Homo sapiens
aaggcgagctcagggaggaca

SEQ ID NO: 26497 - DNA, 27 bp, Homo sapiens
aaggcgagctcagggaggacagaaacc

SEQ ID NO: 26498 - DNA, 28 bp, Homo sapiens
aaggcgagctcagggaggacagaaacct

SEQ ID NO: 26499 - DNA, 30 bp, Homo sapiens
aaggcgagctcagggaggacagaaacctcc

SEQ ID NO: 26500 - DNA, 32 bp, Homo sapiens; identical to SEQ ID NO: 5907

SEQ ID NO: 26501 - DNA, 19 bp, Homo sapiens
aggcgagctcagggaggac

SEQ ID NO: 26502 - DNA, 20 bp, Homo sapiens
aggcgagctcagggaggaca

SEQ ID NO: 26503 - DNA, 22 bp, Homo sapiens
aggcgagctcagggaggacaga

SEQ ID NO: 26504 - DNA, 23 bp, Homo sapiens
aggcgagctcagggaggacagaa

SEQ ID NO: 26505 - DNA, 24 bp, Homo sapiens
aggcgagctcagggaggacagaaa

SEQ ID NO: 26506 - DNA, 18 bp, Homo sapiens
ggcgagctcagggaggac

SEQ ID NO: 26507 - DNA, 19 bp, Homo sapiens
ggcgagctcagggaggaca

SEQ ID NO: 26508 - DNA, 17 bp, Homo sapiens
gcgagctcagggaggac

SEQ ID NO: 26509 - DNA, 24 bp, Homo sapiens
cgagctcagggaggacagaaacct

SEQ ID NO: 26510 - DNA, 21 bp, Homo sapiens
agctcagggaggacagaaacc

SEQ ID NO: 26511 - DNA, 22 bp, Homo sapiens
agctcagggaggacagaaacct

SEQ ID NO: 26512 - DNA, 40 bp, Homo sapiens
agctcagggaggacagaaacctcccgtggagcagaagggc

SEQ ID NO: 26513 - DNA, 16 bp, Homo sapiens
gctcagggaggacaga

SEQ ID NO: 26514 - DNA, 17 bp, Homo sapiens
gctcagggaggacagaa

SEQ ID NO: 26515 - DNA, 18 bp, Homo sapiens
gctcagggaggacagaaa

SEQ ID NO: 26516 - DNA, 21 bp, Homo sapiens
gctcagggaggacagaaacct

SEQ ID NO: 26517 - DNA, 19 bp, Homo sapiens
ctcagggaggacagaaacc

SEQ ID NO: 26518 - DNA, 18 bp, Homo sapiens
tcagggaggacagaaacc

SEQ ID NO: 26519 - DNA, 29 bp, Homo sapiens
tcagggaggacagaaacctcccgtggagc

SEQ ID NO: 26520 - DNA, 17 bp, Homo sapiens
cagggaggacagaaacc

SEQ ID NO: 26521 - DNA, 18 bp, Homo sapiens
cagggaggacagaaacct

SEQ ID NO: 26522 - DNA, 19 bp, Homo sapiens
cagggaggacagaaacctc

SEQ ID NO: 26523 - DNA, 16 bp, Homo sapiens
agggaggacagaaacc

SEQ ID NO: 26524 - DNA, 18 bp, Homo sapiens
agggaggacagaaacctc

SEQ ID NO: 26525 - DNA, 16 bp, Homo sapiens
gggaggacagaaacct

SEQ ID NO: 26526 - DNA, 17 bp, Homo sapiens
gggaggacagaaacctc

SEQ ID NO: 26527 - DNA, 16 bp, Homo sapiens
ggaggacagaaacctc

SEQ ID NO: 26528 - DNA, 22 bp, Homo sapiens
gaggacagaaacctcccgtgga

SEQ ID NO: 26529 - DNA, 23 bp, Homo sapiens
gaggacagaaacctcccgtggag

SEQ ID NO: 26530 - DNA, 24 bp, Homo sapiens
gaggacagaaacctcccgtggagc

SEQ ID NO: 26531 - DNA, 25 bp, Homo sapiens
gaggacagaaacctcccgtggagca

SEQ ID NO: 26532 - DNA, 32 bp, Homo sapiens
gaggacagaaacctcccgtggagcagaagggc

SEQ ID NO: 26533 - DNA, 16 bp, Homo sapiens
aggacagaaacctccc

SEQ ID NO: 26534 - DNA, 17 bp, Homo sapiens
aggacagaaacctcccg

SEQ ID NO: 26535 - DNA, 19 bp, Homo sapiens
aggacagaaacctcccgtg

SEQ ID NO: 26536 - DNA, 20 bp, Homo sapiens
aggacagaaacctcccgtgg

SEQ ID NO: 26537 - DNA, 21 bp, Homo sapiens
aggacagaaacctcccgtgga

SEQ ID NO: 26538 - DNA, 22 bp, Homo sapiens
aggacagaaacctcccgtggag

SEQ ID NO: 26539 - DNA, 23 bp, Homo sapiens
aggacagaaacctcccgtggagc

SEQ ID NO: 26540 - DNA, 24 bp, Homo sapiens
aggacagaaacctcccgtggagca

SEQ ID NO: 26541 - DNA, 26 bp, Homo sapiens
aggacagaaacctcccgtggagcaga

SEQ ID NO: 26542 - DNA, 27 bp, Homo sapiens
aggacagaaacctcccgtggagcagaa

SEQ ID NO: 26543 - DNA, 28 bp, Homo sapiens
aggacagaaacctcccgtggagcagaag

SEQ ID NO: 26544 - DNA, 31 bp, Homo sapiens
aggacagaaacctcccgtggagcagaagggc

SEQ ID NO: 26545 - DNA, 32 bp, Homo sapiens
aggacagaaacctcccgtggagcagaagggca

SEQ ID NO: 26546 - DNA, 42 bp, Homo sapiens
aggacagaaacctcccgtggagcagaagggcaaaagctcgct

SEQ ID NO: 26547 - DNA, 20 bp, Homo sapiens
ggacagaaacctcccgtgga

SEQ ID NO: 26548 - DNA, 21 bp, Homo sapiens
ggacagaaacctcccgtggag

SEQ ID NO: 26549 - DNA, 22 bp, Homo sapiens
ggacagaaacctcccgtggagc

SEQ ID NO: 26550 - DNA, 23 bp, Homo sapiens
ggacagaaacctcccgtggagca

SEQ ID NO: 26551 - DNA, 25 bp, Homo sapiens
ggacagaaacctcccgtggagcaga

SEQ ID NO: 26552 - DNA, 26 bp, Homo sapiens
ggacagaaacctcccgtggagcagaa

SEQ ID NO: 26553 - DNA, 30 bp, Homo sapiens
ggacagaaacctcccgtggagcagaagggc

SEQ ID NO: 26554 - DNA, 29 bp, Homo sapiens
gacagaaacctcccgtggagcagaagggc

SEQ ID NO: 26555 - DNA, 28 bp, Homo sapiens
acagaaacctcccgtggagcagaagggc

SEQ ID NO: 26556 - DNA, 17 bp, Homo sapiens
cagaaacctcccgtgga

SEQ ID NO: 26557 - DNA, 27 bp, Homo sapiens
cagaaacctcccgtggagcagaagggc

SEQ ID NO: 26558 - DNA, 25 bp, Homo sapiens
gaaacctcccgtggagcagaagggc

SEQ ID NO: 26559 - DNA, 24 bp, Homo sapiens
aaacctcccgtggagcagaagggc

SEQ ID NO: 26560 - DNA, 23 bp, Homo sapiens
aacctcccgtggagcagaagggc

SEQ ID NO: 26561 - DNA, 22 bp, Homo sapiens
acctcccgtggagcagaagggc

SEQ ID NO: 26562 - DNA, 21 bp, Homo sapiens
cctcccgtggagcagaagggc

SEQ ID NO: 26563 - DNA, 22 bp, Homo sapiens
cctcccgtggagcagaagggca

SEQ ID NO: 26564 - DNA, 20 bp, Homo sapiens
ctcccgtggagcagaagggc

SEQ ID NO: 26565 - DNA, 16 bp, Homo sapiens
cgtggagcagaagggc

SEQ ID NO: 26566 - DNA, 23 bp, Homo sapiens
cgtggagcagaagggcaaaagct

SEQ ID NO: 26567 - DNA, 24 bp, Homo sapiens
cgtggagcagaagggcaaaagctc

SEQ ID NO: 26568 - DNA, 27 bp, Homo sapiens
cgtggagcagaagggcaaaagctcgct

SEQ ID NO: 26569 - DNA, 32 bp, Homo sapiens; identical to SEQ ID NO: 5926

SEQ ID NO: 26570 - DNA, 33 bp, Homo sapiens
cgtggagcagaagggcaaaagctcgcttgatct

SEQ ID NO: 26571 - DNA, 28 bp, Homo sapiens
gagcagaagggcaaaagctcgcttgatc

SEQ ID NO: 26572 - DNA, 29 bp, Homo sapiens
gagcagaagggcaaaagctcgcttgatct

SEQ ID NO: 26573 - DNA, 31 bp, Homo sapiens
gagcagaagggcaaaagctcgcttgatcttg

SEQ ID NO: 26574 - DNA, 22 bp, Homo sapiens
agcagaagggcaaaagctcgct

SEQ ID NO: 26575 - DNA, 27 bp, Homo sapiens
agcagaagggcaaaagctcgcttgatc

SEQ ID NO: 26576 - DNA, 28 bp, Homo sapiens
agcagaagggcaaaagctcgcttgatct

SEQ ID NO: 26577 - DNA, 32 bp, Homo sapiens
agcagaagggcaaaagctcgcttgatcttgat

SEQ ID NO: 26578 - DNA, 33 bp, Homo sapiens
agcagaagggcaaaagctcgcttgatcttgatt

SEQ ID NO: 26579 - DNA, 26 bp, Homo sapiens
gcagaagggcaaaagctcgcttgatc

SEQ ID NO: 26580 - DNA, 27 bp, Homo sapiens
gcagaagggcaaaagctcgcttgatct

SEQ ID NO: 26581 - DNA, 32 bp, Homo sapiens
gcagaagggcaaaagctcgcttgatcttgatt

SEQ ID NO: 26582 - DNA, 33 bp, Homo sapiens
gcagaagggcaaaagctcgcttgatcttgattt

SEQ ID NO: 26583 - DNA, 16 bp, Homo sapiens
cagaagggcaaaagct

SEQ ID NO: 26584 - DNA, 20 bp, Homo sapiens
cagaagggcaaaagctcgct

SEQ ID NO: 26585 - DNA, 25 bp, Homo sapiens
cagaagggcaaaagctcgcttgatc

SEQ ID NO: 26586 - DNA, 26 bp, Homo sapiens
cagaagggcaaaagctcgcttgatct

SEQ ID NO: 26587 - DNA, 28 bp, Homo sapiens
cagaagggcaaaagctcgcttgatcttg

SEQ ID NO: 26588 - DNA, 29 bp, Homo sapiens
cagaagggcaaaagctcgcttgatcttga

SEQ ID NO: 26589 - DNA, 31 bp, Homo sapiens; identical to SEQ ID NO: 5931

SEQ ID NO: 26590 - DNA, 32 bp, Homo sapiens; identical to SEQ ID NO: 5932

SEQ ID NO: 26591 - DNA, 33 bp, Homo sapiens
cagaagggcaaaagctcgcttgatcttgatttt

SEQ ID NO: 26592 - DNA, 19 bp, Homo sapiens
agaagggcaaaagctcgct

SEQ ID NO: 26593 - DNA, 20 bp, Homo sapiens
agaagggcaaaagctcgctt

SEQ ID NO: 26594 - DNA, 24 bp, Homo sapiens
agaagggcaaaagctcgcttgatc

SEQ ID NO: 26595 - DNA, 25 bp, Homo sapiens
agaagggcaaaagctcgcttgatct

SEQ ID NO: 26596 - DNA, 30 bp, Homo sapiens; identical to SEQ ID NO: 5936

SEQ ID NO: 26597 - DNA, 31 bp, Homo sapiens; identical to SEQ ID NO: 5937

SEQ ID NO: 26598 - DNA, 32 bp, Homo sapiens
agaagggcaaaagctcgcttgatcttgatttt

SEQ ID NO: 26599 - DNA, 18 bp, Homo sapiens
gaagggcaaaagctcgct

SEQ ID NO: 26600 - DNA, 23 bp, Homo sapiens
gaagggcaaaagctcgcttgatc

SEQ ID NO: 26601 - DNA, 24 bp, Homo sapiens
gaagggcaaaagctcgcttgatct

SEQ ID NO: 26602 - DNA, 25 bp, Homo sapiens
gaagggcaaaagctcgcttgatctt

SEQ ID NO: 26603 - DNA, 26 bp, Homo sapiens
gaagggcaaaagctcgcttgatcttg

SEQ ID NO: 26604 - DNA, 29 bp, Homo sapiens
gaagggcaaaagctcgcttgatcttgatt

SEQ ID NO: 26605 - DNA, 30 bp, Homo sapiens; identical to SEQ ID NO: 5941

SEQ ID NO: 26606 - DNA, 31 bp, Homo sapiens; identical to SEQ ID NO: 5942

SEQ ID NO: 26607 - DNA, 22 bp, Homo sapiens
aagggcaaaagctcgcttgatc

SEQ ID NO: 26608 - DNA, 23 bp, Homo sapiens
aagggcaaaagctcgcttgatct

SEQ ID NO: 26609 - DNA, 28 bp, Homo sapiens
aagggcaaaagctcgcttgatcttgatt

SEQ ID NO: 26610 - DNA, 29 bp, Homo sapiens
aagggcaaaagctcgcttgatcttgattt

SEQ ID NO: 26611 - DNA, 16 bp, Homo sapiens
agggcaaaagctcgct

SEQ ID NO: 26612 - DNA, 21 bp, Homo sapiens
agggcaaaagctcgcttgatc

SEQ ID NO: 26613 - DNA, 22 bp, Homo sapiens
agggcaaaagctcgcttgatct

SEQ ID NO: 26614 - DNA, 21 bp, Homo sapiens
gggcaaaagctcgcttgatct

SEQ ID NO: 26615 - DNA, 26 bp, Homo sapiens
gggcaaaagctcgcttgatcttgatt

SEQ ID NO: 26616 - DNA, 27 bp, Homo sapiens
gggcaaaagctcgcttgatcttgattt

SEQ ID NO: 26617 - DNA, 28 bp, Homo sapiens
gggcaaaagctcgcttgatcttgatttt

SEQ ID NO: 26618 - DNA, 20 bp, Homo sapiens
ggcaaaagctcgcttgatct

SEQ ID NO: 26619 - DNA, 22 bp, Homo sapiens
ggcaaaagctcgcttgatcttg

SEQ ID NO: 26620 - DNA, 25 bp, Homo sapiens
ggcaaaagctcgcttgatcttgatt

SEQ ID NO: 26621 - DNA, 26 bp, Homo sapiens
ggcaaaagctcgcttgatcttgattt

SEQ ID NO: 26622 - DNA, 27 bp, Homo sapiens
ggcaaaagctcgcttgatcttgatttt

SEQ ID NO: 26623 - DNA, 18 bp, Homo sapiens
gcaaaagctcgcttgatc

SEQ ID NO: 26624 - DNA, 19 bp, Homo sapiens
gcaaaagctcgcttgatct

SEQ ID NO: 26625 - DNA, 21 bp, Homo sapiens
gcaaaagctcgcttgatcttg

SEQ ID NO: 26626 - DNA, 24 bp, Homo sapiens
gcaaaagctcgcttgatcttgatt

SEQ ID NO: 26627 - DNA, 25 bp, Homo sapiens
gcaaaagctcgcttgatcttgattt

SEQ ID NO: 26628 - DNA, 26 bp, Homo sapiens
gcaaaagctcgcttgatcttgatttt

SEQ ID NO: 26629 - DNA, 18 bp, Homo sapiens
caaaagctcgcttgatct

SEQ ID NO: 26630 - DNA, 24 bp, Homo sapiens
caaaagctcgcttgatcttgattt

SEQ ID NO: 26631 - DNA, 16 bp, Homo sapiens
aaaagctcgcttgatc

SEQ ID NO: 26632 - DNA, 17 bp, Homo sapiens
aaaagctcgcttgatct

SEQ ID NO: 26633 - DNA, 19 bp, Homo sapiens
aaaagctcgcttgatcttg

SEQ ID NO: 26634 - DNA, 22 bp, Homo sapiens
aaaagctcgcttgatcttgatt

SEQ ID NO: 26635 - DNA, 23 bp, Homo sapiens
aaaagctcgcttgatcttgattt

SEQ ID NO: 26636 - DNA, 24 bp, Homo sapiens
aaaagctcgcttgatcttgatttt

SEQ ID NO: 26637 - DNA, 27 bp, Homo sapiens
aaaagctcgcttgatcttgattttcag

SEQ ID NO: 26638 - DNA, 30 bp, Homo sapiens
aaaagctcgcttgatcttgattttcagtac

SEQ ID NO: 26639 - DNA, 31 bp, Homo sapiens; identical to SEQ ID NO: 5948

SEQ ID NO: 26640 - DNA, 16 bp, Homo sapiens
aaagctcgcttgatct

SEQ ID NO: 26641 - DNA, 18 bp, Homo sapiens
aaagctcgcttgatcttg

SEQ ID NO: 26642 - DNA, 20 bp, Homo sapiens
aaagctcgcttgatcttgat

SEQ ID NO: 26643 - DNA, 21 bp, Homo sapiens
aaagctcgcttgatcttgatt

SEQ ID NO: 26644 - DNA, 22 bp, Homo sapiens
aaagctcgcttgatcttgattt

SEQ ID NO: 26645 - DNA, 23 bp, Homo sapiens
aaagctcgcttgatcttgatttt

SEQ ID NO: 26646 - DNA, 26 bp, Homo sapiens
aaagctcgcttgatcttgattttcag

SEQ ID NO: 26647 - DNA, 28 bp, Homo sapiens
aaagctcgcttgatcttgattttcagta

SEQ ID NO: 26648 - DNA, 29 bp, Homo sapiens
aaagctcgcttgatcttgattttcagtac

SEQ ID NO: 26649 - DNA, 30 bp, Homo sapiens; identical to SEQ ID NO: 5951

SEQ ID NO: 26650 - DNA, 31 bp, Homo sapiens
aaagctcgcttgatcttgattttcagtacga

SEQ ID NO: 26651 - DNA, 27 bp, Homo sapiens
aagctcgcttgatcttgattttcagta

SEQ ID NO: 26652 - DNA, 29 bp, Homo sapiens
aagctcgcttgatcttgattttcagtacg

SEQ ID NO: 26653 - DNA, 30 bp, Homo sapiens
aagctcgcttgatcttgattttcagtacga

SEQ ID NO: 26654 - DNA, 33 bp, Homo sapiens
aagctcgcttgatcttgattttcagtacgaata

SEQ ID NO: 26655 - DNA, 24 bp, Homo sapiens
agctcgcttgatcttgattttcag

SEQ ID NO: 26656 - DNA, 26 bp, Homo sapiens
agctcgcttgatcttgattttcagta

SEQ ID NO: 26657 - DNA, 29 bp, Homo sapiens
agctcgcttgatcttgattttcagtacga

SEQ ID NO: 26658 - DNA, 32 bp, Homo sapiens
agctcgcttgatcttgattttcagtacgaata

SEQ ID NO: 26659 - DNA, 22 bp, Homo sapiens
gctcgcttgatcttgattttca

SEQ ID NO: 26660 - DNA, 23 bp, Homo sapiens
gctcgcttgatcttgattttcag

SEQ ID NO: 26661 - DNA, 25 bp, Homo sapiens
gctcgcttgatcttgattttcagta

SEQ ID NO: 26662 - DNA, 28 bp, Homo sapiens
gctcgcttgatcttgattttcagtacga

SEQ ID NO: 26663 - DNA, 31 bp, Homo sapiens
gctcgcttgatcttgattttcagtacgaata

SEQ ID NO: 26664 - DNA, 22 bp, Homo sapiens
ctcgcttgatcttgattttcag

SEQ ID NO: 26665 - DNA, 26 bp, Homo sapiens
ctcgcttgatcttgattttcagtacg

SEQ ID NO: 26666 - DNA, 21 bp, Homo sapiens
tcgcttgatcttgattttcag

SEQ ID NO: 26667 - DNA, 16 bp, Homo sapiens
cgcttgatcttgattt

SEQ ID NO: 26668 - DNA, 24 bp, Homo sapiens
cgcttgatcttgattttcagtacg

SEQ ID NO: 26669 - DNA, 18 bp, Homo sapiens
tcttgattttcagtacga

SEQ ID NO: 26670 - DNA, 21 bp, Homo sapiens
tcttgattttcagtacgaata

SEQ ID NO: 26671 - DNA, 31 bp, Homo sapiens
tcttgattttcagtacgaatacagaccgtga

SEQ ID NO: 26672 - DNA, 25 bp, Homo sapiens
ttttcagtacgaatacagaccgtga

SEQ ID NO: 26673 - DNA, 19 bp, Homo sapiens
tttcagtacgaatacagac

SEQ ID NO: 26674 - DNA, 18 bp, Homo sapiens
ttcagtacgaatacagac

SEQ ID NO: 26675 - DNA, 19 bp, Homo sapiens
ttcagtacgaatacagacc

SEQ ID NO: 26676 - DNA, 27 bp, Homo sapiens
ttcagtacgaatacagaccgtgaaagc

SEQ ID NO: 26677 - DNA, 17 bp, Homo sapiens
tcagtacgaatacagac

SEQ ID NO: 26678 - DNA, 18 bp, Homo sapiens
tcagtacgaatacagacc

SEQ ID NO: 26679 - DNA, 26 bp, Homo sapiens
tcagtacgaatacagaccgtgaaagc

SEQ ID NO: 26680 - DNA, 33 bp, Homo sapiens
tcagtacgaatacagaccgtgaaagcggggcct

SEQ ID NO: 26681 - DNA, 16 bp, Homo sapiens
cagtacgaatacagac

SEQ ID NO: 26682 - DNA, 17 bp, Homo sapiens
cagtacgaatacagacc

SEQ ID NO: 26683 - DNA, 25 bp, Homo sapiens
cagtacgaatacagaccgtgaaagc

SEQ ID NO: 26684 - DNA, 26 bp, Homo sapiens
cagtacgaatacagaccgtgaaagcg

SEQ ID NO: 26685 - DNA, 32 bp, Homo sapiens; identical to SEQ ID NO: 5956

SEQ ID NO: 26686 - DNA, 47 bp, Homo sapiens
cagtacgaatacagaccgtgaaagcggggcctcacgatccttctgac

SEQ ID NO: 26687 - DNA, 42 bp, Homo sapiens
gaatacagaccgtgaaagcggggcctcacgatccttctgacc

SEQ ID NO: 26688 - DNA, 18 bp, Homo sapiens
aatacagaccgtgaaagc

SEQ ID NO: 26689 - DNA, 40 bp, Homo sapiens
aatacagaccgtgaaagcggggcctcacgatccttctgac

SEQ ID NO: 26690 - DNA, 41 bp, Homo sapiens
aatacagaccgtgaaagcggggcctcacgatccttctgacc

SEQ ID NO: 26691 - DNA, 42 bp, Homo sapiens
aatacagaccgtgaaagcggggcctcacgatccttctgacct

SEQ ID NO: 26692 - DNA, 17 bp, Homo sapiens
atacagaccgtgaaagc

SEQ ID NO: 26693 - DNA, 16 bp, Homo sapiens
tacagaccgtgaaagc

SEQ ID NO: 26694 - DNA, 36 bp, Homo sapiens
cagaccgtgaaagcggggcctcacgatccttctgac

SEQ ID NO: 26695 - DNA, 37 bp, Homo sapiens
cagaccgtgaaagcggggcctcacgatccttctgacc

SEQ ID NO: 26696 - DNA, 38 bp, Homo sapiens
cagaccgtgaaagcggggcctcacgatccttctgacct

SEQ ID NO: 26697 - DNA, 35 bp, Homo sapiens
agaccgtgaaagcggggcctcacgatccttctgac

SEQ ID NO: 26698 - DNA, 36 bp, Homo sapiens
agaccgtgaaagcggggcctcacgatccttctgacc

SEQ ID NO: 26699 - DNA, 37 bp, Homo sapiens
agaccgtgaaagcggggcctcacgatccttctgacct

SEQ ID NO: 26700 - DNA, 34 bp, Homo sapiens
gaccgtgaaagcggggcctcacgatccttctgac

SEQ ID NO: 26701 - DNA, 35 bp, Homo sapiens
gaccgtgaaagcggggcctcacgatccttctgacc

SEQ ID NO: 26702 - DNA, 36 bp, Homo sapiens
gaccgtgaaagcggggcctcacgatccttctgacct

SEQ ID NO: 26703 - DNA, 33 bp, Homo sapiens; identical to SEQ ID NO: 5958

SEQ ID NO: 26704 - DNA, 34 bp, Homo sapiens
accgtgaaagcggggcctcacgatccttctgacc

SEQ ID NO: 26705 - DNA, 16 bp, Homo sapiens
cgtgaaagcggggcct

SEQ ID NO: 26706 - DNA, 31 bp, Homo sapiens; identical to SEQ ID NO: 5959

SEQ ID NO: 26707 - DNA, 32 bp, Homo sapiens; identical to SEQ ID NO: 5960

SEQ ID NO: 26708 - DNA, 33 bp, Homo sapiens; identical to SEQ ID NO: 5961

SEQ ID NO: 26709 - DNA, 30 bp, Homo sapiens
gtgaaagcggggcctcacgatccttctgac

SEQ ID NO: 26710 - DNA, 31 bp, Homo sapiens; identical to SEQ ID NO: 5962

SEQ ID NO: 26711 - DNA, 32 bp, Homo sapiens; identical to SEQ ID NO: 5963

SEQ ID NO: 26712 - DNA, 30 bp, Homo sapiens; identical to SEQ ID NO: 5964

SEQ ID NO: 26713 - DNA, 31 bp, Homo sapiens; identical to SEQ ID NO: 5965

SEQ ID NO: 26714 - DNA, 30 bp, Homo sapiens
gaaagcggggcctcacgatccttctgacct

SEQ ID NO: 26715 - DNA, 28 bp, Homo sapiens
aaagcggggcctcacgatccttctgacc

SEQ ID NO: 26716 - DNA, 29 bp, Homo sapiens
aaagcggggcctcacgatccttctgacct

SEQ ID NO: 26717 - DNA, 27 bp, Homo sapiens
aagcggggcctcacgatccttctgacc

SEQ ID NO: 26718 - DNA, 28 bp, Homo sapiens
aagcggggcctcacgatccttctgacct

SEQ ID NO: 26719 - DNA, 30 bp, Homo sapiens
aagcggggcctcacgatccttctgaccttt

SEQ ID NO: 26720 - DNA, 26 bp, Homo sapiens
agcggggcctcacgatccttctgacc

SEQ ID NO: 26721 - DNA, 27 bp, Homo sapiens
agcggggcctcacgatccttctgacct

SEQ ID NO: 26722 - DNA, 32 bp, Homo sapiens
agcggggcctcacgatccttctgaccttttgg

SEQ ID NO: 26723 - DNA, 23 bp, Homo sapiens
gcggggcctcacgatccttctga

SEQ ID NO: 26724 - DNA, 25 bp, Homo sapiens
gcggggcctcacgatccttctgacc

SEQ ID NO: 26725 - DNA, 26 bp, Homo sapiens
gcggggcctcacgatccttctgacct

SEQ ID NO: 26726 - DNA, 24 bp, Homo sapiens
cggggcctcacgatccttctgacc

SEQ ID NO: 26727 - DNA, 25 bp, Homo sapiens
cggggcctcacgatccttctgacct

SEQ ID NO: 26728 - DNA, 30 bp, Homo sapiens
cggggcctcacgatccttctgaccttttgg

SEQ ID NO: 26729 - DNA, 22 bp, Homo sapiens
ggggcctcacgatccttctgac

SEQ ID NO: 26730 - DNA, 23 bp, Homo sapiens
ggggcctcacgatccttctgacc

SEQ ID NO: 26731 - DNA, 24 bp, Homo sapiens
ggggcctcacgatccttctgacct

SEQ ID NO: 26732 - DNA, 29 bp, Homo sapiens
ggggcctcacgatccttctgaccttttgg

SEQ ID NO: 26733 - DNA, 30 bp, Homo sapiens
ggggcctcacgatccttctgaccttttggg

SEQ ID NO: 26734 - DNA, 22 bp, Homo sapiens
gggcctcacgatccttctgacc

SEQ ID NO: 26735 - DNA, 23 bp, Homo sapiens
gggcctcacgatccttctgacct

SEQ ID NO: 26736 - DNA, 18 bp, Homo sapiens
gcctcacgatccttctga

SEQ ID NO: 26737 - DNA, 20 bp, Homo sapiens
gcctcacgatccttctgacc

SEQ ID NO: 26738 - DNA, 17 bp, Homo sapiens
cctcacgatccttctga

SEQ ID NO: 26739 - DNA, 20 bp, Homo sapiens
cctcacgatccttctgacct

SEQ ID NO: 26740 - DNA, 18 bp, Homo sapiens
ctcacgatccttctgacc

SEQ ID NO: 26741 - DNA, 19 bp, Homo sapiens
ctcacgatccttctgacct

SEQ ID NO: 26742 - DNA, 17 bp, Homo sapiens
tcacgatccttctgacc

SEQ ID NO: 26743 - DNA, 18 bp, Homo sapiens
tcacgatccttctgacct

SEQ ID NO: 26744 - DNA, 16 bp, Homo sapiens
cacgatccttctgacc

SEQ ID NO: 26745 - DNA, 17 bp, Homo sapiens
cacgatccttctgacct

SEQ ID NO: 26746 - DNA, 16 bp, Homo sapiens
acgatccttctgacct

SEQ ID NO: 26747 - DNA, 20 bp, Homo sapiens
cgatccttctgaccttttgg

SEQ ID NO: 26748 - DNA, 26 bp, Homo sapiens
cgatccttctgaccttttgggtttta

SEQ ID NO: 26749 - DNA, 24 bp, Homo sapiens
ttttgggttttaagcaggaggtgt

SEQ ID NO: 26750 - DNA, 25 bp, Homo sapiens
ttttgggttttaagcaggaggtgtc

SEQ ID NO: 26751 - DNA, 29 bp, Homo sapiens
ttttgggttttaagcaggaggtgtcagaa

SEQ ID NO: 26752 - DNA, 24 bp, Homo sapiens
tttgggttttaagcaggaggtgtc

SEQ ID NO: 26753 - DNA, 18 bp, Homo sapiens
agcaggaggtgtcagaaa

SEQ ID NO: 26754 - DNA, 19 bp, Homo sapiens
agcaggaggtgtcagaaaa

SEQ ID NO: 26755 - DNA, 23 bp, Homo sapiens
agcaggaggtgtcagaaaagtta

SEQ ID NO: 26756 - DNA, 32 bp, Homo sapiens
agcaggaggtgtcagaaaagttaccacaggga

SEQ ID NO: 26757 - DNA, 17 bp, Homo sapiens
gcaggaggtgtcagaaa

SEQ ID NO: 26758 - DNA, 18 bp, Homo sapiens
gcaggaggtgtcagaaaa

SEQ ID NO: 26759 - DNA, 22 bp, Homo sapiens
gcaggaggtgtcagaaaagtta

SEQ ID NO: 26760 - DNA, 31 bp, Homo sapiens
gcaggaggtgtcagaaaagttaccacaggga

SEQ ID NO: 26761 - DNA, 30 bp, Homo sapiens
aggaggtgtcagaaaagttaccacagggat

SEQ ID NO: 26762 - DNA, 20 bp, Homo sapiens
ccacagggataactggcttg

SEQ ID NO: 26763 - DNA, 29 bp, Homo sapiens
acagggataactggcttgtggcggccaag

SEQ ID NO: 26764 - DNA, 25 bp, Homo sapiens
cagggataactggcttgtggcggcc

SEQ ID NO: 26765 - DNA, 26 bp, Homo sapiens
cagggataactggcttgtggcggcca

SEQ ID NO: 26766 - DNA, 27 bp, Homo sapiens
cagggataactggcttgtggcggccaa

SEQ ID NO: 26767 - DNA, 28 bp, Homo sapiens
cagggataactggcttgtggcggccaag

SEQ ID NO: 26768 - DNA, 27 bp, Homo sapiens
agggataactggcttgtggcggccaag

SEQ ID NO: 26769 - DNA, 17 bp, Homo sapiens
taactggcttgtggcgg

SEQ ID NO: 26770 - DNA, 18 bp, Homo sapiens
taactggcttgtggcggc

SEQ ID NO: 26771 - DNA, 30 bp, Homo sapiens
taactggcttgtggcggccaagcgttcata

SEQ ID NO: 26772 - DNA, 16 bp, Homo sapiens
aactggcttgtggcgg

SEQ ID NO: 26773 - DNA, 17 bp, Homo sapiens
aactggcttgtggcggc

SEQ ID NO: 26774 - DNA, 18 bp, Homo sapiens
aactggcttgtggcggcc

SEQ ID NO: 26775 - DNA, 16 bp, Homo sapiens
actggcttgtggcggc

SEQ ID NO: 26776 - DNA, 17 bp, Homo sapiens
actggcttgtggcggcc

SEQ ID NO: 26777 - DNA, 28 bp, Homo sapiens
actggcttgtggcggccaagcgttcata

SEQ ID NO: 26778 - DNA, 16 bp, Homo sapiens
ctggcttgtggcggcc

SEQ ID NO: 26779 - DNA, 27 bp, Homo sapiens
ctggcttgtggcggccaagcgttcata

SEQ ID NO: 26780 - DNA, 23 bp, Homo sapiens
gcggccaagcgttcatagcgacg

SEQ ID NO: 26781 - DNA, 20 bp, Homo sapiens
gccaagcgttcatagcgacg

SEQ ID NO: 26782 - DNA, 16 bp, Homo sapiens
agcgttcatagcgacg

SEQ ID NO: 26783 - DNA, 20 bp, Homo sapiens
gcgttcatagcgacgtcgct

SEQ ID NO: 26784 - DNA, 26 bp, Homo sapiens
gcgttcatagcgacgtcgctttttga

SEQ ID NO: 26785 - DNA, 28 bp, Homo sapiens
gcgttcatagcgacgtcgctttttgatc

SEQ ID NO: 26786 - DNA, 16 bp, Homo sapiens
cgttcatagcgacgtc

SEQ ID NO: 26787 - DNA, 18 bp, Homo sapiens
cgttcatagcgacgtcgc

SEQ ID NO: 26788 - DNA, 19 bp, Homo sapiens
cgttcatagcgacgtcgct

SEQ ID NO: 26789 - DNA, 20 bp, Homo sapiens
cgttcatagcgacgtcgctt

SEQ ID NO: 26790 - DNA, 21 bp, Homo sapiens
cgttcatagcgacgtcgcttt

SEQ ID NO: 26791 - DNA, 22 bp, Homo sapiens
cgttcatagcgacgtcgctttt

SEQ ID NO: 26792 - DNA, 23 bp, Homo sapiens
cgttcatagcgacgtcgcttttt

SEQ ID NO: 26793 - DNA, 24 bp, Homo sapiens
cgttcatagcgacgtcgctttttg

SEQ ID NO: 26794 - DNA, 26 bp, Homo sapiens
cgttcatagcgacgtcgctttttgat

SEQ ID NO: 26795 - DNA, 27 bp, Homo sapiens
cgttcatagcgacgtcgctttttgatc

SEQ ID NO: 26796 - DNA, 28 bp, Homo sapiens
cgttcatagcgacgtcgctttttgatcc

SEQ ID NO: 26797 - DNA, 29 bp, Homo sapiens
cgttcatagcgacgtcgctttttgatcct

SEQ ID NO: 26798 - DNA, 42 bp, Homo sapiens
cgttcatagcgacgtcgctttttgatccttcgatgtcggctc

SEQ ID NO: 26799 - DNA, 17 bp, Homo sapiens
gttcatagcgacgtcgc

SEQ ID NO: 26800 - DNA, 18 bp, Homo sapiens
gttcatagcgacgtcgct

SEQ ID NO: 26801 - DNA, 19 bp, Homo sapiens
gttcatagcgacgtcgctt

SEQ ID NO: 26802 - DNA, 26 bp, Homo sapiens
gttcatagcgacgtcgctttttgatc

SEQ ID NO: 26803 - DNA, 16 bp, Homo sapiens
ttcatagcgacgtcgc

SEQ ID NO: 26804 - DNA, 17 bp, Homo sapiens
ttcatagcgacgtcgct

SEQ ID NO: 26805 - DNA, 18 bp, Homo sapiens
ttcatagcgacgtcgctt

SEQ ID NO: 26806 - DNA, 22 bp, Homo sapiens
ttcatagcgacgtcgctttttg

SEQ ID NO: 26807 - DNA, 25 bp, Homo sapiens
ttcatagcgacgtcgctttttgatc

SEQ ID NO: 26808 - DNA, 33 bp, Homo sapiens
ttcatagcgacgtcgctttttgatccttcgatg

SEQ ID NO: 26809 - DNA, 16 bp, Homo sapiens
tcatagcgacgtcgct

SEQ ID NO: 26810 - DNA, 17 bp, Homo sapiens
tcatagcgacgtcgctt

SEQ ID NO: 26811 - DNA, 16 bp, Homo sapiens
catagcgacgtcgctt

SEQ ID NO: 26812 - DNA, 25 bp, Homo sapiens
catagcgacgtcgctttttgatcct

SEQ ID NO: 26813 - DNA, 32 bp, Homo sapiens
catagcgacgtcgctttttgatccttcgatgt

SEQ ID NO: 26814 - DNA, 16 bp, Homo sapiens
atagcgacgtcgcttt

SEQ ID NO: 26815 - DNA, 22 bp, Homo sapiens
atagcgacgtcgctttttgatc

SEQ ID NO: 26816 - DNA, 23 bp, Homo sapiens
atagcgacgtcgctttttgatcc

SEQ ID NO: 26817 - DNA, 24 bp, Homo sapiens
atagcgacgtcgctttttgatcct

SEQ ID NO: 26818 - DNA, 31 bp, Homo sapiens; identical to SEQ ID NO: 6007

SEQ ID NO: 26819 - DNA, 19 bp, Homo sapiens
tagcgacgtcgctttttga

SEQ ID NO: 26820 - DNA, 21 bp, Homo sapiens
tagcgacgtcgctttttgatc

SEQ ID NO: 26821 - DNA, 22 bp, Homo sapiens
tagcgacgtcgctttttgatcc

SEQ ID NO: 26822 - DNA, 23 bp, Homo sapiens
tagcgacgtcgctttttgatcct

SEQ ID NO: 26823 - DNA, 26 bp, Homo sapiens
tagcgacgtcgctttttgatccttcg

SEQ ID NO: 26824 - DNA, 27 bp, Homo sapiens
tagcgacgtcgctttttgatccttcga

SEQ ID NO: 26825 - DNA, 29 bp, Homo sapiens
tagcgacgtcgctttttgatccttcgatg

SEQ ID NO: 26826 - DNA, 30 bp, Homo sapiens; identical to SEQ ID NO: 6011

SEQ ID NO: 26827 - DNA, 18 bp, Homo sapiens
agcgacgtcgctttttga

SEQ ID NO: 26828 - DNA, 20 bp, Homo sapiens
agcgacgtcgctttttgatc

SEQ ID NO: 26829 - DNA, 21 bp, Homo sapiens
agcgacgtcgctttttgatcc

SEQ ID NO: 26830 - DNA, 22 bp, Homo sapiens
agcgacgtcgctttttgatcct

SEQ ID NO: 26831 - DNA, 25 bp, Homo sapiens
agcgacgtcgctttttgatccttcg

SEQ ID NO: 26832 - DNA, 28 bp, Homo sapiens
agcgacgtcgctttttgatccttcgatg

SEQ ID NO: 26833 - DNA, 29 bp, Homo sapiens
agcgacgtcgctttttgatccttcgatgt

SEQ ID NO: 26834 - DNA, 16 bp, Homo sapiens
gcgacgtcgctttttg

SEQ ID NO: 26835 - DNA, 17 bp, Homo sapiens
gcgacgtcgctttttga

SEQ ID NO: 26836 - DNA, 19 bp, Homo sapiens
gcgacgtcgctttttgatc

SEQ ID NO: 26837 - DNA, 20 bp, Homo sapiens
gcgacgtcgctttttgatcc

SEQ ID NO: 26838 - DNA, 21 bp, Homo sapiens
gcgacgtcgctttttgatcct

SEQ ID NO: 26839 - DNA, 24 bp, Homo sapiens
gcgacgtcgctttttgatccttcg

SEQ ID NO: 26840 - DNA, 25 bp, Homo sapiens
gcgacgtcgctttttgatccttcga

SEQ ID NO: 26841 - DNA, 27 bp, Homo sapiens
gcgacgtcgctttttgatccttcgatg

SEQ ID NO: 26842 - DNA, 28 bp, Homo sapiens
gcgacgtcgctttttgatccttcgatgt

SEQ ID NO: 26843 - DNA, 16 bp, Homo sapiens
cgacgtcgctttttga

SEQ ID NO: 26844 - DNA, 18 bp, Homo sapiens
cgacgtcgctttttgatc

SEQ ID NO: 26845 - DNA, 19 bp, Homo sapiens
cgacgtcgctttttgatcc

SEQ ID NO: 26846 - DNA, 20 bp, Homo sapiens
cgacgtcgctttttgatcct

SEQ ID NO: 26847 - DNA, 23 bp, Homo sapiens
cgacgtcgctttttgatccttcg

SEQ ID NO: 26848 - DNA, 24 bp, Homo sapiens
cgacgtcgctttttgatccttcga

SEQ ID NO: 26849 - DNA, 26 bp, Homo sapiens
cgacgtcgctttttgatccttcgatg

SEQ ID NO: 26850 - DNA, 17 bp, Homo sapiens
gacgtcgctttttgatc

SEQ ID NO: 26851 - DNA, 25 bp, Homo sapiens
gacgtcgctttttgatccttcgatg

SEQ ID NO: 26852 - DNA, 26 bp, Homo sapiens
gacgtcgctttttgatccttcgatgt

SEQ ID NO: 26853 - DNA, 32 bp, Homo sapiens
gacgtcgctttttgatccttcgatgtcggctc

SEQ ID NO: 26854 - DNA, 33 bp, Homo sapiens
gacgtcgctttttgatccttcgatgtcggctct

SEQ ID NO: 26855 - DNA, 16 bp, Homo sapiens
acgtcgctttttgatc

SEQ ID NO: 26856 - DNA, 24 bp, Homo sapiens
acgtcgctttttgatccttcgatg

SEQ ID NO: 26857 - DNA, 32 bp, Homo sapiens
acgtcgctttttgatccttcgatgtcggctct

SEQ ID NO: 26858 - DNA, 36 bp, Homo sapiens
acgtcgctttttgatccttcgatgtcggctcttcct

SEQ ID NO: 26859 - DNA, 21 bp, Homo sapiens
cgtcgctttttgatccttcga

SEQ ID NO: 26860 - DNA, 23 bp, Homo sapiens
cgtcgctttttgatccttcgatg

SEQ ID NO: 26861 - DNA, 33 bp, Homo sapiens
tcgctttttgatccttcgatgtcggctcttcct

SEQ ID NO: 26862 - DNA, 32 bp, Homo sapiens
cgctttttgatccttcgatgtcggctcttcct

SEQ ID NO: 26863 - DNA, 21 bp, Homo sapiens
gctttttgatccttcgatgtc

SEQ ID NO: 26864 - DNA, 22 bp, Homo sapiens
gctttttgatccttcgatgtcg

SEQ ID NO: 26865 - DNA, 27 bp, Homo sapiens
gctttttgatccttcgatgtcggctct

SEQ ID NO: 26866 - DNA, 29 bp, Homo sapiens
gctttttgatccttcgatgtcggctcttc

SEQ ID NO: 26867 - DNA, 30 bp, Homo sapiens; identical to SEQ ID NO: 6029

SEQ ID NO: 26868 - DNA, 31 bp, Homo sapiens; identical to SEQ ID NO: 6030

SEQ ID NO: 26869 - DNA, 29 bp, Homo sapiens
ctttttgatccttcgatgtcggctcttcc

SEQ ID NO: 26870 - DNA, 30 bp, Homo sapiens; identical to SEQ ID NO: 6031

SEQ ID NO: 26871 - DNA, 39 bp, Homo sapiens
ctttttgatccttcgatgtcggctcttcctatcattgtg

SEQ ID NO: 26872 - DNA, 28 bp, Homo sapiens
tttttgatccttcgatgtcggctcttcc

SEQ ID NO: 26873 - DNA, 29 bp, Homo sapiens
tttttgatccttcgatgtcggctcttcct

SEQ ID NO: 26874 - DNA, 32 bp, Homo sapiens
tttttgatccttcgatgtcggctcttcctatc

SEQ ID NO: 26875 - DNA, 38 bp, Homo sapiens
tttttgatccttcgatgtcggctcttcctatcattgtg

SEQ ID NO: 26876 - DNA, 18 bp, Homo sapiens
ttttgatccttcgatgtc

SEQ ID NO: 26877 - DNA, 22 bp, Homo sapiens
ttttgatccttcgatgtcggct

SEQ ID NO: 26878 - DNA, 23 bp, Homo sapiens
ttttgatccttcgatgtcggctc

SEQ ID NO: 26879 - DNA, 24 bp, Homo sapiens
ttttgatccttcgatgtcggctct

SEQ ID NO: 26880 - DNA, 26 bp, Homo sapiens
ttttgatccttcgatgtcggctcttc

SEQ ID NO: 26881 - DNA, 27 bp, Homo sapiens
ttttgatccttcgatgtcggctcttcc

SEQ ID NO: 26882 - DNA, 28 bp, Homo sapiens
ttttgatccttcgatgtcggctcttcct

SEQ ID NO: 26883 - DNA, 31 bp, Homo sapiens
ttttgatccttcgatgtcggctcttcctatc

SEQ ID NO: 26884 - DNA, 32 bp, Homo sapiens
ttttgatccttcgatgtcggctcttcctatca

SEQ ID NO: 26885 - DNA, 37 bp, Homo sapiens
ttttgatccttcgatgtcggctcttcctatcattgtg

SEQ ID NO: 26886 - DNA, 17 bp, Homo sapiens
tttgatccttcgatgtc

SEQ ID NO: 26887 - DNA, 22 bp, Homo sapiens
tttgatccttcgatgtcggctc

SEQ ID NO: 26888 - DNA, 23 bp, Homo sapiens
tttgatccttcgatgtcggctct

SEQ ID NO: 26889 - DNA, 26 bp, Homo sapiens
tttgatccttcgatgtcggctcttcc

SEQ ID NO: 26890 - DNA, 27 bp, Homo sapiens
tttgatccttcgatgtcggctcttcct

SEQ ID NO: 26891 - DNA, 30 bp, Homo sapiens
tttgatccttcgatgtcggctcttcctatc

SEQ ID NO: 26892 - DNA, 36 bp, Homo sapiens
tttgatccttcgatgtcggctcttcctatcattgtg

SEQ ID NO: 26893 - DNA, 20 bp, Homo sapiens
ttgatccttcgatgtcggct

SEQ ID NO: 26894 - DNA, 21 bp, Homo sapiens
ttgatccttcgatgtcggctc

SEQ ID NO: 26895 - DNA, 22 bp, Homo sapiens
ttgatccttcgatgtcggctct

SEQ ID NO: 26896 - DNA, 24 bp, Homo sapiens
ttgatccttcgatgtcggctcttc

SEQ ID NO: 26897 - DNA, 25 bp, Homo sapiens
ttgatccttcgatgtcggctcttcc

SEQ ID NO: 26898 - DNA, 26 bp, Homo sapiens
ttgatccttcgatgtcggctcttcct

SEQ ID NO: 26899 - DNA, 29 bp, Homo sapiens
ttgatccttcgatgtcggctcttcctatc

SEQ ID NO: 26900 - DNA, 33 bp, Homo sapiens; identical to SEQ ID NO: 6038

SEQ ID NO: 26901 - DNA, 35 bp, Homo sapiens
ttgatccttcgatgtcggctcttcctatcattgtg

SEQ ID NO: 26902 - DNA, 19 bp, Homo sapiens
tgatccttcgatgtcggct

SEQ ID NO: 26903 - DNA, 20 bp, Homo sapiens
tgatccttcgatgtcggctc

SEQ ID NO: 26904 - DNA, 24 bp, Homo sapiens
tgatccttcgatgtcggctcttcc

SEQ ID NO: 26905 - DNA, 25 bp, Homo sapiens
tgatccttcgatgtcggctcttcct

SEQ ID NO: 26906 - DNA, 28 bp, Homo sapiens
tgatccttcgatgtcggctcttcctatc

SEQ ID NO: 26907 - DNA, 29 bp, Homo sapiens
tgatccttcgatgtcggctcttcctatca

SEQ ID NO: 26908 - DNA, 32 bp, Homo sapiens; identical to SEQ ID NO: 6040

SEQ ID NO: 26909 - DNA, 34 bp, Homo sapiens
tgatccttcgatgtcggctcttcctatcattgtg

SEQ ID NO: 26910 - DNA, 18 bp, Homo sapiens
gatccttcgatgtcggct

SEQ ID NO: 26911 - DNA, 19 bp, Homo sapiens
gatccttcgatgtcggctc

SEQ ID NO: 26912 - DNA, 20 bp, Homo sapiens
gatccttcgatgtcggctct

SEQ ID NO: 26913 - DNA, 21 bp, Homo sapiens
gatccttcgatgtcggctctt

SEQ ID NO: 26914 - DNA, 22 bp, Homo sapiens
gatccttcgatgtcggctcttc

SEQ ID NO: 26915 - DNA, 23 bp, Homo sapiens
gatccttcgatgtcggctcttcc

SEQ ID NO: 26916 - DNA, 24 bp, Homo sapiens
gatccttcgatgtcggctcttcct

SEQ ID NO: 26917 - DNA, 27 bp, Homo sapiens
gatccttcgatgtcggctcttcctatc

SEQ ID NO: 26918 - DNA, 28 bp, Homo sapiens
gatccttcgatgtcggctcttcctatca

SEQ ID NO: 26919 - DNA, 29 bp, Homo sapiens
gatccttcgatgtcggctcttcctatcat

SEQ ID NO: 26920 - DNA, 30 bp, Homo sapiens
gatccttcgatgtcggctcttcctatcatt

SEQ ID NO: 26921 - DNA, 31 bp, Homo sapiens; identical to SEQ ID NO: 6044

SEQ ID NO: 26922 - DNA, 32 bp, Homo sapiens
gatccttcgatgtcggctcttcctatcattgt

SEQ ID NO: 26923 - DNA, 33 bp, Homo sapiens; identical to SEQ ID NO: 6045

SEQ ID NO: 26924 - DNA, 18 bp, Homo sapiens
atccttcgatgtcggctc

SEQ ID NO: 26925 - DNA, 19 bp, Homo sapiens
atccttcgatgtcggctct

SEQ ID NO: 26926 - DNA, 20 bp, Homo sapiens
atccttcgatgtcggctctt

SEQ ID NO: 26927 - DNA, 21 bp, Homo sapiens
atccttcgatgtcggctcttc

SEQ ID NO: 26928 - DNA, 22 bp, Homo sapiens
atccttcgatgtcggctcttcc

SEQ ID NO: 26929 - DNA, 23 bp, Homo sapiens
atccttcgatgtcggctcttcct

SEQ ID NO: 26930 - DNA, 26 bp, Homo sapiens
atccttcgatgtcggctcttcctatc

SEQ ID NO: 26931 - DNA, 27 bp, Homo sapiens
atccttcgatgtcggctcttcctatca

SEQ ID NO: 26932 - DNA, 28 bp, Homo sapiens
atccttcgatgtcggctcttcctatcat

SEQ ID NO: 26933 - DNA, 29 bp, Homo sapiens
atccttcgatgtcggctcttcctatcatt

SEQ ID NO: 26934 - DNA, 30 bp, Homo sapiens; identical to SEQ ID NO: 6051

SEQ ID NO: 26935 - DNA, 32 bp, Homo sapiens; identical to SEQ ID NO: 6052

SEQ ID NO: 26936 - DNA, 33 bp, Homo sapiens; identical to SEQ ID NO: 6053

SEQ ID NO: 26937 - DNA, 36 bp, Homo sapiens
atccttcgatgtcggctcttcctatcattgtgaagc

SEQ ID NO: 26938 - DNA, 37 bp, Homo sapiens
atccttcgatgtcggctcttcctatcattgtgaagca

SEQ ID NO: 26939 - DNA, 23 bp, Homo sapiens
tccttcgatgtcggctcttccta

SEQ ID NO: 26940 - DNA, 26 bp, Homo sapiens
tccttcgatgtcggctcttcctatca

SEQ ID NO: 26941 - DNA, 29 bp, Homo sapiens
tccttcgatgtcggctcttcctatcattg

SEQ ID NO: 26942 - DNA, 31 bp, Homo sapiens; identical to SEQ ID NO: 6054

SEQ ID NO: 26943 - DNA, 32 bp, Homo sapiens
tccttcgatgtcggctcttcctatcattgtga

SEQ ID NO: 26944 - DNA, 33 bp, Homo sapiens
tccttcgatgtcggctcttcctatcattgtgaa

SEQ ID NO: 26945 - DNA, 16 bp, Homo sapiens
ccttcgatgtcggctc

SEQ ID NO: 26946 - DNA, 17 bp, Homo sapiens
ccttcgatgtcggctct

SEQ ID NO: 26947 - DNA, 19 bp, Homo sapiens
ccttcgatgtcggctcttc

SEQ ID NO: 26948 - DNA, 20 bp, Homo sapiens
ccttcgatgtcggctcttcc

SEQ ID NO: 26949 - DNA, 21 bp, Homo sapiens
ccttcgatgtcggctcttcct

SEQ ID NO: 26950 - DNA, 24 bp, Homo sapiens
ccttcgatgtcggctcttcctatc

SEQ ID NO: 26951 - DNA, 25 bp, Homo sapiens
ccttcgatgtcggctcttcctatca

SEQ ID NO: 26952 - DNA, 28 bp, Homo sapiens
ccttcgatgtcggctcttcctatcattg

SEQ ID NO: 26953 - DNA, 29 bp, Homo sapiens
ccttcgatgtcggctcttcctatcattgt

SEQ ID NO: 26954 - DNA, 30 bp, Homo sapiens; identical to SEQ ID NO: 6059

SEQ ID NO: 26955 - DNA, 16 bp, Homo sapiens
cttcgatgtcggctct

SEQ ID NO: 26956 - DNA, 17 bp, Homo sapiens
cttcgatgtcggctctt

SEQ ID NO: 26957 - DNA, 18 bp, Homo sapiens
cttcgatgtcggctcttc

SEQ ID NO: 26958 - DNA, 19 bp, Homo sapiens
cttcgatgtcggctcttcc

SEQ ID NO: 26959 - DNA, 20 bp, Homo sapiens
cttcgatgtcggctcttcct

SEQ ID NO: 26960 - DNA, 21 bp, Homo sapiens
cttcgatgtcggctcttccta

SEQ ID NO: 26961 - DNA, 23 bp, Homo sapiens
cttcgatgtcggctcttcctatc

SEQ ID NO: 26962 - DNA, 24 bp, Homo sapiens
cttcgatgtcggctcttcctatca

SEQ ID NO: 26963 - DNA, 25 bp, Homo sapiens
cttcgatgtcggctcttcctatcat

SEQ ID NO: 26964 - DNA, 26 bp, Homo sapiens
cttcgatgtcggctcttcctatcatt

SEQ ID NO: 26965 - DNA, 27 bp, Homo sapiens
cttcgatgtcggctcttcctatcattg

SEQ ID NO: 26966 - DNA, 28 bp, Homo sapiens
cttcgatgtcggctcttcctatcattgt

SEQ ID NO: 26967 - DNA, 29 bp, Homo sapiens
cttcgatgtcggctcttcctatcattgtg

SEQ ID NO: 26968 - DNA, 33 bp, Homo sapiens; identical to SEQ ID NO: 6068

SEQ ID NO: 26969 - DNA, 34 bp, Homo sapiens
cttcgatgtcggctcttcctatcattgtgaagca

SEQ ID NO: 26970 - DNA, 43 bp, Homo sapiens
cttcgatgtcggctcttcctatcattgtgaagcagaattcacc

SEQ ID NO: 26971 - DNA, 16 bp, Homo sapiens
ttcgatgtcggctctt

SEQ ID NO: 26972 - DNA, 17 bp, Homo sapiens
ttcgatgtcggctcttc

SEQ ID NO: 26973 - DNA, 18 bp, Homo sapiens
ttcgatgtcggctcttcc

SEQ ID NO: 26974 - DNA, 19 bp, Homo sapiens
ttcgatgtcggctcttcct

SEQ ID NO: 26975 - DNA, 20 bp, Homo sapiens
ttcgatgtcggctcttccta

SEQ ID NO: 26976 - DNA, 21 bp, Homo sapiens
ttcgatgtcggctcttcctat

SEQ ID NO: 26977 - DNA, 22 bp, Homo sapiens
ttcgatgtcggctcttcctatc

SEQ ID NO: 26978 - DNA, 23 bp, Homo sapiens
ttcgatgtcggctcttcctatca

SEQ ID NO: 26979 - DNA, 24 bp, Homo sapiens
ttcgatgtcggctcttcctatcat

SEQ ID NO: 26980 - DNA, 25 bp, Homo sapiens
ttcgatgtcggctcttcctatcatt

SEQ ID NO: 26981 - DNA, 26 bp, Homo sapiens
ttcgatgtcggctcttcctatcattg

SEQ ID NO: 26982 - DNA, 27 bp, Homo sapiens
ttcgatgtcggctcttcctatcattgt

SEQ ID NO: 26983 - DNA, 28 bp, Homo sapiens
ttcgatgtcggctcttcctatcattgtg

SEQ ID NO: 26984 - DNA, 29 bp, Homo sapiens
ttcgatgtcggctcttcctatcattgtga

SEQ ID NO: 26985 - DNA, 31 bp, Homo sapiens; identical to SEQ ID NO: 6078

SEQ ID NO: 26986 - DNA, 32 bp, Homo sapiens; identical to SEQ ID NO: 6079

SEQ ID NO: 26987 - DNA, 33 bp, Homo sapiens; identical to SEQ ID NO: 6080

SEQ ID NO: 26988 - DNA, 35 bp, Homo sapiens
ttcgatgtcggctcttcctatcattgtgaagcaga

SEQ ID NO: 26989 - DNA, 42 bp, Homo sapiens
ttcgatgtcggctcttcctatcattgtgaagcagaattcacc

SEQ ID NO: 26990 - DNA, 16 bp, Homo sapiens
tcgatgtcggctcttc

SEQ ID NO: 26991 - DNA, 17 bp, Homo sapiens
tcgatgtcggctcttcc

SEQ ID NO: 26992 - DNA, 18 bp, Homo sapiens
tcgatgtcggctcttcct

SEQ ID NO: 26993 - DNA, 21 bp, Homo sapiens
tcgatgtcggctcttcctatc

SEQ ID NO: 26994 - DNA, 22 bp, Homo sapiens
tcgatgtcggctcttcctatca

SEQ ID NO: 26995 - DNA, 25 bp, Homo sapiens
tcgatgtcggctcttcctatcattg

SEQ ID NO: 26996 - DNA, 27 bp, Homo sapiens
tcgatgtcggctcttcctatcattgtg

SEQ ID NO: 26997 - DNA, 31 bp, Homo sapiens; identical to SEQ ID NO: 6086

SEQ ID NO: 26998 - DNA, 32 bp, Homo sapiens; identical to SEQ ID NO: 6087

SEQ ID NO: 26999 - DNA, 16 bp, Homo sapiens
cgatgtcggctcttcc

SEQ ID NO: 27000 - DNA, 17 bp, Homo sapiens
cgatgtcggctcttcct

SEQ ID NO: 27001 - DNA, 20 bp, Homo sapiens
cgatgtcggctcttcctatc

SEQ ID NO: 27002 - DNA, 21 bp, Homo sapiens
cgatgtcggctcttcctatca

SEQ ID NO: 27003 - DNA, 24 bp, Homo sapiens
cgatgtcggctcttcctatcattg

SEQ ID NO: 27004 - DNA, 30 bp, Homo sapiens
cgatgtcggctcttcctatcattgtgaagc

SEQ ID NO: 27005 - DNA, 31 bp, Homo sapiens; identical to SEQ ID NO: 6092

SEQ ID NO: 27006 - DNA, 32 bp, Homo sapiens
cgatgtcggctcttcctatcattgtgaagcag

SEQ ID NO: 27007 - DNA, 16 bp, Homo sapiens
gatgtcggctcttcct

SEQ ID NO: 27008 - DNA, 17 bp, Homo sapiens
gatgtcggctcttccta

SEQ ID NO: 27009 - DNA, 18 bp, Homo sapiens
gatgtcggctcttcctat

SEQ ID NO: 27010 - DNA, 19 bp, Homo sapiens
gatgtcggctcttcctatc

SEQ ID NO: 27011 - DNA, 20 bp, Homo sapiens
gatgtcggctcttcctatca

SEQ ID NO: 27012 - DNA, 21 bp, Homo sapiens
gatgtcggctcttcctatcat

SEQ ID NO: 27013 - DNA, 22 bp, Homo sapiens
gatgtcggctcttcctatcatt

SEQ ID NO: 27014 - DNA, 23 bp, Homo sapiens
gatgtcggctcttcctatcattg

SEQ ID NO: 27015 - DNA, 25 bp, Homo sapiens
gatgtcggctcttcctatcattgtg

SEQ ID NO: 27016 - DNA, 26 bp, Homo sapiens
gatgtcggctcttcctatcattgtga

SEQ ID NO: 27017 - DNA, 28 bp, Homo sapiens
gatgtcggctcttcctatcattgtgaag

SEQ ID NO: 27018 - DNA, 29 bp, Homo sapiens
gatgtcggctcttcctatcattgtgaagc

SEQ ID NO: 27019 - DNA, 30 bp, Homo sapiens; identical to SEQ ID NO: 6101

SEQ ID NO: 27020 - DNA, 31 bp, Homo sapiens; identical to SEQ ID NO: 6102

SEQ ID NO: 27021 - DNA, 32 bp, Homo sapiens; identical to SEQ ID NO: 6103

SEQ ID NO: 27022 - DNA, 39 bp, Homo sapiens
gatgtcggctcttcctatcattgtgaagcagaattcacc

SEQ ID NO: 27023 - DNA, 16 bp, Homo sapiens
atgtcggctcttccta

SEQ ID NO: 27024 - DNA, 17 bp, Homo sapiens
atgtcggctcttcctat

SEQ ID NO: 27025 - DNA, 18 bp, Homo sapiens
atgtcggctcttcctatc

SEQ ID NO: 27026 - DNA, 19 bp, Homo sapiens
atgtcggctcttcctatca

SEQ ID NO: 27027 - DNA, 20 bp, Homo sapiens
atgtcggctcttcctatcat

SEQ ID NO: 27028 - DNA, 21 bp, Homo sapiens
atgtcggctcttcctatcatt

SEQ ID NO: 27029 - DNA, 22 bp, Homo sapiens
atgtcggctcttcctatcattg

SEQ ID NO: 27030 - DNA, 23 bp, Homo sapiens
atgtcggctcttcctatcattgt

SEQ ID NO: 27031 - DNA, 24 bp, Homo sapiens
atgtcggctcttcctatcattgtg

SEQ ID NO: 27032 - DNA, 25 bp, Homo sapiens
atgtcggctcttcctatcattgtga

SEQ ID NO: 27033 - DNA, 26 bp, Homo sapiens
atgtcggctcttcctatcattgtgaa

SEQ ID NO: 27034 - DNA, 27 bp, Homo sapiens
atgtcggctcttcctatcattgtgaag

SEQ ID NO: 27035 - DNA, 28 bp, Homo sapiens
atgtcggctcttcctatcattgtgaagc

SEQ ID NO: 27036 - DNA, 29 bp, Homo sapiens
atgtcggctcttcctatcattgtgaagca

SEQ ID NO: 27037 - DNA, 30 bp, Homo sapiens; identical to SEQ ID NO: 6111

SEQ ID NO: 27038 - DNA, 31 bp, Homo sapiens; identical to SEQ ID NO: 6112

SEQ ID NO: 27039 - DNA, 38 bp, Homo sapiens
atgtcggctcttcctatcattgtgaagcagaattcacc

SEQ ID NO: 27040 - DNA, 18 bp, Homo sapiens
tgtcggctcttcctatca

SEQ ID NO: 27041 - DNA, 24 bp, Homo sapiens
tgtcggctcttcctatcattgtga

SEQ ID NO: 27042 - DNA, 25 bp, Homo sapiens
tgtcggctcttcctatcattgtgaa

SEQ ID NO: 27043 - DNA, 28 bp, Homo sapiens
tgtcggctcttcctatcattgtgaagca

SEQ ID NO: 27044 - DNA, 29 bp, Homo sapiens
tgtcggctcttcctatcattgtgaagcag

SEQ ID NO: 27045 - DNA, 30 bp, Homo sapiens
tgtcggctcttcctatcattgtgaagcaga

SEQ ID NO: 27046 - DNA, 16 bp, Homo sapiens
gtcggctcttcctatc

SEQ ID NO: 27047 - DNA, 26 bp, Homo sapiens
gtcggctcttcctatcattgtgaagc

SEQ ID NO: 27048 - DNA, 27 bp, Homo sapiens
gtcggctcttcctatcattgtgaagca

SEQ ID NO: 27049 - DNA, 28 bp, Homo sapiens
gtcggctcttcctatcattgtgaagcag

SEQ ID NO: 27050 - DNA, 33 bp, Homo sapiens; identical to SEQ ID NO: 6113

SEQ ID NO: 27051 - DNA, 32 bp, Homo sapiens; identical to SEQ ID NO: 6114

SEQ ID NO: 27052 - DNA, 40 bp, Homo sapiens
tatcattgtgaagcagaattcaccaagcgttggattgttc

SEQ ID NO: 27053 - DNA, 43 bp, Homo sapiens
tatcattgtgaagcagaattcaccaagcgttggattgttcacc

SEQ ID NO: 27054 - DNA, 44 bp, Homo sapiens
tatcattgtgaagcagaattcaccaagcgttggattgttcaccc

SEQ ID NO: 27055 - DNA, 47 bp, Homo sapiens
tatcattgtgaagcagaattcaccaagcgttggattgttcacccact

SEQ ID NO: 27056 - DNA, 33 bp, Homo sapiens
atcattgtgaagcagaattcaccaagcgttgga

SEQ ID NO: 27057 - DNA, 39 bp, Homo sapiens
atcattgtgaagcagaattcaccaagcgttggattgttc

SEQ ID NO: 27058 - DNA, 42 bp, Homo sapiens
atcattgtgaagcagaattcaccaagcgttggattgttcacc

SEQ ID NO: 27059 - DNA, 43 bp, Homo sapiens
atcattgtgaagcagaattcaccaagcgttggattgttcaccc

SEQ ID NO: 27060 - DNA, 46 bp, Homo sapiens
atcattgtgaagcagaattcaccaagcgttggattgttcacccact

SEQ ID NO: 27061 - DNA, 20 bp, Homo sapiens
tcattgtgaagcagaattca

SEQ ID NO: 27062 - DNA, 32 bp, Homo sapiens
tcattgtgaagcagaattcaccaagcgttgga

SEQ ID NO: 27063 - DNA, 38 bp, Homo sapiens
tcattgtgaagcagaattcaccaagcgttggattgttc

SEQ ID NO: 27064 - DNA, 42 bp, Homo sapiens
tcattgtgaagcagaattcaccaagcgttggattgttcaccc

SEQ ID NO: 27065 - DNA, 45 bp, Homo sapiens
tcattgtgaagcagaattcaccaagcgttggattgttcacccact

SEQ ID NO: 27066 - DNA, 36 bp, Homo sapiens
cattgtgaagcagaattcaccaagcgttggattgtt

SEQ ID NO: 27067 - DNA, 37 bp, Homo sapiens
cattgtgaagcagaattcaccaagcgttggattgttc

SEQ ID NO: 27068 - DNA, 40 bp, Homo sapiens
cattgtgaagcagaattcaccaagcgttggattgttcacc

SEQ ID NO: 27069 - DNA, 41 bp, Homo sapiens
cattgtgaagcagaattcaccaagcgttggattgttcaccc

SEQ ID NO: 27070 - DNA, 44 bp, Homo sapiens
cattgtgaagcagaattcaccaagcgttggattgttcacccact

SEQ ID NO: 27071 - DNA, 17 bp, Homo sapiens
attgtgaagcagaattc

SEQ ID NO: 27072 - DNA, 18 bp, Homo sapiens
attgtgaagcagaattca

SEQ ID NO: 27073 - DNA, 20 bp, Homo sapiens
attgtgaagcagaattcacc

SEQ ID NO: 27074 - DNA, 30 bp, Homo sapiens
attgtgaagcagaattcaccaagcgttgga

SEQ ID NO: 27075 - DNA, 35 bp, Homo sapiens
attgtgaagcagaattcaccaagcgttggattgtt

SEQ ID NO: 27076 - DNA, 36 bp, Homo sapiens
attgtgaagcagaattcaccaagcgttggattgttc

SEQ ID NO: 27077 - DNA, 37 bp, Homo sapiens
attgtgaagcagaattcaccaagcgttggattgttca

SEQ ID NO: 27078 - DNA, 39 bp, Homo sapiens
attgtgaagcagaattcaccaagcgttggattgttcacc

SEQ ID NO: 27079 - DNA, 40 bp, Homo sapiens
attgtgaagcagaattcaccaagcgttggattgttcaccc

SEQ ID NO: 27080 - DNA, 41 bp, Homo sapiens
attgtgaagcagaattcaccaagcgttggattgttcaccca

SEQ ID NO: 27081 - DNA, 43 bp, Homo sapiens
attgtgaagcagaattcaccaagcgttggattgttcacccact

SEQ ID NO: 27082 - DNA, 16 bp, Homo sapiens
ttgtgaagcagaattc

SEQ ID NO: 27083 - DNA, 17 bp, Homo sapiens
ttgtgaagcagaattca

SEQ ID NO: 27084 - DNA, 19 bp, Homo sapiens
ttgtgaagcagaattcacc

SEQ ID NO: 27085 - DNA, 25 bp, Homo sapiens
ttgtgaagcagaattcaccaagcgt

SEQ ID NO: 27086 - DNA, 29 bp, Homo sapiens
ttgtgaagcagaattcaccaagcgttgga

SEQ ID NO: 27087 - DNA, 30 bp, Homo sapiens
ttgtgaagcagaattcaccaagcgttggat

SEQ ID NO: 27088 - DNA, 33 bp, Homo sapiens
ttgtgaagcagaattcaccaagcgttggattgt

SEQ ID NO: 27089 - DNA, 34 bp, Homo sapiens
ttgtgaagcagaattcaccaagcgttggattgtt

SEQ ID NO: 27090 - DNA, 35 bp, Homo sapiens
ttgtgaagcagaattcaccaagcgttggattgttc

SEQ ID NO: 27091 - DNA, 36 bp, Homo sapiens
ttgtgaagcagaattcaccaagcgttggattgttca

SEQ ID NO: 27092 - DNA, 38 bp, Homo sapiens
ttgtgaagcagaattcaccaagcgttggattgttcacc

SEQ ID NO: 27093 - DNA, 39 bp, Homo sapiens
ttgtgaagcagaattcaccaagcgttggattgttcaccc

SEQ ID NO: 27094 - DNA, 40 bp, Homo sapiens
ttgtgaagcagaattcaccaagcgttggattgttcaccca

SEQ ID NO: 27095 - DNA, 41 bp, Homo sapiens
ttgtgaagcagaattcaccaagcgttggattgttcacccac

SEQ ID NO: 27096 - DNA, 42 bp, Homo sapiens
ttgtgaagcagaattcaccaagcgttggattgttcacccact

SEQ ID NO: 27097 - DNA, 43 bp, Homo sapiens
ttgtgaagcagaattcaccaagcgttggattgttcacccacta

SEQ ID NO: 27098 - DNA, 45 bp, Homo sapiens
ttgtgaagcagaattcaccaagcgttggattgttcacccactaat

SEQ ID NO: 27099 - DNA, 47 bp, Homo sapiens
ttgtgaagcagaattcaccaagcgttggattgttcacccactaatag

SEQ ID NO: 27100 - DNA, 28 bp, Homo sapiens
tgtgaagcagaattcaccaagcgttgga

SEQ ID NO: 27101 - DNA, 33 bp, Homo sapiens; identical to SEQ ID NO: 6116

SEQ ID NO: 27102 - DNA, 34 bp, Homo sapiens
tgtgaagcagaattcaccaagcgttggattgttc

SEQ ID NO: 27103 - DNA, 35 bp, Homo sapiens
tgtgaagcagaattcaccaagcgttggattgttca

SEQ ID NO: 27104 - DNA, 37 bp, Homo sapiens
tgtgaagcagaattcaccaagcgttggattgttcacc

SEQ ID NO: 27105 - DNA, 38 bp, Homo sapiens
tgtgaagcagaattcaccaagcgttggattgttcaccc

SEQ ID NO: 27106 - DNA, 39 bp, Homo sapiens
tgtgaagcagaattcaccaagcgttggattgttcaccca

SEQ ID NO: 27107 - DNA, 41 bp, Homo sapiens
tgtgaagcagaattcaccaagcgttggattgttcacccact

SEQ ID NO: 27108 - DNA, 27 bp, Homo sapiens
gtgaagcagaattcaccaagcgttgga

SEQ ID NO: 27109 - DNA, 32 bp, Homo sapiens; identical to SEQ ID NO: 6117

SEQ ID NO: 27110 - DNA, 33 bp, Homo sapiens; identical to SEQ ID NO: 6118

SEQ ID NO: 27111 - DNA, 34 bp, Homo sapiens
gtgaagcagaattcaccaagcgttggattgttca

SEQ ID NO: 27112 - DNA, 36 bp, Homo sapiens
gtgaagcagaattcaccaagcgttggattgttcacc

SEQ ID NO: 27113 - DNA, 37 bp, Homo sapiens
gtgaagcagaattcaccaagcgttggattgttcaccc

SEQ ID NO: 27114 - DNA, 40 bp, Homo sapiens
gtgaagcagaattcaccaagcgttggattgttcacccact

SEQ ID NO: 27115 - DNA, 26 bp, Homo sapiens
tgaagcagaattcaccaagcgttgga

SEQ ID NO: 27116 - DNA, 31 bp, Homo sapiens
tgaagcagaattcaccaagcgttggattgtt

SEQ ID NO: 27117 - DNA, 32 bp, Homo sapiens; identical to SEQ ID NO: 6119

SEQ ID NO: 27118 - DNA, 35 bp, Homo sapiens
tgaagcagaattcaccaagcgttggattgttcacc

SEQ ID NO: 27119 - DNA, 36 bp, Homo sapiens
tgaagcagaattcaccaagcgttggattgttcaccc

SEQ ID NO: 27120 - DNA, 39 bp, Homo sapiens
tgaagcagaattcaccaagcgttggattgttcacccact

SEQ ID NO: 27121 - DNA, 25 bp, Homo sapiens
gaagcagaattcaccaagcgttgga

SEQ ID NO: 27122 - DNA, 31 bp, Homo sapiens
gaagcagaattcaccaagcgttggattgttc

SEQ ID NO: 27123 - DNA, 34 bp, Homo sapiens
gaagcagaattcaccaagcgttggattgttcacc

SEQ ID NO: 27124 - DNA, 35 bp, Homo sapiens
gaagcagaattcaccaagcgttggattgttcaccc

SEQ ID NO: 27125 - DNA, 38 bp, Homo sapiens
gaagcagaattcaccaagcgttggattgttcacccact

SEQ ID NO: 27126 - DNA, 24 bp, Homo sapiens
aagcagaattcaccaagcgttgga

SEQ ID NO: 27127 - DNA, 29 bp, Homo sapiens
aagcagaattcaccaagcgttggattgtt

SEQ ID NO: 27128 - DNA, 30 bp, Homo sapiens; identical to SEQ ID NO: 6120

SEQ ID NO: 27129 - DNA, 33 bp, Homo sapiens; identical to SEQ ID NO: 6121

SEQ ID NO: 27130 - DNA, 34 bp, Homo sapiens
aagcagaattcaccaagcgttggattgttcaccc

SEQ ID NO: 27131 - DNA, 35 bp, Homo sapiens
aagcagaattcaccaagcgttggattgttcaccca

SEQ ID NO: 27132 - DNA, 37 bp, Homo sapiens
aagcagaattcaccaagcgttggattgttcacccact

SEQ ID NO: 27133 - DNA, 42 bp, Homo sapiens
aagcagaattcaccaagcgttggattgttcacccactaatag

SEQ ID NO: 27134 - DNA, 43 bp, Homo sapiens
aagcagaattcaccaagcgttggattgttcacccactaatagg

SEQ ID NO: 27135 - DNA, 23 bp, Homo sapiens
agcagaattcaccaagcgttgga

SEQ ID NO: 27136 - DNA, 24 bp, Homo sapiens
agcagaattcaccaagcgttggat

SEQ ID NO: 27137 - DNA, 28 bp, Homo sapiens
agcagaattcaccaagcgttggattgtt

SEQ ID NO: 27138 - DNA, 29 bp, Homo sapiens
agcagaattcaccaagcgttggattgttc

SEQ ID NO: 27139 - DNA, 32 bp, Homo sapiens; identical to SEQ ID NO: 6123

SEQ ID NO: 27140 - DNA, 33 bp, Homo sapiens; identical to SEQ ID NO: 6124

SEQ ID NO: 27141 - DNA, 34 bp, Homo sapiens
agcagaattcaccaagcgttggattgttcaccca

SEQ ID NO: 27142 - DNA, 36 bp, Homo sapiens
agcagaattcaccaagcgttggattgttcacccact

SEQ ID NO: 27143 - DNA, 42 bp, Homo sapiens
agcagaattcaccaagcgttggattgttcacccactaatagg

SEQ ID NO: 27144 - DNA, 22 bp, Homo sapiens
gcagaattcaccaagcgttgga

SEQ ID NO: 27145 - DNA, 23 bp, Homo sapiens
gcagaattcaccaagcgttggat

SEQ ID NO: 27146 - DNA, 27 bp, Homo sapiens
gcagaattcaccaagcgttggattgtt

SEQ ID NO: 27147 - DNA, 28 bp, Homo sapiens
gcagaattcaccaagcgttggattgttc

SEQ ID NO: 27148 - DNA, 31 bp, Homo sapiens; identical to SEQ ID NO: 6126

SEQ ID NO: 27149 - DNA, 32 bp, Homo sapiens; identical to SEQ ID NO: 6127

SEQ ID NO: 27150 - DNA, 33 bp, Homo sapiens; identical to SEQ ID NO: 6128

SEQ ID NO: 27151 - DNA, 35 bp, Homo sapiens
gcagaattcaccaagcgttggattgttcacccact

SEQ ID NO: 27152 - DNA, 21 bp, Homo sapiens
cagaattcaccaagcgttgga

SEQ ID NO: 27153 - DNA, 26 bp, Homo sapiens
cagaattcaccaagcgttggattgtt

SEQ ID NO: 27154 - DNA, 27 bp, Homo sapiens
cagaattcaccaagcgttggattgttc

SEQ ID NO: 27155 - DNA, 30 bp, Homo sapiens; identical to SEQ ID NO: 6130

SEQ ID NO: 27156 - DNA, 31 bp, Homo sapiens; identical to SEQ ID NO: 6131

SEQ ID NO: 27157 - DNA, 32 bp, Homo sapiens; identical to SEQ ID NO: 6132

SEQ ID NO: 27158 - DNA, 33 bp, Homo sapiens
cagaattcaccaagcgttggattgttcacccac

SEQ ID NO: 27159 - DNA, 34 bp, Homo sapiens
cagaattcaccaagcgttggattgttcacccact

SEQ ID NO: 27160 - DNA, 39 bp, Homo sapiens
cagaattcaccaagcgttggattgttcacccactaatag

SEQ ID NO: 27161 - DNA, 40 bp, Homo sapiens
cagaattcaccaagcgttggattgttcacccactaatagg

SEQ ID NO: 27162 - DNA, 20 bp, Homo sapiens
agaattcaccaagcgttgga

SEQ ID NO: 27163 - DNA, 25 bp, Homo sapiens
agaattcaccaagcgttggattgtt

SEQ ID NO: 27164 - DNA, 26 bp, Homo sapiens
agaattcaccaagcgttggattgttc

SEQ ID NO: 27165 - DNA, 29 bp, Homo sapiens
agaattcaccaagcgttggattgttcacc

SEQ ID NO: 27166 - DNA, 30 bp, Homo sapiens; identical to SEQ ID NO: 6134

SEQ ID NO: 27167 - DNA, 31 bp, Homo sapiens; identical to SEQ ID NO: 6135

SEQ ID NO: 27168 - DNA, 32 bp, Homo sapiens
agaattcaccaagcgttggattgttcacccac

SEQ ID NO: 27169 - DNA, 33 bp, Homo sapiens; identical to SEQ ID NO: 6136

SEQ ID NO: 27170 - DNA, 39 bp, Homo sapiens
agaattcaccaagcgttggattgttcacccactaatagg

SEQ ID NO: 27171 - DNA, 19 bp, Homo sapiens
gaattcaccaagcgttgga

SEQ ID NO: 27172 - DNA, 24 bp, Homo sapiens
gaattcaccaagcgttggattgtt

SEQ ID NO: 27173 - DNA, 25 bp, Homo sapiens
gaattcaccaagcgttggattgttc

SEQ ID NO: 27174 - DNA, 26 bp, Homo sapiens
gaattcaccaagcgttggattgttca

SEQ ID NO: 27175 - DNA, 27 bp, Homo sapiens
gaattcaccaagcgttggattgttcac

SEQ ID NO: 27176 - DNA, 28 bp, Homo sapiens
gaattcaccaagcgttggattgttcacc

SEQ ID NO: 27177 - DNA, 29 bp, Homo sapiens
gaattcaccaagcgttggattgttcaccc

SEQ ID NO: 27178 - DNA, 30 bp, Homo sapiens; identical to SEQ ID NO: 6142

SEQ ID NO: 27179 - DNA, 31 bp, Homo sapiens; identical to SEQ ID NO: 6143

SEQ ID NO: 27180 - DNA, 32 bp, Homo sapiens; identical to SEQ ID NO: 6144

SEQ ID NO: 27181 - DNA, 33 bp, Homo sapiens; identical to SEQ ID NO: 6145

SEQ ID NO: 27182 - DNA, 35 bp, Homo sapiens
gaattcaccaagcgttggattgttcacccactaat

SEQ ID NO: 27183 - DNA, 36 bp, Homo sapiens
gaattcaccaagcgttggattgttcacccactaata

SEQ ID NO: 27184 - DNA, 37 bp, Homo sapiens
gaattcaccaagcgttggattgttcacccactaatag

SEQ ID NO: 27185 - DNA, 38 bp, Homo sapiens
gaattcaccaagcgttggattgttcacccactaatagg

SEQ ID NO: 27186 - DNA, 39 bp, Homo sapiens
gaattcaccaagcgttggattgttcacccactaataggg

SEQ ID NO: 27187 - DNA, 18 bp, Homo sapiens
aattcaccaagcgttgga

SEQ ID NO: 27188 - DNA, 23 bp, Homo sapiens
aattcaccaagcgttggattgtt

SEQ ID NO: 27189 - DNA, 24 bp, Homo sapiens
aattcaccaagcgttggattgttc

SEQ ID NO: 27190 - DNA, 27 bp, Homo sapiens
aattcaccaagcgttggattgttcacc

SEQ ID NO: 27191 - DNA, 28 bp, Homo sapiens
aattcaccaagcgttggattgttcaccc

SEQ ID NO: 27192 - DNA, 29 bp, Homo sapiens
aattcaccaagcgttggattgttcaccca

SEQ ID NO: 27193 - DNA, 30 bp, Homo sapiens; identical to SEQ ID NO: 6150

SEQ ID NO: 27194 - DNA, 31 bp, Homo sapiens; identical to SEQ ID NO: 6151

SEQ ID NO: 27195 - DNA, 32 bp, Homo sapiens; identical to SEQ ID NO: 6152

SEQ ID NO: 27196 - DNA, 33 bp, Homo sapiens; identical to SEQ ID NO: 6153

SEQ ID NO: 27197 - DNA, 34 bp, Homo sapiens
aattcaccaagcgttggattgttcacccactaat

SEQ ID NO: 27198 - DNA, 35 bp, Homo sapiens
aattcaccaagcgttggattgttcacccactaata

SEQ ID NO: 27199 - DNA, 36 bp, Homo sapiens
aattcaccaagcgttggattgttcacccactaatag

SEQ ID NO: 27200 - DNA, 37 bp, Homo sapiens
aattcaccaagcgttggattgttcacccactaatagg

SEQ ID NO: 27201 - DNA, 38 bp, Homo sapiens
aattcaccaagcgttggattgttcacccactaataggg

SEQ ID NO: 27202 - DNA, 47 bp, Homo sapiens
aattcaccaagcgttggattgttcacccactaatagggaacgtgagc

SEQ ID NO: 27203 - DNA, 17 bp, Homo sapiens
attcaccaagcgttgga

SEQ ID NO: 27204 - DNA, 22 bp, Homo sapiens
attcaccaagcgttggattgtt

SEQ ID NO: 27205 - DNA, 23 bp, Homo sapiens
attcaccaagcgttggattgttc

SEQ ID NO: 27206 - DNA, 24 bp, Homo sapiens
attcaccaagcgttggattgttca

SEQ ID NO: 27207 - DNA, 26 bp, Homo sapiens
attcaccaagcgttggattgttcacc

SEQ ID NO: 27208 - DNA, 27 bp, Homo sapiens
attcaccaagcgttggattgttcaccc

SEQ ID NO: 27209 - DNA, 28 bp, Homo sapiens
attcaccaagcgttggattgttcaccca

SEQ ID NO: 27210 - DNA, 29 bp, Homo sapiens
attcaccaagcgttggattgttcacccac

SEQ ID NO: 27211 - DNA, 30 bp, Homo sapiens; identical to SEQ ID NO: 6157

SEQ ID NO: 27212 - DNA, 31 bp, Homo sapiens
attcaccaagcgttggattgttcacccacta

SEQ ID NO: 27213 - DNA, 32 bp, Homo sapiens
attcaccaagcgttggattgttcacccactaa

SEQ ID NO: 27214 - DNA, 33 bp, Homo sapiens; identical to SEQ ID NO: 6158

SEQ ID NO: 27215 - DNA, 35 bp, Homo sapiens
attcaccaagcgttggattgttcacccactaatag

SEQ ID NO: 27216 - DNA, 36 bp, Homo sapiens
attcaccaagcgttggattgttcacccactaatagg

SEQ ID NO: 27217 - DNA, 37 bp, Homo sapiens
attcaccaagcgttggattgttcacccactaataggg

SEQ ID NO: 27218 - DNA, 16 bp, Homo sapiens
ttcaccaagcgttgga

SEQ ID NO: 27219 - DNA, 21 bp, Homo sapiens
ttcaccaagcgttggattgtt

SEQ ID NO: 27220 - DNA, 22 bp, Homo sapiens
ttcaccaagcgttggattgttc

SEQ ID NO: 27221 - DNA, 25 bp, Homo sapiens
ttcaccaagcgttggattgttcacc

SEQ ID NO: 27222 - DNA, 26 bp, Homo sapiens
ttcaccaagcgttggattgttcaccc

SEQ ID NO: 27223 - DNA, 27 bp, Homo sapiens
ttcaccaagcgttggattgttcaccca

SEQ ID NO: 27224 - DNA, 28 bp, Homo sapiens
ttcaccaagcgttggattgttcacccac

SEQ ID NO: 27225 - DNA, 29 bp, Homo sapiens
ttcaccaagcgttggattgttcacccact

SEQ ID NO: 27226 - DNA, 30 bp, Homo sapiens
ttcaccaagcgttggattgttcacccacta

SEQ ID NO: 27227 - DNA, 31 bp, Homo sapiens
ttcaccaagcgttggattgttcacccactaa

SEQ ID NO: 27228 - DNA, 32 bp, Homo sapiens
ttcaccaagcgttggattgttcacccactaat

SEQ ID NO: 27229 - DNA, 33 bp, Homo sapiens
ttcaccaagcgttggattgttcacccactaata

SEQ ID NO: 27230 - DNA, 35 bp, Homo sapiens
ttcaccaagcgttggattgttcacccactaatagg

SEQ ID NO: 27231 - DNA, 36 bp, Homo sapiens
ttcaccaagcgttggattgttcacccactaataggg

SEQ ID NO: 27232 - DNA, 20 bp, Homo sapiens
tcaccaagcgttggattgtt

SEQ ID NO: 27233 - DNA, 21 bp, Homo sapiens
tcaccaagcgttggattgttc

SEQ ID NO: 27234 - DNA, 23 bp, Homo sapiens
tcaccaagcgttggattgttcac

SEQ ID NO: 27235 - DNA, 24 bp, Homo sapiens
tcaccaagcgttggattgttcacc

SEQ ID NO: 27236 - DNA, 25 bp, Homo sapiens
tcaccaagcgttggattgttcaccc

SEQ ID NO: 27237 - DNA, 26 bp, Homo sapiens
tcaccaagcgttggattgttcaccca

SEQ ID NO: 27238 - DNA, 27 bp, Homo sapiens
tcaccaagcgttggattgttcacccac

SEQ ID NO: 27239 - DNA, 28 bp, Homo sapiens
tcaccaagcgttggattgttcacccact

SEQ ID NO: 27240 - DNA, 30 bp, Homo sapiens
tcaccaagcgttggattgttcacccactaa

SEQ ID NO: 27241 - DNA, 31 bp, Homo sapiens; identical to SEQ ID NO: 6169

SEQ ID NO: 27242 - DNA, 32 bp, Homo sapiens; identical to SEQ ID NO: 6170

SEQ ID NO: 27243 - DNA, 33 bp, Homo sapiens; identical to SEQ ID NO: 6171

SEQ ID NO: 27244 - DNA, 34 bp, Homo sapiens
tcaccaagcgttggattgttcacccactaatagg

SEQ ID NO: 27245 - DNA, 35 bp, Homo sapiens
tcaccaagcgttggattgttcacccactaataggg

SEQ ID NO: 27246 - DNA, 19 bp, Homo sapiens
caccaagcgttggattgtt

SEQ ID NO: 27247 - DNA, 20 bp, Homo sapiens
caccaagcgttggattgttc

SEQ ID NO: 27248 - DNA, 21 bp, Homo sapiens
caccaagcgttggattgttca

SEQ ID NO: 27249 - DNA, 22 bp, Homo sapiens
caccaagcgttggattgttcac

SEQ ID NO: 27250 - DNA, 23 bp, Homo sapiens
caccaagcgttggattgttcacc

SEQ ID NO: 27251 - DNA, 24 bp, Homo sapiens
caccaagcgttggattgttcaccc

SEQ ID NO: 27252 - DNA, 25 bp, Homo sapiens
caccaagcgttggattgttcaccca

SEQ ID NO: 27253 - DNA, 26 bp, Homo sapiens
caccaagcgttggattgttcacccac

SEQ ID NO: 27254 - DNA, 27 bp, Homo sapiens
caccaagcgttggattgttcacccact

SEQ ID NO: 27255 - DNA, 28 bp, Homo sapiens
caccaagcgttggattgttcacccacta

SEQ ID NO: 27256 - DNA, 29 bp, Homo sapiens
caccaagcgttggattgttcacccactaa

SEQ ID NO: 27257 - DNA, 30 bp, Homo sapiens; identical to SEQ ID NO: 6178

SEQ ID NO: 27258 - DNA, 31 bp, Homo sapiens; identical to SEQ ID NO: 6179

SEQ ID NO: 27259 - DNA, 32 bp, Homo sapiens; identical to SEQ ID NO: 6180

SEQ ID NO: 27260 - DNA, 33 bp, Homo sapiens; identical to SEQ ID NO: 6181

SEQ ID NO: 27261 - DNA, 34 bp, Homo sapiens
caccaagcgttggattgttcacccactaataggg

SEQ ID NO: 27262 - DNA, 18 bp, Homo sapiens
accaagcgttggattgtt

SEQ ID NO: 27263 - DNA, 19 bp, Homo sapiens
accaagcgttggattgttc

SEQ ID NO: 27264 - DNA, 20 bp, Homo sapiens
accaagcgttggattgttca

SEQ ID NO: 27265 - DNA, 21 bp, Homo sapiens
accaagcgttggattgttcac

SEQ ID NO: 27266 - DNA, 22 bp, Homo sapiens
accaagcgttggattgttcacc

SEQ ID NO: 27267 - DNA, 23 bp, Homo sapiens
accaagcgttggattgttcaccc

SEQ ID NO: 27268 - DNA, 24 bp, Homo sapiens
accaagcgttggattgttcaccca

SEQ ID NO: 27269 - DNA, 25 bp, Homo sapiens
accaagcgttggattgttcacccac

SEQ ID NO: 27270 - DNA, 26 bp, Homo sapiens
accaagcgttggattgttcacccact

SEQ ID NO: 27271 - DNA, 27 bp, Homo sapiens
accaagcgttggattgttcacccacta

SEQ ID NO: 27272 - DNA, 28 bp, Homo sapiens
accaagcgttggattgttcacccactaa

SEQ ID NO: 27273 - DNA, 29 bp, Homo sapiens
accaagcgttggattgttcacccactaat

SEQ ID NO: 27274 - DNA, 30 bp, Homo sapiens; identical to SEQ ID NO: 6189

SEQ ID NO: 27275 - DNA, 31 bp, Homo sapiens; identical to SEQ ID NO: 6190

SEQ ID NO: 27276 - DNA, 32 bp, Homo sapiens; identical to SEQ ID NO: 6191

SEQ ID NO: 27277 - DNA, 33 bp, Homo sapiens; identical to SEQ ID NO: 6192

SEQ ID NO: 27278 - DNA, 17 bp, Homo sapiens
ccaagcgttggattgtt

SEQ ID NO: 27279 - DNA, 18 bp, Homo sapiens
ccaagcgttggattgttc

SEQ ID NO: 27280 - DNA, 19 bp, Homo sapiens
ccaagcgttggattgttca

SEQ ID NO: 27281 - DNA, 20 bp, Homo sapiens
ccaagcgttggattgttcac

SEQ ID NO: 27282 - DNA, 21 bp, Homo sapiens
ccaagcgttggattgttcacc

SEQ ID NO: 27283 - DNA, 22 bp, Homo sapiens
ccaagcgttggattgttcaccc

SEQ ID NO: 27284 - DNA, 23 bp, Homo sapiens
ccaagcgttggattgttcaccca

SEQ ID NO: 27285 - DNA, 24 bp, Homo sapiens
ccaagcgttggattgttcacccac

SEQ ID NO: 27286 - DNA, 25 bp, Homo sapiens
ccaagcgttggattgttcacccact

SEQ ID NO: 27287 - DNA, 26 bp, Homo sapiens
ccaagcgttggattgttcacccacta

SEQ ID NO: 27288 - DNA, 27 bp, Homo sapiens
ccaagcgttggattgttcacccactaa

SEQ ID NO: 27289 - DNA, 29 bp, Homo sapiens
ccaagcgttggattgttcacccactaata

SEQ ID NO: 27290 - DNA, 30 bp, Homo sapiens; identical to SEQ ID NO: 6197

SEQ ID NO: 27291 - DNA, 31 bp, Homo sapiens; identical to SEQ ID NO: 6198

SEQ ID NO: 27292 - DNA, 32 bp, Homo sapiens; identical to SEQ ID NO: 6199

SEQ ID NO: 27293 - DNA, 33 bp, Homo sapiens
ccaagcgttggattgttcacccactaataggga

SEQ ID NO: 27294 - DNA, 16 bp, Homo sapiens
caagcgttggattgtt

SEQ ID NO: 27295 - DNA, 17 bp, Homo sapiens
caagcgttggattgttc

SEQ ID NO: 27296 - DNA, 18 bp, Homo sapiens
caagcgttggattgttca

SEQ ID NO: 27297 - DNA, 19 bp, Homo sapiens
caagcgttggattgttcac

SEQ ID NO: 27298 - DNA, 20 bp, Homo sapiens
caagcgttggattgttcacc

SEQ ID NO: 27299 - DNA, 21 bp, Homo sapiens
caagcgttggattgttcaccc

SEQ ID NO: 27300 - DNA, 22 bp, Homo sapiens
caagcgttggattgttcaccca

SEQ ID NO: 27301 - DNA, 23 bp, Homo sapiens
caagcgttggattgttcacccac

SEQ ID NO: 27302 - DNA, 24 bp, Homo sapiens
caagcgttggattgttcacccact

SEQ ID NO: 27303 - DNA, 28 bp, Homo sapiens
caagcgttggattgttcacccactaata

SEQ ID NO: 27304 - DNA, 29 bp, Homo sapiens
caagcgttggattgttcacccactaatag

SEQ ID NO: 27305 - DNA, 30 bp, Homo sapiens; identical to SEQ ID NO: 6205

SEQ ID NO: 27306 - DNA, 31 bp, Homo sapiens; identical to SEQ ID NO: 6206

SEQ ID NO: 27307 - DNA, 16 bp, Homo sapiens
aagcgttggattgttc

SEQ ID NO: 27308 - DNA, 17 bp, Homo sapiens
aagcgttggattgttca

SEQ ID NO: 27309 - DNA, 18 bp, Homo sapiens
aagcgttggattgttcac

SEQ ID NO: 27310 - DNA, 19 bp, Homo sapiens
aagcgttggattgttcacc

SEQ ID NO: 27311 - DNA, 20 bp, Homo sapiens
aagcgttggattgttcaccc

SEQ ID NO: 27312 - DNA, 21 bp, Homo sapiens
aagcgttggattgttcaccca

SEQ ID NO: 27313 - DNA, 22 bp, Homo sapiens
aagcgttggattgttcacccac

SEQ ID NO: 27314 - DNA, 23 bp, Homo sapiens
aagcgttggattgttcacccact

SEQ ID NO: 27315 - DNA, 24 bp, Homo sapiens
aagcgttggattgttcacccacta

SEQ ID NO: 27316 - DNA, 25 bp, Homo sapiens
aagcgttggattgttcacccactaa

SEQ ID NO: 27317 - DNA, 26 bp, Homo sapiens
aagcgttggattgttcacccactaat

SEQ ID NO: 27318 - DNA, 27 bp, Homo sapiens
aagcgttggattgttcacccactaata

SEQ ID NO: 27319 - DNA, 28 bp, Homo sapiens
aagcgttggattgttcacccactaatag

SEQ ID NO: 27320 - DNA, 29 bp, Homo sapiens
aagcgttggattgttcacccactaatagg

SEQ ID NO: 27321 - DNA, 30 bp, Homo sapiens; identical to SEQ ID NO: 6219

SEQ ID NO: 27322 - DNA, 31 bp, Homo sapiens; identical to SEQ ID NO: 6220

SEQ ID NO: 27323 - DNA, 32 bp, Homo sapiens; identical to SEQ ID NO: 6221

SEQ ID NO: 27324 - DNA, 33 bp, Homo sapiens
aagcgttggattgttcacccactaatagggaac

SEQ ID NO: 27325 - DNA, 40 bp, Homo sapiens
aagcgttggattgttcacccactaatagggaacgtgagct

SEQ ID NO: 27326 - DNA, 16 bp, Homo sapiens
agcgttggattgttca

SEQ ID NO: 27327 - DNA, 17 bp, Homo sapiens
agcgttggattgttcac

SEQ ID NO: 27328 - DNA, 18 bp, Homo sapiens
agcgttggattgttcacc

SEQ ID NO: 27329 - DNA, 19 bp, Homo sapiens
agcgttggattgttcaccc

SEQ ID NO: 27330 - DNA, 20 bp, Homo sapiens
agcgttggattgttcaccca

SEQ ID NO: 27331 - DNA, 22 bp, Homo sapiens
agcgttggattgttcacccact

SEQ ID NO: 27332 - DNA, 24 bp, Homo sapiens
agcgttggattgttcacccactaa

SEQ ID NO: 27333 - DNA, 26 bp, Homo sapiens
agcgttggattgttcacccactaata

SEQ ID NO: 27334 - DNA, 28 bp, Homo sapiens
agcgttggattgttcacccactaatagg

SEQ ID NO: 27335 - DNA, 29 bp, Homo sapiens
agcgttggattgttcacccactaataggg

SEQ ID NO: 27336 - DNA, 30 bp, Homo sapiens
agcgttggattgttcacccactaataggga

SEQ ID NO: 27337 - DNA, 31 bp, Homo sapiens
agcgttggattgttcacccactaatagggaa

SEQ ID NO: 27338 - DNA, 33 bp, Homo sapiens
agcgttggattgttcacccactaatagggaacg

SEQ ID NO: 27339 - DNA, 17 bp, Homo sapiens
gcgttggattgttcacc

SEQ ID NO: 27340 - DNA, 18 bp, Homo sapiens
gcgttggattgttcaccc

SEQ ID NO: 27341 - DNA, 25 bp, Homo sapiens
gcgttggattgttcacccactaata

SEQ ID NO: 27342 - DNA, 29 bp, Homo sapiens
gcgttggattgttcacccactaataggga

SEQ ID NO: 27343 - DNA, 30 bp, Homo sapiens
gcgttggattgttcacccactaatagggaa

SEQ ID NO: 27344 - DNA, 16 bp, Homo sapiens
cgttggattgttcacc

SEQ ID NO: 27345 - DNA, 17 bp, Homo sapiens
cgttggattgttcaccc

SEQ ID NO: 27346 - DNA, 16 bp, Homo sapiens
gttggattgttcaccc

SEQ ID NO: 27347 - DNA, 16 bp, Homo sapiens
ttggattgttcaccca

SEQ ID NO: 27348 - DNA, 17 bp, Homo sapiens
ttggattgttcacccac

SEQ ID NO: 27349 - DNA, 18 bp, Homo sapiens
ttggattgttcacccact

SEQ ID NO: 27350 - DNA, 23 bp, Homo sapiens
ttggattgttcacccactaatag

SEQ ID NO: 27351 - DNA, 24 bp, Homo sapiens
ttggattgttcacccactaatagg

SEQ ID NO: 27352 - DNA, 25 bp, Homo sapiens
ttggattgttcacccactaataggg

SEQ ID NO: 27353 - DNA, 26 bp, Homo sapiens
ttggattgttcacccactaataggga

SEQ ID NO: 27354 - DNA, 27 bp, Homo sapiens
ttggattgttcacccactaatagggaa

SEQ ID NO: 27355 - DNA, 28 bp, Homo sapiens
ttggattgttcacccactaatagggaac

SEQ ID NO: 27356 - DNA, 33 bp, Homo sapiens
ttggattgttcacccactaatagggaacgtgag

SEQ ID NO: 27357 - DNA, 34 bp, Homo sapiens
ttggattgttcacccactaatagggaacgtgagc

SEQ ID NO: 27358 - DNA, 20 bp, Homo sapiens
cactaatagggaacgtgagc

SEQ ID NO: 27359 - DNA, 21 bp, Homo sapiens
cactaatagggaacgtgagct

SEQ ID NO: 27360 - DNA, 19 bp, Homo sapiens
actaatagggaacgtgagc

SEQ ID NO: 27361 - DNA, 20 bp, Homo sapiens
actaatagggaacgtgagct

SEQ ID NO: 27362 - DNA, 18 bp, Homo sapiens
ctaatagggaacgtgagc

SEQ ID NO: 27363 - DNA, 19 bp, Homo sapiens
ctaatagggaacgtgagct

SEQ ID NO: 27364 - DNA, 17 bp, Homo sapiens
taatagggaacgtgagc

SEQ ID NO: 27365 - DNA, 18 bp, Homo sapiens
taatagggaacgtgagct

SEQ ID NO: 27366 - DNA, 16 bp, Homo sapiens
aatagggaacgtgagc

SEQ ID NO: 27367 - DNA, 17 bp, Homo sapiens
aatagggaacgtgagct

SEQ ID NO: 27368 - DNA, 29 bp, Homo sapiens
aatagggaacgtgagctgggtttagaccg

SEQ ID NO: 27369 - DNA, 16 bp, Homo sapiens
atagggaacgtgagct

SEQ ID NO: 27370 - DNA, 31 bp, Homo sapiens
acgtgagctgggtttagaccgtcgtgagaca

SEQ ID NO: 27371 - DNA, 17 bp, Homo sapiens
cgtgagctgggtttaga

SEQ ID NO: 27372 - DNA, 30 bp, Homo sapiens
cgtgagctgggtttagaccgtcgtgagaca

SEQ ID NO: 27373 - DNA, 28 bp, Homo sapiens
tgagctgggtttagaccgtcgtgagaca

SEQ ID NO: 27374 - DNA, 26 bp, Homo sapiens
agctgggtttagaccgtcgtgagaca

SEQ ID NO: 27375 - DNA, 24 bp, Homo sapiens
ctgggtttagaccgtcgtgagaca

SEQ ID NO: 27376 - DNA, 20 bp, Homo sapiens
gggtttagaccgtcgtgaga

SEQ ID NO: 27377 - DNA, 25 bp, Homo sapiens
gggtttagaccgtcgtgagacaggt

SEQ ID NO: 27378 - DNA, 19 bp, Homo sapiens
ggtttagaccgtcgtgaga

SEQ ID NO: 27379 - DNA, 18 bp, Homo sapiens
gtttagaccgtcgtgaga

SEQ ID NO: 27380 - DNA, 20 bp, Homo sapiens
gtttagaccgtcgtgagaca

SEQ ID NO: 27381 - DNA, 17 bp, Homo sapiens
tttagaccgtcgtgaga

SEQ ID NO: 27382 - DNA, 16 bp, Homo sapiens
ttagaccgtcgtgaga

SEQ ID NO: 27383 - DNA, 18 bp, Homo sapiens
ttagaccgtcgtgagaca

SEQ ID NO: 27384 - DNA, 16 bp, Homo sapiens
tagaccgtcgtgagac

SEQ ID NO: 27385 - DNA, 17 bp, Homo sapiens
tagaccgtcgtgagaca

SEQ ID NO: 27386 - DNA, 16 bp, Homo sapiens
agaccgtcgtgagaca

SEQ ID NO: 27387 - DNA, 18 bp, Homo sapiens
agaccgtcgtgagacagg

SEQ ID NO: 27388 - DNA, 17 bp, Homo sapiens
gaccgtcgtgagacagg

SEQ ID NO: 27389 - DNA, 33 bp, Homo sapiens
gtcgtgagacaggttagttttaccctactgatg

SEQ ID NO: 27390 - DNA, 16 bp, Homo sapiens
tcgtgagacaggttag

SEQ ID NO: 27391 - DNA, 16 bp, Homo sapiens
cgtgagacaggttagt

SEQ ID NO: 27392 - DNA, 17 bp, Homo sapiens
cgtgagacaggttagtt

SEQ ID NO: 27393 - DNA, 20 bp, Homo sapiens
cgtgagacaggttagtttta

SEQ ID NO: 27394 - DNA, 32 bp, Homo sapiens
tagttttaccctactgatgatgtgttgttgcc

SEQ ID NO: 27395 - DNA, 30 bp, Homo sapiens
gttttaccctactgatgatgtgttgttgcc

SEQ ID NO: 27396 - DNA, 31 bp, Homo sapiens
gttttaccctactgatgatgtgttgttgcca

SEQ ID NO: 27397 - DNA, 29 bp, Homo sapiens
ttttaccctactgatgatgtgttgttgcc

SEQ ID NO: 27398 - DNA, 32 bp, Homo sapiens
ttttaccctactgatgatgtgttgttgccatg

SEQ ID NO: 27399 - DNA, 28 bp, Homo sapiens
tttaccctactgatgatgtgttgttgcc

SEQ ID NO: 27400 - DNA, 25 bp, Homo sapiens
ttaccctactgatgatgtgttgttg

SEQ ID NO: 27401 - DNA, 26 bp, Homo sapiens
ttaccctactgatgatgtgttgttgc

SEQ ID NO: 27402 - DNA, 27 bp, Homo sapiens
ttaccctactgatgatgtgttgttgcc

SEQ ID NO: 27403 - DNA, 28 bp, Homo sapiens
ttaccctactgatgatgtgttgttgcca

SEQ ID NO: 27404 - DNA, 29 bp, Homo sapiens
ttaccctactgatgatgtgttgttgccat

SEQ ID NO: 27405 - DNA, 30 bp, Homo sapiens; identical to SEQ ID NO: 6239

SEQ ID NO: 27406 - DNA, 33 bp, Homo sapiens
ttaccctactgatgatgtgttgttgccatggta

SEQ ID NO: 27407 - DNA, 26 bp, Homo sapiens
taccctactgatgatgtgttgttgcc

SEQ ID NO: 27408 - DNA, 29 bp, Homo sapiens
taccctactgatgatgtgttgttgccatg

SEQ ID NO: 27409 - DNA, 23 bp, Homo sapiens
accctactgatgatgtgttgttg

SEQ ID NO: 27410 - DNA, 25 bp, Homo sapiens
accctactgatgatgtgttgttgcc

SEQ ID NO: 27411 - DNA, 28 bp, Homo sapiens
accctactgatgatgtgttgttgccatg

SEQ ID NO: 27412 - DNA, 22 bp, Homo sapiens
ccctactgatgatgtgttgttg

SEQ ID NO: 27413 - DNA, 24 bp, Homo sapiens
ccctactgatgatgtgttgttgcc

SEQ ID NO: 27414 - DNA, 25 bp, Homo sapiens
ccctactgatgatgtgttgttgcca

SEQ ID NO: 27415 - DNA, 28 bp, Homo sapiens
ccctactgatgatgtgttgttgccatgg

SEQ ID NO: 27416 - DNA, 30 bp, Homo sapiens
ccctactgatgatgtgttgttgccatggta

SEQ ID NO: 27417 - DNA, 32 bp, Homo sapiens
ctactgatgatgtgttgttgccatggtaatcc

SEQ ID NO: 27418 - DNA, 19 bp, Homo sapiens
ctgatgatgtgttgttgcc

SEQ ID NO: 27419 - DNA, 20 bp, Homo sapiens
ctgatgatgtgttgttgcca

SEQ ID NO: 27420 - DNA, 25 bp, Homo sapiens
ctgatgatgtgttgttgccatggta

SEQ ID NO: 27421 - DNA, 19 bp, Homo sapiens
tgatgatgtgttgttgcca

SEQ ID NO: 27422 - DNA, 17 bp, Homo sapiens
gatgatgtgttgttgcc

SEQ ID NO: 27423 - DNA, 28 bp, Homo sapiens
gatgatgtgttgttgccatggtaatcct

SEQ ID NO: 27424 - DNA, 16 bp, Homo sapiens
tgatgtgttgttgcca

SEQ ID NO: 27425 - DNA, 19 bp, Homo sapiens
tgatgtgttgttgccatgg

SEQ ID NO: 27426 - DNA, 21 bp, Homo sapiens
tgatgtgttgttgccatggta

SEQ ID NO: 27427 - DNA, 31 bp, Homo sapiens
tgatgtgttgttgccatggtaatcctgctca

SEQ ID NO: 27428 - DNA, 19 bp, Homo sapiens
gatgtgttgttgccatggt

SEQ ID NO: 27429 - DNA, 20 bp, Homo sapiens
gatgtgttgttgccatggta

SEQ ID NO: 27430 - DNA, 18 bp, Homo sapiens
tgtgttgttgccatggta

SEQ ID NO: 27431 - DNA, 16 bp, Homo sapiens
tgttgttgccatggta

SEQ ID NO: 27432 - DNA, 24 bp, Homo sapiens
gccatggtaatcctgctcagtacg

SEQ ID NO: 27433 - DNA, 42 bp, Homo sapiens
atggtaatcctgctcagtacgagaggaaccgcaggttcagac

SEQ ID NO: 27434 - DNA, 21 bp, Homo sapiens
ctgctcagtacgagaggaacc

SEQ ID NO: 27435 - DNA, 23 bp, Homo sapiens
ctgctcagtacgagaggaaccgc

SEQ ID NO: 27436 - DNA, 33 bp, Homo sapiens
ctgctcagtacgagaggaaccgcaggttcagac

SEQ ID NO: 27437 - DNA, 32 bp, Homo sapiens
tgctcagtacgagaggaaccgcaggttcagac

SEQ ID NO: 27438 - DNA, 16 bp, Homo sapiens
cagtacgagaggaacc

SEQ ID NO: 27439 - DNA, 17 bp, Homo sapiens
cagtacgagaggaaccg

SEQ ID NO: 27440 - DNA, 28 bp, Homo sapiens
cagtacgagaggaaccgcaggttcagac

SEQ ID NO: 27441 - DNA, 22 bp, Homo sapiens
gagaggaaccgcaggttcagac

SEQ ID NO: 27442 - DNA, 30 bp, Homo sapiens; identical to SEQ ID NO: 6242

SEQ ID NO: 27443 - DNA, 32 bp, Homo sapiens
gagaggaaccgcaggttcagacatttggtgta

SEQ ID NO: 27444 - DNA, 27 bp, Homo sapiens
aggaaccgcaggttcagacatttggtg

SEQ ID NO: 27445 - DNA, 26 bp, Homo sapiens
ggaaccgcaggttcagacatttggtg

SEQ ID NO: 27446 - DNA, 25 bp, Homo sapiens
gaaccgcaggttcagacatttggtg

SEQ ID NO: 27447 - DNA, 16 bp, Homo sapiens
aaccgcaggttcagac

SEQ ID NO: 27448 - DNA, 16 bp, Homo sapiens
accgcaggttcagaca

SEQ ID NO: 27449 - DNA, 20 bp, Homo sapiens
accgcaggttcagacatttg

SEQ ID NO: 27450 - DNA, 19 bp, Homo sapiens
ccgcaggttcagacatttg

SEQ ID NO: 27451 - DNA, 24 bp, Homo sapiens
ccgcaggttcagacatttggtgta

SEQ ID NO: 27452 - DNA, 16 bp, Homo sapiens
caggttcagacatttg

SEQ ID NO: 27453 - DNA, 17 bp, Homo sapiens
ggttcagacatttggtg

SEQ ID NO: 27454 - DNA, 19 bp, Homo sapiens
ggttcagacatttggtgta

SEQ ID NO: 27455 - DNA, 25 bp, Homo sapiens
gacatttggtgtatgtgcttggctg

SEQ ID NO: 27456 - DNA, 26 bp, Homo sapiens
gacatttggtgtatgtgcttggctga

SEQ ID NO: 27457 - DNA, 29 bp, Homo sapiens
gacatttggtgtatgtgcttggctgagga

SEQ ID NO: 27458 - DNA, 31 bp, Homo sapiens
gacatttggtgtatgtgcttggctgaggagc

SEQ ID NO: 27459 - DNA, 18 bp, Homo sapiens
catttggtgtatgtgctt

SEQ ID NO: 27460 - DNA, 21 bp, Homo sapiens
catttggtgtatgtgcttggc

SEQ ID NO: 27461 - DNA, 23 bp, Homo sapiens
catttggtgtatgtgcttggctg

SEQ ID NO: 27462 - DNA, 24 bp, Homo sapiens
catttggtgtatgtgcttggctga

SEQ ID NO: 27463 - DNA, 25 bp, Homo sapiens
catttggtgtatgtgcttggctgag

SEQ ID NO: 27464 - DNA, 26 bp, Homo sapiens
catttggtgtatgtgcttggctgagg

SEQ ID NO: 27465 - DNA, 27 bp, Homo sapiens
catttggtgtatgtgcttggctgagga

SEQ ID NO: 27466 - DNA, 31 bp, Homo sapiens
catttggtgtatgtgcttggctgaggagcca

SEQ ID NO: 27467 - DNA, 32 bp, Homo sapiens
catttggtgtatgtgcttggctgaggagccaa

SEQ ID NO: 27468 - DNA, 16 bp, Homo sapiens
atttggtgtatgtgct

SEQ ID NO: 27469 - DNA, 17 bp, Homo sapiens
atttggtgtatgtgctt

SEQ ID NO: 27470 - DNA, 20 bp, Homo sapiens
atttggtgtatgtgcttggc

SEQ ID NO: 27471 - DNA, 21 bp, Homo sapiens
atttggtgtatgtgcttggct

SEQ ID NO: 27472 - DNA, 26 bp, Homo sapiens
atttggtgtatgtgcttggctgagga

SEQ ID NO: 27473 - DNA, 27 bp, Homo sapiens
atttggtgtatgtgcttggctgaggag

SEQ ID NO: 27474 - DNA, 28 bp, Homo sapiens
atttggtgtatgtgcttggctgaggagc

SEQ ID NO: 27475 - DNA, 29 bp, Homo sapiens
atttggtgtatgtgcttggctgaggagcc

SEQ ID NO: 27476 - DNA, 19 bp, Homo sapiens
tttggtgtatgtgcttggc

SEQ ID NO: 27477 - DNA, 21 bp, Homo sapiens
tttggtgtatgtgcttggctg

SEQ ID NO: 27478 - DNA, 22 bp, Homo sapiens
tttggtgtatgtgcttggctga

SEQ ID NO: 27479 - DNA, 23 bp, Homo sapiens
tttggtgtatgtgcttggctgag

SEQ ID NO: 27480 - DNA, 24 bp, Homo sapiens
tttggtgtatgtgcttggctgagg

SEQ ID NO: 27481 - DNA, 25 bp, Homo sapiens
tttggtgtatgtgcttggctgagga

SEQ ID NO: 27482 - DNA, 27 bp, Homo sapiens
tttggtgtatgtgcttggctgaggagc

SEQ ID NO: 27483 - DNA, 28 bp, Homo sapiens
tttggtgtatgtgcttggctgaggagcc

SEQ ID NO: 27484 - DNA, 29 bp, Homo sapiens
tttggtgtatgtgcttggctgaggagcca

SEQ ID NO: 27485 - DNA, 30 bp, Homo sapiens
tttggtgtatgtgcttggctgaggagccaa

SEQ ID NO: 27486 - DNA, 23 bp, Homo sapiens
ggtgtatgtgcttggctgaggag

SEQ ID NO: 27487 - DNA, 24 bp, Homo sapiens
ggtgtatgtgcttggctgaggagc

SEQ ID NO: 27488 - DNA, 25 bp, Homo sapiens
ggtgtatgtgcttggctgaggagcc

SEQ ID NO: 27489 - DNA, 18 bp, Homo sapiens
gtgtatgtgcttggctga

SEQ ID NO: 27490 - DNA, 23 bp, Homo sapiens
gtgtatgtgcttggctgaggagc

SEQ ID NO: 27491 - DNA, 24 bp, Homo sapiens
gtgtatgtgcttggctgaggagcc

SEQ ID NO: 27492 - DNA, 17 bp, Homo sapiens
tgtatgtgcttggctga

SEQ ID NO: 27493 - DNA, 21 bp, Homo sapiens
tgtatgtgcttggctgaggag

SEQ ID NO: 27494 - DNA, 22 bp, Homo sapiens
tgtatgtgcttggctgaggagc

SEQ ID NO: 27495 - DNA, 23 bp, Homo sapiens
tgtatgtgcttggctgaggagcc

SEQ ID NO: 27496 - DNA, 31 bp, Homo sapiens
tgtatgtgcttggctgaggagccaatggggc

SEQ ID NO: 27497 - DNA, 16 bp, Homo sapiens
gtatgtgcttggctga

SEQ ID NO: 27498 - DNA, 20 bp, Homo sapiens
gtatgtgcttggctgaggag

SEQ ID NO: 27499 - DNA, 21 bp, Homo sapiens
gtatgtgcttggctgaggagc

SEQ ID NO: 27500 - DNA, 22 bp, Homo sapiens
gtatgtgcttggctgaggagcc

SEQ ID NO: 27501 - DNA, 19 bp, Homo sapiens
tatgtgcttggctgaggag

SEQ ID NO: 27502 - DNA, 20 bp, Homo sapiens
tatgtgcttggctgaggagc

SEQ ID NO: 27503 - DNA, 21 bp, Homo sapiens
tatgtgcttggctgaggagcc

SEQ ID NO: 27504 - DNA, 29 bp, Homo sapiens
tatgtgcttggctgaggagccaatggggc

SEQ ID NO: 27505 - DNA, 30 bp, Homo sapiens
tatgtgcttggctgaggagccaatggggcg

SEQ ID NO: 27506 - DNA, 19 bp, Homo sapiens
atgtgcttggctgaggagc

SEQ ID NO: 27507 - DNA, 20 bp, Homo sapiens
atgtgcttggctgaggagcc

SEQ ID NO: 27508 - DNA, 16 bp, Homo sapiens
tgtgcttggctgagga

SEQ ID NO: 27509 - DNA, 17 bp, Homo sapiens
tgtgcttggctgaggag

SEQ ID NO: 27510 - DNA, 18 bp, Homo sapiens
tgtgcttggctgaggagc

SEQ ID NO: 27511 - DNA, 19 bp, Homo sapiens
tgtgcttggctgaggagcc

SEQ ID NO: 27512 - DNA, 20 bp, Homo sapiens
tgtgcttggctgaggagcca

SEQ ID NO: 27513 - DNA, 21 bp, Homo sapiens
tgtgcttggctgaggagccaa

SEQ ID NO: 27514 - DNA, 27 bp, Homo sapiens
tgtgcttggctgaggagccaatggggc

SEQ ID NO: 27515 - DNA, 28 bp, Homo sapiens
tgtgcttggctgaggagccaatggggcg

SEQ ID NO: 27516 - DNA, 29 bp, Homo sapiens
tgtgcttggctgaggagccaatggggcga

SEQ ID NO: 27517 - DNA, 30 bp, Homo sapiens
tgtgcttggctgaggagccaatggggcgaa

SEQ ID NO: 27518 - DNA, 33 bp, Homo sapiens; identical to SEQ ID NO: 6259

SEQ ID NO: 27519 - DNA, 17 bp, Homo sapiens
gtgcttggctgaggagc

SEQ ID NO: 27520 - DNA, 18 bp, Homo sapiens
gtgcttggctgaggagcc

SEQ ID NO: 27521 - DNA, 25 bp, Homo sapiens
gtgcttggctgaggagccaatgggg

SEQ ID NO: 27522 - DNA, 26 bp, Homo sapiens
gtgcttggctgaggagccaatggggc

SEQ ID NO: 27523 - DNA, 27 bp, Homo sapiens
gtgcttggctgaggagccaatggggcg

SEQ ID NO: 27524 - DNA, 32 bp, Homo sapiens
gtgcttggctgaggagccaatggggcgaagct

SEQ ID NO: 27525 - DNA, 16 bp, Homo sapiens
tgcttggctgaggagc

SEQ ID NO: 27526 - DNA, 17 bp, Homo sapiens
tgcttggctgaggagcc

SEQ ID NO: 27527 - DNA, 25 bp, Homo sapiens
tgcttggctgaggagccaatggggc

SEQ ID NO: 27528 - DNA, 16 bp, Homo sapiens
gcttggctgaggagcc

SEQ ID NO: 27529 - DNA, 23 bp, Homo sapiens
cttggctgaggagccaatggggc

SEQ ID NO: 27530 - DNA, 24 bp, Homo sapiens
cttggctgaggagccaatggggcg

SEQ ID NO: 27531 - DNA, 29 bp, Homo sapiens
cttggctgaggagccaatggggcgaagct

SEQ ID NO: 27532 - DNA, 21 bp, Homo sapiens
tggctgaggagccaatggggc

SEQ ID NO: 27533 - DNA, 27 bp, Homo sapiens
tggctgaggagccaatggggcgaagct

SEQ ID NO: 27534 - DNA, 33 bp, Homo sapiens; identical to SEQ ID NO: 6267

SEQ ID NO: 27535 - DNA, 31 bp, Homo sapiens
tgaggagccaatggggcgaagctaccatctg

SEQ ID NO: 27536 - DNA, 30 bp, Homo sapiens
gaggagccaatggggcgaagctaccatctg

SEQ ID NO: 27537 - DNA, 18 bp, Homo sapiens
caatggggcgaagctacc

SEQ ID NO: 27538 - DNA, 30 bp, Homo sapiens
caatggggcgaagctaccatctgtgggatt

SEQ ID NO: 27539 - DNA, 43 bp, Homo sapiens
caatggggcgaagctaccatctgtgggattatgactgaacgcc

SEQ ID NO: 27540 - DNA, 44 bp, Homo sapiens
caatggggcgaagctaccatctgtgggattatgactgaacgcct

SEQ ID NO: 27541 - DNA, 17 bp, Homo sapiens
aatggggcgaagctacc

SEQ ID NO: 27542 - DNA, 28 bp, Homo sapiens
aatggggcgaagctaccatctgtgggat

SEQ ID NO: 27543 - DNA, 29 bp, Homo sapiens
aatggggcgaagctaccatctgtgggatt

SEQ ID NO: 27544 - DNA, 30 bp, Homo sapiens
aatggggcgaagctaccatctgtgggatta

SEQ ID NO: 27545 - DNA, 42 bp, Homo sapiens
aatggggcgaagctaccatctgtgggattatgactgaacgcc

SEQ ID NO: 27546 - DNA, 43 bp, Homo sapiens
aatggggcgaagctaccatctgtgggattatgactgaacgcct

SEQ ID NO: 27547 - DNA, 16 bp, Homo sapiens
atggggcgaagctacc

SEQ ID NO: 27548 - DNA, 41 bp, Homo sapiens
atggggcgaagctaccatctgtgggattatgactgaacgcc

SEQ ID NO: 27549 - DNA, 40 bp, Homo sapiens
tggggcgaagctaccatctgtgggattatgactgaacgcc

SEQ ID NO: 27550 - DNA, 39 bp, Homo sapiens
ggggcgaagctaccatctgtgggattatgactgaacgcc

SEQ ID NO: 27551 - DNA, 37 bp, Homo sapiens
gggcgaagctaccatctgtgggattatgactgaacgc

SEQ ID NO: 27552 - DNA, 38 bp, Homo sapiens
gggcgaagctaccatctgtgggattatgactgaacgcc

SEQ ID NO: 27553 - DNA, 30 bp, Homo sapiens
ggcgaagctaccatctgtgggattatgact

SEQ ID NO: 27554 - DNA, 33 bp, Homo sapiens
ggcgaagctaccatctgtgggattatgactgaa

SEQ ID NO: 27555 - DNA, 36 bp, Homo sapiens
ggcgaagctaccatctgtgggattatgactgaacgc

SEQ ID NO: 27556 - DNA, 37 bp, Homo sapiens
ggcgaagctaccatctgtgggattatgactgaacgcc

SEQ ID NO: 27557 - DNA, 23 bp, Homo sapiens
gcgaagctaccatctgtgggatt

SEQ ID NO: 27558 - DNA, 29 bp, Homo sapiens
gcgaagctaccatctgtgggattatgact

SEQ ID NO: 27559 - DNA, 31 bp, Homo sapiens
gcgaagctaccatctgtgggattatgactga

SEQ ID NO: 27560 - DNA, 32 bp, Homo sapiens
gcgaagctaccatctgtgggattatgactgaa

SEQ ID NO: 27561 - DNA, 33 bp, Homo sapiens
gcgaagctaccatctgtgggattatgactgaac

SEQ ID NO: 27562 - DNA, 34 bp, Homo sapiens
gcgaagctaccatctgtgggattatgactgaacg

SEQ ID NO: 27563 - DNA, 36 bp, Homo sapiens
gcgaagctaccatctgtgggattatgactgaacgcc

SEQ ID NO: 27564 - DNA, 37 bp, Homo sapiens
gcgaagctaccatctgtgggattatgactgaacgcct

SEQ ID NO: 27565 - DNA, 22 bp, Homo sapiens
cgaagctaccatctgtgggatt

SEQ ID NO: 27566 - DNA, 30 bp, Homo sapiens
cgaagctaccatctgtgggattatgactga

SEQ ID NO: 27567 - DNA, 35 bp, Homo sapiens
cgaagctaccatctgtgggattatgactgaacgcc

SEQ ID NO: 27568 - DNA, 36 bp, Homo sapiens
cgaagctaccatctgtgggattatgactgaacgcct

SEQ ID NO: 27569 - DNA, 21 bp, Homo sapiens
gaagctaccatctgtgggatt

SEQ ID NO: 27570 - DNA, 27 bp, Homo sapiens
gaagctaccatctgtgggattatgact

SEQ ID NO: 27571 - DNA, 33 bp, Homo sapiens
gaagctaccatctgtgggattatgactgaacgc

SEQ ID NO: 27572 - DNA, 34 bp, Homo sapiens
gaagctaccatctgtgggattatgactgaacgcc

SEQ ID NO: 27573 - DNA, 35 bp, Homo sapiens
gaagctaccatctgtgggattatgactgaacgcct

SEQ ID NO: 27574 - DNA, 26 bp, Homo sapiens
aagctaccatctgtgggattatgact

SEQ ID NO: 27575 - DNA, 28 bp, Homo sapiens
aagctaccatctgtgggattatgactga

SEQ ID NO: 27576 - DNA, 31 bp, Homo sapiens
aagctaccatctgtgggattatgactgaacg

SEQ ID NO: 27577 - DNA, 32 bp, Homo sapiens; identical to SEQ ID NO: 6270

SEQ ID NO: 27578 - DNA, 33 bp, Homo sapiens; identical to SEQ ID NO: 6271

SEQ ID NO: 27579 - DNA, 34 bp, Homo sapiens
aagctaccatctgtgggattatgactgaacgcct

SEQ ID NO: 27580 - DNA, 23 bp, Homo sapiens
agctaccatctgtgggattatga

SEQ ID NO: 27581 - DNA, 27 bp, Homo sapiens
agctaccatctgtgggattatgactga

SEQ ID NO: 27582 - DNA, 28 bp, Homo sapiens
agctaccatctgtgggattatgactgaa

SEQ ID NO: 27583 - DNA, 32 bp, Homo sapiens; identical to SEQ ID NO: 6272

SEQ ID NO: 27584 - DNA, 33 bp, Homo sapiens; identical to SEQ ID NO: 6273

SEQ ID NO: 27585 - DNA, 16 bp, Homo sapiens
gctaccatctgtggga

SEQ ID NO: 27586 - DNA, 19 bp, Homo sapiens
gctaccatctgtgggatta

SEQ ID NO: 27587 - DNA, 22 bp, Homo sapiens
gctaccatctgtgggattatga

SEQ ID NO: 27588 - DNA, 23 bp, Homo sapiens
gctaccatctgtgggattatgac

SEQ ID NO: 27589 - DNA, 24 bp, Homo sapiens
gctaccatctgtgggattatgact

SEQ ID NO: 27590 - DNA, 26 bp, Homo sapiens
gctaccatctgtgggattatgactga

SEQ ID NO: 27591 - DNA, 27 bp, Homo sapiens
gctaccatctgtgggattatgactgaa

SEQ ID NO: 27592 - DNA, 31 bp, Homo sapiens; identical to SEQ ID NO: 6275

SEQ ID NO: 27593 - DNA, 32 bp, Homo sapiens; identical to SEQ ID NO: 6276

SEQ ID NO: 27594 - DNA, 25 bp, Homo sapiens
ctaccatctgtgggattatgactga

SEQ ID NO: 27595 - DNA, 30 bp, Homo sapiens; identical to SEQ ID NO: 6277

SEQ ID NO: 27596 - DNA, 31 bp, Homo sapiens; identical to SEQ ID NO: 6278

SEQ ID NO: 27597 - DNA, 24 bp, Homo sapiens
taccatctgtgggattatgactga

SEQ ID NO: 27598 - DNA, 29 bp, Homo sapiens
taccatctgtgggattatgactgaacgcc

SEQ ID NO: 27599 - DNA, 30 bp, Homo sapiens; identical to SEQ ID NO: 6280

SEQ ID NO: 27600 - DNA, 33 bp, Homo sapiens
taccatctgtgggattatgactgaacgcctcta

SEQ ID NO: 27601 - DNA, 20 bp, Homo sapiens
accatctgtgggattatgac

SEQ ID NO: 27602 - DNA, 21 bp, Homo sapiens
accatctgtgggattatgact

SEQ ID NO: 27603 - DNA, 22 bp, Homo sapiens
accatctgtgggattatgactg

SEQ ID NO: 27604 - DNA, 23 bp, Homo sapiens
accatctgtgggattatgactga

SEQ ID NO: 27605 - DNA, 24 bp, Homo sapiens
accatctgtgggattatgactgaa

SEQ ID NO: 27606 - DNA, 25 bp, Homo sapiens
accatctgtgggattatgactgaac

SEQ ID NO: 27607 - DNA, 26 bp, Homo sapiens
accatctgtgggattatgactgaacg

SEQ ID NO: 27608 - DNA, 27 bp, Homo sapiens
accatctgtgggattatgactgaacgc

SEQ ID NO: 27609 - DNA, 28 bp, Homo sapiens
accatctgtgggattatgactgaacgcc

SEQ ID NO: 27610 - DNA, 29 bp, Homo sapiens
accatctgtgggattatgactgaacgcct

SEQ ID NO: 27611 - DNA, 30 bp, Homo sapiens; identical to SEQ ID NO: 6288

SEQ ID NO: 27612 - DNA, 31 bp, Homo sapiens; identical to SEQ ID NO: 6289

SEQ ID NO: 27613 - DNA, 32 bp, Homo sapiens; identical to SEQ ID NO: 6290

SEQ ID NO: 27614 - DNA, 33 bp, Homo sapiens; identical to SEQ ID NO: 6291

SEQ ID NO: 27615 - DNA, 35 bp, Homo sapiens
accatctgtgggattatgactgaacgcctctaagt

SEQ ID NO: 27616 - DNA, 18 bp, Homo sapiens
ccatctgtgggattatga

SEQ ID NO: 27617 - DNA, 21 bp, Homo sapiens
ccatctgtgggattatgactg

SEQ ID NO: 27618 - DNA, 22 bp, Homo sapiens
ccatctgtgggattatgactga

SEQ ID NO: 27619 - DNA, 23 bp, Homo sapiens
ccatctgtgggattatgactgaa

SEQ ID NO: 27620 - DNA, 27 bp, Homo sapiens
ccatctgtgggattatgactgaacgcc

SEQ ID NO: 27621 - DNA, 28 bp, Homo sapiens
ccatctgtgggattatgactgaacgcct

SEQ ID NO: 27622 - DNA, 30 bp, Homo sapiens
ccatctgtgggattatgactgaacgcctct

SEQ ID NO: 27623 - DNA, 31 bp, Homo sapiens
ccatctgtgggattatgactgaacgcctcta

SEQ ID NO: 27624 - DNA, 32 bp, Homo sapiens
ccatctgtgggattatgactgaacgcctctaa

SEQ ID NO: 27625 - DNA, 33 bp, Homo sapiens
ccatctgtgggattatgactgaacgcctctaag

SEQ ID NO: 27626 - DNA, 18 bp, Homo sapiens
catctgtgggattatgac

SEQ ID NO: 27627 - DNA, 19 bp, Homo sapiens
catctgtgggattatgact

SEQ ID NO: 27628 - DNA, 21 bp, Homo sapiens
catctgtgggattatgactga

SEQ ID NO: 27629 - DNA, 24 bp, Homo sapiens
catctgtgggattatgactgaacg

SEQ ID NO: 27630 - DNA, 26 bp, Homo sapiens
catctgtgggattatgactgaacgcc

SEQ ID NO: 27631 - DNA, 27 bp, Homo sapiens
catctgtgggattatgactgaacgcct

SEQ ID NO: 27632 - DNA, 28 bp, Homo sapiens
catctgtgggattatgactgaacgcctc

SEQ ID NO: 27633 - DNA, 29 bp, Homo sapiens
catctgtgggattatgactgaacgcctct

SEQ ID NO: 27634 - DNA, 17 bp, Homo sapiens
atctgtgggattatgac

SEQ ID NO: 27635 - DNA, 18 bp, Homo sapiens
atctgtgggattatgact

SEQ ID NO: 27636 - DNA, 19 bp, Homo sapiens
atctgtgggattatgactg

SEQ ID NO: 27637 - DNA, 20 bp, Homo sapiens
atctgtgggattatgactga

SEQ ID NO: 27638 - DNA, 23 bp, Homo sapiens
atctgtgggattatgactgaacg

SEQ ID NO: 27639 - DNA, 24 bp, Homo sapiens
atctgtgggattatgactgaacgc

SEQ ID NO: 27640 - DNA, 25 bp, Homo sapiens
atctgtgggattatgactgaacgcc

SEQ ID NO: 27641 - DNA, 26 bp, Homo sapiens
atctgtgggattatgactgaacgcct

SEQ ID NO: 27642 - DNA, 27 bp, Homo sapiens
atctgtgggattatgactgaacgcctc

SEQ ID NO: 27643 - DNA, 28 bp, Homo sapiens
atctgtgggattatgactgaacgcctct

SEQ ID NO: 27644 - DNA, 33 bp, Homo sapiens
atctgtgggattatgactgaacgcctctaagtc

SEQ ID NO: 27645 - DNA, 16 bp, Homo sapiens
tctgtgggattatgac

SEQ ID NO: 27646 - DNA, 17 bp, Homo sapiens
tctgtgggattatgact

SEQ ID NO: 27647 - DNA, 18 bp, Homo sapiens
tctgtgggattatgactg

SEQ ID NO: 27648 - DNA, 19 bp, Homo sapiens
tctgtgggattatgactga

SEQ ID NO: 27649 - DNA, 20 bp, Homo sapiens
tctgtgggattatgactgaa

SEQ ID NO: 27650 - DNA, 24 bp, Homo sapiens
tctgtgggattatgactgaacgcc

SEQ ID NO: 27651 - DNA, 25 bp, Homo sapiens
tctgtgggattatgactgaacgcct

SEQ ID NO: 27652 - DNA, 28 bp, Homo sapiens
tctgtgggattatgactgaacgcctcta

SEQ ID NO: 27653 - DNA, 29 bp, Homo sapiens
tctgtgggattatgactgaacgcctctaa

SEQ ID NO: 27654 - DNA, 32 bp, Homo sapiens
tctgtgggattatgactgaacgcctctaagtc

SEQ ID NO: 27655 - DNA, 33 bp, Homo sapiens
tctgtgggattatgactgaacgcctctaagtca

SEQ ID NO: 27656 - DNA, 23 bp, Homo sapiens
ctgtgggattatgactgaacgcc

SEQ ID NO: 27657 - DNA, 24 bp, Homo sapiens
ctgtgggattatgactgaacgcct

SEQ ID NO: 27658 - DNA, 32 bp, Homo sapiens
ctgtgggattatgactgaacgcctctaagtca

SEQ ID NO: 27659 - DNA, 20 bp, Homo sapiens
tgtgggattatgactgaacg

SEQ ID NO: 27660 - DNA, 22 bp, Homo sapiens
tgtgggattatgactgaacgcc

SEQ ID NO: 27661 - DNA, 23 bp, Homo sapiens
tgtgggattatgactgaacgcct

SEQ ID NO: 27662 - DNA, 30 bp, Homo sapiens
tgtgggattatgactgaacgcctctaagtc

SEQ ID NO: 27663 - DNA, 31 bp, Homo sapiens
tgtgggattatgactgaacgcctctaagtca

SEQ ID NO: 27664 - DNA, 18 bp, Homo sapiens
gtgggattatgactgaac

SEQ ID NO: 27665 - DNA, 19 bp, Homo sapiens
gtgggattatgactgaacg

SEQ ID NO: 27666 - DNA, 21 bp, Homo sapiens
gtgggattatgactgaacgcc

SEQ ID NO: 27667 - DNA, 22 bp, Homo sapiens
gtgggattatgactgaacgcct

SEQ ID NO: 27668 - DNA, 23 bp, Homo sapiens
gtgggattatgactgaacgcctc

SEQ ID NO: 27669 - DNA, 24 bp, Homo sapiens
gtgggattatgactgaacgcctct

SEQ ID NO: 27670 - DNA, 30 bp, Homo sapiens
gtgggattatgactgaacgcctctaagtca

SEQ ID NO: 27671 - DNA, 20 bp, Homo sapiens
tgggattatgactgaacgcc

SEQ ID NO: 27672 - DNA, 21 bp, Homo sapiens
tgggattatgactgaacgcct

SEQ ID NO: 27673 - DNA, 19 bp, Homo sapiens
gggattatgactgaacgcc

SEQ ID NO: 27674 - DNA, 20 bp, Homo sapiens
gggattatgactgaacgcct

SEQ ID NO: 27675 - DNA, 22 bp, Homo sapiens
gggattatgactgaacgcctct

SEQ ID NO: 27676 - DNA, 28 bp, Homo sapiens
gggattatgactgaacgcctctaagtca

SEQ ID NO: 27677 - DNA, 33 bp, Homo sapiens
gggattatgactgaacgcctctaagtcagaatc

SEQ ID NO: 27678 - DNA, 17 bp, Homo sapiens
gattatgactgaacgcc

SEQ ID NO: 27679 - DNA, 18 bp, Homo sapiens
gattatgactgaacgcct

SEQ ID NO: 27680 - DNA, 16 bp, Homo sapiens
attatgactgaacgcc

SEQ ID NO: 27681 - DNA, 17 bp, Homo sapiens
attatgactgaacgcct

SEQ ID NO: 27682 - DNA, 16 bp, Homo sapiens
ttatgactgaacgcct

SEQ ID NO: 27683 - DNA, 18 bp, Homo sapiens
ttatgactgaacgcctct

SEQ ID NO: 27684 - DNA, 19 bp, Homo sapiens
ttatgactgaacgcctcta

SEQ ID NO: 27685 - DNA, 20 bp, Homo sapiens
ttatgactgaacgcctctaa

SEQ ID NO: 27686 - DNA, 21 bp, Homo sapiens
ttatgactgaacgcctctaag

SEQ ID NO: 27687 - DNA, 24 bp, Homo sapiens
ttatgactgaacgcctctaagtca

SEQ ID NO: 27688 - DNA, 26 bp, Homo sapiens
ttatgactgaacgcctctaagtcaga

SEQ ID NO: 27689 - DNA, 16 bp, Homo sapiens
atgactgaacgcctct

SEQ ID NO: 27690 - DNA, 20 bp, Homo sapiens
atgactgaacgcctctaagt

SEQ ID NO: 27691 - DNA, 32 bp, Homo sapiens
atgactgaacgcctctaagtcagaatcccgcc

SEQ ID NO: 27692 - DNA, 16 bp, Homo sapiens
tgactgaacgcctcta

SEQ ID NO: 27693 - DNA, 17 bp, Homo sapiens
tgactgaacgcctctaa

SEQ ID NO: 27694 - DNA, 18 bp, Homo sapiens
tgactgaacgcctctaag

SEQ ID NO: 27695 - DNA, 19 bp, Homo sapiens
tgactgaacgcctctaagt

SEQ ID NO: 27696 - DNA, 20 bp, Homo sapiens
tgactgaacgcctctaagtc

SEQ ID NO: 27697 - DNA, 21 bp, Homo sapiens
tgactgaacgcctctaagtca

SEQ ID NO: 27698 - DNA, 23 bp, Homo sapiens
tgactgaacgcctctaagtcaga

SEQ ID NO: 27699 - DNA, 33 bp, Homo sapiens
tgactgaacgcctctaagtcagaatcccgccca

SEQ ID NO: 27700 - DNA, 17 bp, Homo sapiens
gactgaacgcctctaag

SEQ ID NO: 27701 - DNA, 18 bp, Homo sapiens
gactgaacgcctctaagt

SEQ ID NO: 27702 - DNA, 30 bp, Homo sapiens
gactgaacgcctctaagtcagaatcccgcc

SEQ ID NO: 27703 - DNA, 31 bp, Homo sapiens
gactgaacgcctctaagtcagaatcccgccc

SEQ ID NO: 27704 - DNA, 19 bp, Homo sapiens
actgaacgcctctaagtca

SEQ ID NO: 27705 - DNA, 29 bp, Homo sapiens
actgaacgcctctaagtcagaatcccgcc

SEQ ID NO: 27706 - DNA, 31 bp, Homo sapiens
actgaacgcctctaagtcagaatcccgccca

SEQ ID NO: 27707 - DNA, 18 bp, Homo sapiens
ctgaacgcctctaagtca

SEQ ID NO: 27708 - DNA, 20 bp, Homo sapiens
ctgaacgcctctaagtcaga

SEQ ID NO: 27709 - DNA, 30 bp, Homo sapiens
ctgaacgcctctaagtcagaatcccgccca

SEQ ID NO: 27710 - DNA, 19 bp, Homo sapiens
tgaacgcctctaagtcaga

SEQ ID NO: 27711 - DNA, 16 bp, Homo sapiens
acgcctctaagtcaga

SEQ ID NO: 27712 - DNA, 26 bp, Homo sapiens
acgcctctaagtcagaatcccgccca

SEQ ID NO: 27713 - DNA, 25 bp, Homo sapiens
cgcctctaagtcagaatcccgccca

SEQ ID NO: 27714 - DNA, 32 bp, Homo sapiens
ctctaagtcagaatcccgcccaggcggaacga

SEQ ID NO: 27715 - DNA, 17 bp, Homo sapiens
tctaagtcagaatcccg

SEQ ID NO: 27716 - DNA, 19 bp, Homo sapiens
tctaagtcagaatcccgcc

SEQ ID NO: 27717 - DNA, 20 bp, Homo sapiens
tctaagtcagaatcccgccc

SEQ ID NO: 27718 - DNA, 22 bp, Homo sapiens
tctaagtcagaatcccgcccag

SEQ ID NO: 27719 - DNA, 23 bp, Homo sapiens
tctaagtcagaatcccgcccagg

SEQ ID NO: 27720 - DNA, 24 bp, Homo sapiens
tctaagtcagaatcccgcccaggc

SEQ ID NO: 27721 - DNA, 25 bp, Homo sapiens
tctaagtcagaatcccgcccaggcg

SEQ ID NO: 27722 - DNA, 26 bp, Homo sapiens
tctaagtcagaatcccgcccaggcgg

SEQ ID NO: 27723 - DNA, 16 bp, Homo sapiens
ctaagtcagaatcccg

SEQ ID NO: 27724 - DNA, 18 bp, Homo sapiens
ctaagtcagaatcccgcc

SEQ ID NO: 27725 - DNA, 19 bp, Homo sapiens
ctaagtcagaatcccgccc

SEQ ID NO: 27726 - DNA, 20 bp, Homo sapiens
ctaagtcagaatcccgccca

SEQ ID NO: 27727 - DNA, 21 bp, Homo sapiens
ctaagtcagaatcccgcccag

SEQ ID NO: 27728 - DNA, 22 bp, Homo sapiens
ctaagtcagaatcccgcccagg

SEQ ID NO: 27729 - DNA, 23 bp, Homo sapiens
ctaagtcagaatcccgcccaggc

SEQ ID NO: 27730 - DNA, 24 bp, Homo sapiens
ctaagtcagaatcccgcccaggcg

SEQ ID NO: 27731 - DNA, 25 bp, Homo sapiens
ctaagtcagaatcccgcccaggcgg

SEQ ID NO: 27732 - DNA, 28 bp, Homo sapiens
ctaagtcagaatcccgcccaggcggaac

SEQ ID NO: 27733 - DNA, 17 bp, Homo sapiens
taagtcagaatcccgcc

SEQ ID NO: 27734 - DNA, 18 bp, Homo sapiens
taagtcagaatcccgccc

SEQ ID NO: 27735 - DNA, 21 bp, Homo sapiens
taagtcagaatcccgcccagg

SEQ ID NO: 27736 - DNA, 16 bp, Homo sapiens
agaatcccgcccaggc

SEQ ID NO: 27737 - DNA, 30 bp, Homo sapiens
agaatcccgcccaggcggaacgatacggca

SEQ ID NO: 27738 - DNA, 32 bp, Homo sapiens
agaatcccgcccaggcggaacgatacggcagc

SEQ ID NO: 27739 - DNA, 29 bp, Homo sapiens
gaatcccgcccaggcggaacgatacggca

SEQ ID NO: 27740 - DNA, 31 bp, Homo sapiens
gaatcccgcccaggcggaacgatacggcagc

SEQ ID NO: 27741 - DNA, 27 bp, Homo sapiens
atcccgcccaggcggaacgatacggca

SEQ ID NO: 27742 - DNA, 29 bp, Homo sapiens
atcccgcccaggcggaacgatacggcagc

SEQ ID NO: 27743 - DNA, 26 bp, Homo sapiens
tcccgcccaggcggaacgatacggca

SEQ ID NO: 27744 - DNA, 28 bp, Homo sapiens
tcccgcccaggcggaacgatacggcagc

SEQ ID NO: 27745 - DNA, 27 bp, Homo sapiens
cccgcccaggcggaacgatacggcagc

SEQ ID NO: 27746 - DNA, 25 bp, Homo sapiens
cgcccaggcggaacgatacggcagc

SEQ ID NO: 27747 - DNA, 23 bp, Homo sapiens
caggcggaacgatacggcagcgc

SEQ ID NO: 27748 - DNA, 24 bp, Homo sapiens
caggcggaacgatacggcagcgcc

SEQ ID NO: 27749 - DNA, 32 bp, Homo sapiens
caggcggaacgatacggcagcgccgcggagcc

SEQ ID NO: 27750 - DNA, 31 bp, Homo sapiens
aggcggaacgatacggcagcgccgcggagcc

SEQ ID NO: 27751 - DNA, 31 bp, Homo sapiens
ggcggaacgatacggcagcgccgcggagcct

SEQ ID NO: 27752 - DNA, 33 bp, Homo sapiens
cggaacgatacggcagcgccgcggagcctcggt

SEQ ID NO: 27753 - DNA, 26 bp, Homo sapiens
gaacgatacggcagcgccgcggagcc

SEQ ID NO: 27754 - DNA, 22 bp, Homo sapiens
gatacggcagcgccgcggagcc

SEQ ID NO: 27755 - DNA, 21 bp, Homo sapiens
atacggcagcgccgcggagcc

SEQ ID NO: 27756 - DNA, 31 bp, Homo sapiens
atacggcagcgccgcggagcctcggttggcc

SEQ ID NO: 27757 - DNA, 20 bp, Homo sapiens
tacggcagcgccgcggagcc

SEQ ID NO: 27758 - DNA, 18 bp, Homo sapiens
cggcagcgccgcggagcc

SEQ ID NO: 27759 - DNA, 33 bp, Homo sapiens
cggcagcgccgcggagcctcggttggcctcgga

SEQ ID NO: 27760 - DNA, 16 bp, Homo sapiens
ggcagcgccgcggagc

SEQ ID NO: 27761 - DNA, 32 bp, Homo sapiens
ggcagcgccgcggagcctcggttggcctcgga

SEQ ID NO: 27762 - DNA, 16 bp, Homo sapiens
gcagcgccgcggagcc

SEQ ID NO: 27763 - DNA, 17 bp, Homo sapiens
gcagcgccgcggagcct

SEQ ID NO: 27764 - DNA, 27 bp, Homo sapiens
gcagcgccgcggagcctcggttggcct

SEQ ID NO: 27765 - DNA, 29 bp, Homo sapiens
gcagcgccgcggagcctcggttggcctcg

SEQ ID NO: 27766 - DNA, 31 bp, Homo sapiens; identical to SEQ ID NO: 6321

SEQ ID NO: 27767 - DNA, 32 bp, Homo sapiens
gcagcgccgcggagcctcggttggcctcggat

SEQ ID NO: 27768 - DNA, 40 bp, Homo sapiens
gcagcgccgcggagcctcggttggcctcggatagccggtc

SEQ ID NO: 27769 - DNA, 28 bp, Homo sapiens
cagcgccgcggagcctcggttggcctcg

SEQ ID NO: 27770 - DNA, 30 bp, Homo sapiens; identical to SEQ ID NO: 6322

SEQ ID NO: 27771 - DNA, 31 bp, Homo sapiens
cagcgccgcggagcctcggttggcctcggat

SEQ ID NO: 27772 - DNA, 39 bp, Homo sapiens
cagcgccgcggagcctcggttggcctcggatagccggtc

SEQ ID NO: 27773 - DNA, 24 bp, Homo sapiens
agcgccgcggagcctcggttggcc

SEQ ID NO: 27774 - DNA, 25 bp, Homo sapiens
agcgccgcggagcctcggttggcct

SEQ ID NO: 27775 - DNA, 29 bp, Homo sapiens
agcgccgcggagcctcggttggcctcgga

SEQ ID NO: 27776 - DNA, 30 bp, Homo sapiens
agcgccgcggagcctcggttggcctcggat

SEQ ID NO: 27777 - DNA, 23 bp, Homo sapiens
gcgccgcggagcctcggttggcc

SEQ ID NO: 27778 - DNA, 25 bp, Homo sapiens
gcgccgcggagcctcggttggcctc

SEQ ID NO: 27779 - DNA, 26 bp, Homo sapiens
gcgccgcggagcctcggttggcctcg

SEQ ID NO: 27780 - DNA, 28 bp, Homo sapiens
gcgccgcggagcctcggttggcctcgga

SEQ ID NO: 27781 - DNA, 16 bp, Homo sapiens
cgccgcggagcctcgg

SEQ ID NO: 27782 - DNA, 24 bp, Homo sapiens
cgccgcggagcctcggttggcctc

SEQ ID NO: 27783 - DNA, 25 bp, Homo sapiens
cgccgcggagcctcggttggcctcg

SEQ ID NO: 27784 - DNA, 27 bp, Homo sapiens
cgccgcggagcctcggttggcctcgga

SEQ ID NO: 27785 - DNA, 24 bp, Homo sapiens
gccgcggagcctcggttggcctcg

SEQ ID NO: 27786 - DNA, 22 bp, Homo sapiens
ccgcggagcctcggttggcctc

SEQ ID NO: 27787 - DNA, 21 bp, Homo sapiens
cgcggagcctcggttggcctc

SEQ ID NO: 27788 - DNA, 22 bp, Homo sapiens
cgcggagcctcggttggcctcg

SEQ ID NO: 27789 - DNA, 31 bp, Homo sapiens
cgcggagcctcggttggcctcggatagccgg

SEQ ID NO: 27790 - DNA, 32 bp, Homo sapiens
cgcggagcctcggttggcctcggatagccggt

SEQ ID NO: 27791 - DNA, 33 bp, Homo sapiens
cgcggagcctcggttggcctcggatagccggtc

SEQ ID NO: 27792 - DNA, 18 bp, Homo sapiens
gcggagcctcggttggcc

SEQ ID NO: 27793 - DNA, 20 bp, Homo sapiens
gcggagcctcggttggcctc

SEQ ID NO: 27794 - DNA, 21 bp, Homo sapiens
gcggagcctcggttggcctcg

SEQ ID NO: 27795 - DNA, 31 bp, Homo sapiens
gcggagcctcggttggcctcggatagccggt

SEQ ID NO: 27796 - DNA, 32 bp, Homo sapiens
gcggagcctcggttggcctcggatagccggtc

SEQ ID NO: 27797 - DNA, 33 bp, Homo sapiens
gcggagcctcggttggcctcggatagccggtcc

SEQ ID NO: 27798 - DNA, 17 bp, Homo sapiens
cggagcctcggttggcc

SEQ ID NO: 27799 - DNA, 18 bp, Homo sapiens
cggagcctcggttggcct

SEQ ID NO: 27800 - DNA, 19 bp, Homo sapiens
cggagcctcggttggcctc

SEQ ID NO: 27801 - DNA, 20 bp, Homo sapiens
cggagcctcggttggcctcg

SEQ ID NO: 27802 - DNA, 22 bp, Homo sapiens
cggagcctcggttggcctcgga

SEQ ID NO: 27803 - DNA, 27 bp, Homo sapiens
cggagcctcggttggcctcggatagcc

SEQ ID NO: 27804 - DNA, 29 bp, Homo sapiens
cggagcctcggttggcctcggatagccgg

SEQ ID NO: 27805 - DNA, 30 bp, Homo sapiens
cggagcctcggttggcctcggatagccggt

SEQ ID NO: 27806 - DNA, 31 bp, Homo sapiens
cggagcctcggttggcctcggatagccggtc

SEQ ID NO: 27807 - DNA, 32 bp, Homo sapiens; identical to SEQ ID NO: 6331

SEQ ID NO: 27808 - DNA, 33 bp, Homo sapiens; identical to SEQ ID NO: 6332

SEQ ID NO: 27809 - DNA, 36 bp, Homo sapiens
cggagcctcggttggcctcggatagccggtcccccg

SEQ ID NO: 27810 - DNA, 39 bp, Homo sapiens
cggagcctcggttggcctcggatagccggtcccccgcct

SEQ ID NO: 27811 - DNA, 16 bp, Homo sapiens
ggagcctcggttggcc

SEQ ID NO: 27812 - DNA, 17 bp, Homo sapiens
ggagcctcggttggcct

SEQ ID NO: 27813 - DNA, 18 bp, Homo sapiens
ggagcctcggttggcctc

SEQ ID NO: 27814 - DNA, 19 bp, Homo sapiens
ggagcctcggttggcctcg

SEQ ID NO: 27815 - DNA, 21 bp, Homo sapiens
ggagcctcggttggcctcgga

SEQ ID NO: 27816 - DNA, 22 bp, Homo sapiens
ggagcctcggttggcctcggat

SEQ ID NO: 27817 - DNA, 29 bp, Homo sapiens
ggagcctcggttggcctcggatagccggt

SEQ ID NO: 27818 - DNA, 30 bp, Homo sapiens; identical to SEQ ID NO: 6334

SEQ ID NO: 27819 - DNA, 32 bp, Homo sapiens; identical to SEQ ID NO: 6335

SEQ ID NO: 27820 - DNA, 18 bp, Homo sapiens
gagcctcggttggcctcg

SEQ ID NO: 27821 - DNA, 20 bp, Homo sapiens
gagcctcggttggcctcgga

SEQ ID NO: 27822 - DNA, 28 bp, Homo sapiens
gagcctcggttggcctcggatagccggt

SEQ ID NO: 27823 - DNA, 29 bp, Homo sapiens
gagcctcggttggcctcggatagccggtc

SEQ ID NO: 27824 - DNA, 31 bp, Homo sapiens
gagcctcggttggcctcggatagccggtccc

SEQ ID NO: 27825 - DNA, 34 bp, Homo sapiens
gagcctcggttggcctcggatagccggtcccccg

SEQ ID NO: 27826 - DNA, 17 bp, Homo sapiens
agcctcggttggcctcg

SEQ ID NO: 27827 - DNA, 19 bp, Homo sapiens
agcctcggttggcctcgga

SEQ ID NO: 27828 - DNA, 20 bp, Homo sapiens
agcctcggttggcctcggat

SEQ ID NO: 27829 - DNA, 28 bp, Homo sapiens
agcctcggttggcctcggatagccggtc

SEQ ID NO: 27830 - DNA, 30 bp, Homo sapiens
agcctcggttggcctcggatagccggtccc

SEQ ID NO: 27831 - DNA, 33 bp, Homo sapiens; identical to SEQ ID NO: 6337

SEQ ID NO: 27832 - DNA, 16 bp, Homo sapiens
gcctcggttggcctcg

SEQ ID NO: 27833 - DNA, 18 bp, Homo sapiens
gcctcggttggcctcgga

SEQ ID NO: 27834 - DNA, 19 bp, Homo sapiens
gcctcggttggcctcggat

SEQ ID NO: 27835 - DNA, 20 bp, Homo sapiens
gcctcggttggcctcggata

SEQ ID NO: 27836 - DNA, 22 bp, Homo sapiens
gcctcggttggcctcggatagc

SEQ ID NO: 27837 - DNA, 23 bp, Homo sapiens
gcctcggttggcctcggatagcc

SEQ ID NO: 27838 - DNA, 24 bp, Homo sapiens
gcctcggttggcctcggatagccg

SEQ ID NO: 27839 - DNA, 16 bp, Homo sapiens
cctcggttggcctcgg

SEQ ID NO: 27840 - DNA, 17 bp, Homo sapiens
cctcggttggcctcgga

SEQ ID NO: 27841 - DNA, 18 bp, Homo sapiens
cctcggttggcctcggat

SEQ ID NO: 27842 - DNA, 19 bp, Homo sapiens
cctcggttggcctcggata

SEQ ID NO: 27843 - DNA, 31 bp, Homo sapiens
cctcggttggcctcggatagccggtcccccg

SEQ ID NO: 27844 - DNA, 16 bp, Homo sapiens
ctcggttggcctcgga

SEQ ID NO: 27845 - DNA, 17 bp, Homo sapiens
ctcggttggcctcggat

SEQ ID NO: 27846 - DNA, 25 bp, Homo sapiens
ctcggttggcctcggatagccggtc

SEQ ID NO: 27847 - DNA, 32 bp, Homo sapiens
ctcggttggcctcggatagccggtcccccgcc

SEQ ID NO: 27848 - DNA, 33 bp, Homo sapiens
ctcggttggcctcggatagccggtcccccgcct

SEQ ID NO: 27849 - DNA, 16 bp, Homo sapiens
tcggttggcctcggat

SEQ ID NO: 27850 - DNA, 24 bp, Homo sapiens
tcggttggcctcggatagccggtc

SEQ ID NO: 27851 - DNA, 31 bp, Homo sapiens
tcggttggcctcggatagccggtcccccgcc

SEQ ID NO: 27852 - DNA, 32 bp, Homo sapiens
tcggttggcctcggatagccggtcccccgcct

SEQ ID NO: 27853 - DNA, 23 bp, Homo sapiens
cggttggcctcggatagccggtc

SEQ ID NO: 27854 - DNA, 28 bp, Homo sapiens
gttggcctcggatagccggtcccccgcc

SEQ ID NO: 27855 - DNA, 29 bp, Homo sapiens
gttggcctcggatagccggtcccccgcct

SEQ ID NO: 27856 - DNA, 30 bp, Homo sapiens
gttggcctcggatagccggtcccccgcctg

SEQ ID NO: 27857 - DNA, 28 bp, Homo sapiens
ttggcctcggatagccggtcccccgcct

SEQ ID NO: 27858 - DNA, 26 bp, Homo sapiens
ggcctcggatagccggtcccccgcct

SEQ ID NO: 27859 - DNA, 28 bp, Homo sapiens
ggcctcggatagccggtcccccgcctgt

SEQ ID NO: 27860 - DNA, 24 bp, Homo sapiens
gcctcggatagccggtcccccgcc

SEQ ID NO: 27861 - DNA, 25 bp, Homo sapiens
gcctcggatagccggtcccccgcct

SEQ ID NO: 27862 - DNA, 16 bp, Homo sapiens
cctcggatagccggtc

SEQ ID NO: 27863 - DNA, 23 bp, Homo sapiens
cctcggatagccggtcccccgcc

SEQ ID NO: 27864 - DNA, 21 bp, Homo sapiens
tcggatagccggtcccccgcc

SEQ ID NO: 27865 - DNA, 22 bp, Homo sapiens
tcggatagccggtcccccgcct

SEQ ID NO: 27866 - DNA, 20 bp, Homo sapiens
cggatagccggtcccccgcc

SEQ ID NO: 27867 - DNA, 21 bp, Homo sapiens
cggatagccggtcccccgcct

SEQ ID NO: 27868 - DNA, 33 bp, Homo sapiens
cggatagccggtcccccgcctgtccccgccggc

SEQ ID NO: 27869 - DNA, 19 bp, Homo sapiens
ggatagccggtcccccgcc

SEQ ID NO: 27870 - DNA, 20 bp, Homo sapiens
ggatagccggtcccccgcct

SEQ ID NO: 27871 - DNA, 16 bp, Homo sapiens
gatagccggtcccccg

SEQ ID NO: 27872 - DNA, 17 bp, Homo sapiens
gatagccggtcccccgc

SEQ ID NO: 27873 - DNA, 18 bp, Homo sapiens
gatagccggtcccccgcc

SEQ ID NO: 27874 - DNA, 19 bp, Homo sapiens
gatagccggtcccccgcct

SEQ ID NO: 27875 - DNA, 21 bp, Homo sapiens
gatagccggtcccccgcctgt

SEQ ID NO: 27876 - DNA, 17 bp, Homo sapiens
atagccggtcccccgcc

SEQ ID NO: 27877 - DNA, 18 bp, Homo sapiens
atagccggtcccccgcct

SEQ ID NO: 27878 - DNA, 25 bp, Homo sapiens
atagccggtcccccgcctgtccccg

SEQ ID NO: 27879 - DNA, 16 bp, Homo sapiens
tagccggtcccccgcc

SEQ ID NO: 27880 - DNA, 17 bp, Homo sapiens
tagccggtcccccgcct

SEQ ID NO: 27881 - DNA, 20 bp, Homo sapiens
tagccggtcccccgcctgtc

SEQ ID NO: 27882 - DNA, 23 bp, Homo sapiens
tagccggtcccccgcctgtcccc

SEQ ID NO: 27883 - DNA, 26 bp, Homo sapiens
tagccggtcccccgcctgtccccgcc

SEQ ID NO: 27884 - DNA, 16 bp, Homo sapiens
agccggtcccccgcct

SEQ ID NO: 27885 - DNA, 23 bp, Homo sapiens
agccggtcccccgcctgtccccg

SEQ ID NO: 27886 - DNA, 25 bp, Homo sapiens
agccggtcccccgcctgtccccgcc

SEQ ID NO: 27887 - DNA, 17 bp, Homo sapiens
cctgtccccgccggcgg

SEQ ID NO: 27888 - DNA, 23 bp, Homo sapiens
cctgtccccgccggcgggccgcc

SEQ ID NO: 27889 - DNA, 24 bp, Homo sapiens
cctgtccccgccggcgggccgccc

SEQ ID NO: 27890 - DNA, 22 bp, Homo sapiens
ctgtccccgccggcgggccgcc

SEQ ID NO: 27891 - DNA, 17 bp, Homo sapiens
tgtccccgccggcgggc

SEQ ID NO: 27892 - DNA, 18 bp, Homo sapiens
tgtccccgccggcgggcc

SEQ ID NO: 27893 - DNA, 19 bp, Homo sapiens
tgtccccgccggcgggccg

SEQ ID NO: 27894 - DNA, 21 bp, Homo sapiens
tgtccccgccggcgggccgcc

SEQ ID NO: 27895 - DNA, 22 bp, Homo sapiens
tgtccccgccggcgggccgccc

SEQ ID NO: 27896 - DNA, 23 bp, Homo sapiens
tgtccccgccggcgggccgcccc

SEQ ID NO: 27897 - DNA, 24 bp, Homo sapiens
tgtccccgccggcgggccgccccc

SEQ ID NO: 27898 - DNA, 25 bp, Homo sapiens
tgtccccgccggcgggccgcccccc

SEQ ID NO: 27899 - DNA, 26 bp, Homo sapiens
tgtccccgccggcgggccgccccccc

SEQ ID NO: 27900 - DNA, 33 bp, Homo sapiens
tgtccccgccggcgggccgcccccccctccacg

SEQ ID NO: 27901 - DNA, 16 bp, Homo sapiens
gtccccgccggcgggc

SEQ ID NO: 27902 - DNA, 17 bp, Homo sapiens
gtccccgccggcgggcc

SEQ ID NO: 27903 - DNA, 20 bp, Homo sapiens
gtccccgccggcgggccgcc

SEQ ID NO: 27904 - DNA, 21 bp, Homo sapiens
gtccccgccggcgggccgccc

SEQ ID NO: 27905 - DNA, 22 bp, Homo sapiens
gtccccgccggcgggccgcccc

SEQ ID NO: 27906 - DNA, 16 bp, Homo sapiens
tccccgccggcgggcc

SEQ ID NO: 27907 - DNA, 19 bp, Homo sapiens
tccccgccggcgggccgcc

SEQ ID NO: 27908 - DNA, 20 bp, Homo sapiens
tccccgccggcgggccgccc

SEQ ID NO: 27909 - DNA, 21 bp, Homo sapiens
tccccgccggcgggccgcccc

SEQ ID NO: 27910 - DNA, 22 bp, Homo sapiens
tccccgccggcgggccgccccc

SEQ ID NO: 27911 - DNA, 23 bp, Homo sapiens
tccccgccggcgggccgcccccc

SEQ ID NO: 27912 - DNA, 24 bp, Homo sapiens
tccccgccggcgggccgccccccc

SEQ ID NO: 27913 - DNA, 25 bp, Homo sapiens
tccccgccggcgggccgcccccccc

SEQ ID NO: 27914 - DNA, 18 bp, Homo sapiens
ccccgccggcgggccgcc

SEQ ID NO: 27915 - DNA, 23 bp, Homo sapiens
ccccgccggcgggccgccccccc

SEQ ID NO: 27916 - DNA, 24 bp, Homo sapiens
ccccgccggcgggccgcccccccc

SEQ ID NO: 27917 - DNA, 19 bp, Homo sapiens
cccgccggcgggccgcccc

SEQ ID NO: 27918 - DNA, 20 bp, Homo sapiens
cccgccggcgggccgccccc

SEQ ID NO: 27919 - DNA, 21 bp, Homo sapiens
cccgccggcgggccgcccccc

SEQ ID NO: 27920 - DNA, 22 bp, Homo sapiens
cccgccggcgggccgccccccc

SEQ ID NO: 27921 - DNA, 23 bp, Homo sapiens
cccgccggcgggccgcccccccc

SEQ ID NO: 27922 - DNA, 22 bp, Homo sapiens
ccgccggcgggccgcccccccc

SEQ ID NO: 27923 - DNA, 20 bp, Homo sapiens
cgccggcgggccgccccccc

SEQ ID NO: 27924 - DNA, 21 bp, Homo sapiens
cgccggcgggccgcccccccc

SEQ ID NO: 27925 - DNA, 16 bp, Homo sapiens
ccggcgggccgccccc

SEQ ID NO: 27926 - DNA, 17 bp, Homo sapiens
ccggcgggccgcccccc

SEQ ID NO: 27927 - DNA, 18 bp, Homo sapiens
ccggcgggccgccccccc

SEQ ID NO: 27928 - DNA, 19 bp, Homo sapiens
ccggcgggccgcccccccc

SEQ ID NO: 27929 - DNA, 16 bp, Homo sapiens
cggcgggccgcccccc

SEQ ID NO: 27930 - DNA, 25 bp, Homo sapiens
acgcgccccgcgcgcgcgggagggc

SEQ ID NO: 27931 - DNA, 23 bp, Homo sapiens
gcgccccgcgcgcgcgggagggc

SEQ ID NO: 27932 - DNA, 22 bp, Homo sapiens
cgccccgcgcgcgcgggagggc

SEQ ID NO: 27933 - DNA, 21 bp, Homo sapiens
gccccgcgcgcgcgggagggc

SEQ ID NO: 27934 - DNA, 20 bp, Homo sapiens
ccccgcgcgcgcgggagggc

SEQ ID NO: 27935 - DNA, 21 bp, Homo sapiens
ccccgcgcgcgcgggagggcg

SEQ ID NO: 27936 - DNA, 23 bp, Homo sapiens
ccccgcgcgcgcgggagggcgcg

SEQ ID NO: 27937 - DNA, 32 bp, Homo sapiens
gagggcgcgtgccccgccgcgcgccgggaccg

SEQ ID NO: 27938 - DNA, 30 bp, Homo sapiens
gggcgcgtgccccgccgcgcgccgggaccg

SEQ ID NO: 27939 - DNA, 26 bp, Homo sapiens
ccgccgcgcgccgggaccggggtccg

SEQ ID NO: 27940 - DNA, 16 bp, Homo sapiens
cgccgcgcgccgggac

SEQ ID NO: 27941 - DNA, 19 bp, Homo sapiens
cgccgggaccggggtccgg

SEQ ID NO: 27942 - DNA, 20 bp, Homo sapiens
ccgggaccggggtccggtgc

SEQ ID NO: 27943 - DNA, 20 bp, Homo sapiens
ggaccggggtccggtgcgga

SEQ ID NO: 27944 - DNA, 19 bp, Homo sapiens
gaccggggtccggtgcgga

SEQ ID NO: 27945 - DNA, 18 bp, Homo sapiens
accggggtccggtgcgga

SEQ ID NO: 27946 - DNA, 33 bp, Homo sapiens; identical to SEQ ID NO: 6356

SEQ ID NO: 27947 - DNA, 17 bp, Homo sapiens
ccggggtccggtgcgga

SEQ ID NO: 27948 - DNA, 32 bp, Homo sapiens
ccggggtccggtgcggagtgcccttcgtcctg

SEQ ID NO: 27949 - DNA, 31 bp, Homo sapiens
cggggtccggtgcggagtgcccttcgtcctg

SEQ ID NO: 27950 - DNA, 26 bp, Homo sapiens
gggtccggtgcggagtgcccttcgtc

SEQ ID NO: 27951 - DNA, 28 bp, Homo sapiens
gggtccggtgcggagtgcccttcgtcct

SEQ ID NO: 27952 - DNA, 17 bp, Homo sapiens
ggtccggtgcggagtgc

SEQ ID NO: 27953 - DNA, 28 bp, Homo sapiens
ggtccggtgcggagtgcccttcgtcctg

SEQ ID NO: 27954 - DNA, 16 bp, Homo sapiens
gtccggtgcggagtgc

SEQ ID NO: 27955 - DNA, 17 bp, Homo sapiens
gtccggtgcggagtgcc

SEQ ID NO: 27956 - DNA, 21 bp, Homo sapiens
gtccggtgcggagtgcccttc

SEQ ID NO: 27957 - DNA, 23 bp, Homo sapiens
gtccggtgcggagtgcccttcgt

SEQ ID NO: 27958 - DNA, 27 bp, Homo sapiens
gtccggtgcggagtgcccttcgtcctg

SEQ ID NO: 27959 - DNA, 28 bp, Homo sapiens
gtccggtgcggagtgcccttcgtcctgg

SEQ ID NO: 27960 - DNA, 26 bp, Homo sapiens
tccggtgcggagtgcccttcgtcctg

SEQ ID NO: 27961 - DNA, 21 bp, Homo sapiens
cggtgcggagtgcccttcgtc

SEQ ID NO: 27962 - DNA, 22 bp, Homo sapiens
cggtgcggagtgcccttcgtcc

SEQ ID NO: 27963 - DNA, 24 bp, Homo sapiens
cggtgcggagtgcccttcgtcctg

SEQ ID NO: 27964 - DNA, 20 bp, Homo sapiens
ggtgcggagtgcccttcgtc

SEQ ID NO: 27965 - DNA, 21 bp, Homo sapiens
ggtgcggagtgcccttcgtcc

SEQ ID NO: 27966 - DNA, 23 bp, Homo sapiens
ggtgcggagtgcccttcgtcctg

SEQ ID NO: 27967 - DNA, 19 bp, Homo sapiens
gtgcggagtgcccttcgtc

SEQ ID NO: 27968 - DNA, 16 bp, Homo sapiens
gagtgcccttcgtcct

SEQ ID NO: 27969 - DNA, 17 bp, Homo sapiens
gagtgcccttcgtcctg

SEQ ID NO: 27970 - DNA, 18 bp, Homo sapiens
gagtgcccttcgtcctgg

SEQ ID NO: 27971 - DNA, 19 bp, Homo sapiens
gagtgcccttcgtcctggg

SEQ ID NO: 27972 - DNA, 18 bp, Homo sapiens
agtgcccttcgtcctggg

SEQ ID NO: 27973 - DNA, 16 bp, Homo sapiens
gtgcccttcgtcctgg

SEQ ID NO: 27974 - DNA, 17 bp, Homo sapiens
gtgcccttcgtcctggg

SEQ ID NO: 27975 - DNA, 18 bp, Homo sapiens
gtgcccttcgtcctggga

SEQ ID NO: 27976 - DNA, 16 bp, Homo sapiens
tgcccttcgtcctggg

SEQ ID NO: 27977 - DNA, 26 bp, Homo sapiens
cttcgtcctgggaaacggggcgcggc

SEQ ID NO: 27978 - DNA, 26 bp, Homo sapiens
ttcgtcctgggaaacggggcgcggct

SEQ ID NO: 27979 - DNA, 16 bp, Homo sapiens
tgggaaacggggcgcg

SEQ ID NO: 27980 - DNA, 16 bp, Homo sapiens
ggaaacggggcgcggc

SEQ ID NO: 27981 - DNA, 16 bp, Homo sapiens
gaaacggggcgcggct

SEQ ID NO: 27982 - DNA, 16 bp, Homo sapiens
ggaaaggcggccgccc

SEQ ID NO: 27983 - DNA, 27 bp, Homo sapiens
ggaaaggcggccgccccctcgcccgtc

SEQ ID NO: 27984 - DNA, 19 bp, Homo sapiens
gcggccgccccctcgcccg

SEQ ID NO: 27985 - DNA, 16 bp, Homo sapiens
cggccgccccctcgcc

SEQ ID NO: 27986 - DNA, 17 bp, Homo sapiens
cggccgccccctcgccc

SEQ ID NO: 27987 - DNA, 18 bp, Homo sapiens
cggccgccccctcgcccg

SEQ ID NO: 27988 - DNA, 20 bp, Homo sapiens
cggccgccccctcgcccgtc

SEQ ID NO: 27989 - DNA, 28 bp, Homo sapiens
cggccgccccctcgcccgtcacgcaccg

SEQ ID NO: 27990 - DNA, 16 bp, Homo sapiens
gccgccccctcgcccg

SEQ ID NO: 27991 - DNA, 30 bp, Homo sapiens
gccgccccctcgcccgtcacgcaccgcacg

SEQ ID NO: 27992 - DNA, 19 bp, Homo sapiens
cctcgcccgtcacgcaccg

SEQ ID NO: 27993 - DNA, 18 bp, Homo sapiens
ctcgcccgtcacgcaccg

SEQ ID NO: 27994 - DNA, 16 bp, Homo sapiens
cgcccgtcacgcaccg

SEQ ID NO: 27995 - DNA, 28 bp, Homo sapiens
gtcacgcaccgcacgttcgtggggaacc

SEQ ID NO: 27996 - DNA, 29 bp, Homo sapiens
gtcacgcaccgcacgttcgtggggaacct

SEQ ID NO: 27997 - DNA, 29 bp, Homo sapiens
acgcaccgcacgttcgtggggaacctggc

SEQ ID NO: 27998 - DNA, 32 bp, Homo sapiens; identical to SEQ ID NO: 6363

SEQ ID NO: 27999 - DNA, 24 bp, Homo sapiens
cgcaccgcacgttcgtggggaacc

SEQ ID NO: 28000 - DNA, 25 bp, Homo sapiens
cgcaccgcacgttcgtggggaacct

SEQ ID NO: 28001 - DNA, 26 bp, Homo sapiens
cgcaccgcacgttcgtggggaacctg

SEQ ID NO: 28002 - DNA, 28 bp, Homo sapiens
cgcaccgcacgttcgtggggaacctggc

SEQ ID NO: 28003 - DNA, 30 bp, Homo sapiens
cgcaccgcacgttcgtggggaacctggcgc

SEQ ID NO: 28004 - DNA, 31 bp, Homo sapiens; identical to SEQ ID NO: 6364

SEQ ID NO: 28005 - DNA, 32 bp, Homo sapiens
cgcaccgcacgttcgtggggaacctggcgcta

SEQ ID NO: 28006 - DNA, 23 bp, Homo sapiens
gcaccgcacgttcgtggggaacc

SEQ ID NO: 28007 - DNA, 25 bp, Homo sapiens
gcaccgcacgttcgtggggaacctg

SEQ ID NO: 28008 - DNA, 30 bp, Homo sapiens
gcaccgcacgttcgtggggaacctggcgct

SEQ ID NO: 28009 - DNA, 29 bp, Homo sapiens
caccgcacgttcgtggggaacctggcgct

SEQ ID NO: 28010 - DNA, 30 bp, Homo sapiens
caccgcacgttcgtggggaacctggcgcta

SEQ ID NO: 28011 - DNA, 33 bp, Homo sapiens; identical to SEQ ID NO: 6366

SEQ ID NO: 28012 - DNA, 34 bp, Homo sapiens
caccgcacgttcgtggggaacctggcgctaaacc

SEQ ID NO: 28013 - DNA, 28 bp, Homo sapiens
accgcacgttcgtggggaacctggcgct

SEQ ID NO: 28014 - DNA, 33 bp, Homo sapiens
accgcacgttcgtggggaacctggcgctaaacc

SEQ ID NO: 28015 - DNA, 21 bp, Homo sapiens
ccgcacgttcgtggggaacct

SEQ ID NO: 28016 - DNA, 23 bp, Homo sapiens
ccgcacgttcgtggggaacctgg

SEQ ID NO: 28017 - DNA, 24 bp, Homo sapiens
ccgcacgttcgtggggaacctggc

SEQ ID NO: 28018 - DNA, 25 bp, Homo sapiens
ccgcacgttcgtggggaacctggcg

SEQ ID NO: 28019 - DNA, 27 bp, Homo sapiens
ccgcacgttcgtggggaacctggcgct

SEQ ID NO: 28020 - DNA, 28 bp, Homo sapiens
ccgcacgttcgtggggaacctggcgcta

SEQ ID NO: 28021 - DNA, 29 bp, Homo sapiens
ccgcacgttcgtggggaacctggcgctaa

SEQ ID NO: 28022 - DNA, 30 bp, Homo sapiens
ccgcacgttcgtggggaacctggcgctaaa

SEQ ID NO: 28023 - DNA, 31 bp, Homo sapiens; identical to SEQ ID NO: 6368

SEQ ID NO: 28024 - DNA, 32 bp, Homo sapiens; identical to SEQ ID NO: 6369

SEQ ID NO: 28025 - DNA, 33 bp, Homo sapiens
ccgcacgttcgtggggaacctggcgctaaacca

SEQ ID NO: 28026 - DNA, 42 bp, Homo sapiens
ccgcacgttcgtggggaacctggcgctaaaccattcgtagac

SEQ ID NO: 28027 - DNA, 26 bp, Homo sapiens
cgcacgttcgtggggaacctggcgct

SEQ ID NO: 28028 - DNA, 31 bp, Homo sapiens; identical to SEQ ID NO: 6371

SEQ ID NO: 28029 - DNA, 32 bp, Homo sapiens
cgcacgttcgtggggaacctggcgctaaacca

SEQ ID NO: 28030 - DNA, 18 bp, Homo sapiens
gcacgttcgtggggaacc

SEQ ID NO: 28031 - DNA, 19 bp, Homo sapiens
gcacgttcgtggggaacct

SEQ ID NO: 28032 - DNA, 20 bp, Homo sapiens
gcacgttcgtggggaacctg

SEQ ID NO: 28033 - DNA, 22 bp, Homo sapiens
gcacgttcgtggggaacctggc

SEQ ID NO: 28034 - DNA, 23 bp, Homo sapiens
gcacgttcgtggggaacctggcg

SEQ ID NO: 28035 - DNA, 25 bp, Homo sapiens
gcacgttcgtggggaacctggcgct

SEQ ID NO: 28036 - DNA, 26 bp, Homo sapiens
gcacgttcgtggggaacctggcgcta

SEQ ID NO: 28037 - DNA, 29 bp, Homo sapiens
gcacgttcgtggggaacctggcgctaaac

SEQ ID NO: 28038 - DNA, 30 bp, Homo sapiens; identical to SEQ ID NO: 6373

SEQ ID NO: 28039 - DNA, 31 bp, Homo sapiens; identical to SEQ ID NO: 6374

SEQ ID NO: 28040 - DNA, 33 bp, Homo sapiens; identical to SEQ ID NO: 6375

SEQ ID NO: 28041 - DNA, 44 bp, Homo sapiens
gcacgttcgtggggaacctggcgctaaaccattcgtagacgacc

SEQ ID NO: 28042 - DNA, 21 bp, Homo sapiens
cacgttcgtggggaacctggc

SEQ ID NO: 28043 - DNA, 22 bp, Homo sapiens
cacgttcgtggggaacctggcg

SEQ ID NO: 28044 - DNA, 24 bp, Homo sapiens
cacgttcgtggggaacctggcgct

SEQ ID NO: 28045 - DNA, 28 bp, Homo sapiens
cacgttcgtggggaacctggcgctaaac

SEQ ID NO: 28046 - DNA, 29 bp, Homo sapiens
cacgttcgtggggaacctggcgctaaacc

SEQ ID NO: 28047 - DNA, 30 bp, Homo sapiens; identical to SEQ ID NO: 6378

SEQ ID NO: 28048 - DNA, 32 bp, Homo sapiens
cacgttcgtggggaacctggcgctaaaccatt

SEQ ID NO: 28049 - DNA, 23 bp, Homo sapiens
acgttcgtggggaacctggcgct

SEQ ID NO: 28050 - DNA, 22 bp, Homo sapiens
cgttcgtggggaacctggcgct

SEQ ID NO: 28051 - DNA, 23 bp, Homo sapiens
cgttcgtggggaacctggcgcta

SEQ ID NO: 28052 - DNA, 27 bp, Homo sapiens
cgttcgtggggaacctggcgctaaacc

SEQ ID NO: 28053 - DNA, 28 bp, Homo sapiens
cgttcgtggggaacctggcgctaaacca

SEQ ID NO: 28054 - DNA, 30 bp, Homo sapiens
cgttcgtggggaacctggcgctaaaccatt

SEQ ID NO: 28055 - DNA, 26 bp, Homo sapiens
gttcgtggggaacctggcgctaaacc

SEQ ID NO: 28056 - DNA, 19 bp, Homo sapiens
ttcgtggggaacctggcgc

SEQ ID NO: 28057 - DNA, 20 bp, Homo sapiens
ttcgtggggaacctggcgct

SEQ ID NO: 28058 - DNA, 21 bp, Homo sapiens
ttcgtggggaacctggcgcta

SEQ ID NO: 28059 - DNA, 24 bp, Homo sapiens
ttcgtggggaacctggcgctaaac

SEQ ID NO: 28060 - DNA, 25 bp, Homo sapiens
ttcgtggggaacctggcgctaaacc

SEQ ID NO: 28061 - DNA, 26 bp, Homo sapiens
ttcgtggggaacctggcgctaaacca

SEQ ID NO: 28062 - DNA, 28 bp, Homo sapiens
ttcgtggggaacctggcgctaaaccatt

SEQ ID NO: 28063 - DNA, 19 bp, Homo sapiens
tcgtggggaacctggcgct

SEQ ID NO: 28064 - DNA, 23 bp, Homo sapiens
tcgtggggaacctggcgctaaac

SEQ ID NO: 28065 - DNA, 24 bp, Homo sapiens
tcgtggggaacctggcgctaaacc

SEQ ID NO: 28066 - DNA, 25 bp, Homo sapiens
tcgtggggaacctggcgctaaacca

SEQ ID NO: 28067 - DNA, 27 bp, Homo sapiens
tcgtggggaacctggcgctaaaccatt

SEQ ID NO: 28068 - DNA, 18 bp, Homo sapiens
cgtggggaacctggcgct

SEQ ID NO: 28069 - DNA, 22 bp, Homo sapiens
cgtggggaacctggcgctaaac

SEQ ID NO: 28070 - DNA, 23 bp, Homo sapiens
cgtggggaacctggcgctaaacc

SEQ ID NO: 28071 - DNA, 24 bp, Homo sapiens
cgtggggaacctggcgctaaacca

SEQ ID NO: 28072 - DNA, 26 bp, Homo sapiens
cgtggggaacctggcgctaaaccatt

SEQ ID NO: 28073 - DNA, 32 bp, Homo sapiens
cgtggggaacctggcgctaaaccattcgtaga

SEQ ID NO: 28074 - DNA, 33 bp, Homo sapiens
cgtggggaacctggcgctaaaccattcgtagac

SEQ ID NO: 28075 - DNA, 38 bp, Homo sapiens
cgtggggaacctggcgctaaaccattcgtagacgacct

SEQ ID NO: 28076 - DNA, 17 bp, Homo sapiens
gtggggaacctggcgct

SEQ ID NO: 28077 - DNA, 22 bp, Homo sapiens
gtggggaacctggcgctaaacc

SEQ ID NO: 28078 - DNA, 25 bp, Homo sapiens
gtggggaacctggcgctaaaccatt

SEQ ID NO: 28079 - DNA, 16 bp, Homo sapiens
tggggaacctggcgct

SEQ ID NO: 28080 - DNA, 17 bp, Homo sapiens
tggggaacctggcgcta

SEQ ID NO: 28081 - DNA, 20 bp, Homo sapiens
tggggaacctggcgctaaac

SEQ ID NO: 28082 - DNA, 21 bp, Homo sapiens
tggggaacctggcgctaaacc

SEQ ID NO: 28083 - DNA, 30 bp, Homo sapiens
tggggaacctggcgctaaaccattcgtaga

SEQ ID NO: 28084 - DNA, 31 bp, Homo sapiens
tggggaacctggcgctaaaccattcgtagac

SEQ ID NO: 28085 - DNA, 33 bp, Homo sapiens
gaacctggcgctaaaccattcgtagacgacctg

SEQ ID NO: 28086 - DNA, 26 bp, Homo sapiens
aacctggcgctaaaccattcgtagac

SEQ ID NO: 28087 - DNA, 32 bp, Homo sapiens
aacctggcgctaaaccattcgtagacgacctg

SEQ ID NO: 28088 - DNA, 25 bp, Homo sapiens
acctggcgctaaaccattcgtagac

SEQ ID NO: 28089 - DNA, 26 bp, Homo sapiens
acctggcgctaaaccattcgtagacg

SEQ ID NO: 28090 - DNA, 29 bp, Homo sapiens
acctggcgctaaaccattcgtagacgacc

SEQ ID NO: 28091 - DNA, 31 bp, Homo sapiens
acctggcgctaaaccattcgtagacgacctg

SEQ ID NO: 28092 - DNA, 33 bp, Homo sapiens
acctggcgctaaaccattcgtagacgacctgct

SEQ ID NO: 28093 - DNA, 24 bp, Homo sapiens
cctggcgctaaaccattcgtagac

SEQ ID NO: 28094 - DNA, 25 bp, Homo sapiens
cctggcgctaaaccattcgtagacg

SEQ ID NO: 28095 - DNA, 26 bp, Homo sapiens
cctggcgctaaaccattcgtagacga

SEQ ID NO: 28096 - DNA, 27 bp, Homo sapiens
cctggcgctaaaccattcgtagacgac

SEQ ID NO: 28097 - DNA, 28 bp, Homo sapiens
cctggcgctaaaccattcgtagacgacc

SEQ ID NO: 28098 - DNA, 29 bp, Homo sapiens
cctggcgctaaaccattcgtagacgacct

SEQ ID NO: 28099 - DNA, 32 bp, Homo sapiens
cctggcgctaaaccattcgtagacgacctgct

SEQ ID NO: 28100 - DNA, 23 bp, Homo sapiens
ctggcgctaaaccattcgtagac

SEQ ID NO: 28101 - DNA, 24 bp, Homo sapiens
ctggcgctaaaccattcgtagacg

SEQ ID NO: 28102 - DNA, 26 bp, Homo sapiens
ctggcgctaaaccattcgtagacgac

SEQ ID NO: 28103 - DNA, 27 bp, Homo sapiens
ctggcgctaaaccattcgtagacgacc

SEQ ID NO: 28104 - DNA, 31 bp, Homo sapiens; identical to SEQ ID NO: 6398

SEQ ID NO: 28105 - DNA, 33 bp, Homo sapiens
ctggcgctaaaccattcgtagacgacctgcttc

SEQ ID NO: 28106 - DNA, 22 bp, Homo sapiens
tggcgctaaaccattcgtagac

SEQ ID NO: 28107 - DNA, 23 bp, Homo sapiens
tggcgctaaaccattcgtagacg

SEQ ID NO: 28108 - DNA, 25 bp, Homo sapiens
tggcgctaaaccattcgtagacgac

SEQ ID NO: 28109 - DNA, 26 bp, Homo sapiens
tggcgctaaaccattcgtagacgacc

SEQ ID NO: 28110 - DNA, 30 bp, Homo sapiens
tggcgctaaaccattcgtagacgacctgct

SEQ ID NO: 28111 - DNA, 21 bp, Homo sapiens
ggcgctaaaccattcgtagac

SEQ ID NO: 28112 - DNA, 22 bp, Homo sapiens
ggcgctaaaccattcgtagacg

SEQ ID NO: 28113 - DNA, 23 bp, Homo sapiens
ggcgctaaaccattcgtagacga

SEQ ID NO: 28114 - DNA, 24 bp, Homo sapiens
ggcgctaaaccattcgtagacgac

SEQ ID NO: 28115 - DNA, 25 bp, Homo sapiens
ggcgctaaaccattcgtagacgacc

SEQ ID NO: 28116 - DNA, 26 bp, Homo sapiens
ggcgctaaaccattcgtagacgacct

SEQ ID NO: 28117 - DNA, 29 bp, Homo sapiens
ggcgctaaaccattcgtagacgacctgct

SEQ ID NO: 28118 - DNA, 30 bp, Homo sapiens
ggcgctaaaccattcgtagacgacctgctt

SEQ ID NO: 28119 - DNA, 31 bp, Homo sapiens
ggcgctaaaccattcgtagacgacctgcttc

SEQ ID NO: 28120 - DNA, 32 bp, Homo sapiens
ggcgctaaaccattcgtagacgacctgcttct

SEQ ID NO: 28121 - DNA, 21 bp, Homo sapiens
gcgctaaaccattcgtagacg

SEQ ID NO: 28122 - DNA, 23 bp, Homo sapiens
gcgctaaaccattcgtagacgac

SEQ ID NO: 28123 - DNA, 24 bp, Homo sapiens
gcgctaaaccattcgtagacgacc

SEQ ID NO: 28124 - DNA, 19 bp, Homo sapiens
cgctaaaccattcgtagac

SEQ ID NO: 28125 - DNA, 20 bp, Homo sapiens
cgctaaaccattcgtagacg

SEQ ID NO: 28126 - DNA, 21 bp, Homo sapiens
cgctaaaccattcgtagacga

SEQ ID NO: 28127 - DNA, 22 bp, Homo sapiens
cgctaaaccattcgtagacgac

SEQ ID NO: 28128 - DNA, 23 bp, Homo sapiens
cgctaaaccattcgtagacgacc

SEQ ID NO: 28129 - DNA, 24 bp, Homo sapiens
cgctaaaccattcgtagacgacct

SEQ ID NO: 28130 - DNA, 25 bp, Homo sapiens
cgctaaaccattcgtagacgacctg

SEQ ID NO: 28131 - DNA, 27 bp, Homo sapiens
cgctaaaccattcgtagacgacctgct

SEQ ID NO: 28132 - DNA, 28 bp, Homo sapiens
cgctaaaccattcgtagacgacctgctt

SEQ ID NO: 28133 - DNA, 29 bp, Homo sapiens
cgctaaaccattcgtagacgacctgcttc

SEQ ID NO: 28134 - DNA, 30 bp, Homo sapiens
cgctaaaccattcgtagacgacctgcttct

SEQ ID NO: 28135 - DNA, 32 bp, Homo sapiens
cgctaaaccattcgtagacgacctgcttctgg

SEQ ID NO: 28136 - DNA, 18 bp, Homo sapiens
gctaaaccattcgtagac

SEQ ID NO: 28137 - DNA, 19 bp, Homo sapiens
gctaaaccattcgtagacg

SEQ ID NO: 28138 - DNA, 20 bp, Homo sapiens
gctaaaccattcgtagacga

SEQ ID NO: 28139 - DNA, 21 bp, Homo sapiens
gctaaaccattcgtagacgac

SEQ ID NO: 28140 - DNA, 22 bp, Homo sapiens
gctaaaccattcgtagacgacc

SEQ ID NO: 28141 - DNA, 23 bp, Homo sapiens
gctaaaccattcgtagacgacct

SEQ ID NO: 28142 - DNA, 26 bp, Homo sapiens
gctaaaccattcgtagacgacctgct

SEQ ID NO: 28143 - DNA, 27 bp, Homo sapiens
gctaaaccattcgtagacgacctgctt

SEQ ID NO: 28144 - DNA, 28 bp, Homo sapiens
gctaaaccattcgtagacgacctgcttc

SEQ ID NO: 28145 - DNA, 29 bp, Homo sapiens
gctaaaccattcgtagacgacctgcttct

SEQ ID NO: 28146 - DNA, 17 bp, Homo sapiens
ctaaaccattcgtagac

SEQ ID NO: 28147 - DNA, 18 bp, Homo sapiens
ctaaaccattcgtagacg

SEQ ID NO: 28148 - DNA, 19 bp, Homo sapiens
ctaaaccattcgtagacga

SEQ ID NO: 28149 - DNA, 20 bp, Homo sapiens
ctaaaccattcgtagacgac

SEQ ID NO: 28150 - DNA, 21 bp, Homo sapiens
ctaaaccattcgtagacgacc

SEQ ID NO: 28151 - DNA, 22 bp, Homo sapiens
ctaaaccattcgtagacgacct

SEQ ID NO: 28152 - DNA, 25 bp, Homo sapiens
ctaaaccattcgtagacgacctgct

SEQ ID NO: 28153 - DNA, 26 bp, Homo sapiens
ctaaaccattcgtagacgacctgctt

SEQ ID NO: 28154 - DNA, 27 bp, Homo sapiens
ctaaaccattcgtagacgacctgcttc

SEQ ID NO: 28155 - DNA, 28 bp, Homo sapiens
ctaaaccattcgtagacgacctgcttct

SEQ ID NO: 28156 - DNA, 17 bp, Homo sapiens
taaaccattcgtagacg

SEQ ID NO: 28157 - DNA, 18 bp, Homo sapiens
taaaccattcgtagacga

SEQ ID NO: 28158 - DNA, 19 bp, Homo sapiens
taaaccattcgtagacgac

SEQ ID NO: 28159 - DNA, 20 bp, Homo sapiens
taaaccattcgtagacgacc

SEQ ID NO: 28160 - DNA, 21 bp, Homo sapiens
taaaccattcgtagacgacct

SEQ ID NO: 28161 - DNA, 24 bp, Homo sapiens
taaaccattcgtagacgacctgct

SEQ ID NO: 28162 - DNA, 25 bp, Homo sapiens
taaaccattcgtagacgacctgctt

SEQ ID NO: 28163 - DNA, 26 bp, Homo sapiens
taaaccattcgtagacgacctgcttc

SEQ ID NO: 28164 - DNA, 27 bp, Homo sapiens
taaaccattcgtagacgacctgcttct

SEQ ID NO: 28165 - DNA, 16 bp, Homo sapiens
aaaccattcgtagacg

SEQ ID NO: 28166 - DNA, 17 bp, Homo sapiens
aaaccattcgtagacga

SEQ ID NO: 28167 - DNA, 18 bp, Homo sapiens
aaaccattcgtagacgac

SEQ ID NO: 28168 - DNA, 19 bp, Homo sapiens
aaaccattcgtagacgacc

SEQ ID NO: 28169 - DNA, 20 bp, Homo sapiens
aaaccattcgtagacgacct

SEQ ID NO: 28170 - DNA, 23 bp, Homo sapiens
aaaccattcgtagacgacctgct

SEQ ID NO: 28171 - DNA, 24 bp, Homo sapiens
aaaccattcgtagacgacctgctt

SEQ ID NO: 28172 - DNA, 25 bp, Homo sapiens
aaaccattcgtagacgacctgcttc

SEQ ID NO: 28173 - DNA, 26 bp, Homo sapiens
aaaccattcgtagacgacctgcttct

SEQ ID NO: 28174 - DNA, 27 bp, Homo sapiens
aaaccattcgtagacgacctgcttctg

SEQ ID NO: 28175 - DNA, 16 bp, Homo sapiens
aaccattcgtagacga

SEQ ID NO: 28176 - DNA, 17 bp, Homo sapiens
aaccattcgtagacgac

SEQ ID NO: 28177 - DNA, 18 bp, Homo sapiens
aaccattcgtagacgacc

SEQ ID NO: 28178 - DNA, 19 bp, Homo sapiens
aaccattcgtagacgacct

SEQ ID NO: 28179 - DNA, 20 bp, Homo sapiens
aaccattcgtagacgacctg

SEQ ID NO: 28180 - DNA, 22 bp, Homo sapiens
aaccattcgtagacgacctgct

SEQ ID NO: 28181 - DNA, 23 bp, Homo sapiens
aaccattcgtagacgacctgctt

SEQ ID NO: 28182 - DNA, 24 bp, Homo sapiens
aaccattcgtagacgacctgcttc

SEQ ID NO: 28183 - DNA, 25 bp, Homo sapiens
aaccattcgtagacgacctgcttct

SEQ ID NO: 28184 - DNA, 26 bp, Homo sapiens
aaccattcgtagacgacctgcttctg

SEQ ID NO: 28185 - DNA, 27 bp, Homo sapiens
aaccattcgtagacgacctgcttctgg

SEQ ID NO: 28186 - DNA, 33 bp, Homo sapiens
aaccattcgtagacgacctgcttctgggtcggg

SEQ ID NO: 28187 - DNA, 16 bp, Homo sapiens
accattcgtagacgac

SEQ ID NO: 28188 - DNA, 17 bp, Homo sapiens
accattcgtagacgacc

SEQ ID NO: 28189 - DNA, 18 bp, Homo sapiens
accattcgtagacgacct

SEQ ID NO: 28190 - DNA, 19 bp, Homo sapiens
accattcgtagacgacctg

SEQ ID NO: 28191 - DNA, 21 bp, Homo sapiens
accattcgtagacgacctgct

SEQ ID NO: 28192 - DNA, 22 bp, Homo sapiens
accattcgtagacgacctgctt

SEQ ID NO: 28193 - DNA, 23 bp, Homo sapiens
accattcgtagacgacctgcttc

SEQ ID NO: 28194 - DNA, 24 bp, Homo sapiens
accattcgtagacgacctgcttct

SEQ ID NO: 28195 - DNA, 25 bp, Homo sapiens
accattcgtagacgacctgcttctg

SEQ ID NO: 28196 - DNA, 26 bp, Homo sapiens
accattcgtagacgacctgcttctgg

SEQ ID NO: 28197 - DNA, 32 bp, Homo sapiens
accattcgtagacgacctgcttctgggtcggg

SEQ ID NO: 28198 - DNA, 33 bp, Homo sapiens
accattcgtagacgacctgcttctgggtcgggg

SEQ ID NO: 28199 - DNA, 16 bp, Homo sapiens
ccattcgtagacgacc

SEQ ID NO: 28200 - DNA, 17 bp, Homo sapiens
ccattcgtagacgacct

SEQ ID NO: 28201 - DNA, 20 bp, Homo sapiens
ccattcgtagacgacctgct

SEQ ID NO: 28202 - DNA, 21 bp, Homo sapiens
ccattcgtagacgacctgctt

SEQ ID NO: 28203 - DNA, 22 bp, Homo sapiens
ccattcgtagacgacctgcttc

SEQ ID NO: 28204 - DNA, 23 bp, Homo sapiens
ccattcgtagacgacctgcttct

SEQ ID NO: 28205 - DNA, 24 bp, Homo sapiens
ccattcgtagacgacctgcttctg

SEQ ID NO: 28206 - DNA, 31 bp, Homo sapiens
ccattcgtagacgacctgcttctgggtcggg

SEQ ID NO: 28207 - DNA, 32 bp, Homo sapiens
ccattcgtagacgacctgcttctgggtcgggg

SEQ ID NO: 28208 - DNA, 16 bp, Homo sapiens
cattcgtagacgacct

SEQ ID NO: 28209 - DNA, 19 bp, Homo sapiens
cattcgtagacgacctgct

SEQ ID NO: 28210 - DNA, 20 bp, Homo sapiens
cattcgtagacgacctgctt

SEQ ID NO: 28211 - DNA, 21 bp, Homo sapiens
cattcgtagacgacctgcttc

SEQ ID NO: 28212 - DNA, 22 bp, Homo sapiens
cattcgtagacgacctgcttct

SEQ ID NO: 28213 - DNA, 33 bp, Homo sapiens
cattcgtagacgacctgcttctgggtcggggtt

SEQ ID NO: 28214 - DNA, 17 bp, Homo sapiens
attcgtagacgacctgc

SEQ ID NO: 28215 - DNA, 18 bp, Homo sapiens
attcgtagacgacctgct

SEQ ID NO: 28216 - DNA, 19 bp, Homo sapiens
attcgtagacgacctgctt

SEQ ID NO: 28217 - DNA, 20 bp, Homo sapiens
attcgtagacgacctgcttc

SEQ ID NO: 28218 - DNA, 21 bp, Homo sapiens
attcgtagacgacctgcttct

SEQ ID NO: 28219 - DNA, 22 bp, Homo sapiens
attcgtagacgacctgcttctg

SEQ ID NO: 28220 - DNA, 23 bp, Homo sapiens
attcgtagacgacctgcttctgg

SEQ ID NO: 28221 - DNA, 24 bp, Homo sapiens
attcgtagacgacctgcttctggg

SEQ ID NO: 28222 - DNA, 17 bp, Homo sapiens
ttcgtagacgacctgct

SEQ ID NO: 28223 - DNA, 18 bp, Homo sapiens
ttcgtagacgacctgctt

SEQ ID NO: 28224 - DNA, 19 bp, Homo sapiens
ttcgtagacgacctgcttc

SEQ ID NO: 28225 - DNA, 20 bp, Homo sapiens
ttcgtagacgacctgcttct

SEQ ID NO: 28226 - DNA, 21 bp, Homo sapiens
ttcgtagacgacctgcttctg

SEQ ID NO: 28227 - DNA, 24 bp, Homo sapiens
ttcgtagacgacctgcttctgggt

SEQ ID NO: 28228 - DNA, 30 bp, Homo sapiens
ttcgtagacgacctgcttctgggtcggggt

SEQ ID NO: 28229 - DNA, 16 bp, Homo sapiens
tcgtagacgacctgct

SEQ ID NO: 28230 - DNA, 19 bp, Homo sapiens
tcgtagacgacctgcttct

SEQ ID NO: 28231 - DNA, 16 bp, Homo sapiens
cgtagacgacctgctt

SEQ ID NO: 28232 - DNA, 17 bp, Homo sapiens
cgtagacgacctgcttc

SEQ ID NO: 28233 - DNA, 18 bp, Homo sapiens
cgtagacgacctgcttct

SEQ ID NO: 28234 - DNA, 20 bp, Homo sapiens
cgtagacgacctgcttctgg

SEQ ID NO: 28235 - DNA, 32 bp, Homo sapiens
cgtagacgacctgcttctgggtcggggtttcg

SEQ ID NO: 28236 - DNA, 16 bp, Homo sapiens
gtagacgacctgcttc

SEQ ID NO: 28237 - DNA, 17 bp, Homo sapiens
gtagacgacctgcttct

SEQ ID NO: 28238 - DNA, 33 bp, Homo sapiens
acgacctgcttctgggtcggggtttcgtacgta

SEQ ID NO: 28239 - DNA, 32 bp, Homo sapiens
cgacctgcttctgggtcggggtttcgtacgta

SEQ ID NO: 28240 - DNA, 25 bp, Homo sapiens
cctgcttctgggtcggggtttcgta

SEQ ID NO: 28241 - DNA, 29 bp, Homo sapiens
cctgcttctgggtcggggtttcgtacgta

SEQ ID NO: 28242 - DNA, 32 bp, Homo sapiens
cctgcttctgggtcggggtttcgtacgtagca

SEQ ID NO: 28243 - DNA, 21 bp, Homo sapiens
tgcttctgggtcggggtttcg

SEQ ID NO: 28244 - DNA, 25 bp, Homo sapiens
tgcttctgggtcggggtttcgtacg

SEQ ID NO: 28245 - DNA, 33 bp, Homo sapiens
gcttctgggtcggggtttcgtacgtagcagagc

SEQ ID NO: 28246 - DNA, 16 bp, Homo sapiens
cttctgggtcggggtt

SEQ ID NO: 28247 - DNA, 28 bp, Homo sapiens
cttctgggtcggggtttcgtacgtagca

SEQ ID NO: 28248 - DNA, 20 bp, Homo sapiens
ttctgggtcggggtttcgta

SEQ ID NO: 28249 - DNA, 24 bp, Homo sapiens
ttctgggtcggggtttcgtacgta

SEQ ID NO: 28250 - DNA, 27 bp, Homo sapiens
ttctgggtcggggtttcgtacgtagca

SEQ ID NO: 28251 - DNA, 35 bp, Homo sapiens
ttctgggtcggggtttcgtacgtagcagagcagct

SEQ ID NO: 28252 - DNA, 36 bp, Homo sapiens
ttctgggtcggggtttcgtacgtagcagagcagctc

SEQ ID NO: 28253 - DNA, 16 bp, Homo sapiens
tctgggtcggggtttc

SEQ ID NO: 28254 - DNA, 17 bp, Homo sapiens
tctgggtcggggtttcg

SEQ ID NO: 28255 - DNA, 18 bp, Homo sapiens
tctgggtcggggtttcgt

SEQ ID NO: 28256 - DNA, 19 bp, Homo sapiens
tctgggtcggggtttcgta

SEQ ID NO: 28257 - DNA, 20 bp, Homo sapiens
tctgggtcggggtttcgtac

SEQ ID NO: 28258 - DNA, 21 bp, Homo sapiens
tctgggtcggggtttcgtacg

SEQ ID NO: 28259 - DNA, 23 bp, Homo sapiens
tctgggtcggggtttcgtacgta

SEQ ID NO: 28260 - DNA, 26 bp, Homo sapiens
tctgggtcggggtttcgtacgtagca

SEQ ID NO: 28261 - DNA, 28 bp, Homo sapiens
tctgggtcggggtttcgtacgtagcaga

SEQ ID NO: 28262 - DNA, 30 bp, Homo sapiens; identical to SEQ ID NO: 6461

SEQ ID NO: 28263 - DNA, 31 bp, Homo sapiens
tctgggtcggggtttcgtacgtagcagagca

SEQ ID NO: 28264 - DNA, 34 bp, Homo sapiens
tctgggtcggggtttcgtacgtagcagagcagct

SEQ ID NO: 28265 - DNA, 35 bp, Homo sapiens
tctgggtcggggtttcgtacgtagcagagcagctc

SEQ ID NO: 28266 - DNA, 36 bp, Homo sapiens
tctgggtcggggtttcgtacgtagcagagcagctcc

SEQ ID NO: 28267 - DNA, 37 bp, Homo sapiens
tctgggtcggggtttcgtacgtagcagagcagctccc

SEQ ID NO: 28268 - DNA, 16 bp, Homo sapiens
ctgggtcggggtttcg

SEQ ID NO: 28269 - DNA, 17 bp, Homo sapiens
ctgggtcggggtttcgt

SEQ ID NO: 28270 - DNA, 18 bp, Homo sapiens
ctgggtcggggtttcgta

SEQ ID NO: 28271 - DNA, 22 bp, Homo sapiens
ctgggtcggggtttcgtacgta

SEQ ID NO: 28272 - DNA, 25 bp, Homo sapiens
ctgggtcggggtttcgtacgtagca

SEQ ID NO: 28273 - DNA, 27 bp, Homo sapiens
ctgggtcggggtttcgtacgtagcaga

SEQ ID NO: 28274 - DNA, 29 bp, Homo sapiens
ctgggtcggggtttcgtacgtagcagagc

SEQ ID NO: 28275 - DNA, 30 bp, Homo sapiens
ctgggtcggggtttcgtacgtagcagagca

SEQ ID NO: 28276 - DNA, 33 bp, Homo sapiens; identical to SEQ ID NO: 6462

SEQ ID NO: 28277 - DNA, 16 bp, Homo sapiens
tgggtcggggtttcgt

SEQ ID NO: 28278 - DNA, 17 bp, Homo sapiens
tgggtcggggtttcgta

SEQ ID NO: 28279 - DNA, 21 bp, Homo sapiens
tgggtcggggtttcgtacgta

SEQ ID NO: 28280 - DNA, 23 bp, Homo sapiens
tgggtcggggtttcgtacgtagc

SEQ ID NO: 28281 - DNA, 24 bp, Homo sapiens
tgggtcggggtttcgtacgtagca

SEQ ID NO: 28282 - DNA, 26 bp, Homo sapiens
tgggtcggggtttcgtacgtagcaga

SEQ ID NO: 28283 - DNA, 27 bp, Homo sapiens
tgggtcggggtttcgtacgtagcagag

SEQ ID NO: 28284 - DNA, 28 bp, Homo sapiens
tgggtcggggtttcgtacgtagcagagc

SEQ ID NO: 28285 - DNA, 29 bp, Homo sapiens
tgggtcggggtttcgtacgtagcagagca

SEQ ID NO: 28286 - DNA, 32 bp, Homo sapiens
tgggtcggggtttcgtacgtagcagagcagct

SEQ ID NO: 28287 - DNA, 33 bp, Homo sapiens; identical to SEQ ID NO: 6466

SEQ ID NO: 28288 - DNA, 27 bp, Homo sapiens
gggtcggggtttcgtacgtagcagagc

SEQ ID NO: 28289 - DNA, 28 bp, Homo sapiens
gggtcggggtttcgtacgtagcagagca

SEQ ID NO: 28290 - DNA, 31 bp, Homo sapiens
gggtcggggtttcgtacgtagcagagcagct

SEQ ID NO: 28291 - DNA, 32 bp, Homo sapiens
gggtcggggtttcgtacgtagcagagcagctc

SEQ ID NO: 28292 - DNA, 33 bp, Homo sapiens
gggtcggggtttcgtacgtagcagagcagctcc

SEQ ID NO: 28293 - DNA, 22 bp, Homo sapiens
ggtcggggtttcgtacgtagca

SEQ ID NO: 28294 - DNA, 24 bp, Homo sapiens
ggtcggggtttcgtacgtagcaga

SEQ ID NO: 28295 - DNA, 27 bp, Homo sapiens
ggtcggggtttcgtacgtagcagagca

SEQ ID NO: 28296 - DNA, 31 bp, Homo sapiens
ggtcggggtttcgtacgtagcagagcagctc

SEQ ID NO: 28297 - DNA, 32 bp, Homo sapiens
ggtcggggtttcgtacgtagcagagcagctcc

SEQ ID NO: 28298 - DNA, 33 bp, Homo sapiens
ggtcggggtttcgtacgtagcagagcagctccc

SEQ ID NO: 28299 - DNA, 21 bp, Homo sapiens
gtcggggtttcgtacgtagca

SEQ ID NO: 28300 - DNA, 23 bp, Homo sapiens
gtcggggtttcgtacgtagcaga

SEQ ID NO: 28301 - DNA, 26 bp, Homo sapiens
gtcggggtttcgtacgtagcagagca

SEQ ID NO: 28302 - DNA, 33 bp, Homo sapiens
gtcggggtttcgtacgtagcagagcagctccct

SEQ ID NO: 28303 - DNA, 20 bp, Homo sapiens
tcggggtttcgtacgtagca

SEQ ID NO: 28304 - DNA, 22 bp, Homo sapiens
tcggggtttcgtacgtagcaga

SEQ ID NO: 28305 - DNA, 25 bp, Homo sapiens
tcggggtttcgtacgtagcagagca

SEQ ID NO: 28306 - DNA, 29 bp, Homo sapiens
tcggggtttcgtacgtagcagagcagctc

SEQ ID NO: 28307 - DNA, 18 bp, Homo sapiens
cggggtttcgtacgtagc

SEQ ID NO: 28308 - DNA, 19 bp, Homo sapiens
cggggtttcgtacgtagca

SEQ ID NO: 28309 - DNA, 21 bp, Homo sapiens
cggggtttcgtacgtagcaga

SEQ ID NO: 28310 - DNA, 24 bp, Homo sapiens
cggggtttcgtacgtagcagagca

SEQ ID NO: 28311 - DNA, 27 bp, Homo sapiens
cggggtttcgtacgtagcagagcagct

SEQ ID NO: 28312 - DNA, 28 bp, Homo sapiens
cggggtttcgtacgtagcagagcagctc

SEQ ID NO: 28313 - DNA, 31 bp, Homo sapiens
cggggtttcgtacgtagcagagcagctccct

SEQ ID NO: 28314 - DNA, 22 bp, Homo sapiens
gggtttcgtacgtagcagagca

SEQ ID NO: 28315 - DNA, 26 bp, Homo sapiens
gggtttcgtacgtagcagagcagctc

SEQ ID NO: 28316 - DNA, 16 bp, Homo sapiens
ggtttcgtacgtagca

SEQ ID NO: 28317 - DNA, 18 bp, Homo sapiens
ggtttcgtacgtagcaga

SEQ ID NO: 28318 - DNA, 21 bp, Homo sapiens
ggtttcgtacgtagcagagca

SEQ ID NO: 28319 - DNA, 17 bp, Homo sapiens
gtttcgtacgtagcaga

SEQ ID NO: 28320 - DNA, 20 bp, Homo sapiens
gtttcgtacgtagcagagca

SEQ ID NO: 28321 - DNA, 16 bp, Homo sapiens
tttcgtacgtagcaga

SEQ ID NO: 28322 - DNA, 19 bp, Homo sapiens
tttcgtacgtagcagagca

SEQ ID NO: 28323 - DNA, 24 bp, Homo sapiens
tttcgtacgtagcagagcagctcc

SEQ ID NO: 28324 - DNA, 26 bp, Homo sapiens
tttcgtacgtagcagagcagctccct

SEQ ID NO: 28325 - DNA, 27 bp, Homo sapiens
tttcgtacgtagcagagcagctccctc

SEQ ID NO: 28326 - DNA, 25 bp, Homo sapiens
ttcgtacgtagcagagcagctccct

SEQ ID NO: 28327 - DNA, 16 bp, Homo sapiens
tcgtacgtagcagagc

SEQ ID NO: 28328 - DNA, 20 bp, Homo sapiens
tcgtacgtagcagagcagct

SEQ ID NO: 28329 - DNA, 21 bp, Homo sapiens
tcgtacgtagcagagcagctc

SEQ ID NO: 28330 - DNA, 22 bp, Homo sapiens
tcgtacgtagcagagcagctcc

SEQ ID NO: 28331 - DNA, 23 bp, Homo sapiens
tcgtacgtagcagagcagctccc

SEQ ID NO: 28332 - DNA, 24 bp, Homo sapiens
tcgtacgtagcagagcagctccct

SEQ ID NO: 28333 - DNA, 25 bp, Homo sapiens
tcgtacgtagcagagcagctccctc

SEQ ID NO: 28334 - DNA, 16 bp, Homo sapiens
cgtacgtagcagagca

SEQ ID NO: 28335 - DNA, 18 bp, Homo sapiens
cgtacgtagcagagcagc

SEQ ID NO: 28336 - DNA, 19 bp, Homo sapiens
cgtacgtagcagagcagct

SEQ ID NO: 28337 - DNA, 20 bp, Homo sapiens
cgtacgtagcagagcagctc

SEQ ID NO: 28338 - DNA, 21 bp, Homo sapiens
cgtacgtagcagagcagctcc

SEQ ID NO: 28339 - DNA, 22 bp, Homo sapiens
cgtacgtagcagagcagctccc

SEQ ID NO: 28340 - DNA, 23 bp, Homo sapiens
cgtacgtagcagagcagctccct

SEQ ID NO: 28341 - DNA, 24 bp, Homo sapiens
cgtacgtagcagagcagctccctc

SEQ ID NO: 28342 - DNA, 17 bp, Homo sapiens
gtacgtagcagagcagc

SEQ ID NO: 28343 - DNA, 18 bp, Homo sapiens
gtacgtagcagagcagct

SEQ ID NO: 28344 - DNA, 19 bp, Homo sapiens
gtacgtagcagagcagctc

SEQ ID NO: 28345 - DNA, 20 bp, Homo sapiens
gtacgtagcagagcagctcc

SEQ ID NO: 28346 - DNA, 21 bp, Homo sapiens
gtacgtagcagagcagctccc

SEQ ID NO: 28347 - DNA, 22 bp, Homo sapiens
gtacgtagcagagcagctccct

SEQ ID NO: 28348 - DNA, 23 bp, Homo sapiens
gtacgtagcagagcagctccctc

SEQ ID NO: 28349 - DNA, 27 bp, Homo sapiens
gtacgtagcagagcagctccctcgctg

SEQ ID NO: 28350 - DNA, 16 bp, Homo sapiens
tacgtagcagagcagc

SEQ ID NO: 28351 - DNA, 17 bp, Homo sapiens
tacgtagcagagcagct

SEQ ID NO: 28352 - DNA, 18 bp, Homo sapiens
tacgtagcagagcagctc

SEQ ID NO: 28353 - DNA, 19 bp, Homo sapiens
tacgtagcagagcagctcc

SEQ ID NO: 28354 - DNA, 20 bp, Homo sapiens
tacgtagcagagcagctccc

SEQ ID NO: 28355 - DNA, 21 bp, Homo sapiens
tacgtagcagagcagctccct

SEQ ID NO: 28356 - DNA, 22 bp, Homo sapiens
tacgtagcagagcagctccctc

SEQ ID NO: 28357 - DNA, 26 bp, Homo sapiens
tacgtagcagagcagctccctcgctg

SEQ ID NO: 28358 - DNA, 16 bp, Homo sapiens
acgtagcagagcagct

SEQ ID NO: 28359 - DNA, 17 bp, Homo sapiens
acgtagcagagcagctc

SEQ ID NO: 28360 - DNA, 20 bp, Homo sapiens
acgtagcagagcagctccct

SEQ ID NO: 28361 - DNA, 16 bp, Homo sapiens
cgtagcagagcagctc

SEQ ID NO: 28362 - DNA, 19 bp, Homo sapiens
cgtagcagagcagctccct

SEQ ID NO: 28363 - DNA, 24 bp, Homo sapiens
cgtagcagagcagctccctcgctg

SEQ ID NO: 28364 - DNA, 18 bp, Homo sapiens
gtagcagagcagctccct

SEQ ID NO: 28365 - DNA, 28 bp, Homo sapiens
gtagcagagcagctccctcgctgcgatc

SEQ ID NO: 28366 - DNA, 29 bp, Homo sapiens
gtagcagagcagctccctcgctgcgatct

SEQ ID NO: 28367 - DNA, 17 bp, Homo sapiens
tagcagagcagctccct

SEQ ID NO: 28368 - DNA, 25 bp, Homo sapiens
gcagagcagctccctcgctgcgatc

SEQ ID NO: 28369 - DNA, 26 bp, Homo sapiens
gcagagcagctccctcgctgcgatct

SEQ ID NO: 28370 - DNA, 18 bp, Homo sapiens
agagcagctccctcgctg

SEQ ID NO: 28371 - DNA, 16 bp, Homo sapiens
agcagctccctcgctg

SEQ ID NO: 28372 - DNA, 21 bp, Homo sapiens
gcagctccctcgctgcgatct

SEQ ID NO: 28373 - DNA, 26 bp, Homo sapiens
gcagctccctcgctgcgatctattga

SEQ ID NO: 28374 - DNA, 29 bp, Homo sapiens
gcagctccctcgctgcgatctattgaaag

SEQ ID NO: 28375 - DNA, 20 bp, Homo sapiens
cagctccctcgctgcgatct

SEQ ID NO: 28376 - DNA, 29 bp, Homo sapiens
cagctccctcgctgcgatctattgaaagt

SEQ ID NO: 28377 - DNA, 19 bp, Homo sapiens
agctccctcgctgcgatct

SEQ ID NO: 28378 - DNA, 27 bp, Homo sapiens
agctccctcgctgcgatctattgaaag

SEQ ID NO: 28379 - DNA, 29 bp, Homo sapiens
agctccctcgctgcgatctattgaaagtc

SEQ ID NO: 28380 - DNA, 16 bp, Homo sapiens
gctccctcgctgcgat

SEQ ID NO: 28381 - DNA, 17 bp, Homo sapiens
gctccctcgctgcgatc

SEQ ID NO: 28382 - DNA, 18 bp, Homo sapiens
gctccctcgctgcgatct

SEQ ID NO: 28383 - DNA, 19 bp, Homo sapiens
gctccctcgctgcgatcta

SEQ ID NO: 28384 - DNA, 22 bp, Homo sapiens
gctccctcgctgcgatctattg

SEQ ID NO: 28385 - DNA, 23 bp, Homo sapiens
gctccctcgctgcgatctattga

SEQ ID NO: 28386 - DNA, 24 bp, Homo sapiens
gctccctcgctgcgatctattgaa

SEQ ID NO: 28387 - DNA, 25 bp, Homo sapiens
gctccctcgctgcgatctattgaaa

SEQ ID NO: 28388 - DNA, 26 bp, Homo sapiens
gctccctcgctgcgatctattgaaag

SEQ ID NO: 28389 - DNA, 27 bp, Homo sapiens
gctccctcgctgcgatctattgaaagt

SEQ ID NO: 28390 - DNA, 28 bp, Homo sapiens
gctccctcgctgcgatctattgaaagtc

SEQ ID NO: 28391 - DNA, 29 bp, Homo sapiens
gctccctcgctgcgatctattgaaagtca

SEQ ID NO: 28392 - DNA, 16 bp, Homo sapiens
ctccctcgctgcgatc

SEQ ID NO: 28393 - DNA, 17 bp, Homo sapiens
ctccctcgctgcgatct

SEQ ID NO: 28394 - DNA, 25 bp, Homo sapiens
ctccctcgctgcgatctattgaaag

SEQ ID NO: 28395 - DNA, 26 bp, Homo sapiens
ctccctcgctgcgatctattgaaagt

SEQ ID NO: 28396 - DNA, 27 bp, Homo sapiens
ctccctcgctgcgatctattgaaagtc

SEQ ID NO: 28397 - DNA, 16 bp, Homo sapiens
tccctcgctgcgatct

SEQ ID NO: 28398 - DNA, 24 bp, Homo sapiens
tccctcgctgcgatctattgaaag

SEQ ID NO: 28399 - DNA, 25 bp, Homo sapiens
tccctcgctgcgatctattgaaagt

SEQ ID NO: 28400 - DNA, 26 bp, Homo sapiens
tccctcgctgcgatctattgaaagtc

SEQ ID NO: 28401 - DNA, 25 bp, Homo sapiens
ccctcgctgcgatctattgaaagtc

SEQ ID NO: 28402 - DNA, 23 bp, Homo sapiens
cctcgctgcgatctattgaaagt

SEQ ID NO: 28403 - DNA, 24 bp, Homo sapiens
cctcgctgcgatctattgaaagtc

SEQ ID NO: 28404 - DNA, 46 bp, Homo sapiens
cctcgctgcgatctattgaaagtcagccctcgacacaagggtttgt

SEQ ID NO: 28405 - DNA, 21 bp, Homo sapiens
ctcgctgcgatctattgaaag

SEQ ID NO: 28406 - DNA, 22 bp, Homo sapiens
ctcgctgcgatctattgaaagt

SEQ ID NO: 28407 - DNA, 23 bp, Homo sapiens
ctcgctgcgatctattgaaagtc

SEQ ID NO: 28408 - DNA, 33 bp, Homo sapiens
ctcgctgcgatctattgaaagtcagccctcgac

SEQ ID NO: 28409 - DNA, 36 bp, Homo sapiens
ctcgctgcgatctattgaaagtcagccctcgacaca

SEQ ID NO: 28410 - DNA, 41 bp, Homo sapiens
ctcgctgcgatctattgaaagtcagccctcgacacaagggt

SEQ ID NO: 28411 - DNA, 42 bp, Homo sapiens
ctcgctgcgatctattgaaagtcagccctcgacacaagggtt

SEQ ID NO: 28412 - DNA, 44 bp, Homo sapiens
ctcgctgcgatctattgaaagtcagccctcgacacaagggtttg

SEQ ID NO: 28413 - DNA, 45 bp, Homo sapiens
ctcgctgcgatctattgaaagtcagccctcgacacaagggtttgt

SEQ ID NO: 28414 - DNA, 46 bp, Homo sapiens
ctcgctgcgatctattgaaagtcagccctcgacacaagggtttgtc

SEQ ID NO: 28415 - DNA, 16 bp, Homo sapiens
tcgctgcgatctattg

SEQ ID NO: 28416 - DNA, 17 bp, Homo sapiens
tcgctgcgatctattga

SEQ ID NO: 28417 - DNA, 18 bp, Homo sapiens
tcgctgcgatctattgaa

SEQ ID NO: 28418 - DNA, 19 bp, Homo sapiens
tcgctgcgatctattgaaa

SEQ ID NO: 28419 - DNA, 20 bp, Homo sapiens
tcgctgcgatctattgaaag

SEQ ID NO: 28420 - DNA, 21 bp, Homo sapiens
tcgctgcgatctattgaaagt

SEQ ID NO: 28421 - DNA, 22 bp, Homo sapiens
tcgctgcgatctattgaaagtc

SEQ ID NO: 28422 - DNA, 32 bp, Homo sapiens; identical to SEQ ID NO: 6495

SEQ ID NO: 28423 - DNA, 33 bp, Homo sapiens
tcgctgcgatctattgaaagtcagccctcgaca

SEQ ID NO: 28424 - DNA, 43 bp, Homo sapiens
tcgctgcgatctattgaaagtcagccctcgacacaagggtttg

SEQ ID NO: 28425 - DNA, 44 bp, Homo sapiens
tcgctgcgatctattgaaagtcagccctcgacacaagggtttgt

SEQ ID NO: 28426 - DNA, 16 bp, Homo sapiens
cgctgcgatctattga

SEQ ID NO: 28427 - DNA, 17 bp, Homo sapiens
cgctgcgatctattgaa

SEQ ID NO: 28428 - DNA, 18 bp, Homo sapiens
cgctgcgatctattgaaa

SEQ ID NO: 28429 - DNA, 19 bp, Homo sapiens
cgctgcgatctattgaaag

SEQ ID NO: 28430 - DNA, 20 bp, Homo sapiens
cgctgcgatctattgaaagt

SEQ ID NO: 28431 - DNA, 21 bp, Homo sapiens
cgctgcgatctattgaaagtc

SEQ ID NO: 28432 - DNA, 23 bp, Homo sapiens
cgctgcgatctattgaaagtcag

SEQ ID NO: 28433 - DNA, 31 bp, Homo sapiens; identical to SEQ ID NO: 6500

SEQ ID NO: 28434 - DNA, 32 bp, Homo sapiens
cgctgcgatctattgaaagtcagccctcgaca

SEQ ID NO: 28435 - DNA, 33 bp, Homo sapiens
cgctgcgatctattgaaagtcagccctcgacac

SEQ ID NO: 28436 - DNA, 42 bp, Homo sapiens
cgctgcgatctattgaaagtcagccctcgacacaagggtttg

SEQ ID NO: 28437 - DNA, 43 bp, Homo sapiens
cgctgcgatctattgaaagtcagccctcgacacaagggtttgt

SEQ ID NO: 28438 - DNA, 18 bp, Homo sapiens
gctgcgatctattgaaag

SEQ ID NO: 28439 - DNA, 19 bp, Homo sapiens
gctgcgatctattgaaagt

SEQ ID NO: 28440 - DNA, 20 bp, Homo sapiens
gctgcgatctattgaaagtc

SEQ ID NO: 28441 - DNA, 22 bp, Homo sapiens
gctgcgatctattgaaagtcag

SEQ ID NO: 28442 - DNA, 32 bp, Homo sapiens
gctgcgatctattgaaagtcagccctcgacac

SEQ ID NO: 28443 - DNA, 41 bp, Homo sapiens
gctgcgatctattgaaagtcagccctcgacacaagggtttg

SEQ ID NO: 28444 - DNA, 42 bp, Homo sapiens
gctgcgatctattgaaagtcagccctcgacacaagggtttgt

SEQ ID NO: 28445 - DNA, 17 bp, Homo sapiens
ctgcgatctattgaaag

SEQ ID NO: 28446 - DNA, 18 bp, Homo sapiens
ctgcgatctattgaaagt

SEQ ID NO: 28447 - DNA, 19 bp, Homo sapiens
ctgcgatctattgaaagtc

SEQ ID NO: 28448 - DNA, 29 bp, Homo sapiens
ctgcgatctattgaaagtcagccctcgac

SEQ ID NO: 28449 - DNA, 18 bp, Homo sapiens
tgcgatctattgaaagtc

SEQ ID NO: 28450 - DNA, 18 bp, Homo sapiens
atctattgaaagtcagcc

SEQ ID NO: 28451 - DNA, 19 bp, Homo sapiens
atctattgaaagtcagccc

SEQ ID NO: 28452 - DNA, 24 bp, Homo sapiens
atctattgaaagtcagccctcgac

SEQ ID NO: 28453 - DNA, 36 bp, Homo sapiens
atctattgaaagtcagccctcgacacaagggtttgt

SEQ ID NO: 28454 - DNA, 17 bp, Homo sapiens
tctattgaaagtcagcc

SEQ ID NO: 28455 - DNA, 18 bp, Homo sapiens
tctattgaaagtcagccc

SEQ ID NO: 28456 - DNA, 22 bp, Homo sapiens
tctattgaaagtcagccctcga

SEQ ID NO: 28457 - DNA, 24 bp, Homo sapiens
tctattgaaagtcagccctcgaca

SEQ ID NO: 28458 - DNA, 26 bp, Homo sapiens
tctattgaaagtcagccctcgacaca

SEQ ID NO: 28459 - DNA, 27 bp, Homo sapiens
tctattgaaagtcagccctcgacacaa

SEQ ID NO: 28460 - DNA, 16 bp, Homo sapiens
ctattgaaagtcagcc

SEQ ID NO: 28461 - DNA, 17 bp, Homo sapiens
ctattgaaagtcagccc

SEQ ID NO: 28462 - DNA, 18 bp, Homo sapiens
ctattgaaagtcagccct

SEQ ID NO: 28463 - DNA, 22 bp, Homo sapiens
ctattgaaagtcagccctcgac

SEQ ID NO: 28464 - DNA, 33 bp, Homo sapiens
ctattgaaagtcagccctcgacacaagggtttg

SEQ ID NO: 28465 - DNA, 16 bp, Homo sapiens
tattgaaagtcagccc

SEQ ID NO: 28466 - DNA, 17 bp, Homo sapiens
tattgaaagtcagccct

SEQ ID NO: 28467 - DNA, 20 bp, Homo sapiens
tattgaaagtcagccctcga

SEQ ID NO: 28468 - DNA, 21 bp, Homo sapiens
tattgaaagtcagccctcgac

SEQ ID NO: 28469 - DNA, 24 bp, Homo sapiens
tattgaaagtcagccctcgacaca

SEQ ID NO: 28470 - DNA, 27 bp, Homo sapiens
tattgaaagtcagccctcgacacaagg

SEQ ID NO: 28471 - DNA, 30 bp, Homo sapiens
tattgaaagtcagccctcgacacaagggtt

SEQ ID NO: 28472 - DNA, 31 bp, Homo sapiens
tattgaaagtcagccctcgacacaagggttt

SEQ ID NO: 28473 - DNA, 32 bp, Homo sapiens; identical to SEQ ID NO: 6507

SEQ ID NO: 28474 - DNA, 33 bp, Homo sapiens; identical to SEQ ID NO: 6508

SEQ ID NO: 28475 - DNA, 16 bp, Homo sapiens
attgaaagtcagccct

SEQ ID NO: 28476 - DNA, 17 bp, Homo sapiens
attgaaagtcagccctc

SEQ ID NO: 28477 - DNA, 18 bp, Homo sapiens
attgaaagtcagccctcg

SEQ ID NO: 28478 - DNA, 20 bp, Homo sapiens
attgaaagtcagccctcgac

SEQ ID NO: 28479 - DNA, 23 bp, Homo sapiens
attgaaagtcagccctcgacaca

SEQ ID NO: 28480 - DNA, 29 bp, Homo sapiens
attgaaagtcagccctcgacacaagggtt

SEQ ID NO: 28481 - DNA, 31 bp, Homo sapiens; identical to SEQ ID NO: 6510

SEQ ID NO: 28482 - DNA, 32 bp, Homo sapiens; identical to SEQ ID NO: 6511

SEQ ID NO: 28483 - DNA, 33 bp, Homo sapiens
attgaaagtcagccctcgacacaagggtttgtc

SEQ ID NO: 28484 - DNA, 18 bp, Homo sapiens
ttgaaagtcagccctcga

SEQ ID NO: 28485 - DNA, 30 bp, Homo sapiens; identical to SEQ ID NO: 6512

SEQ ID NO: 28486 - DNA, 31 bp, Homo sapiens; identical to SEQ ID NO: 6513

SEQ ID NO: 28487 - DNA, 29 bp, Homo sapiens
tgaaagtcagccctcgacacaagggtttg

SEQ ID NO: 28488 - DNA, 30 bp, Homo sapiens
tgaaagtcagccctcgacacaagggtttgt

SEQ ID NO: 28489 - DNA, 28 bp, Homo sapiens
gaaagtcagccctcgacacaagggtttg

SEQ ID NO: 28490 - DNA, 29 bp, Homo sapiens
gaaagtcagccctcgacacaagggtttgt

SEQ ID NO: 28491 - DNA, 27 bp, Homo sapiens
aaagtcagccctcgacacaagggtttg

SEQ ID NO: 28492 - DNA, 28 bp, Homo sapiens
aaagtcagccctcgacacaagggtttgt

SEQ ID NO: 28493 - DNA, 26 bp, Homo sapiens
aagtcagccctcgacacaagggtttg

SEQ ID NO: 28494 - DNA, 27 bp, Homo sapiens
aagtcagccctcgacacaagggtttgt

SEQ ID NO: 28495 - DNA, 26 bp, Homo sapiens
agtcagccctcgacacaagggtttgt

SEQ ID NO: 28496 - DNA, 25 bp, Homo sapiens
gtcagccctcgacacaagggtttgt

SEQ ID NO: 28497 - DNA, 24 bp, Homo sapiens
tcagccctcgacacaagggtttgt

SEQ ID NO: 28498 - DNA, 23 bp, Homo sapiens
cagccctcgacacaagggtttgt

SEQ ID NO: 28499 - DNA, 16 bp, Homo sapiens
agccctcgacacaagg

SEQ ID NO: 28500 - DNA, 22 bp, Homo sapiens
agccctcgacacaagggtttgt

SEQ ID NO: 28501 - DNA, 20 bp, Homo sapiens
ccctcgacacaagggtttgt

SEQ ID NO: 28502 - DNA, 18 bp, Homo sapiens
cctcgacacaagggtttg

SEQ ID NO: 28503 - DNA, 19 bp, Homo sapiens
cctcgacacaagggtttgt

SEQ ID NO: 28504 - DNA, 20 bp, Homo sapiens
cctcgacacaagggtttgtc

SEQ ID NO: 28505 - DNA, 17 bp, Homo sapiens
ctcgacacaagggtttg

SEQ ID NO: 28506 - DNA, 18 bp, Homo sapiens
ctcgacacaagggtttgt

SEQ ID NO: 28507 - DNA, 16 bp, Homo sapiens
tcgacacaagggtttg

SEQ ID NO: 28508 - DNA, 17 bp, Homo sapiens
tcgacacaagggtttgt

SEQ ID NO: 28509 - DNA, 16 bp, Homo sapiens
cgacacaagggtttgt

SEQ ID NO: 28510 - DNA, 18 bp, Homo sapiens
cgggcgtggtggtggggg

SEQ ID NO: 28511 - DNA, 19 bp, Homo sapiens
agagagagagagagaaaga

SEQ ID NO: 28512 - DNA, 19 bp, Homo sapiens
agagagagagagagaaaga

SEQ ID NO: 28513 - DNA, 19 bp, Homo sapiens
agagagagagagagaaaga

SEQ ID NO: 28514 - DNA, 16 bp, Homo sapiens
agcgagaccccgtctc

SEQ ID NO: 28515 - DNA, 17 bp, Homo sapiens
gctactcgggaggctga

SEQ ID NO: 28516 - DNA, 30 bp, Homo sapiens
agcgtctacggccataccaccctgaacgcg

SEQ ID NO: 28517 - DNA, 22 bp, Homo sapiens
gtctacggccataccaccctga

SEQ ID NO: 28518 - DNA, 24 bp, Homo sapiens
gtctacggccataccaccctgaac

SEQ ID NO: 28519 - DNA, 25 bp, Homo sapiens
gtctacggccataccaccctgaacg

SEQ ID NO: 28520 - DNA, 26 bp, Homo sapiens
gtctacggccataccaccctgaacgc

SEQ ID NO: 28521 - DNA, 28 bp, Homo sapiens
gtctacggccataccaccctgaacgcgc

SEQ ID NO: 28522 - DNA, 29 bp, Homo sapiens
gtctacggccataccaccctgaacgcgcc

SEQ ID NO: 28523 - DNA, 30 bp, Homo sapiens; identical to SEQ ID NO: 8

SEQ ID NO: 28524 - DNA, 30 bp, Homo sapiens; identical to SEQ ID NO: 6557

SEQ ID NO: 28525 - DNA, 29 bp, Homo sapiens
ctacggccataccaccctgaacgcgcccg

SEQ ID NO: 28526 - DNA, 28 bp, Homo sapiens
tacggccataccaccctgaacgcgcccg

SEQ ID NO: 28527 - DNA, 22 bp, Homo sapiens
acggccataccaccctgaacgc

SEQ ID NO: 28528 - DNA, 27 bp, Homo sapiens
acggccataccaccctgaacgcgcccg

SEQ ID NO: 28529 - DNA, 21 bp, Homo sapiens
cggccataccaccctgaacgc

SEQ ID NO: 28530 - DNA, 26 bp, Homo sapiens
cggccataccaccctgaacgcgcccg

SEQ ID NO: 28531 - DNA, 25 bp, Homo sapiens
ggccataccaccctgaacgcgcccg

SEQ ID NO: 28532 - DNA, 24 bp, Homo sapiens
gccataccaccctgaacgcgcccg

SEQ ID NO: 28533 - DNA, 18 bp, Homo sapiens
ccataccaccctgaacgc

SEQ ID NO: 28534 - DNA, 23 bp, Homo sapiens
ccataccaccctgaacgcgcccg

SEQ ID NO: 28535 - DNA, 17 bp, Homo sapiens
cataccaccctgaacgc

SEQ ID NO: 28536 - DNA, 22 bp, Homo sapiens
cataccaccctgaacgcgcccg

SEQ ID NO: 28537 - DNA, 21 bp, Homo sapiens
ataccaccctgaacgcgcccg

SEQ ID NO: 28538 - DNA, 20 bp, Homo sapiens
taccaccctgaacgcgcccg

SEQ ID NO: 28539 - DNA, 19 bp, Homo sapiens
accaccctgaacgcgcccg

SEQ ID NO: 28540 - DNA, 20 bp, Homo sapiens
accaccctgaacgcgcccga

SEQ ID NO: 28541 - DNA, 18 bp, Homo sapiens
ccaccctgaacgcgcccg

SEQ ID NO: 28542 - DNA, 19 bp, Homo sapiens
ccaccctgaacgcgcccga

SEQ ID NO: 28543 - DNA, 28 bp, Homo sapiens
ccaccctgaacgcgcccgatctcgtctg

SEQ ID NO: 28544 - DNA, 17 bp, Homo sapiens
caccctgaacgcgcccg

SEQ ID NO: 28545 - DNA, 18 bp, Homo sapiens
caccctgaacgcgcccga

SEQ ID NO: 28546 - DNA, 27 bp, Homo sapiens
caccctgaacgcgcccgatctcgtctg

SEQ ID NO: 28547 - DNA, 16 bp, Homo sapiens
accctgaacgcgcccg

SEQ ID NO: 28548 - DNA, 26 bp, Homo sapiens
accctgaacgcgcccgatctcgtctg

SEQ ID NO: 28549 - DNA, 16 bp, Homo sapiens
ccctgaacgcgcccga

SEQ ID NO: 28550 - DNA, 25 bp, Homo sapiens
ccctgaacgcgcccgatctcgtctg

SEQ ID NO: 28551 - DNA, 24 bp, Homo sapiens
cctgaacgcgcccgatctcgtctg

SEQ ID NO: 28552 - DNA, 23 bp, Homo sapiens
ctgaacgcgcccgatctcgtctg

SEQ ID NO: 28553 - DNA, 22 bp, Homo sapiens
tgaacgcgcccgatctcgtctg

SEQ ID NO: 28554 - DNA, 23 bp, Homo sapiens
tgaacgcgcccgatctcgtctga

SEQ ID NO: 28555 - DNA, 29 bp, Homo sapiens
tgaacgcgcccgatctcgtctgatctcgg

SEQ ID NO: 28556 - DNA, 21 bp, Homo sapiens
gaacgcgcccgatctcgtctg

SEQ ID NO: 28557 - DNA, 20 bp, Homo sapiens
aacgcgcccgatctcgtctg

SEQ ID NO: 28558 - DNA, 21 bp, Homo sapiens
aacgcgcccgatctcgtctga

SEQ ID NO: 28559 - DNA, 19 bp, Homo sapiens
acgcgcccgatctcgtctg

SEQ ID NO: 28560 - DNA, 20 bp, Homo sapiens
acgcgcccgatctcgtctga

SEQ ID NO: 28561 - DNA, 21 bp, Homo sapiens
acgcgcccgatctcgtctgat

SEQ ID NO: 28562 - DNA, 18 bp, Homo sapiens
cgcgcccgatctcgtctg

SEQ ID NO: 28563 - DNA, 17 bp, Homo sapiens
gcgcccgatctcgtctg

SEQ ID NO: 28564 - DNA, 19 bp, Homo sapiens
gcgcccgatctcgtctgat

SEQ ID NO: 28565 - DNA, 16 bp, Homo sapiens
cgcccgatctcgtctg

SEQ ID NO: 28566 - DNA, 22 bp, Homo sapiens
cgcccgatctcgtctgatctcg

SEQ ID NO: 28567 - DNA, 19 bp, Homo sapiens
cgatctcgtctgatctcgg

SEQ ID NO: 28568 - DNA, 20 bp, Homo sapiens
cgatctcgtctgatctcgga

SEQ ID NO: 28569 - DNA, 23 bp, Homo sapiens
cgatctcgtctgatctcggaagc

SEQ ID NO: 28570 - DNA, 18 bp, Homo sapiens
gatctcgtctgatctcgg

SEQ ID NO: 28571 - DNA, 19 bp, Homo sapiens
gatctcgtctgatctcgga

SEQ ID NO: 28572 - DNA, 18 bp, Homo sapiens
atctcgtctgatctcgga

SEQ ID NO: 28573 - DNA, 20 bp, Homo sapiens
atctcgtctgatctcggaag

SEQ ID NO: 28574 - DNA, 21 bp, Homo sapiens
atctcgtctgatctcggaagc

SEQ ID NO: 28575 - DNA, 22 bp, Homo sapiens
atctcgtctgatctcggaagct

SEQ ID NO: 28576 - DNA, 16 bp, Homo sapiens
tctcgtctgatctcgg

SEQ ID NO: 28577 - DNA, 17 bp, Homo sapiens
tctcgtctgatctcgga

SEQ ID NO: 28578 - DNA, 19 bp, Homo sapiens
tctcgtctgatctcggaag

SEQ ID NO: 28579 - DNA, 20 bp, Homo sapiens
tctcgtctgatctcggaagc

SEQ ID NO: 28580 - DNA, 24 bp, Homo sapiens
tctcgtctgatctcggaagctaag

SEQ ID NO: 28581 - DNA, 16 bp, Homo sapiens
ctcgtctgatctcgga

SEQ ID NO: 28582 - DNA, 18 bp, Homo sapiens
ctcgtctgatctcggaag

SEQ ID NO: 28583 - DNA, 19 bp, Homo sapiens
ctcgtctgatctcggaagc

SEQ ID NO: 28584 - DNA, 20 bp, Homo sapiens
ctcgtctgatctcggaagct

SEQ ID NO: 28585 - DNA, 23 bp, Homo sapiens
ctcgtctgatctcggaagctaag

SEQ ID NO: 28586 - DNA, 17 bp, Homo sapiens
tcgtctgatctcggaag

SEQ ID NO: 28587 - DNA, 18 bp, Homo sapiens
tcgtctgatctcggaagc

SEQ ID NO: 28588 - DNA, 19 bp, Homo sapiens
tcgtctgatctcggaagct

SEQ ID NO: 28589 - DNA, 22 bp, Homo sapiens
tcgtctgatctcggaagctaag

SEQ ID NO: 28590 - DNA, 23 bp, Homo sapiens
tcgtctgatctcggaagctaagc

SEQ ID NO: 28591 - DNA, 25 bp, Homo sapiens
tcgtctgatctcggaagctaagcag

SEQ ID NO: 28592 - DNA, 16 bp, Homo sapiens
cgtctgatctcggaag

SEQ ID NO: 28593 - DNA, 17 bp, Homo sapiens
cgtctgatctcggaagc

SEQ ID NO: 28594 - DNA, 18 bp, Homo sapiens
cgtctgatctcggaagct

SEQ ID NO: 28595 - DNA, 21 bp, Homo sapiens
cgtctgatctcggaagctaag

SEQ ID NO: 28596 - DNA, 22 bp, Homo sapiens
cgtctgatctcggaagctaagc

SEQ ID NO: 28597 - DNA, 23 bp, Homo sapiens
cgtctgatctcggaagctaagca

SEQ ID NO: 28598 - DNA, 24 bp, Homo sapiens
cgtctgatctcggaagctaagcag

SEQ ID NO: 28599 - DNA, 16 bp, Homo sapiens
gtctgatctcggaagc

SEQ ID NO: 28600 - DNA, 20 bp, Homo sapiens
gtctgatctcggaagctaag

SEQ ID NO: 28601 - DNA, 21 bp, Homo sapiens
gtctgatctcggaagctaagc

SEQ ID NO: 28602 - DNA, 22 bp, Homo sapiens
gtctgatctcggaagctaagca

SEQ ID NO: 28603 - DNA, 23 bp, Homo sapiens
gtctgatctcggaagctaagcag

SEQ ID NO: 28604 - DNA, 24 bp, Homo sapiens
gtctgatctcggaagctaagcagg

SEQ ID NO: 28605 - DNA, 19 bp, Homo sapiens
tctgatctcggaagctaag

SEQ ID NO: 28606 - DNA, 20 bp, Homo sapiens
tctgatctcggaagctaagc

SEQ ID NO: 28607 - DNA, 21 bp, Homo sapiens
tctgatctcggaagctaagca

SEQ ID NO: 28608 - DNA, 22 bp, Homo sapiens
tctgatctcggaagctaagcag

SEQ ID NO: 28609 - DNA, 23 bp, Homo sapiens
tctgatctcggaagctaagcagg

SEQ ID NO: 28610 - DNA, 24 bp, Homo sapiens
tctgatctcggaagctaagcaggg

SEQ ID NO: 28611 - DNA, 25 bp, Homo sapiens
tctgatctcggaagctaagcagggt

SEQ ID NO: 28612 - DNA, 18 bp, Homo sapiens
ctgatctcggaagctaag

SEQ ID NO: 28613 - DNA, 19 bp, Homo sapiens
ctgatctcggaagctaagc

SEQ ID NO: 28614 - DNA, 20 bp, Homo sapiens
ctgatctcggaagctaagca

SEQ ID NO: 28615 - DNA, 21 bp, Homo sapiens
ctgatctcggaagctaagcag

SEQ ID NO: 28616 - DNA, 22 bp, Homo sapiens
ctgatctcggaagctaagcagg

SEQ ID NO: 28617 - DNA, 23 bp, Homo sapiens
ctgatctcggaagctaagcaggg

SEQ ID NO: 28618 - DNA, 24 bp, Homo sapiens
ctgatctcggaagctaagcagggt

SEQ ID NO: 28619 - DNA, 25 bp, Homo sapiens
ctgatctcggaagctaagcagggtc

SEQ ID NO: 28620 - DNA, 17 bp, Homo sapiens
tgatctcggaagctaag

SEQ ID NO: 28621 - DNA, 20 bp, Homo sapiens
tgatctcggaagctaagcag

SEQ ID NO: 28622 - DNA, 21 bp, Homo sapiens
tgatctcggaagctaagcagg

SEQ ID NO: 28623 - DNA, 21 bp, Homo sapiens
ctcggaagctaagcagggtcg

SEQ ID NO: 28624 - DNA, 22 bp, Homo sapiens
ctcggaagctaagcagggtcgg

SEQ ID NO: 28625 - DNA, 20 bp, Homo sapiens
ctaagcagggtcgggcctgg

SEQ ID NO: 28626 - DNA, 24 bp, Homo sapiens
ctaagcagggtcgggcctggttag

SEQ ID NO: 28627 - DNA, 23 bp, Homo sapiens
taagcagggtcgggcctggttag

SEQ ID NO: 28628 - DNA, 24 bp, Homo sapiens
taagcagggtcgggcctggttagt

SEQ ID NO: 28629 - DNA, 22 bp, Homo sapiens
aagcagggtcgggcctggttag

SEQ ID NO: 28630 - DNA, 21 bp, Homo sapiens
agcagggtcgggcctggttag

SEQ ID NO: 28631 - DNA, 20 bp, Homo sapiens
gcagggtcgggcctggttag

SEQ ID NO: 28632 - DNA, 21 bp, Homo sapiens
gcctggttagtacttggatgg

SEQ ID NO: 28633 - DNA, 22 bp, Homo sapiens
ctggttagtacttggatgggag

SEQ ID NO: 28634 - DNA, 23 bp, Homo sapiens
ctggttagtacttggatgggaga

SEQ ID NO: 28635 - DNA, 24 bp, Homo sapiens
ctggttagtacttggatgggagac

SEQ ID NO: 28636 - DNA, 29 bp, Homo sapiens
gttagtacttggatgggagaccgcctggg

SEQ ID NO: 28637 - DNA, 29 bp, Homo sapiens
agtacttggatgggagaccgcctgggaat

SEQ ID NO: 28638 - DNA, 30 bp, Homo sapiens; identical to SEQ ID NO: 6980

SEQ ID NO: 28639 - DNA, 30 bp, Homo sapiens
ttggatgggagaccgcctgggaataccggg

SEQ ID NO: 28640 - DNA, 30 bp, Homo sapiens
tggatgggagaccgcctgggaataccgggt

SEQ ID NO: 28641 - DNA, 30 bp, Homo sapiens
ggatgggagaccgcctgggaataccgggtg

SEQ ID NO: 28642 - DNA, 24 bp, Homo sapiens
gcctgggaataccgggtgctgtag

SEQ ID NO: 28643 - DNA, 25 bp, Homo sapiens
gcctgggaataccgggtgctgtagg

SEQ ID NO: 28644 - DNA, 28 bp, Homo sapiens
gcctgggaataccgggtgctgtaggctt

SEQ ID NO: 28645 - DNA, 29 bp, Homo sapiens
gcctgggaataccgggtgctgtaggcttt

SEQ ID NO: 28646 - DNA, 23 bp, Homo sapiens
cctgggaataccgggtgctgtag

SEQ ID NO: 28647 - DNA, 24 bp, Homo sapiens
cctgggaataccgggtgctgtagg

SEQ ID NO: 28648 - DNA, 26 bp, Homo sapiens
cctgggaataccgggtgctgtaggct

SEQ ID NO: 28649 - DNA, 27 bp, Homo sapiens
cctgggaataccgggtgctgtaggctt

SEQ ID NO: 28650 - DNA, 28 bp, Homo sapiens
cctgggaataccgggtgctgtaggcttt

SEQ ID NO: 28651 - DNA, 22 bp, Homo sapiens
ctgggaataccgggtgctgtag

SEQ ID NO: 28652 - DNA, 23 bp, Homo sapiens
ctgggaataccgggtgctgtagg

SEQ ID NO: 28653 - DNA, 25 bp, Homo sapiens
ctgggaataccgggtgctgtaggct

SEQ ID NO: 28654 - DNA, 26 bp, Homo sapiens
ctgggaataccgggtgctgtaggctt

SEQ ID NO: 28655 - DNA, 27 bp, Homo sapiens
ctgggaataccgggtgctgtaggcttt

SEQ ID NO: 28656 - DNA, 21 bp, Homo sapiens
tgggaataccgggtgctgtag

SEQ ID NO: 28657 - DNA, 22 bp, Homo sapiens
tgggaataccgggtgctgtagg

SEQ ID NO: 28658 - DNA, 23 bp, Homo sapiens
tgggaataccgggtgctgtaggc

SEQ ID NO: 28659 - DNA, 24 bp, Homo sapiens
tgggaataccgggtgctgtaggct

SEQ ID NO: 28660 - DNA, 25 bp, Homo sapiens
tgggaataccgggtgctgtaggctt

SEQ ID NO: 28661 - DNA, 26 bp, Homo sapiens
tgggaataccgggtgctgtaggcttt

SEQ ID NO: 28662 - DNA, 20 bp, Homo sapiens
gggaataccgggtgctgtag

SEQ ID NO: 28663 - DNA, 21 bp, Homo sapiens
gggaataccgggtgctgtagg

SEQ ID NO: 28664 - DNA, 22 bp, Homo sapiens
gggaataccgggtgctgtaggc

SEQ ID NO: 28665 - DNA, 23 bp, Homo sapiens
gggaataccgggtgctgtaggct

SEQ ID NO: 28666 - DNA, 24 bp, Homo sapiens
gggaataccgggtgctgtaggctt

SEQ ID NO: 28667 - DNA, 25 bp, Homo sapiens
gggaataccgggtgctgtaggcttt

SEQ ID NO: 28668 - DNA, 19 bp, Homo sapiens
ggaataccgggtgctgtag

SEQ ID NO: 28669 - DNA, 20 bp, Homo sapiens
ggaataccgggtgctgtagg

SEQ ID NO: 28670 - DNA, 21 bp, Homo sapiens
ggaataccgggtgctgtaggc

SEQ ID NO: 28671 - DNA, 22 bp, Homo sapiens
ggaataccgggtgctgtaggct

SEQ ID NO: 28672 - DNA, 23 bp, Homo sapiens
ggaataccgggtgctgtaggctt

SEQ ID NO: 28673 - DNA, 24 bp, Homo sapiens
ggaataccgggtgctgtaggcttt

SEQ ID NO: 28674 - DNA, 25 bp, Homo sapiens
ggaataccgggtgctgtaggctttt

SEQ ID NO: 28675 - DNA, 18 bp, Homo sapiens
gaataccgggtgctgtag

SEQ ID NO: 28676 - DNA, 19 bp, Homo sapiens
gaataccgggtgctgtagg

SEQ ID NO: 28677 - DNA, 20 bp, Homo sapiens
gaataccgggtgctgtaggc

SEQ ID NO: 28678 - DNA, 21 bp, Homo sapiens
gaataccgggtgctgtaggct

SEQ ID NO: 28679 - DNA, 22 bp, Homo sapiens
gaataccgggtgctgtaggctt

SEQ ID NO: 28680 - DNA, 23 bp, Homo sapiens
gaataccgggtgctgtaggcttt

SEQ ID NO: 28681 - DNA, 18 bp, Homo sapiens
aataccgggtgctgtagg

SEQ ID NO: 28682 - DNA, 19 bp, Homo sapiens
aataccgggtgctgtaggc

SEQ ID NO: 28683 - DNA, 20 bp, Homo sapiens
aataccgggtgctgtaggct

SEQ ID NO: 28684 - DNA, 21 bp, Homo sapiens
aataccgggtgctgtaggctt

SEQ ID NO: 28685 - DNA, 22 bp, Homo sapiens
aataccgggtgctgtaggcttt

SEQ ID NO: 28686 - DNA, 17 bp, Homo sapiens
ataccgggtgctgtagg

SEQ ID NO: 28687 - DNA, 18 bp, Homo sapiens
ataccgggtgctgtaggc

SEQ ID NO: 28688 - DNA, 19 bp, Homo sapiens
ataccgggtgctgtaggct

SEQ ID NO: 28689 - DNA, 20 bp, Homo sapiens
ataccgggtgctgtaggctt

SEQ ID NO: 28690 - DNA, 21 bp, Homo sapiens
ataccgggtgctgtaggcttt

SEQ ID NO: 28691 - DNA, 22 bp, Homo sapiens
ataccgggtgctgtaggctttt

SEQ ID NO: 28692 - DNA, 23 bp, Homo sapiens
ataccgggtgctgtaggcttttt

SEQ ID NO: 28693 - DNA, 16 bp, Homo sapiens
taccgggtgctgtagg

SEQ ID NO: 28694 - DNA, 17 bp, Homo sapiens
taccgggtgctgtaggc

SEQ ID NO: 28695 - DNA, 18 bp, Homo sapiens
taccgggtgctgtaggct

SEQ ID NO: 28696 - DNA, 19 bp, Homo sapiens
taccgggtgctgtaggctt

SEQ ID NO: 28697 - DNA, 20 bp, Homo sapiens
taccgggtgctgtaggcttt

SEQ ID NO: 28698 - DNA, 21 bp, Homo sapiens
taccgggtgctgtaggctttt

SEQ ID NO: 28699 - DNA, 22 bp, Homo sapiens
taccgggtgctgtaggcttttt

SEQ ID NO: 28700 - DNA, 16 bp, Homo sapiens
accgggtgctgtaggc

SEQ ID NO: 28701 - DNA, 17 bp, Homo sapiens
accgggtgctgtaggct

SEQ ID NO: 28702 - DNA, 18 bp, Homo sapiens
accgggtgctgtaggctt

SEQ ID NO: 28703 - DNA, 19 bp, Homo sapiens
accgggtgctgtaggcttt

SEQ ID NO: 28704 - DNA, 20 bp, Homo sapiens
accgggtgctgtaggctttt

SEQ ID NO: 28705 - DNA, 21 bp, Homo sapiens
accgggtgctgtaggcttttt

SEQ ID NO: 28706 - DNA, 16 bp, Homo sapiens
ccgggtgctgtaggct

SEQ ID NO: 28707 - DNA, 17 bp, Homo sapiens
ccgggtgctgtaggctt

SEQ ID NO: 28708 - DNA, 18 bp, Homo sapiens
ccgggtgctgtaggcttt

SEQ ID NO: 28709 - DNA, 19 bp, Homo sapiens
ccgggtgctgtaggctttt

SEQ ID NO: 28710 - DNA, 20 bp, Homo sapiens
ccgggtgctgtaggcttttt

SEQ ID NO: 28711 - DNA, 16 bp, Homo sapiens
cgggtgctgtaggctt

SEQ ID NO: 28712 - DNA, 17 bp, Homo sapiens
cgggtgctgtaggcttt

SEQ ID NO: 28713 - DNA, 18 bp, Homo sapiens
cgggtgctgtaggctttt

SEQ ID NO: 28714 - DNA, 19 bp, Homo sapiens
cgggtgctgtaggcttttt

SEQ ID NO: 28715 - DNA, 16 bp, Homo sapiens
gggtgctgtaggcttt

SEQ ID NO: 28716 - DNA, 17 bp, Homo sapiens
gggtgctgtaggctttt

SEQ ID NO: 28717 - DNA, 18 bp, Homo sapiens
gggtgctgtaggcttttt

SEQ ID NO: 28718 - DNA, 17 bp, Homo sapiens
ggtgctgtaggcttttt

SEQ ID NO: 28719 - DNA, 30 bp, Homo sapiens; identical to SEQ ID NO: 213

SEQ ID NO: 28720 - DNA, 23 bp, Homo sapiens
ctcacctgagttgtaaaaaactc

SEQ ID NO: 28721 - DNA, 22 bp, Homo sapiens
ctgtaatcgataaaccccgatc

SEQ ID NO: 28722 - DNA, 23 bp, Homo sapiens
ctggaaagtgcacttggacgaac

SEQ ID NO: 28723 - DNA, 20 bp, Homo sapiens
gctaaacctagccccaaacc

SEQ ID NO: 28724 - DNA, 21 bp, Homo sapiens
gctaaacctagccccaaaccc

SEQ ID NO: 28725 - DNA, 22 bp, Homo sapiens
gctaaacctagccccaaaccca

SEQ ID NO: 28726 - DNA, 23 bp, Homo sapiens
gctaaacctagccccaaacccac

SEQ ID NO: 28727 - DNA, 24 bp, Homo sapiens
gctaaacctagccccaaacccact

SEQ ID NO: 28728 - DNA, 26 bp, Homo sapiens
gctaaacctagccccaaacccactcc

SEQ ID NO: 28729 - DNA, 29 bp, Homo sapiens
gctaaacctagccccaaacccactccacc

SEQ ID NO: 28730 - DNA, 30 bp, Homo sapiens; identical to SEQ ID NO: 832

SEQ ID NO: 28731 - DNA, 19 bp, Homo sapiens
ctgtcaacccaacacaggc

SEQ ID NO: 28732 - DNA, 20 bp, Homo sapiens
tttaaccagtgaaattgacc

SEQ ID NO: 28733 - DNA, 23 bp, Homo sapiens
ctgcattaaaaatttcggttggg

SEQ ID NO: 28734 - DNA, 21 bp, Homo sapiens
gcattaaaaatttcggttggg

SEQ ID NO: 28735 - DNA, 19 bp, Homo sapiens
attaaaaatttcggttggg

SEQ ID NO: 28736 - DNA, 17 bp, Homo sapiens
taaaaatttcggttggg

SEQ ID NO: 28737 - DNA, 16 bp, Homo sapiens
aaaaatttcggttggg

SEQ ID NO: 28738 - DNA, 17 bp, Homo sapiens
gatccaataacttgacc

SEQ ID NO: 28739 - DNA, 21 bp, Homo sapiens
gatccaataacttgaccaacg

SEQ ID NO: 28740 - DNA, 22 bp, Homo sapiens
gatccaataacttgaccaacgg

SEQ ID NO: 28741 - DNA, 23 bp, Homo sapiens
gatccaataacttgaccaacgga

SEQ ID NO: 28742 - DNA, 30 bp, Homo sapiens
caacaatagggtttacgacctcgatgttgg

SEQ ID NO: 28743 - DNA, 23 bp, Homo sapiens
gtttacgacctcgatgttggatc

SEQ ID NO: 28744 - DNA, 17 bp, Homo sapiens
tattaaaggttcgtttg

SEQ ID NO: 28745 - DNA, 18 bp, Homo sapiens
tattaaaggttcgtttgt

SEQ ID NO: 28746 - DNA, 21 bp, Homo sapiens
acccaagaacagggtttgtta

SEQ ID NO: 28747 - DNA, 16 bp, Homo sapiens
gtgggggagaggctgt

SEQ ID NO: 28748 - DNA, 18 bp, Homo sapiens
gtgggggagaggctgtcg

SEQ ID NO: 28749 - DNA, 21 bp, Homo sapiens
cttcgtgatcgatgtggtgac

SEQ ID NO: 28750 - DNA, 22 bp, Homo sapiens
cttcgtgatcgatgtggtgacg

SEQ ID NO: 28751 - DNA, 23 bp, Homo sapiens
cttcgtgatcgatgtggtgacgt

SEQ ID NO: 28752 - DNA, 24 bp, Homo sapiens
cttcgtgatcgatgtggtgacgtc

SEQ ID NO: 28753 - DNA, 25 bp, Homo sapiens
cttcgtgatcgatgtggtgacgtcg

SEQ ID NO: 28754 - DNA, 27 bp, Homo sapiens
cttcgtgatcgatgtggtgacgtcgtg

SEQ ID NO: 28755 - DNA, 28 bp, Homo sapiens
cttcgtgatcgatgtggtgacgtcgtgc

SEQ ID NO: 28756 - DNA, 30 bp, Homo sapiens; identical to SEQ ID NO: 1878

SEQ ID NO: 28757 - DNA, 20 bp, Homo sapiens
ttcgtgatcgatgtggtgac

SEQ ID NO: 28758 - DNA, 21 bp, Homo sapiens
ttcgtgatcgatgtggtgacg

SEQ ID NO: 28759 - DNA, 22 bp, Homo sapiens
ttcgtgatcgatgtggtgacgt

SEQ ID NO: 28760 - DNA, 23 bp, Homo sapiens
ttcgtgatcgatgtggtgacgtc

SEQ ID NO: 28761 - DNA, 26 bp, Homo sapiens
ttcgtgatcgatgtggtgacgtcgtg

SEQ ID NO: 28762 - DNA, 27 bp, Homo sapiens
ttcgtgatcgatgtggtgacgtcgtgc

SEQ ID NO: 28763 - DNA, 30 bp, Homo sapiens; identical to SEQ ID NO: 1888

SEQ ID NO: 28764 - DNA, 30 bp, Homo sapiens; identical to SEQ ID NO: 1894

SEQ ID NO: 28765 - DNA, 30 bp, Homo sapiens; identical to SEQ ID NO: 1904

SEQ ID NO: 28766 - DNA, 20 bp, Homo sapiens
gacctcgccgtcccgcccgc

SEQ ID NO: 28767 - DNA, 21 bp, Homo sapiens
gacctcgccgtcccgcccgcc

SEQ ID NO: 28768 - DNA, 21 bp, Homo sapiens
gcgcacgcgcgcaccggccgg

SEQ ID NO: 28769 - DNA, 20 bp, Homo sapiens
gtcgcggtcccccgtcccgg

SEQ ID NO: 28770 - DNA, 24 bp, Homo sapiens
gccgggccccgggccctcgaccgg

SEQ ID NO: 28771 - DNA, 21 bp, Homo sapiens
gggccccgggccctcgaccgg

SEQ ID NO: 28772 - DNA, 22 bp, Homo sapiens
gggccccgggccctcgaccgga

SEQ ID NO: 28773 - DNA, 23 bp, Homo sapiens
gggccccgggccctcgaccggac

SEQ ID NO: 28774 - DNA, 24 bp, Homo sapiens
gggccccgggccctcgaccggacc

SEQ ID NO: 28775 - DNA, 23 bp, Homo sapiens
cctacctggttgatcctgccagt

SEQ ID NO: 28776 - DNA, 22 bp, Homo sapiens
ctacctggttgatcctgccagt

SEQ ID NO: 28777 - DNA, 16 bp, Homo sapiens
tacctggttgatcctg

SEQ ID NO: 28778 - DNA, 17 bp, Homo sapiens
tacctggttgatcctgc

SEQ ID NO: 28779 - DNA, 18 bp, Homo sapiens
tacctggttgatcctgcc

SEQ ID NO: 28780 - DNA, 19 bp, Homo sapiens
tacctggttgatcctgcca

SEQ ID NO: 28781 - DNA, 20 bp, Homo sapiens
tacctggttgatcctgccag

SEQ ID NO: 28782 - DNA, 21 bp, Homo sapiens
tacctggttgatcctgccagt

SEQ ID NO: 28783 - DNA, 22 bp, Homo sapiens
tacctggttgatcctgccagta

SEQ ID NO: 28784 - DNA, 24 bp, Homo sapiens
tacctggttgatcctgccagtagc

SEQ ID NO: 28785 - DNA, 30 bp, Homo sapiens; identical to SEQ ID NO: 12067

SEQ ID NO: 28786 - DNA, 19 bp, Homo sapiens
cctggttgatcctgccagt

SEQ ID NO: 28787 - DNA, 16 bp, Homo sapiens
ttgatcctgccagtag

SEQ ID NO: 28788 - DNA, 22 bp, Homo sapiens
gcatatgcttgtctcaaagatt

SEQ ID NO: 28789 - DNA, 20 bp, Homo sapiens
agttatggttcctttggtcg

SEQ ID NO: 28790 - DNA, 24 bp, Homo sapiens
agttatggttcctttggtcgctcg

SEQ ID NO: 28791 - DNA, 23 bp, Homo sapiens
gttatggttcctttggtcgctcg

SEQ ID NO: 28792 - DNA, 22 bp, Homo sapiens
ttatggttcctttggtcgctcg

SEQ ID NO: 28793 - DNA, 20 bp, Homo sapiens
atggttcctttggtcgctcg

SEQ ID NO: 28794 - DNA, 22 bp, Homo sapiens
tctcctacttggataactgtgg

SEQ ID NO: 28795 - DNA, 29 bp, Homo sapiens
tctcctacttggataactgtggtaattct

SEQ ID NO: 28796 - DNA, 21 bp, Homo sapiens
ctcctacttggataactgtgg

SEQ ID NO: 28797 - DNA, 25 bp, Homo sapiens
ctcctacttggataactgtggtaat

SEQ ID NO: 28798 - DNA, 30 bp, Homo sapiens; identical to SEQ ID NO: 2071

SEQ ID NO: 28799 - DNA, 20 bp, Homo sapiens
tcctacttggataactgtgg

SEQ ID NO: 28800 - DNA, 21 bp, Homo sapiens
tcctacttggataactgtggt

SEQ ID NO: 28801 - DNA, 24 bp, Homo sapiens
tcctacttggataactgtggtaat

SEQ ID NO: 28802 - DNA, 29 bp, Homo sapiens
tcctacttggataactgtggtaattctag

SEQ ID NO: 28803 - DNA, 19 bp, Homo sapiens
cctacttggataactgtgg

SEQ ID NO: 28804 - DNA, 30 bp, Homo sapiens; identical to SEQ ID NO: 2081

SEQ ID NO: 28805 - DNA, 22 bp, Homo sapiens
ctacttggataactgtggtaat

SEQ ID NO: 28806 - DNA, 30 bp, Homo sapiens; identical to SEQ ID NO: 2087

SEQ ID NO: 28807 - DNA, 21 bp, Homo sapiens
tacttggataactgtggtaat

SEQ ID NO: 28808 - DNA, 21 bp, Homo sapiens
tggataactgtggtaattcta

SEQ ID NO: 28809 - DNA, 24 bp, Homo sapiens
tggataactgtggtaattctagag

SEQ ID NO: 28810 - DNA, 25 bp, Homo sapiens
tggataactgtggtaattctagagc

SEQ ID NO: 28811 - DNA, 29 bp, Homo sapiens
tggataactgtggtaattctagagctaat

SEQ ID NO: 28812 - DNA, 24 bp, Homo sapiens
ggataactgtggtaattctagagc

SEQ ID NO: 28813 - DNA, 23 bp, Homo sapiens
gataactgtggtaattctagagc

SEQ ID NO: 28814 - DNA, 24 bp, Homo sapiens
gataactgtggtaattctagagct

SEQ ID NO: 28815 - DNA, 22 bp, Homo sapiens
ataactgtggtaattctagagc

SEQ ID NO: 28816 - DNA, 23 bp, Homo sapiens
ataactgtggtaattctagagct

SEQ ID NO: 28817 - DNA, 21 bp, Homo sapiens
taactgtggtaattctagagc

SEQ ID NO: 28818 - DNA, 22 bp, Homo sapiens
taactgtggtaattctagagct

SEQ ID NO: 28819 - DNA, 20 bp, Homo sapiens
aactgtggtaattctagagc

SEQ ID NO: 28820 - DNA, 21 bp, Homo sapiens
aactgtggtaattctagagct

SEQ ID NO: 28821 - DNA, 19 bp, Homo sapiens
actgtggtaattctagagc

SEQ ID NO: 28822 - DNA, 20 bp, Homo sapiens
actgtggtaattctagagct

SEQ ID NO: 28823 - DNA, 21 bp, Homo sapiens
actgtggtaattctagagcta

SEQ ID NO: 28824 - DNA, 24 bp, Homo sapiens
actgtggtaattctagagctaata

SEQ ID NO: 28825 - DNA, 30 bp, Homo sapiens; identical to SEQ ID NO: 2123

SEQ ID NO: 28826 - DNA, 18 bp, Homo sapiens
ctgtggtaattctagagc

SEQ ID NO: 28827 - DNA, 19 bp, Homo sapiens
ctgtggtaattctagagct

SEQ ID NO: 28828 - DNA, 23 bp, Homo sapiens
gtggtaattctagagctaataca

SEQ ID NO: 28829 - DNA, 19 bp, Homo sapiens
atgcgtgcatttatcagat

SEQ ID NO: 28830 - DNA, 20 bp, Homo sapiens
atgcgtgcatttatcagatc

SEQ ID NO: 28831 - DNA, 21 bp, Homo sapiens
atgcgtgcatttatcagatca

SEQ ID NO: 28832 - DNA, 17 bp, Homo sapiens
tgcgtgcatttatcaga

SEQ ID NO: 28833 - DNA, 18 bp, Homo sapiens
tgcgtgcatttatcagat

SEQ ID NO: 28834 - DNA, 19 bp, Homo sapiens
tgcgtgcatttatcagatc

SEQ ID NO: 28835 - DNA, 20 bp, Homo sapiens
tgcgtgcatttatcagatca

SEQ ID NO: 28836 - DNA, 21 bp, Homo sapiens
tgcgtgcatttatcagatcaa

SEQ ID NO: 28837 - DNA, 22 bp, Homo sapiens
tgcgtgcatttatcagatcaaa

SEQ ID NO: 28838 - DNA, 25 bp, Homo sapiens
tgcgtgcatttatcagatcaaaacc

SEQ ID NO: 28839 - DNA, 21 bp, Homo sapiens
atcagatcaaaaccaacccgg

SEQ ID NO: 28840 - DNA, 21 bp, Homo sapiens
cccggtcagcccctctccggc

SEQ ID NO: 28841 - DNA, 25 bp, Homo sapiens
cccggtcagcccctctccggccccg

SEQ ID NO: 28842 - DNA, 20 bp, Homo sapiens
ccggtcagcccctctccggc

SEQ ID NO: 28843 - DNA, 21 bp, Homo sapiens
gccggggggcgggcgccggcg

SEQ ID NO: 28844 - DNA, 23 bp, Homo sapiens
gccggggggcgggcgccggcggc

SEQ ID NO: 28845 - DNA, 23 bp, Homo sapiens
ccggcggctttggtgactctaga

SEQ ID NO: 28846 - DNA, 18 bp, Homo sapiens
ggctttggtgactctaga

SEQ ID NO: 28847 - DNA, 20 bp, Homo sapiens
ggctttggtgactctagata

SEQ ID NO: 28848 - DNA, 27 bp, Homo sapiens
ggctttggtgactctagataacctcgg

SEQ ID NO: 28849 - DNA, 17 bp, Homo sapiens
gctttggtgactctaga

SEQ ID NO: 28850 - DNA, 19 bp, Homo sapiens
gctttggtgactctagata

SEQ ID NO: 28851 - DNA, 26 bp, Homo sapiens
gctttggtgactctagataacctcgg

SEQ ID NO: 28852 - DNA, 16 bp, Homo sapiens
ctttggtgactctaga

SEQ ID NO: 28853 - DNA, 18 bp, Homo sapiens
ctttggtgactctagata

SEQ ID NO: 28854 - DNA, 25 bp, Homo sapiens
ctttggtgactctagataacctcgg

SEQ ID NO: 28855 - DNA, 29 bp, Homo sapiens
ctttggtgactctagataacctcgggccg

SEQ ID NO: 28856 - DNA, 24 bp, Homo sapiens
tttggtgactctagataacctcgg

SEQ ID NO: 28857 - DNA, 23 bp, Homo sapiens
gataacctcgggccgatcgcacg

SEQ ID NO: 28858 - DNA, 20 bp, Homo sapiens
ataacctcgggccgatcgca

SEQ ID NO: 28859 - DNA, 21 bp, Homo sapiens
ataacctcgggccgatcgcac

SEQ ID NO: 28860 - DNA, 22 bp, Homo sapiens
ataacctcgggccgatcgcacg

SEQ ID NO: 28861 - DNA, 20 bp, Homo sapiens
taacctcgggccgatcgcac

SEQ ID NO: 28862 - DNA, 21 bp, Homo sapiens
taacctcgggccgatcgcacg

SEQ ID NO: 28863 - DNA, 22 bp, Homo sapiens
taacctcgggccgatcgcacgc

SEQ ID NO: 28864 - DNA, 18 bp, Homo sapiens
aacctcgggccgatcgca

SEQ ID NO: 28865 - DNA, 19 bp, Homo sapiens
aacctcgggccgatcgcac

SEQ ID NO: 28866 - DNA, 20 bp, Homo sapiens
aacctcgggccgatcgcacg

SEQ ID NO: 28867 - DNA, 21 bp, Homo sapiens
aacctcgggccgatcgcacgc

SEQ ID NO: 28868 - DNA, 18 bp, Homo sapiens
acctcgggccgatcgcac

SEQ ID NO: 28869 - DNA, 19 bp, Homo sapiens
acctcgggccgatcgcacg

SEQ ID NO: 28870 - DNA, 20 bp, Homo sapiens
acctcgggccgatcgcacgc

SEQ ID NO: 28871 - DNA, 17 bp, Homo sapiens
cctcgggccgatcgcac

SEQ ID NO: 28872 - DNA, 18 bp, Homo sapiens
cctcgggccgatcgcacg

SEQ ID NO: 28873 - DNA, 16 bp, Homo sapiens
ctcgggccgatcgcac

SEQ ID NO: 28874 - DNA, 23 bp, Homo sapiens
ccgtgcctaccatggtgaccacg

SEQ ID NO: 28875 - DNA, 22 bp, Homo sapiens
cgtgcctaccatggtgaccacg

SEQ ID NO: 28876 - DNA, 17 bp, Homo sapiens
ctaccatggtgaccacg

SEQ ID NO: 28877 - DNA, 16 bp, Homo sapiens
taccatggtgaccacg

SEQ ID NO: 28878 - DNA, 23 bp, Homo sapiens
gattccggagagggagcctgaga

SEQ ID NO: 28879 - DNA, 20 bp, Homo sapiens
attccggagagggagcctga

SEQ ID NO: 28880 - DNA, 21 bp, Homo sapiens
attccggagagggagcctgag

SEQ ID NO: 28881 - DNA, 22 bp, Homo sapiens
attccggagagggagcctgaga

SEQ ID NO: 28882 - DNA, 21 bp, Homo sapiens
ttccggagagggagcctgaga

SEQ ID NO: 28883 - DNA, 17 bp, Homo sapiens
aacaatacaggactctt

SEQ ID NO: 28884 - DNA, 18 bp, Homo sapiens
aacaatacaggactcttt

SEQ ID NO: 28885 - DNA, 22 bp, Homo sapiens
ccagcagccgcggtaattccag

SEQ ID NO: 28886 - DNA, 23 bp, Homo sapiens
aaagctcgtagttggatcttggg

SEQ ID NO: 28887 - DNA, 21 bp, Homo sapiens
aagctcgtagttggatcttgg

SEQ ID NO: 28888 - DNA, 22 bp, Homo sapiens
aagctcgtagttggatcttggg

SEQ ID NO: 28889 - DNA, 23 bp, Homo sapiens
aagctcgtagttggatcttggga

SEQ ID NO: 28890 - DNA, 21 bp, Homo sapiens
agctcgtagttggatcttggg

SEQ ID NO: 28891 - DNA, 22 bp, Homo sapiens
agctcgtagttggatcttggga

SEQ ID NO: 28892 - DNA, 20 bp, Homo sapiens
gctcgtagttggatcttggg

SEQ ID NO: 28893 - DNA, 21 bp, Homo sapiens
gctcgtagttggatcttggga

SEQ ID NO: 28894 - DNA, 22 bp, Homo sapiens
gctcgtagttggatcttgggag

SEQ ID NO: 28895 - DNA, 23 bp, Homo sapiens
gctcgtagttggatcttgggagc

SEQ ID NO: 28896 - DNA, 19 bp, Homo sapiens
ctcgtagttggatcttggg

SEQ ID NO: 28897 - DNA, 20 bp, Homo sapiens
ctcgtagttggatcttggga

SEQ ID NO: 28898 - DNA, 21 bp, Homo sapiens
ctcgtagttggatcttgggag

SEQ ID NO: 28899 - DNA, 22 bp, Homo sapiens
ctcgtagttggatcttgggagc

SEQ ID NO: 28900 - DNA, 23 bp, Homo sapiens
ctcgtagttggatcttgggagcg

SEQ ID NO: 28901 - DNA, 18 bp, Homo sapiens
tcgtagttggatcttggg

SEQ ID NO: 28902 - DNA, 19 bp, Homo sapiens
tcgtagttggatcttggga

SEQ ID NO: 28903 - DNA, 21 bp, Homo sapiens
tcgtagttggatcttgggagc

SEQ ID NO: 28904 - DNA, 22 bp, Homo sapiens
tcgtagttggatcttgggagcg

SEQ ID NO: 28905 - DNA, 17 bp, Homo sapiens
cgtagttggatcttggg

SEQ ID NO: 28906 - DNA, 18 bp, Homo sapiens
cgtagttggatcttggga

SEQ ID NO: 28907 - DNA, 19 bp, Homo sapiens
cgtagttggatcttgggag

SEQ ID NO: 28908 - DNA, 20 bp, Homo sapiens
cgtagttggatcttgggagc

SEQ ID NO: 28909 - DNA, 21 bp, Homo sapiens
cgtagttggatcttgggagcg

SEQ ID NO: 28910 - DNA, 22 bp, Homo sapiens
cgtagttggatcttgggagcgg

SEQ ID NO: 28911 - DNA, 23 bp, Homo sapiens
cgtagttggatcttgggagcggg

SEQ ID NO: 28912 - DNA, 24 bp, Homo sapiens
cgtagttggatcttgggagcgggc

SEQ ID NO: 28913 - DNA, 25 bp, Homo sapiens
cgtagttggatcttgggagcgggcg

SEQ ID NO: 28914 - DNA, 26 bp, Homo sapiens
cgtagttggatcttgggagcgggcgg

SEQ ID NO: 28915 - DNA, 27 bp, Homo sapiens
cgtagttggatcttgggagcgggcggg

SEQ ID NO: 28916 - DNA, 19 bp, Homo sapiens
gtagttggatcttgggagc

SEQ ID NO: 28917 - DNA, 20 bp, Homo sapiens
gtagttggatcttgggagcg

SEQ ID NO: 28918 - DNA, 21 bp, Homo sapiens
gtagttggatcttgggagcgg

SEQ ID NO: 28919 - DNA, 23 bp, Homo sapiens
gtagttggatcttgggagcgggc

SEQ ID NO: 28920 - DNA, 24 bp, Homo sapiens
gtagttggatcttgggagcgggcg

SEQ ID NO: 28921 - DNA, 18 bp, Homo sapiens
tagttggatcttgggagc

SEQ ID NO: 28922 - DNA, 19 bp, Homo sapiens
tagttggatcttgggagcg

SEQ ID NO: 28923 - DNA, 20 bp, Homo sapiens
tagttggatcttgggagcgg

SEQ ID NO: 28924 - DNA, 21 bp, Homo sapiens
tagttggatcttgggagcggg

SEQ ID NO: 28925 - DNA, 22 bp, Homo sapiens
tagttggatcttgggagcgggc

SEQ ID NO: 28926 - DNA, 23 bp, Homo sapiens
tagttggatcttgggagcgggcg

SEQ ID NO: 28927 - DNA, 24 bp, Homo sapiens
tagttggatcttgggagcgggcgg

SEQ ID NO: 28928 - DNA, 22 bp, Homo sapiens
gcgagccaccgcccgtccccgc

SEQ ID NO: 28929 - DNA, 25 bp, Homo sapiens
gcgagccaccgcccgtccccgcccc

SEQ ID NO: 28930 - DNA, 23 bp, Homo sapiens
ctcggcgccccctcgatgctctt

SEQ ID NO: 28931 - DNA, 21 bp, Homo sapiens
ttgttggttttcggaactgag

SEQ ID NO: 28932 - DNA, 22 bp, Homo sapiens
ttgttggttttcggaactgagg

SEQ ID NO: 28933 - DNA, 23 bp, Homo sapiens
ttgttggttttcggaactgaggc

SEQ ID NO: 28934 - DNA, 24 bp, Homo sapiens
ttgttggttttcggaactgaggcc

SEQ ID NO: 28935 - DNA, 21 bp, Homo sapiens
tgttggttttcggaactgagg

SEQ ID NO: 28936 - DNA, 23 bp, Homo sapiens
tgttggttttcggaactgaggcc

SEQ ID NO: 28937 - DNA, 19 bp, Homo sapiens
gttggttttcggaactgag

SEQ ID NO: 28938 - DNA, 20 bp, Homo sapiens
gttggttttcggaactgagg

SEQ ID NO: 28939 - DNA, 21 bp, Homo sapiens
gttggttttcggaactgaggc

SEQ ID NO: 28940 - DNA, 22 bp, Homo sapiens
gttggttttcggaactgaggcc

SEQ ID NO: 28941 - DNA, 25 bp, Homo sapiens
gttggttttcggaactgaggccatg

SEQ ID NO: 28942 - DNA, 19 bp, Homo sapiens
ttggttttcggaactgagg

SEQ ID NO: 28943 - DNA, 20 bp, Homo sapiens
ttggttttcggaactgaggc

SEQ ID NO: 28944 - DNA, 21 bp, Homo sapiens
ttggttttcggaactgaggcc

SEQ ID NO: 28945 - DNA, 24 bp, Homo sapiens
ttggttttcggaactgaggccatg

SEQ ID NO: 28946 - DNA, 18 bp, Homo sapiens
tggttttcggaactgagg

SEQ ID NO: 28947 - DNA, 17 bp, Homo sapiens
ggttttcggaactgagg

SEQ ID NO: 28948 - DNA, 19 bp, Homo sapiens
ggttttcggaactgaggcc

SEQ ID NO: 28949 - DNA, 21 bp, Homo sapiens
gttttcggaactgaggccatg

SEQ ID NO: 28950 - DNA, 22 bp, Homo sapiens
gttttcggaactgaggccatga

SEQ ID NO: 28951 - DNA, 20 bp, Homo sapiens
tttcggaactgaggccatga

SEQ ID NO: 28952 - DNA, 23 bp, Homo sapiens
gaactgaggccatgattaagagg

SEQ ID NO: 28953 - DNA, 22 bp, Homo sapiens
aactgaggccatgattaagagg

SEQ ID NO: 28954 - DNA, 21 bp, Homo sapiens
actgaggccatgattaagagg

SEQ ID NO: 28955 - DNA, 30 bp, Homo sapiens
catgattaagagggacggccgggggcattc

SEQ ID NO: 28956 - DNA, 30 bp, Homo sapiens
atgattaagagggacggccgggggcattcg

SEQ ID NO: 28957 - DNA, 30 bp, Homo sapiens
tgattaagagggacggccgggggcattcgt

SEQ ID NO: 28958 - DNA, 25 bp, Homo sapiens
gctagaggtgaaattcttggaccgg

SEQ ID NO: 28959 - DNA, 22 bp, Homo sapiens
agaggtgaaattcttggaccgg

SEQ ID NO: 28960 - DNA, 19 bp, Homo sapiens
gaggtgaaattcttggacc

SEQ ID NO: 28961 - DNA, 21 bp, Homo sapiens
gaggtgaaattcttggaccgg

SEQ ID NO: 28962 - DNA, 23 bp, Homo sapiens
gaggtgaaattcttggaccggcg

SEQ ID NO: 28963 - DNA, 24 bp, Homo sapiens
gaggtgaaattcttggaccggcgc

SEQ ID NO: 28964 - DNA, 25 bp, Homo sapiens
gaggtgaaattcttggaccggcgca

SEQ ID NO: 28965 - DNA, 18 bp, Homo sapiens
gtgaaattcttggaccgg

SEQ ID NO: 28966 - DNA, 21 bp, Homo sapiens
ttcttggaccggcgcaagacg

SEQ ID NO: 28967 - DNA, 23 bp, Homo sapiens
ttcttggaccggcgcaagacgga

SEQ ID NO: 28968 - DNA, 26 bp, Homo sapiens
tcttggaccggcgcaagacggaccag

SEQ ID NO: 28969 - DNA, 27 bp, Homo sapiens
tcttggaccggcgcaagacggaccaga

SEQ ID NO: 28970 - DNA, 19 bp, Homo sapiens
gacggaccagagcgaaagc

SEQ ID NO: 28971 - DNA, 21 bp, Homo sapiens
agagcgaaagcatttgccaag

SEQ ID NO: 28972 - DNA, 29 bp, Homo sapiens
tgttttcattaatcaagaacgaaagtcgg

SEQ ID NO: 28973 - DNA, 30 bp, Homo sapiens
gttttcattaatcaagaacgaaagtcggag

SEQ ID NO: 28974 - DNA, 28 bp, Homo sapiens
ttcattaatcaagaacgaaagtcggagg

SEQ ID NO: 28975 - DNA, 26 bp, Homo sapiens
cattaatcaagaacgaaagtcggagg

SEQ ID NO: 28976 - DNA, 25 bp, Homo sapiens
attaatcaagaacgaaagtcggagg

SEQ ID NO: 28977 - DNA, 24 bp, Homo sapiens
ttaatcaagaacgaaagtcggagg

SEQ ID NO: 28978 - DNA, 23 bp, Homo sapiens
taatcaagaacgaaagtcggagg

SEQ ID NO: 28979 - DNA, 22 bp, Homo sapiens
aatcaagaacgaaagtcggagg

SEQ ID NO: 28980 - DNA, 21 bp, Homo sapiens
atcaagaacgaaagtcggagg

SEQ ID NO: 28981 - DNA, 24 bp, Homo sapiens
atcaagaacgaaagtcggaggttc

SEQ ID NO: 28982 - DNA, 25 bp, Homo sapiens
atcaagaacgaaagtcggaggttcg

SEQ ID NO: 28983 - DNA, 20 bp, Homo sapiens
tcaagaacgaaagtcggagg

SEQ ID NO: 28984 - DNA, 23 bp, Homo sapiens
tcaagaacgaaagtcggaggttc

SEQ ID NO: 28985 - DNA, 18 bp, Homo sapiens
caagaacgaaagtcggag

SEQ ID NO: 28986 - DNA, 19 bp, Homo sapiens
caagaacgaaagtcggagg

SEQ ID NO: 28987 - DNA, 20 bp, Homo sapiens
caagaacgaaagtcggaggt

SEQ ID NO: 28988 - DNA, 21 bp, Homo sapiens
caagaacgaaagtcggaggtt

SEQ ID NO: 28989 - DNA, 22 bp, Homo sapiens
caagaacgaaagtcggaggttc

SEQ ID NO: 28990 - DNA, 23 bp, Homo sapiens
caagaacgaaagtcggaggttcg

SEQ ID NO: 28991 - DNA, 17 bp, Homo sapiens
aagaacgaaagtcggag

SEQ ID NO: 28992 - DNA, 18 bp, Homo sapiens
aagaacgaaagtcggagg

SEQ ID NO: 28993 - DNA, 19 bp, Homo sapiens
aagaacgaaagtcggaggt

SEQ ID NO: 28994 - DNA, 20 bp, Homo sapiens
aagaacgaaagtcggaggtt

SEQ ID NO: 28995 - DNA, 21 bp, Homo sapiens
aagaacgaaagtcggaggttc

SEQ ID NO: 28996 - DNA, 22 bp, Homo sapiens
aagaacgaaagtcggaggttcg

SEQ ID NO: 28997 - DNA, 23 bp, Homo sapiens
aagaacgaaagtcggaggttcga

SEQ ID NO: 28998 - DNA, 25 bp, Homo sapiens
aagaacgaaagtcggaggttcgaag

SEQ ID NO: 28999 - DNA, 26 bp, Homo sapiens
aagaacgaaagtcggaggttcgaaga

SEQ ID NO: 29000 - DNA, 28 bp, Homo sapiens
aagaacgaaagtcggaggttcgaagacg

SEQ ID NO: 29001 - DNA, 17 bp, Homo sapiens
agaacgaaagtcggagg

SEQ ID NO: 29002 - DNA, 18 bp, Homo sapiens
agaacgaaagtcggaggt

SEQ ID NO: 29003 - DNA, 19 bp, Homo sapiens
agaacgaaagtcggaggtt

SEQ ID NO: 29004 - DNA, 20 bp, Homo sapiens
agaacgaaagtcggaggttc

SEQ ID NO: 29005 - DNA, 21 bp, Homo sapiens
agaacgaaagtcggaggttcg

SEQ ID NO: 29006 - DNA, 22 bp, Homo sapiens
agaacgaaagtcggaggttcga

SEQ ID NO: 29007 - DNA, 24 bp, Homo sapiens
agaacgaaagtcggaggttcgaag

SEQ ID NO: 29008 - DNA, 25 bp, Homo sapiens
agaacgaaagtcggaggttcgaaga

SEQ ID NO: 29009 - DNA, 26 bp, Homo sapiens
agaacgaaagtcggaggttcgaagac

SEQ ID NO: 29010 - DNA, 27 bp, Homo sapiens
agaacgaaagtcggaggttcgaagacg

SEQ ID NO: 29011 - DNA, 16 bp, Homo sapiens
gaacgaaagtcggagg

SEQ ID NO: 29012 - DNA, 18 bp, Homo sapiens
gaacgaaagtcggaggtt

SEQ ID NO: 29013 - DNA, 19 bp, Homo sapiens
gaacgaaagtcggaggttc

SEQ ID NO: 29014 - DNA, 20 bp, Homo sapiens
gaacgaaagtcggaggttcg

SEQ ID NO: 29015 - DNA, 21 bp, Homo sapiens
gaacgaaagtcggaggttcga

SEQ ID NO: 29016 - DNA, 23 bp, Homo sapiens
gaacgaaagtcggaggttcgaag

SEQ ID NO: 29017 - DNA, 24 bp, Homo sapiens
gaacgaaagtcggaggttcgaaga

SEQ ID NO: 29018 - DNA, 17 bp, Homo sapiens
aacgaaagtcggaggtt

SEQ ID NO: 29019 - DNA, 18 bp, Homo sapiens
aacgaaagtcggaggttc

SEQ ID NO: 29020 - DNA, 19 bp, Homo sapiens
aacgaaagtcggaggttcg

SEQ ID NO: 29021 - DNA, 20 bp, Homo sapiens
aacgaaagtcggaggttcga

SEQ ID NO: 29022 - DNA, 21 bp, Homo sapiens
aacgaaagtcggaggttcgaa

SEQ ID NO: 29023 - DNA, 22 bp, Homo sapiens
aacgaaagtcggaggttcgaag

SEQ ID NO: 29024 - DNA, 23 bp, Homo sapiens
aacgaaagtcggaggttcgaaga

SEQ ID NO: 29025 - DNA, 24 bp, Homo sapiens
aacgaaagtcggaggttcgaagac

SEQ ID NO: 29026 - DNA, 25 bp, Homo sapiens
aacgaaagtcggaggttcgaagacg

SEQ ID NO: 29027 - DNA, 26 bp, Homo sapiens
aacgaaagtcggaggttcgaagacga

SEQ ID NO: 29028 - DNA, 28 bp, Homo sapiens
aacgaaagtcggaggttcgaagacgatc

SEQ ID NO: 29029 - DNA, 30 bp, Homo sapiens
aacgaaagtcggaggttcgaagacgatcag

SEQ ID NO: 29030 - DNA, 16 bp, Homo sapiens
acgaaagtcggaggtt

SEQ ID NO: 29031 - DNA, 17 bp, Homo sapiens
acgaaagtcggaggttc

SEQ ID NO: 29032 - DNA, 18 bp, Homo sapiens
acgaaagtcggaggttcg

SEQ ID NO: 29033 - DNA, 19 bp, Homo sapiens
acgaaagtcggaggttcga

SEQ ID NO: 29034 - DNA, 20 bp, Homo sapiens
acgaaagtcggaggttcgaa

SEQ ID NO: 29035 - DNA, 21 bp, Homo sapiens
acgaaagtcggaggttcgaag

SEQ ID NO: 29036 - DNA, 22 bp, Homo sapiens
acgaaagtcggaggttcgaaga

SEQ ID NO: 29037 - DNA, 23 bp, Homo sapiens
acgaaagtcggaggttcgaagac

SEQ ID NO: 29038 - DNA, 24 bp, Homo sapiens
acgaaagtcggaggttcgaagacg

SEQ ID NO: 29039 - DNA, 25 bp, Homo sapiens
acgaaagtcggaggttcgaagacga

SEQ ID NO: 29040 - DNA, 26 bp, Homo sapiens
acgaaagtcggaggttcgaagacgat

SEQ ID NO: 29041 - DNA, 27 bp, Homo sapiens
acgaaagtcggaggttcgaagacgatc

SEQ ID NO: 29042 - DNA, 28 bp, Homo sapiens
acgaaagtcggaggttcgaagacgatca

SEQ ID NO: 29043 - DNA, 29 bp, Homo sapiens
acgaaagtcggaggttcgaagacgatcag

SEQ ID NO: 29044 - DNA, 19 bp, Homo sapiens
cgaaagtcggaggttcgaa

SEQ ID NO: 29045 - DNA, 21 bp, Homo sapiens
cgaaagtcggaggttcgaaga

SEQ ID NO: 29046 - DNA, 24 bp, Homo sapiens
cgaaagtcggaggttcgaagacga

SEQ ID NO: 29047 - DNA, 27 bp, Homo sapiens
cgaaagtcggaggttcgaagacgatca

SEQ ID NO: 29048 - DNA, 19 bp, Homo sapiens
gaaagtcggaggttcgaag

SEQ ID NO: 29049 - DNA, 20 bp, Homo sapiens
gaaagtcggaggttcgaaga

SEQ ID NO: 29050 - DNA, 21 bp, Homo sapiens
gaaagtcggaggttcgaagac

SEQ ID NO: 29051 - DNA, 22 bp, Homo sapiens
gaaagtcggaggttcgaagacg

SEQ ID NO: 29052 - DNA, 23 bp, Homo sapiens
gaaagtcggaggttcgaagacga

SEQ ID NO: 29053 - DNA, 25 bp, Homo sapiens
gaaagtcggaggttcgaagacgatc

SEQ ID NO: 29054 - DNA, 16 bp, Homo sapiens
aaagtcggaggttcga

SEQ ID NO: 29055 - DNA, 18 bp, Homo sapiens
aaagtcggaggttcgaag

SEQ ID NO: 29056 - DNA, 19 bp, Homo sapiens
aaagtcggaggttcgaaga

SEQ ID NO: 29057 - DNA, 20 bp, Homo sapiens
aaagtcggaggttcgaagac

SEQ ID NO: 29058 - DNA, 21 bp, Homo sapiens
aaagtcggaggttcgaagacg

SEQ ID NO: 29059 - DNA, 22 bp, Homo sapiens
aaagtcggaggttcgaagacga

SEQ ID NO: 29060 - DNA, 23 bp, Homo sapiens
aaagtcggaggttcgaagacgat

SEQ ID NO: 29061 - DNA, 24 bp, Homo sapiens
aaagtcggaggttcgaagacgatc

SEQ ID NO: 29062 - DNA, 25 bp, Homo sapiens
aaagtcggaggttcgaagacgatca

SEQ ID NO: 29063 - DNA, 20 bp, Homo sapiens
aagtcggaggttcgaagacg

SEQ ID NO: 29064 - DNA, 23 bp, Homo sapiens
aagtcggaggttcgaagacgatc

SEQ ID NO: 29065 - DNA, 24 bp, Homo sapiens
aagtcggaggttcgaagacgatca

SEQ ID NO: 29066 - DNA, 25 bp, Homo sapiens
atcagataccgtcgtagttccgacc

SEQ ID NO: 29067 - DNA, 24 bp, Homo sapiens
tcagataccgtcgtagttccgacc

SEQ ID NO: 29068 - DNA, 23 bp, Homo sapiens
cagataccgtcgtagttccgacc

SEQ ID NO: 29069 - DNA, 19 bp, Homo sapiens
tattcccatgacccgccgg

SEQ ID NO: 29070 - DNA, 18 bp, Homo sapiens
attcccatgacccgccgg

SEQ ID NO: 29071 - DNA, 22 bp, Homo sapiens
attcccatgacccgccgggcag

SEQ ID NO: 29072 - DNA, 23 bp, Homo sapiens
attcccatgacccgccgggcagc

SEQ ID NO: 29073 - DNA, 21 bp, Homo sapiens
ttcccatgacccgccgggcag

SEQ ID NO: 29074 - DNA, 22 bp, Homo sapiens
ttcccatgacccgccgggcagc

SEQ ID NO: 29075 - DNA, 20 bp, Homo sapiens
tcccatgacccgccgggcag

SEQ ID NO: 29076 - DNA, 21 bp, Homo sapiens
tcccatgacccgccgggcagc

SEQ ID NO: 29077 - DNA, 18 bp, Homo sapiens
cccatgacccgccgggca

SEQ ID NO: 29078 - DNA, 19 bp, Homo sapiens
cccatgacccgccgggcag

SEQ ID NO: 29079 - DNA, 20 bp, Homo sapiens
cccatgacccgccgggcagc

SEQ ID NO: 29080 - DNA, 19 bp, Homo sapiens
ccatgacccgccgggcagc

SEQ ID NO: 29081 - DNA, 22 bp, Homo sapiens
atgacccgccgggcagcttccg

SEQ ID NO: 29082 - DNA, 20 bp, Homo sapiens
ccaaagtctttgggttccgg

SEQ ID NO: 29083 - DNA, 21 bp, Homo sapiens
ctcacccggcccggacacgga

SEQ ID NO: 29084 - DNA, 18 bp, Homo sapiens
tcacccggcccggacacg

SEQ ID NO: 29085 - DNA, 19 bp, Homo sapiens
tcacccggcccggacacgg

SEQ ID NO: 29086 - DNA, 20 bp, Homo sapiens
tcacccggcccggacacgga

SEQ ID NO: 29087 - DNA, 22 bp, Homo sapiens
cccggcccggacacggacagga

SEQ ID NO: 29088 - DNA, 20 bp, Homo sapiens
cggcccggacacggacagga

SEQ ID NO: 29089 - DNA, 23 bp, Homo sapiens
cggcccggacacggacaggattg

SEQ ID NO: 29090 - DNA, 19 bp, Homo sapiens
ggcccggacacggacagga

SEQ ID NO: 29091 - DNA, 17 bp, Homo sapiens
cccggacacggacagga

SEQ ID NO: 29092 - DNA, 24 bp, Homo sapiens
cccggacacggacaggattgacag

SEQ ID NO: 29093 - DNA, 16 bp, Homo sapiens
ccggacacggacagga

SEQ ID NO: 29094 - DNA, 20 bp, Homo sapiens
ccggacacggacaggattga

SEQ ID NO: 29095 - DNA, 24 bp, Homo sapiens
ccggacacggacaggattgacaga

SEQ ID NO: 29096 - DNA, 19 bp, Homo sapiens
cacggacaggattgacaga

SEQ ID NO: 29097 - DNA, 21 bp, Homo sapiens
acaggattgacagattgatag

SEQ ID NO: 29098 - DNA, 20 bp, Homo sapiens
caggattgacagattgatag

SEQ ID NO: 29099 - DNA, 22 bp, Homo sapiens
gtgcatggccgttcttagttgg

SEQ ID NO: 29100 - DNA, 21 bp, Homo sapiens
tgcatggccgttcttagttgg

SEQ ID NO: 29101 - DNA, 25 bp, Homo sapiens
tccgataacgaacgagactctggca

SEQ ID NO: 29102 - DNA, 22 bp, Homo sapiens
ccgataacgaacgagactctgg

SEQ ID NO: 29103 - DNA, 24 bp, Homo sapiens
ccgataacgaacgagactctggca

SEQ ID NO: 29104 - DNA, 23 bp, Homo sapiens
cgataacgaacgagactctggca

SEQ ID NO: 29105 - DNA, 22 bp, Homo sapiens
gataacgaacgagactctggca

SEQ ID NO: 29106 - DNA, 19 bp, Homo sapiens
aacgaacgagactctggca

SEQ ID NO: 29107 - DNA, 18 bp, Homo sapiens
acgaacgagactctggca

SEQ ID NO: 29108 - DNA, 17 bp, Homo sapiens
cgaacgagactctggca

SEQ ID NO: 29109 - DNA, 21 bp, Homo sapiens
cgaacgagactctggcatgct

SEQ ID NO: 29110 - DNA, 20 bp, Homo sapiens
gagactctggcatgctaact

SEQ ID NO: 29111 - DNA, 29 bp, Homo sapiens
gagactctggcatgctaactagttacgcg

SEQ ID NO: 29112 - DNA, 17 bp, Homo sapiens
ctctggcatgctaacta

SEQ ID NO: 29113 - DNA, 19 bp, Homo sapiens
ctctggcatgctaactagt

SEQ ID NO: 29114 - DNA, 20 bp, Homo sapiens
ctctggcatgctaactagtt

SEQ ID NO: 29115 - DNA, 21 bp, Homo sapiens
ctctggcatgctaactagtta

SEQ ID NO: 29116 - DNA, 22 bp, Homo sapiens
ctctggcatgctaactagttac

SEQ ID NO: 29117 - DNA, 23 bp, Homo sapiens
ctctggcatgctaactagttacg

SEQ ID NO: 29118 - DNA, 24 bp, Homo sapiens
ctctggcatgctaactagttacgc

SEQ ID NO: 29119 - DNA, 30 bp, Homo sapiens
ctctggcatgctaactagttacgcgacccc

SEQ ID NO: 29120 - DNA, 24 bp, Homo sapiens
catgctaactagttacgcgacccc

SEQ ID NO: 29121 - DNA, 22 bp, Homo sapiens
tgctaactagttacgcgacccc

SEQ ID NO: 29122 - DNA, 23 bp, Homo sapiens
tgctaactagttacgcgaccccc

SEQ ID NO: 29123 - DNA, 21 bp, Homo sapiens
gacaagtggcgttcagccacc

SEQ ID NO: 29124 - DNA, 20 bp, Homo sapiens
cttagatgtccggggctgca

SEQ ID NO: 29125 - DNA, 22 bp, Homo sapiens
cttagatgtccggggctgcacg

SEQ ID NO: 29126 - DNA, 23 bp, Homo sapiens
cttagatgtccggggctgcacgc

SEQ ID NO: 29127 - DNA, 19 bp, Homo sapiens
ttagatgtccggggctgca

SEQ ID NO: 29128 - DNA, 21 bp, Homo sapiens
ttagatgtccggggctgcacg

SEQ ID NO: 29129 - DNA, 22 bp, Homo sapiens
ttagatgtccggggctgcacgc

SEQ ID NO: 29130 - DNA, 23 bp, Homo sapiens
ttagatgtccggggctgcacgcg

SEQ ID NO: 29131 - DNA, 24 bp, Homo sapiens
ttagatgtccggggctgcacgcgc

SEQ ID NO: 29132 - DNA, 18 bp, Homo sapiens
tagatgtccggggctgca

SEQ ID NO: 29133 - DNA, 20 bp, Homo sapiens
tagatgtccggggctgcacg

SEQ ID NO: 29134 - DNA, 21 bp, Homo sapiens
tagatgtccggggctgcacgc

SEQ ID NO: 29135 - DNA, 22 bp, Homo sapiens
tagatgtccggggctgcacgcg

SEQ ID NO: 29136 - DNA, 19 bp, Homo sapiens
agatgtccggggctgcacg

SEQ ID NO: 29137 - DNA, 18 bp, Homo sapiens
gatgtccggggctgcacg

SEQ ID NO: 29138 - DNA, 18 bp, Homo sapiens
ccggggctgcacgcgcgc

SEQ ID NO: 29139 - DNA, 21 bp, Homo sapiens
cattcgtgatggggatcgggg

SEQ ID NO: 29140 - DNA, 20 bp, Homo sapiens
attcgtgatggggatcgggg

SEQ ID NO: 29141 - DNA, 21 bp, Homo sapiens
tgatggggatcggggattgca

SEQ ID NO: 29142 - DNA, 20 bp, Homo sapiens
gatggggatcggggattgca

SEQ ID NO: 29143 - DNA, 19 bp, Homo sapiens
atggggatcggggattgca

SEQ ID NO: 29144 - DNA, 21 bp, Homo sapiens
aggaattcccagtaagtgcgg

SEQ ID NO: 29145 - DNA, 18 bp, Homo sapiens
aattcccagtaagtgcgg

SEQ ID NO: 29146 - DNA, 22 bp, Homo sapiens
tttagtgaggccctcggatcgg

SEQ ID NO: 29147 - DNA, 21 bp, Homo sapiens
ttagtgaggccctcggatcgg

SEQ ID NO: 29148 - DNA, 20 bp, Homo sapiens
tagtgaggccctcggatcgg

SEQ ID NO: 29149 - DNA, 21 bp, Homo sapiens
ctcggatcggccccgccgggg

SEQ ID NO: 29150 - DNA, 22 bp, Homo sapiens
gatcggccccgccggggtcggc

SEQ ID NO: 29151 - DNA, 16 bp, Homo sapiens
acggccctggcggagc

SEQ ID NO: 29152 - DNA, 18 bp, Homo sapiens
acggccctggcggagcgc

SEQ ID NO: 29153 - DNA, 19 bp, Homo sapiens
acggccctggcggagcgct

SEQ ID NO: 29154 - DNA, 21 bp, Homo sapiens
acggccctggcggagcgctga

SEQ ID NO: 29155 - DNA, 23 bp, Homo sapiens
acggccctggcggagcgctgaga

SEQ ID NO: 29156 - DNA, 30 bp, Homo sapiens; identical to SEQ ID NO: 16971

SEQ ID NO: 29157 - DNA, 22 bp, Homo sapiens
ctggcggagcgctgagaagacg

SEQ ID NO: 29158 - DNA, 23 bp, Homo sapiens
ctggcggagcgctgagaagacgg

SEQ ID NO: 29159 - DNA, 25 bp, Homo sapiens
ctggcggagcgctgagaagacggtc

SEQ ID NO: 29160 - DNA, 30 bp, Homo sapiens
ctggcggagcgctgagaagacggtcgaact

SEQ ID NO: 29161 - DNA, 29 bp, Homo sapiens
gctgagaagacggtcgaacttgactatct

SEQ ID NO: 29162 - DNA, 23 bp, Homo sapiens
acggtcgaacttgactatctaga

SEQ ID NO: 29163 - DNA, 19 bp, Homo sapiens
cggtcgaacttgactatct

SEQ ID NO: 29164 - DNA, 21 bp, Homo sapiens
cggtcgaacttgactatctag

SEQ ID NO: 29165 - DNA, 22 bp, Homo sapiens
cggtcgaacttgactatctaga

SEQ ID NO: 29166 - DNA, 29 bp, Homo sapiens
cggtcgaacttgactatctagaggaagta

SEQ ID NO: 29167 - DNA, 23 bp, Homo sapiens
ggtcgaacttgactatctagagg

SEQ ID NO: 29168 - DNA, 29 bp, Homo sapiens
ggtcgaacttgactatctagaggaagtaa

SEQ ID NO: 29169 - DNA, 19 bp, Homo sapiens
gtcgaacttgactatctag

SEQ ID NO: 29170 - DNA, 20 bp, Homo sapiens
gtcgaacttgactatctaga

SEQ ID NO: 29171 - DNA, 21 bp, Homo sapiens
gtcgaacttgactatctagag

SEQ ID NO: 29172 - DNA, 22 bp, Homo sapiens
gtcgaacttgactatctagagg

SEQ ID NO: 29173 - DNA, 23 bp, Homo sapiens
gtcgaacttgactatctagagga

SEQ ID NO: 29174 - DNA, 24 bp, Homo sapiens
gtcgaacttgactatctagaggaa

SEQ ID NO: 29175 - DNA, 25 bp, Homo sapiens
gtcgaacttgactatctagaggaag

SEQ ID NO: 29176 - DNA, 26 bp, Homo sapiens
gtcgaacttgactatctagaggaagt

SEQ ID NO: 29177 - DNA, 29 bp, Homo sapiens
gtcgaacttgactatctagaggaagtaaa

SEQ ID NO: 29178 - DNA, 21 bp, Homo sapiens
tcgaacttgactatctagagg

SEQ ID NO: 29179 - DNA, 22 bp, Homo sapiens
tcgaacttgactatctagagga

SEQ ID NO: 29180 - DNA, 20 bp, Homo sapiens
cgaacttgactatctagagg

SEQ ID NO: 29181 - DNA, 19 bp, Homo sapiens
gaacttgactatctagagg

SEQ ID NO: 29182 - DNA, 20 bp, Homo sapiens
gaacttgactatctagagga

SEQ ID NO: 29183 - DNA, 22 bp, Homo sapiens
gaacttgactatctagaggaag

SEQ ID NO: 29184 - DNA, 23 bp, Homo sapiens
gaacttgactatctagaggaagt

SEQ ID NO: 29185 - DNA, 20 bp, Homo sapiens
tcgtaacaaggtttccgtag

SEQ ID NO: 29186 - DNA, 30 bp, Homo sapiens
gtaacaaggtttccgtaggtgaacctgcgg

SEQ ID NO: 29187 - DNA, 27 bp, Homo sapiens
gtaggtgaacctgcggaaggatcatta

SEQ ID NO: 29188 - DNA, 24 bp, Homo sapiens
ggtgaacctgcggaaggatcatta

SEQ ID NO: 29189 - DNA, 22 bp, Homo sapiens
tgaacctgcggaaggatcatta

SEQ ID NO: 29190 - DNA, 19 bp, Homo sapiens
acctgcggaaggatcatta

SEQ ID NO: 29191 - DNA, 18 bp, Homo sapiens
cctgcggaaggatcatta

SEQ ID NO: 29192 - DNA, 17 bp, Homo sapiens
ctgcggaaggatcatta

SEQ ID NO: 29193 - DNA, 20 bp, Homo sapiens
gtgggtcgggggcggtggtg

SEQ ID NO: 29194 - DNA, 21 bp, Homo sapiens
gtgggtcgggggcggtggtgg

SEQ ID NO: 29195 - DNA, 20 bp, Homo sapiens
tgggtcgggggcggtggtgg

SEQ ID NO: 29196 - DNA, 21 bp, Homo sapiens
tgggtcgggggcggtggtggg

SEQ ID NO: 29197 - DNA, 22 bp, Homo sapiens
tgggtcgggggcggtggtgggc

SEQ ID NO: 29198 - DNA, 30 bp, Homo sapiens
gggcctcctcccggtgcgtcgtcgggagcg

SEQ ID NO: 29199 - DNA, 18 bp, Homo sapiens
cctcgtacgactcttagc

SEQ ID NO: 29200 - DNA, 19 bp, Homo sapiens
cctcgtacgactcttagcg

SEQ ID NO: 29201 - DNA, 20 bp, Homo sapiens
cctcgtacgactcttagcgg

SEQ ID NO: 29202 - DNA, 22 bp, Homo sapiens
cctcgtacgactcttagcggtg

SEQ ID NO: 29203 - DNA, 23 bp, Homo sapiens
cctcgtacgactcttagcggtgg

SEQ ID NO: 29204 - DNA, 24 bp, Homo sapiens
cctcgtacgactcttagcggtgga

SEQ ID NO: 29205 - DNA, 30 bp, Homo sapiens
cctcgtacgactcttagcggtggatcactc

SEQ ID NO: 29206 - DNA, 16 bp, Homo sapiens
ctcgtacgactcttag

SEQ ID NO: 29207 - DNA, 17 bp, Homo sapiens
ctcgtacgactcttagc

SEQ ID NO: 29208 - DNA, 18 bp, Homo sapiens
ctcgtacgactcttagcg

SEQ ID NO: 29209 - DNA, 19 bp, Homo sapiens
ctcgtacgactcttagcgg

SEQ ID NO: 29210 - DNA, 20 bp, Homo sapiens
ctcgtacgactcttagcggt

SEQ ID NO: 29211 - DNA, 21 bp, Homo sapiens
ctcgtacgactcttagcggtg

SEQ ID NO: 29212 - DNA, 22 bp, Homo sapiens
ctcgtacgactcttagcggtgg

SEQ ID NO: 29213 - DNA, 23 bp, Homo sapiens
ctcgtacgactcttagcggtgga

SEQ ID NO: 29214 - DNA, 24 bp, Homo sapiens
ctcgtacgactcttagcggtggat

SEQ ID NO: 29215 - DNA, 25 bp, Homo sapiens
ctcgtacgactcttagcggtggatc

SEQ ID NO: 29216 - DNA, 26 bp, Homo sapiens
ctcgtacgactcttagcggtggatca

SEQ ID NO: 29217 - DNA, 27 bp, Homo sapiens
ctcgtacgactcttagcggtggatcac

SEQ ID NO: 29218 - DNA, 28 bp, Homo sapiens
ctcgtacgactcttagcggtggatcact

SEQ ID NO: 29219 - DNA, 29 bp, Homo sapiens
ctcgtacgactcttagcggtggatcactc

SEQ ID NO: 29220 - DNA, 30 bp, Homo sapiens
ctcgtacgactcttagcggtggatcactcg

SEQ ID NO: 29221 - DNA, 16 bp, Homo sapiens
tcgtacgactcttagc

SEQ ID NO: 29222 - DNA, 17 bp, Homo sapiens
tcgtacgactcttagcg

SEQ ID NO: 29223 - DNA, 18 bp, Homo sapiens
tcgtacgactcttagcgg

SEQ ID NO: 29224 - DNA, 19 bp, Homo sapiens
tcgtacgactcttagcggt

SEQ ID NO: 29225 - DNA, 20 bp, Homo sapiens
tcgtacgactcttagcggtg

SEQ ID NO: 29226 - DNA, 21 bp, Homo sapiens
tcgtacgactcttagcggtgg

SEQ ID NO: 29227 - DNA, 22 bp, Homo sapiens
tcgtacgactcttagcggtgga

SEQ ID NO: 29228 - DNA, 23 bp, Homo sapiens
tcgtacgactcttagcggtggat

SEQ ID NO: 29229 - DNA, 24 bp, Homo sapiens
tcgtacgactcttagcggtggatc

SEQ ID NO: 29230 - DNA, 25 bp, Homo sapiens
tcgtacgactcttagcggtggatca

SEQ ID NO: 29231 - DNA, 26 bp, Homo sapiens
tcgtacgactcttagcggtggatcac

SEQ ID NO: 29232 - DNA, 27 bp, Homo sapiens
tcgtacgactcttagcggtggatcact

SEQ ID NO: 29233 - DNA, 28 bp, Homo sapiens
tcgtacgactcttagcggtggatcactc

SEQ ID NO: 29234 - DNA, 29 bp, Homo sapiens
tcgtacgactcttagcggtggatcactcg

SEQ ID NO: 29235 - DNA, 30 bp, Homo sapiens; identical to SEQ ID NO: 17328

SEQ ID NO: 29236 - DNA, 17 bp, Homo sapiens
cgtacgactcttagcgg

SEQ ID NO: 29237 - DNA, 18 bp, Homo sapiens
cgtacgactcttagcggt

SEQ ID NO: 29238 - DNA, 19 bp, Homo sapiens
cgtacgactcttagcggtg

SEQ ID NO: 29239 - DNA, 20 bp, Homo sapiens
cgtacgactcttagcggtgg

SEQ ID NO: 29240 - DNA, 21 bp, Homo sapiens
cgtacgactcttagcggtgga

SEQ ID NO: 29241 - DNA, 22 bp, Homo sapiens
cgtacgactcttagcggtggat

SEQ ID NO: 29242 - DNA, 23 bp, Homo sapiens
cgtacgactcttagcggtggatc

SEQ ID NO: 29243 - DNA, 24 bp, Homo sapiens
cgtacgactcttagcggtggatca

SEQ ID NO: 29244 - DNA, 26 bp, Homo sapiens
cgtacgactcttagcggtggatcact

SEQ ID NO: 29245 - DNA, 30 bp, Homo sapiens; identical to SEQ ID NO: 17342

SEQ ID NO: 29246 - DNA, 17 bp, Homo sapiens
gtacgactcttagcggt

SEQ ID NO: 29247 - DNA, 18 bp, Homo sapiens
gtacgactcttagcggtg

SEQ ID NO: 29248 - DNA, 19 bp, Homo sapiens
gtacgactcttagcggtgg

SEQ ID NO: 29249 - DNA, 20 bp, Homo sapiens
gtacgactcttagcggtgga

SEQ ID NO: 29250 - DNA, 21 bp, Homo sapiens
gtacgactcttagcggtggat

SEQ ID NO: 29251 - DNA, 22 bp, Homo sapiens
gtacgactcttagcggtggatc

SEQ ID NO: 29252 - DNA, 30 bp, Homo sapiens; identical to SEQ ID NO: 3563

SEQ ID NO: 29253 - DNA, 30 bp, Homo sapiens; identical to SEQ ID NO: 17364

SEQ ID NO: 29254 - DNA, 30 bp, Homo sapiens; identical to SEQ ID NO: 17373

SEQ ID NO: 29255 - DNA, 16 bp, Homo sapiens
cgactcttagcggtgg

SEQ ID NO: 29256 - DNA, 17 bp, Homo sapiens
cgactcttagcggtgga

SEQ ID NO: 29257 - DNA, 18 bp, Homo sapiens
cgactcttagcggtggat

SEQ ID NO: 29258 - DNA, 19 bp, Homo sapiens
cgactcttagcggtggatc

SEQ ID NO: 29259 - DNA, 20 bp, Homo sapiens
cgactcttagcggtggatca

SEQ ID NO: 29260 - DNA, 21 bp, Homo sapiens
cgactcttagcggtggatcac

SEQ ID NO: 29261 - DNA, 22 bp, Homo sapiens
cgactcttagcggtggatcact

SEQ ID NO: 29262 - DNA, 23 bp, Homo sapiens
cgactcttagcggtggatcactc

SEQ ID NO: 29263 - DNA, 24 bp, Homo sapiens
cgactcttagcggtggatcactcg

SEQ ID NO: 29264 - DNA, 25 bp, Homo sapiens
cgactcttagcggtggatcactcgg

SEQ ID NO: 29265 - DNA, 26 bp, Homo sapiens
cgactcttagcggtggatcactcggc

SEQ ID NO: 29266 - DNA, 27 bp, Homo sapiens
cgactcttagcggtggatcactcggct

SEQ ID NO: 29267 - DNA, 28 bp, Homo sapiens
cgactcttagcggtggatcactcggctc

SEQ ID NO: 29268 - DNA, 29 bp, Homo sapiens
cgactcttagcggtggatcactcggctcg

SEQ ID NO: 29269 - DNA, 30 bp, Homo sapiens; identical to SEQ ID NO: 3579

SEQ ID NO: 29270 - DNA, 16 bp, Homo sapiens
gactcttagcggtgga

SEQ ID NO: 29271 - DNA, 17 bp, Homo sapiens
gactcttagcggtggat

SEQ ID NO: 29272 - DNA, 18 bp, Homo sapiens
gactcttagcggtggatc

SEQ ID NO: 29273 - DNA, 19 bp, Homo sapiens
gactcttagcggtggatca

SEQ ID NO: 29274 - DNA, 20 bp, Homo sapiens
gactcttagcggtggatcac

SEQ ID NO: 29275 - DNA, 21 bp, Homo sapiens
gactcttagcggtggatcact

SEQ ID NO: 29276 - DNA, 22 bp, Homo sapiens
gactcttagcggtggatcactc

SEQ ID NO: 29277 - DNA, 23 bp, Homo sapiens
gactcttagcggtggatcactcg

SEQ ID NO: 29278 - DNA, 24 bp, Homo sapiens
gactcttagcggtggatcactcgg

SEQ ID NO: 29279 - DNA, 25 bp, Homo sapiens
gactcttagcggtggatcactcggc

SEQ ID NO: 29280 - DNA, 26 bp, Homo sapiens
gactcttagcggtggatcactcggct

SEQ ID NO: 29281 - DNA, 29 bp, Homo sapiens
gactcttagcggtggatcactcggctcgt

SEQ ID NO: 29282 - DNA, 30 bp, Homo sapiens; identical to SEQ ID NO: 3590

SEQ ID NO: 29283 - DNA, 17 bp, Homo sapiens
actcttagcggtggatc

SEQ ID NO: 29284 - DNA, 23 bp, Homo sapiens
actcttagcggtggatcactcgg

SEQ ID NO: 29285 - DNA, 24 bp, Homo sapiens
actcttagcggtggatcactcggc

SEQ ID NO: 29286 - DNA, 25 bp, Homo sapiens
actcttagcggtggatcactcggct

SEQ ID NO: 29287 - DNA, 28 bp, Homo sapiens
actcttagcggtggatcactcggctcgt

SEQ ID NO: 29288 - DNA, 30 bp, Homo sapiens
actcttagcggtggatcactcggctcgtgc

SEQ ID NO: 29289 - DNA, 23 bp, Homo sapiens
ctcttagcggtggatcactcggc

SEQ ID NO: 29290 - DNA, 30 bp, Homo sapiens
ctcttagcggtggatcactcggctcgtgcg

SEQ ID NO: 29291 - DNA, 24 bp, Homo sapiens
gcggtggatcactcggctcgtgcg

SEQ ID NO: 29292 - DNA, 20 bp, Homo sapiens
cggtggatcactcggctcgt

SEQ ID NO: 29293 - DNA, 21 bp, Homo sapiens
cggtggatcactcggctcgtg

SEQ ID NO: 29294 - DNA, 22 bp, Homo sapiens
cggtggatcactcggctcgtgc

SEQ ID NO: 29295 - DNA, 23 bp, Homo sapiens
cggtggatcactcggctcgtgcg

SEQ ID NO: 29296 - DNA, 24 bp, Homo sapiens
cggtggatcactcggctcgtgcgt

SEQ ID NO: 29297 - DNA, 25 bp, Homo sapiens
cggtggatcactcggctcgtgcgtc

SEQ ID NO: 29298 - DNA, 27 bp, Homo sapiens
cggtggatcactcggctcgtgcgtcga

SEQ ID NO: 29299 - DNA, 29 bp, Homo sapiens
cggtggatcactcggctcgtgcgtcgatg

SEQ ID NO: 29300 - DNA, 21 bp, Homo sapiens
ggtggatcactcggctcgtgc

SEQ ID NO: 29301 - DNA, 20 bp, Homo sapiens
gtggatcactcggctcgtgc

SEQ ID NO: 29302 - DNA, 21 bp, Homo sapiens
gtggatcactcggctcgtgcg

SEQ ID NO: 29303 - DNA, 22 bp, Homo sapiens
gtggatcactcggctcgtgcgt

SEQ ID NO: 29304 - DNA, 23 bp, Homo sapiens
gtggatcactcggctcgtgcgtc

SEQ ID NO: 29305 - DNA, 24 bp, Homo sapiens
gtggatcactcggctcgtgcgtcg

SEQ ID NO: 29306 - DNA, 19 bp, Homo sapiens
tggatcactcggctcgtgc

SEQ ID NO: 29307 - DNA, 20 bp, Homo sapiens
tggatcactcggctcgtgcg

SEQ ID NO: 29308 - DNA, 21 bp, Homo sapiens
tggatcactcggctcgtgcgt

SEQ ID NO: 29309 - DNA, 22 bp, Homo sapiens
tggatcactcggctcgtgcgtc

SEQ ID NO: 29310 - DNA, 23 bp, Homo sapiens
tggatcactcggctcgtgcgtcg

SEQ ID NO: 29311 - DNA, 24 bp, Homo sapiens
tggatcactcggctcgtgcgtcga

SEQ ID NO: 29312 - DNA, 22 bp, Homo sapiens
gatgaagaacgcagctagctgc

SEQ ID NO: 29313 - DNA, 22 bp, Homo sapiens
agaattaatgtgaattgcagga

SEQ ID NO: 29314 - DNA, 23 bp, Homo sapiens
agaattaatgtgaattgcaggac

SEQ ID NO: 29315 - DNA, 24 bp, Homo sapiens
agaattaatgtgaattgcaggaca

SEQ ID NO: 29316 - DNA, 21 bp, Homo sapiens
gaattaatgtgaattgcagga

SEQ ID NO: 29317 - DNA, 22 bp, Homo sapiens
gaattaatgtgaattgcaggac

SEQ ID NO: 29318 - DNA, 23 bp, Homo sapiens
gaattaatgtgaattgcaggaca

SEQ ID NO: 29319 - DNA, 24 bp, Homo sapiens
gaattaatgtgaattgcaggacac

SEQ ID NO: 29320 - DNA, 19 bp, Homo sapiens
attaatgtgaattgcagga

SEQ ID NO: 29321 - DNA, 20 bp, Homo sapiens
attaatgtgaattgcaggac

SEQ ID NO: 29322 - DNA, 21 bp, Homo sapiens
attaatgtgaattgcaggaca

SEQ ID NO: 29323 - DNA, 22 bp, Homo sapiens
attaatgtgaattgcaggacac

SEQ ID NO: 29324 - DNA, 19 bp, Homo sapiens
ttaatgtgaattgcaggac

SEQ ID NO: 29325 - DNA, 20 bp, Homo sapiens
ttaatgtgaattgcaggaca

SEQ ID NO: 29326 - DNA, 24 bp, Homo sapiens
tgtgaattgcaggacacattgatc

SEQ ID NO: 29327 - DNA, 30 bp, Homo sapiens
tgtgaattgcaggacacattgatcatcgac

SEQ ID NO: 29328 - DNA, 29 bp, Homo sapiens
gtgaattgcaggacacattgatcatcgac

SEQ ID NO: 29329 - DNA, 30 bp, Homo sapiens; identical to SEQ ID NO: 17602

SEQ ID NO: 29330 - DNA, 30 bp, Homo sapiens
acacattgatcatcgacacttcgaacgcac

SEQ ID NO: 29331 - DNA, 25 bp, Homo sapiens
cacattgatcatcgacacttcgaac

SEQ ID NO: 29332 - DNA, 27 bp, Homo sapiens
cacattgatcatcgacacttcgaacgc

SEQ ID NO: 29333 - DNA, 30 bp, Homo sapiens; identical to SEQ ID NO: 17736

SEQ ID NO: 29334 - DNA, 16 bp, Homo sapiens
acattgatcatcgaca

SEQ ID NO: 29335 - DNA, 20 bp, Homo sapiens
acattgatcatcgacacttc

SEQ ID NO: 29336 - DNA, 22 bp, Homo sapiens
acattgatcatcgacacttcga

SEQ ID NO: 29337 - DNA, 24 bp, Homo sapiens
acattgatcatcgacacttcgaac

SEQ ID NO: 29338 - DNA, 26 bp, Homo sapiens
acattgatcatcgacacttcgaacgc

SEQ ID NO: 29339 - DNA, 27 bp, Homo sapiens
acattgatcatcgacacttcgaacgca

SEQ ID NO: 29340 - DNA, 30 bp, Homo sapiens; identical to SEQ ID NO: 3670

SEQ ID NO: 29341 - DNA, 19 bp, Homo sapiens
cattgatcatcgacacttc

SEQ ID NO: 29342 - DNA, 21 bp, Homo sapiens
cattgatcatcgacacttcga

SEQ ID NO: 29343 - DNA, 23 bp, Homo sapiens
cattgatcatcgacacttcgaac

SEQ ID NO: 29344 - DNA, 25 bp, Homo sapiens
cattgatcatcgacacttcgaacgc

SEQ ID NO: 29345 - DNA, 26 bp, Homo sapiens
cattgatcatcgacacttcgaacgca

SEQ ID NO: 29346 - DNA, 30 bp, Homo sapiens; identical to SEQ ID NO: 17772

SEQ ID NO: 29347 - DNA, 20 bp, Homo sapiens
attgatcatcgacacttcga

SEQ ID NO: 29348 - DNA, 22 bp, Homo sapiens
attgatcatcgacacttcgaac

SEQ ID NO: 29349 - DNA, 24 bp, Homo sapiens
attgatcatcgacacttcgaacgc

SEQ ID NO: 29350 - DNA, 25 bp, Homo sapiens
attgatcatcgacacttcgaacgca

SEQ ID NO: 29351 - DNA, 26 bp, Homo sapiens
attgatcatcgacacttcgaacgcac

SEQ ID NO: 29352 - DNA, 30 bp, Homo sapiens; identical to SEQ ID NO: 17788

SEQ ID NO: 29353 - DNA, 21 bp, Homo sapiens
ttgatcatcgacacttcgaac

SEQ ID NO: 29354 - DNA, 23 bp, Homo sapiens
ttgatcatcgacacttcgaacgc

SEQ ID NO: 29355 - DNA, 30 bp, Homo sapiens
ttgatcatcgacacttcgaacgcacttgcg

SEQ ID NO: 29356 - DNA, 22 bp, Homo sapiens
tgatcatcgacacttcgaacgc

SEQ ID NO: 29357 - DNA, 19 bp, Homo sapiens
gatcatcgacacttcgaac

SEQ ID NO: 29358 - DNA, 21 bp, Homo sapiens
gatcatcgacacttcgaacgc

SEQ ID NO: 29359 - DNA, 22 bp, Homo sapiens
gatcatcgacacttcgaacgca

SEQ ID NO: 29360 - DNA, 30 bp, Homo sapiens
gatcatcgacacttcgaacgcacttgcggc

SEQ ID NO: 29361 - DNA, 23 bp, Homo sapiens
gacacttcgaacgcacttgcggc

SEQ ID NO: 29362 - DNA, 30 bp, Homo sapiens
gaacgcacttgcggccccgggttcctcccg

SEQ ID NO: 29363 - DNA, 30 bp, Homo sapiens; identical to SEQ ID NO: 3739

SEQ ID NO: 29364 - DNA, 22 bp, Homo sapiens
cccggggctacgcctgtctgag

SEQ ID NO: 29365 - DNA, 23 bp, Homo sapiens
gctacgcctgtctgagcgtcgct

SEQ ID NO: 29366 - DNA, 22 bp, Homo sapiens
ctacgcctgtctgagcgtcgct

SEQ ID NO: 29367 - DNA, 21 bp, Homo sapiens
tacgcctgtctgagcgtcgct

SEQ ID NO: 29368 - DNA, 20 bp, Homo sapiens
acgcctgtctgagcgtcgct

SEQ ID NO: 29369 - DNA, 18 bp, Homo sapiens
cgcctgtctgagcgtcgc

SEQ ID NO: 29370 - DNA, 19 bp, Homo sapiens
cgcctgtctgagcgtcgct

SEQ ID NO: 29371 - DNA, 20 bp, Homo sapiens
cgcctgtctgagcgtcgctt

SEQ ID NO: 29372 - DNA, 18 bp, Homo sapiens
gcctgtctgagcgtcgct

SEQ ID NO: 29373 - DNA, 19 bp, Homo sapiens
gcctgtctgagcgtcgctt

SEQ ID NO: 29374 - DNA, 16 bp, Homo sapiens
cctgtctgagcgtcgc

SEQ ID NO: 29375 - DNA, 17 bp, Homo sapiens
cctgtctgagcgtcgct

SEQ ID NO: 29376 - DNA, 18 bp, Homo sapiens
cctgtctgagcgtcgctt

SEQ ID NO: 29377 - DNA, 16 bp, Homo sapiens
ctgtctgagcgtcgct

SEQ ID NO: 29378 - DNA, 17 bp, Homo sapiens
ctgtctgagcgtcgctt

SEQ ID NO: 29379 - DNA, 19 bp, Homo sapiens
ctgtctgagcgtcgcttgc

SEQ ID NO: 29380 - DNA, 16 bp, Homo sapiens
tgtctgagcgtcgctt

SEQ ID NO: 29381 - DNA, 21 bp, Homo sapiens
cggtggcggcccggcgtccgg

SEQ ID NO: 29382 - DNA, 19 bp, Homo sapiens
gacgcgacctcagatcaga

SEQ ID NO: 29383 - DNA, 22 bp, Homo sapiens
gacgcgacctcagatcagacgt

SEQ ID NO: 29384 - DNA, 24 bp, Homo sapiens
gacgcgacctcagatcagacgtgg

SEQ ID NO: 29385 - DNA, 25 bp, Homo sapiens
gacgcgacctcagatcagacgtggc

SEQ ID NO: 29386 - DNA, 30 bp, Homo sapiens; identical to SEQ ID NO: 3832

SEQ ID NO: 29387 - DNA, 17 bp, Homo sapiens
acgcgacctcagatcag

SEQ ID NO: 29388 - DNA, 18 bp, Homo sapiens
acgcgacctcagatcaga

SEQ ID NO: 29389 - DNA, 19 bp, Homo sapiens
acgcgacctcagatcagac

SEQ ID NO: 29390 - DNA, 20 bp, Homo sapiens
acgcgacctcagatcagacg

SEQ ID NO: 29391 - DNA, 21 bp, Homo sapiens
acgcgacctcagatcagacgt

SEQ ID NO: 29392 - DNA, 23 bp, Homo sapiens
acgcgacctcagatcagacgtgg

SEQ ID NO: 29393 - DNA, 24 bp, Homo sapiens
acgcgacctcagatcagacgtggc

SEQ ID NO: 29394 - DNA, 25 bp, Homo sapiens
acgcgacctcagatcagacgtggcg

SEQ ID NO: 29395 - DNA, 30 bp, Homo sapiens; identical to SEQ ID NO: 3848

SEQ ID NO: 29396 - DNA, 16 bp, Homo sapiens
cgcgacctcagatcag

SEQ ID NO: 29397 - DNA, 17 bp, Homo sapiens
cgcgacctcagatcaga

SEQ ID NO: 29398 - DNA, 18 bp, Homo sapiens
cgcgacctcagatcagac

SEQ ID NO: 29399 - DNA, 19 bp, Homo sapiens
cgcgacctcagatcagacg

SEQ ID NO: 29400 - DNA, 20 bp, Homo sapiens
cgcgacctcagatcagacgt

SEQ ID NO: 29401 - DNA, 21 bp, Homo sapiens
cgcgacctcagatcagacgtg

SEQ ID NO: 29402 - DNA, 22 bp, Homo sapiens
cgcgacctcagatcagacgtgg

SEQ ID NO: 29403 - DNA, 23 bp, Homo sapiens
cgcgacctcagatcagacgtggc

SEQ ID NO: 29404 - DNA, 24 bp, Homo sapiens
cgcgacctcagatcagacgtggcg

SEQ ID NO: 29405 - DNA, 25 bp, Homo sapiens
cgcgacctcagatcagacgtggcga

SEQ ID NO: 29406 - DNA, 26 bp, Homo sapiens
cgcgacctcagatcagacgtggcgac

SEQ ID NO: 29407 - DNA, 27 bp, Homo sapiens
cgcgacctcagatcagacgtggcgacc

SEQ ID NO: 29408 - DNA, 28 bp, Homo sapiens
cgcgacctcagatcagacgtggcgaccc

SEQ ID NO: 29409 - DNA, 29 bp, Homo sapiens
cgcgacctcagatcagacgtggcgacccg

SEQ ID NO: 29410 - DNA, 30 bp, Homo sapiens; identical to SEQ ID NO: 3865

SEQ ID NO: 29411 - DNA, 16 bp, Homo sapiens
gcgacctcagatcaga

SEQ ID NO: 29412 - DNA, 18 bp, Homo sapiens
gcgacctcagatcagacg

SEQ ID NO: 29413 - DNA, 19 bp, Homo sapiens
gcgacctcagatcagacgt

SEQ ID NO: 29414 - DNA, 20 bp, Homo sapiens
gcgacctcagatcagacgtg

SEQ ID NO: 29415 - DNA, 21 bp, Homo sapiens
gcgacctcagatcagacgtgg

SEQ ID NO: 29416 - DNA, 22 bp, Homo sapiens
gcgacctcagatcagacgtggc

SEQ ID NO: 29417 - DNA, 23 bp, Homo sapiens
gcgacctcagatcagacgtggcg

SEQ ID NO: 29418 - DNA, 24 bp, Homo sapiens
gcgacctcagatcagacgtggcga

SEQ ID NO: 29419 - DNA, 29 bp, Homo sapiens
gcgacctcagatcagacgtggcgacccgc

SEQ ID NO: 29420 - DNA, 30 bp, Homo sapiens; identical to SEQ ID NO: 3876

SEQ ID NO: 29421 - DNA, 19 bp, Homo sapiens
cgacctcagatcagacgtg

SEQ ID NO: 29422 - DNA, 20 bp, Homo sapiens
cgacctcagatcagacgtgg

SEQ ID NO: 29423 - DNA, 21 bp, Homo sapiens
cgacctcagatcagacgtggc

SEQ ID NO: 29424 - DNA, 22 bp, Homo sapiens
cgacctcagatcagacgtggcg

SEQ ID NO: 29425 - DNA, 23 bp, Homo sapiens
cgacctcagatcagacgtggcga

SEQ ID NO: 29426 - DNA, 24 bp, Homo sapiens
cgacctcagatcagacgtggcgac

SEQ ID NO: 29427 - DNA, 25 bp, Homo sapiens
cgacctcagatcagacgtggcgacc

SEQ ID NO: 29428 - DNA, 27 bp, Homo sapiens
cgacctcagatcagacgtggcgacccg

SEQ ID NO: 29429 - DNA, 28 bp, Homo sapiens
cgacctcagatcagacgtggcgacccgc

SEQ ID NO: 29430 - DNA, 30 bp, Homo sapiens; identical to SEQ ID NO: 3888

SEQ ID NO: 29431 - DNA, 19 bp, Homo sapiens
gacctcagatcagacgtgg

SEQ ID NO: 29432 - DNA, 20 bp, Homo sapiens
gacctcagatcagacgtggc

SEQ ID NO: 29433 - DNA, 21 bp, Homo sapiens
gacctcagatcagacgtggcg

SEQ ID NO: 29434 - DNA, 22 bp, Homo sapiens
gacctcagatcagacgtggcga

SEQ ID NO: 29435 - DNA, 24 bp, Homo sapiens
gacctcagatcagacgtggcgacc

SEQ ID NO: 29436 - DNA, 26 bp, Homo sapiens
gacctcagatcagacgtggcgacccg

SEQ ID NO: 29437 - DNA, 27 bp, Homo sapiens
gacctcagatcagacgtggcgacccgc

SEQ ID NO: 29438 - DNA, 18 bp, Homo sapiens
acctcagatcagacgtgg

SEQ ID NO: 29439 - DNA, 20 bp, Homo sapiens
acctcagatcagacgtggcg

SEQ ID NO: 29440 - DNA, 21 bp, Homo sapiens
acctcagatcagacgtggcga

SEQ ID NO: 29441 - DNA, 22 bp, Homo sapiens
acctcagatcagacgtggcgac

SEQ ID NO: 29442 - DNA, 23 bp, Homo sapiens
acctcagatcagacgtggcgacc

SEQ ID NO: 29443 - DNA, 24 bp, Homo sapiens
acctcagatcagacgtggcgaccc

SEQ ID NO: 29444 - DNA, 25 bp, Homo sapiens
acctcagatcagacgtggcgacccg

SEQ ID NO: 29445 - DNA, 26 bp, Homo sapiens
acctcagatcagacgtggcgacccgc

SEQ ID NO: 29446 - DNA, 29 bp, Homo sapiens
acctcagatcagacgtggcgacccgctga

SEQ ID NO: 29447 - DNA, 17 bp, Homo sapiens
cctcagatcagacgtgg

SEQ ID NO: 29448 - DNA, 18 bp, Homo sapiens
cctcagatcagacgtggc

SEQ ID NO: 29449 - DNA, 19 bp, Homo sapiens
cctcagatcagacgtggcg

SEQ ID NO: 29450 - DNA, 20 bp, Homo sapiens
cctcagatcagacgtggcga

SEQ ID NO: 29451 - DNA, 21 bp, Homo sapiens
cctcagatcagacgtggcgac

SEQ ID NO: 29452 - DNA, 22 bp, Homo sapiens
cctcagatcagacgtggcgacc

SEQ ID NO: 29453 - DNA, 23 bp, Homo sapiens
cctcagatcagacgtggcgaccc

SEQ ID NO: 29454 - DNA, 24 bp, Homo sapiens
cctcagatcagacgtggcgacccg

SEQ ID NO: 29455 - DNA, 25 bp, Homo sapiens
cctcagatcagacgtggcgacccgc

SEQ ID NO: 29456 - DNA, 16 bp, Homo sapiens
ctcagatcagacgtgg

SEQ ID NO: 29457 - DNA, 17 bp, Homo sapiens
ctcagatcagacgtggc

SEQ ID NO: 29458 - DNA, 18 bp, Homo sapiens
ctcagatcagacgtggcg

SEQ ID NO: 29459 - DNA, 19 bp, Homo sapiens
ctcagatcagacgtggcga

SEQ ID NO: 29460 - DNA, 23 bp, Homo sapiens
ctcagatcagacgtggcgacccg

SEQ ID NO: 29461 - DNA, 24 bp, Homo sapiens
ctcagatcagacgtggcgacccgc

SEQ ID NO: 29462 - DNA, 25 bp, Homo sapiens
ctcagatcagacgtggcgacccgct

SEQ ID NO: 29463 - DNA, 23 bp, Homo sapiens
tcagatcagacgtggcgacccgc

SEQ ID NO: 29464 - DNA, 24 bp, Homo sapiens
tcagatcagacgtggcgacccgct

SEQ ID NO: 29465 - DNA, 22 bp, Homo sapiens
cagatcagacgtggcgacccgc

SEQ ID NO: 29466 - DNA, 22 bp, Homo sapiens
atcagacgtggcgacccgctga

SEQ ID NO: 29467 - DNA, 20 bp, Homo sapiens
cagacgtggcgacccgctga

SEQ ID NO: 29468 - DNA, 22 bp, Homo sapiens
gacgtggcgacccgctgaattt

SEQ ID NO: 29469 - DNA, 22 bp, Homo sapiens
agagcccagcgccgaatccccg

SEQ ID NO: 29470 - DNA, 23 bp, Homo sapiens
agagcccagcgccgaatccccgc

SEQ ID NO: 29471 - DNA, 19 bp, Homo sapiens
gagcccagcgccgaatccc

SEQ ID NO: 29472 - DNA, 20 bp, Homo sapiens
gagcccagcgccgaatcccc

SEQ ID NO: 29473 - DNA, 21 bp, Homo sapiens
gagcccagcgccgaatccccg

SEQ ID NO: 29474 - DNA, 22 bp, Homo sapiens
gagcccagcgccgaatccccgc

SEQ ID NO: 29475 - DNA, 23 bp, Homo sapiens
gagcccagcgccgaatccccgcc

SEQ ID NO: 29476 - DNA, 24 bp, Homo sapiens
gagcccagcgccgaatccccgccc

SEQ ID NO: 29477 - DNA, 19 bp, Homo sapiens
agcccagcgccgaatcccc

SEQ ID NO: 29478 - DNA, 20 bp, Homo sapiens
agcccagcgccgaatccccg

SEQ ID NO: 29479 - DNA, 21 bp, Homo sapiens
agcccagcgccgaatccccgc

SEQ ID NO: 29480 - DNA, 20 bp, Homo sapiens
gcggggcgcgggacatgtgg

SEQ ID NO: 29481 - DNA, 23 bp, Homo sapiens
catgtggcgtacggaagacccgc

SEQ ID NO: 29482 - DNA, 19 bp, Homo sapiens
cccgctccccggcgccgct

SEQ ID NO: 29483 - DNA, 21 bp, Homo sapiens
gggcccaagtccttctgatcg

SEQ ID NO: 29484 - DNA, 24 bp, Homo sapiens
gggcccaagtccttctgatcgagg

SEQ ID NO: 29485 - DNA, 20 bp, Homo sapiens
ggcccaagtccttctgatcg

SEQ ID NO: 29486 - DNA, 23 bp, Homo sapiens
cccaagtccttctgatcgaggcc

SEQ ID NO: 29487 - DNA, 24 bp, Homo sapiens
cccaagtccttctgatcgaggccc

SEQ ID NO: 29488 - DNA, 21 bp, Homo sapiens
ccaagtccttctgatcgaggc

SEQ ID NO: 29489 - DNA, 22 bp, Homo sapiens
ccaagtccttctgatcgaggcc

SEQ ID NO: 29490 - DNA, 23 bp, Homo sapiens
ccaagtccttctgatcgaggccc

SEQ ID NO: 29491 - DNA, 21 bp, Homo sapiens
caagtccttctgatcgaggcc

SEQ ID NO: 29492 - DNA, 22 bp, Homo sapiens
caagtccttctgatcgaggccc

SEQ ID NO: 29493 - DNA, 16 bp, Homo sapiens
cttctgatcgaggccc

SEQ ID NO: 29494 - DNA, 29 bp, Homo sapiens
gatcgaggcccagcccgtggacggtgtga

SEQ ID NO: 29495 - DNA, 26 bp, Homo sapiens
cgaggcccagcccgtggacggtgtga

SEQ ID NO: 29496 - DNA, 24 bp, Homo sapiens
gaggcccagcccgtggacggtgtg

SEQ ID NO: 29497 - DNA, 25 bp, Homo sapiens
gaggcccagcccgtggacggtgtga

SEQ ID NO: 29498 - DNA, 26 bp, Homo sapiens
gaggcccagcccgtggacggtgtgag

SEQ ID NO: 29499 - DNA, 21 bp, Homo sapiens
aggcccagcccgtggacggtg

SEQ ID NO: 29500 - DNA, 23 bp, Homo sapiens
aggcccagcccgtggacggtgtg

SEQ ID NO: 29501 - DNA, 24 bp, Homo sapiens
aggcccagcccgtggacggtgtga

SEQ ID NO: 29502 - DNA, 25 bp, Homo sapiens
aggcccagcccgtggacggtgtgag

SEQ ID NO: 29503 - DNA, 27 bp, Homo sapiens
aggcccagcccgtggacggtgtgaggc

SEQ ID NO: 29504 - DNA, 22 bp, Homo sapiens
ggcccagcccgtggacggtgtg

SEQ ID NO: 29505 - DNA, 23 bp, Homo sapiens
ggcccagcccgtggacggtgtga

SEQ ID NO: 29506 - DNA, 24 bp, Homo sapiens
ggcccagcccgtggacggtgtgag

SEQ ID NO: 29507 - DNA, 22 bp, Homo sapiens
gcccagcccgtggacggtgtga

SEQ ID NO: 29508 - DNA, 21 bp, Homo sapiens
cccagcccgtggacggtgtga

SEQ ID NO: 29509 - DNA, 22 bp, Homo sapiens
ttcccggagtcgggttgcttgg

SEQ ID NO: 29510 - DNA, 23 bp, Homo sapiens
ttcccggagtcgggttgcttggg

SEQ ID NO: 29511 - DNA, 24 bp, Homo sapiens
ttcccggagtcgggttgcttggga

SEQ ID NO: 29512 - DNA, 21 bp, Homo sapiens
gctaaataccggcacgagacc

SEQ ID NO: 29513 - DNA, 17 bp, Homo sapiens
tgaaaagaactttgaag

SEQ ID NO: 29514 - DNA, 19 bp, Homo sapiens
tgaaaagaactttgaagag

SEQ ID NO: 29515 - DNA, 20 bp, Homo sapiens
tgaaaagaactttgaagaga

SEQ ID NO: 29516 - DNA, 21 bp, Homo sapiens
tgaaaagaactttgaagagag

SEQ ID NO: 29517 - DNA, 22 bp, Homo sapiens
tgaaaagaactttgaagagaga

SEQ ID NO: 29518 - DNA, 23 bp, Homo sapiens
tgaaaagaactttgaagagagag

SEQ ID NO: 29519 - DNA, 24 bp, Homo sapiens
tgaaaagaactttgaagagagagt

SEQ ID NO: 29520 - DNA, 25 bp, Homo sapiens
tgaaaagaactttgaagagagagtt

SEQ ID NO: 29521 - DNA, 29 bp, Homo sapiens
tgaaaagaactttgaagagagagttcaag

SEQ ID NO: 29522 - DNA, 20 bp, Homo sapiens
gaaaagaactttgaagagag

SEQ ID NO: 29523 - DNA, 21 bp, Homo sapiens
gaaaagaactttgaagagaga

SEQ ID NO: 29524 - DNA, 22 bp, Homo sapiens
gaaaagaactttgaagagagag

SEQ ID NO: 29525 - DNA, 23 bp, Homo sapiens
gaaaagaactttgaagagagagt

SEQ ID NO: 29526 - DNA, 19 bp, Homo sapiens
aaaagaactttgaagagag

SEQ ID NO: 29527 - DNA, 20 bp, Homo sapiens
aaaagaactttgaagagaga

SEQ ID NO: 29528 - DNA, 21 bp, Homo sapiens
aaaagaactttgaagagagag

SEQ ID NO: 29529 - DNA, 22 bp, Homo sapiens
aaaagaactttgaagagagagt

SEQ ID NO: 29530 - DNA, 18 bp, Homo sapiens
aaagaactttgaagagag

SEQ ID NO: 29531 - DNA, 19 bp, Homo sapiens
aaagaactttgaagagaga

SEQ ID NO: 29532 - DNA, 20 bp, Homo sapiens
aaagaactttgaagagagag

SEQ ID NO: 29533 - DNA, 21 bp, Homo sapiens
aaagaactttgaagagagagt

SEQ ID NO: 29534 - DNA, 17 bp, Homo sapiens
aagaactttgaagagag

SEQ ID NO: 29535 - DNA, 18 bp, Homo sapiens
aagaactttgaagagaga

SEQ ID NO: 29536 - DNA, 19 bp, Homo sapiens
aagaactttgaagagagag

SEQ ID NO: 29537 - DNA, 20 bp, Homo sapiens
aagaactttgaagagagagt

SEQ ID NO: 29538 - DNA, 19 bp, Homo sapiens
agaactttgaagagagagt

SEQ ID NO: 29539 - DNA, 18 bp, Homo sapiens
gaactttgaagagagagt

SEQ ID NO: 29540 - DNA, 24 bp, Homo sapiens
gagggcgtgaaaccgttaagaggt

SEQ ID NO: 29541 - DNA, 23 bp, Homo sapiens
agggcgtgaaaccgttaagaggt

SEQ ID NO: 29542 - DNA, 22 bp, Homo sapiens
gggcgtgaaaccgttaagaggt

SEQ ID NO: 29543 - DNA, 19 bp, Homo sapiens
cgtgaaaccgttaagaggt

SEQ ID NO: 29544 - DNA, 18 bp, Homo sapiens
gtgaaaccgttaagaggt

SEQ ID NO: 29545 - DNA, 19 bp, Homo sapiens
ggtccggccgtgtcggcgg

SEQ ID NO: 29546 - DNA, 20 bp, Homo sapiens
ggtccggccgtgtcggcggc

SEQ ID NO: 29547 - DNA, 18 bp, Homo sapiens
gtccggccgtgtcggcgg

SEQ ID NO: 29548 - DNA, 19 bp, Homo sapiens
gtccggccgtgtcggcggc

SEQ ID NO: 29549 - DNA, 17 bp, Homo sapiens
tccggccgtgtcggcgg

SEQ ID NO: 29550 - DNA, 16 bp, Homo sapiens
ccggccgtgtcggcgg

SEQ ID NO: 29551 - DNA, 20 bp, Homo sapiens
cccgccctcccttcccccgc

SEQ ID NO: 29552 - DNA, 21 bp, Homo sapiens
ccccgccgcccctcctcctcc

SEQ ID NO: 29553 - DNA, 22 bp, Homo sapiens
ccccgccgcccctcctcctcct

SEQ ID NO: 29554 - DNA, 20 bp, Homo sapiens
cccgccgcccctcctcctcc

SEQ ID NO: 29555 - DNA, 21 bp, Homo sapiens
cccgccgcccctcctcctcct

SEQ ID NO: 29556 - DNA, 25 bp, Homo sapiens
cccgccgcccctcctcctcctcccc

SEQ ID NO: 29557 - DNA, 22 bp, Homo sapiens
ggagggggcgggctccggcggg

SEQ ID NO: 29558 - DNA, 23 bp, Homo sapiens
ggagggggcgggctccggcgggt

SEQ ID NO: 29559 - DNA, 20 bp, Homo sapiens
ggcgggtgcgggggtgggcg

SEQ ID NO: 29560 - DNA, 20 bp, Homo sapiens
ggggaccgtcccccgaccgg

SEQ ID NO: 29561 - DNA, 18 bp, Homo sapiens
ggaccgtcccccgaccgg

SEQ ID NO: 29562 - DNA, 21 bp, Homo sapiens
cgtcccccgaccggcgaccgg

SEQ ID NO: 29563 - DNA, 20 bp, Homo sapiens
ggcgaccggccgccgccggg

SEQ ID NO: 29564 - DNA, 21 bp, Homo sapiens
gcggcggtgcgccgcgaccgg

SEQ ID NO: 29565 - DNA, 20 bp, Homo sapiens
cggcggtgcgccgcgaccgg

SEQ ID NO: 29566 - DNA, 19 bp, Homo sapiens
ggcggtgcgccgcgaccgg

SEQ ID NO: 29567 - DNA, 18 bp, Homo sapiens
cgccgcgaccggctccgg

SEQ ID NO: 29568 - DNA, 19 bp, Homo sapiens
cgccgcgaccggctccggg

SEQ ID NO: 29569 - DNA, 21 bp, Homo sapiens
cgccgcgaccggctccgggac

SEQ ID NO: 29570 - DNA, 27 bp, Homo sapiens
ccgcgaccggctccgggacggctggga

SEQ ID NO: 29571 - DNA, 19 bp, Homo sapiens
aaggcccggcggggaaggt

SEQ ID NO: 29572 - DNA, 24 bp, Homo sapiens
ggcggggaaggtggctcggggggc

SEQ ID NO: 29573 - DNA, 19 bp, Homo sapiens
gtccgtccgtccgtccgtc

SEQ ID NO: 29574 - DNA, 20 bp, Homo sapiens
gtccgtccgtccgtccgtcc

SEQ ID NO: 29575 - DNA, 19 bp, Homo sapiens
cccgtctccgccccccggc

SEQ ID NO: 29576 - DNA, 20 bp, Homo sapiens
cccgtctccgccccccggcc

SEQ ID NO: 29577 - DNA, 21 bp, Homo sapiens
cccgtctccgccccccggccc

SEQ ID NO: 29578 - DNA, 19 bp, Homo sapiens
ccgtctccgccccccggcc

SEQ ID NO: 29579 - DNA, 20 bp, Homo sapiens
ccgtctccgccccccggccc

SEQ ID NO: 29580 - DNA, 21 bp, Homo sapiens
ccgtctccgccccccggcccc

SEQ ID NO: 29581 - DNA, 18 bp, Homo sapiens
cgtctccgccccccggcc

SEQ ID NO: 29582 - DNA, 19 bp, Homo sapiens
cgtctccgccccccggccc

SEQ ID NO: 29583 - DNA, 23 bp, Homo sapiens
cgtctccgccccccggccccgcg

SEQ ID NO: 29584 - DNA, 25 bp, Homo sapiens
cgtctccgccccccggccccgcgtc

SEQ ID NO: 29585 - DNA, 20 bp, Homo sapiens
ccgccccccggccccgcgtc

SEQ ID NO: 29586 - DNA, 25 bp, Homo sapiens
ccgccccccggccccgcgtcctccc

SEQ ID NO: 29587 - DNA, 18 bp, Homo sapiens
gccccccggccccgcgtc

SEQ ID NO: 29588 - DNA, 23 bp, Homo sapiens
gccccccggccccgcgtcctccc

SEQ ID NO: 29589 - DNA, 22 bp, Homo sapiens
ccccccggccccgcgtcctccc

SEQ ID NO: 29590 - DNA, 21 bp, Homo sapiens
cccccggccccgcgtcctccc

SEQ ID NO: 29591 - DNA, 20 bp, Homo sapiens
ccccggccccgcgtcctccc

SEQ ID NO: 29592 - DNA, 19 bp, Homo sapiens
cccggccccgcgtcctccc

SEQ ID NO: 29593 - DNA, 18 bp, Homo sapiens
ccggccccgcgtcctccc

SEQ ID NO: 29594 - DNA, 21 bp, Homo sapiens
ctccctcgggagggcgcgcgg

SEQ ID NO: 29595 - DNA, 19 bp, Homo sapiens
agggcgcgcgggtcggggc

SEQ ID NO: 29596 - DNA, 23 bp, Homo sapiens
agggcgcgcgggtcggggcggcg

SEQ ID NO: 29597 - DNA, 25 bp, Homo sapiens
agggcgcgcgggtcggggcggcggc

SEQ ID NO: 29598 - DNA, 18 bp, Homo sapiens
gggcgcgcgggtcggggc

SEQ ID NO: 29599 - DNA, 22 bp, Homo sapiens
gggcgcgcgggtcggggcggcg

SEQ ID NO: 29600 - DNA, 24 bp, Homo sapiens
gggcgcgcgggtcggggcggcggc

SEQ ID NO: 29601 - DNA, 20 bp, Homo sapiens
ggcgcgcgggtcggggcggc

SEQ ID NO: 29602 - DNA, 23 bp, Homo sapiens
ggcgcgcgggtcggggcggcggc

SEQ ID NO: 29603 - DNA, 22 bp, Homo sapiens
gcgcgcgggtcggggcggcggc

SEQ ID NO: 29604 - DNA, 21 bp, Homo sapiens
cgcgcgggtcggggcggcggc

SEQ ID NO: 29605 - DNA, 20 bp, Homo sapiens
gcgcgggtcggggcggcggc

SEQ ID NO: 29606 - DNA, 19 bp, Homo sapiens
cgcgggtcggggcggcggc

SEQ ID NO: 29607 - DNA, 22 bp, Homo sapiens
cgggtcggggcggcggcggcgg

SEQ ID NO: 29608 - DNA, 23 bp, Homo sapiens
cgggtcggggcggcggcggcggc

SEQ ID NO: 29609 - DNA, 21 bp, Homo sapiens
gggtcggggcggcggcggcgg

SEQ ID NO: 29610 - DNA, 22 bp, Homo sapiens
gggtcggggcggcggcggcggc

SEQ ID NO: 29611 - DNA, 19 bp, Homo sapiens
ggtcggggcggcggcggcg

SEQ ID NO: 29612 - DNA, 20 bp, Homo sapiens
ggtcggggcggcggcggcgg

SEQ ID NO: 29613 - DNA, 21 bp, Homo sapiens
ggtcggggcggcggcggcggc

SEQ ID NO: 29614 - DNA, 22 bp, Homo sapiens
ggtcggggcggcggcggcggcg

SEQ ID NO: 29615 - DNA, 23 bp, Homo sapiens
ggtcggggcggcggcggcggcgg

SEQ ID NO: 29616 - DNA, 22 bp, Homo sapiens
gaatcccggggccgagggagcg

SEQ ID NO: 29617 - DNA, 19 bp, Homo sapiens
cggcgcccacccccgcggg

SEQ ID NO: 29618 - DNA, 20 bp, Homo sapiens
cggcgcccacccccgcgggg

SEQ ID NO: 29619 - DNA, 17 bp, Homo sapiens
ggcgcccacccccgcgg

SEQ ID NO: 29620 - DNA, 18 bp, Homo sapiens
ggcgcccacccccgcggg

SEQ ID NO: 29621 - DNA, 19 bp, Homo sapiens
ggcgcccacccccgcgggg

SEQ ID NO: 29622 - DNA, 20 bp, Homo sapiens
ggcgcccacccccgcgggga

SEQ ID NO: 29623 - DNA, 19 bp, Homo sapiens
gcgcccacccccgcgggga

SEQ ID NO: 29624 - DNA, 18 bp, Homo sapiens
cgcccacccccgcgggga

SEQ ID NO: 29625 - DNA, 21 bp, Homo sapiens
cgcccacccccgcggggaatc

SEQ ID NO: 29626 - DNA, 20 bp, Homo sapiens
cccccgcgggggcgcgccgg

SEQ ID NO: 29627 - DNA, 19 bp, Homo sapiens
ccccgcgggggcgcgccgg

SEQ ID NO: 29628 - DNA, 22 bp, Homo sapiens
cgcgcgcgggtcggggggcggg

SEQ ID NO: 29629 - DNA, 23 bp, Homo sapiens
cgcgcgcgggtcggggggcgggg

SEQ ID NO: 29630 - DNA, 24 bp, Homo sapiens
cgcgcgcgggtcggggggcggggc

SEQ ID NO: 29631 - DNA, 21 bp, Homo sapiens
cgcgcgggtcggggggcgggg

SEQ ID NO: 29632 - DNA, 19 bp, Homo sapiens
cgcgggtcggggggcgggg

SEQ ID NO: 29633 - DNA, 20 bp, Homo sapiens
cgcgggtcggggggcggggc

SEQ ID NO: 29634 - DNA, 27 bp, Homo sapiens
cgcgggtcggggggcggggcggactgt

SEQ ID NO: 29635 - DNA, 26 bp, Homo sapiens
gcgggtcggggggcggggcggactgt

SEQ ID NO: 29636 - DNA, 23 bp, Homo sapiens
ggtcggggggcggggcggactgt

SEQ ID NO: 29637 - DNA, 20 bp, Homo sapiens
cggggggcggggcggactgt

SEQ ID NO: 29638 - DNA, 19 bp, Homo sapiens
ggggggcggggcggactgt

SEQ ID NO: 29639 - DNA, 18 bp, Homo sapiens
gggggcggggcggactgt

SEQ ID NO: 29640 - DNA, 30 bp, Homo sapiens; identical to SEQ ID NO: 20009

SEQ ID NO: 29641 - DNA, 21 bp, Homo sapiens
cgggcgggtcgcgccgtcggg

SEQ ID NO: 29642 - DNA, 17 bp, Homo sapiens
gggtcgcgccgtcgggc

SEQ ID NO: 29643 - DNA, 23 bp, Homo sapiens
gggtcgcgccgtcgggcccgggg

SEQ ID NO: 29644 - DNA, 16 bp, Homo sapiens
ggtcgcgccgtcgggc

SEQ ID NO: 29645 - DNA, 17 bp, Homo sapiens
ggtcgcgccgtcgggcc

SEQ ID NO: 29646 - DNA, 19 bp, Homo sapiens
ggtcgcgccgtcgggcccg

SEQ ID NO: 29647 - DNA, 20 bp, Homo sapiens
ggtcgcgccgtcgggcccgg

SEQ ID NO: 29648 - DNA, 21 bp, Homo sapiens
ggtcgcgccgtcgggcccggg

SEQ ID NO: 29649 - DNA, 22 bp, Homo sapiens
ggtcgcgccgtcgggcccgggg

SEQ ID NO: 29650 - DNA, 23 bp, Homo sapiens
ggtcgcgccgtcgggcccggggg

SEQ ID NO: 29651 - DNA, 24 bp, Homo sapiens
ggtcgcgccgtcgggcccggggga

SEQ ID NO: 29652 - DNA, 25 bp, Homo sapiens
ggtcgcgccgtcgggcccgggggag

SEQ ID NO: 29653 - DNA, 26 bp, Homo sapiens
ggtcgcgccgtcgggcccgggggagg

SEQ ID NO: 29654 - DNA, 19 bp, Homo sapiens
gtcgcgccgtcgggcccgg

SEQ ID NO: 29655 - DNA, 20 bp, Homo sapiens
gtcgcgccgtcgggcccggg

SEQ ID NO: 29656 - DNA, 21 bp, Homo sapiens
gtcgcgccgtcgggcccgggg

SEQ ID NO: 29657 - DNA, 22 bp, Homo sapiens
gtcgcgccgtcgggcccggggg

SEQ ID NO: 29658 - DNA, 23 bp, Homo sapiens
gtcgcgccgtcgggcccggggga

SEQ ID NO: 29659 - DNA, 24 bp, Homo sapiens
gtcgcgccgtcgggcccgggggag

SEQ ID NO: 29660 - DNA, 25 bp, Homo sapiens
gtcgcgccgtcgggcccgggggagg

SEQ ID NO: 29661 - DNA, 26 bp, Homo sapiens
gtcgcgccgtcgggcccgggggaggt

SEQ ID NO: 29662 - DNA, 27 bp, Homo sapiens
gtcgcgccgtcgggcccgggggaggtt

SEQ ID NO: 29663 - DNA, 19 bp, Homo sapiens
tcgcgccgtcgggcccggg

SEQ ID NO: 29664 - DNA, 20 bp, Homo sapiens
tcgcgccgtcgggcccgggg

SEQ ID NO: 29665 - DNA, 21 bp, Homo sapiens
tcgcgccgtcgggcccggggg

SEQ ID NO: 29666 - DNA, 22 bp, Homo sapiens
tcgcgccgtcgggcccggggga

SEQ ID NO: 29667 - DNA, 23 bp, Homo sapiens
tcgcgccgtcgggcccgggggag

SEQ ID NO: 29668 - DNA, 24 bp, Homo sapiens
tcgcgccgtcgggcccgggggagg

SEQ ID NO: 29669 - DNA, 25 bp, Homo sapiens
tcgcgccgtcgggcccgggggaggt

SEQ ID NO: 29670 - DNA, 26 bp, Homo sapiens
tcgcgccgtcgggcccgggggaggtt

SEQ ID NO: 29671 - DNA, 18 bp, Homo sapiens
cgcgccgtcgggcccggg

SEQ ID NO: 29672 - DNA, 19 bp, Homo sapiens
cgcgccgtcgggcccgggg

SEQ ID NO: 29673 - DNA, 20 bp, Homo sapiens
cgcgccgtcgggcccggggg

SEQ ID NO: 29674 - DNA, 21 bp, Homo sapiens
cgcgccgtcgggcccggggga

SEQ ID NO: 29675 - DNA, 22 bp, Homo sapiens
cgcgccgtcgggcccgggggag

SEQ ID NO: 29676 - DNA, 23 bp, Homo sapiens
cgcgccgtcgggcccgggggagg

SEQ ID NO: 29677 - DNA, 24 bp, Homo sapiens
cgcgccgtcgggcccgggggaggt

SEQ ID NO: 29678 - DNA, 25 bp, Homo sapiens
cgcgccgtcgggcccgggggaggtt

SEQ ID NO: 29679 - DNA, 16 bp, Homo sapiens
gcgccgtcgggcccgg

SEQ ID NO: 29680 - DNA, 17 bp, Homo sapiens
gcgccgtcgggcccggg

SEQ ID NO: 29681 - DNA, 18 bp, Homo sapiens
gcgccgtcgggcccgggg

SEQ ID NO: 29682 - DNA, 19 bp, Homo sapiens
gcgccgtcgggcccggggg

SEQ ID NO: 29683 - DNA, 20 bp, Homo sapiens
gcgccgtcgggcccggggga

SEQ ID NO: 29684 - DNA, 21 bp, Homo sapiens
gcgccgtcgggcccgggggag

SEQ ID NO: 29685 - DNA, 22 bp, Homo sapiens
gcgccgtcgggcccgggggagg

SEQ ID NO: 29686 - DNA, 23 bp, Homo sapiens
gcgccgtcgggcccgggggaggt

SEQ ID NO: 29687 - DNA, 24 bp, Homo sapiens
gcgccgtcgggcccgggggaggtt

SEQ ID NO: 29688 - DNA, 16 bp, Homo sapiens
cgccgtcgggcccggg

SEQ ID NO: 29689 - DNA, 17 bp, Homo sapiens
cgccgtcgggcccgggg

SEQ ID NO: 29690 - DNA, 18 bp, Homo sapiens
cgccgtcgggcccggggg

SEQ ID NO: 29691 - DNA, 19 bp, Homo sapiens
cgccgtcgggcccggggga

SEQ ID NO: 29692 - DNA, 20 bp, Homo sapiens
cgccgtcgggcccgggggag

SEQ ID NO: 29693 - DNA, 21 bp, Homo sapiens
cgccgtcgggcccgggggagg

SEQ ID NO: 29694 - DNA, 22 bp, Homo sapiens
cgccgtcgggcccgggggaggt

SEQ ID NO: 29695 - DNA, 23 bp, Homo sapiens
cgccgtcgggcccgggggaggtt

SEQ ID NO: 29696 - DNA, 21 bp, Homo sapiens
gccgtcgggcccgggggaggt

SEQ ID NO: 29697 - DNA, 20 bp, Homo sapiens
ccgtcgggcccgggggaggt

SEQ ID NO: 29698 - DNA, 20 bp, Homo sapiens
ctcggggccacgcgcgcgtc

SEQ ID NO: 29699 - DNA, 19 bp, Homo sapiens
tcggggccacgcgcgcgtc

SEQ ID NO: 29700 - DNA, 18 bp, Homo sapiens
cggggccacgcgcgcgtc

SEQ ID NO: 29701 - DNA, 19 bp, Homo sapiens
cgcgcgtcccccgaagagg

SEQ ID NO: 29702 - DNA, 21 bp, Homo sapiens
cgcacggggtcggcggcgacg

SEQ ID NO: 29703 - DNA, 26 bp, Homo sapiens
cgcacggggtcggcggcgacgtcggc

SEQ ID NO: 29704 - DNA, 20 bp, Homo sapiens
gcacggggtcggcggcgacg

SEQ ID NO: 29705 - DNA, 25 bp, Homo sapiens
gcacggggtcggcggcgacgtcggc

SEQ ID NO: 29706 - DNA, 19 bp, Homo sapiens
cacggggtcggcggcgacg

SEQ ID NO: 29707 - DNA, 21 bp, Homo sapiens
cacggggtcggcggcgacgtc

SEQ ID NO: 29708 - DNA, 24 bp, Homo sapiens
cacggggtcggcggcgacgtcggc

SEQ ID NO: 29709 - DNA, 18 bp, Homo sapiens
acggggtcggcggcgacg

SEQ ID NO: 29710 - DNA, 23 bp, Homo sapiens
acggggtcggcggcgacgtcggc

SEQ ID NO: 29711 - DNA, 21 bp, Homo sapiens
cggggtcggcggcgacgtcgg

SEQ ID NO: 29712 - DNA, 22 bp, Homo sapiens
cggggtcggcggcgacgtcggc

SEQ ID NO: 29713 - DNA, 20 bp, Homo sapiens
ggggtcggcggcgacgtcgg

SEQ ID NO: 29714 - DNA, 21 bp, Homo sapiens
ggggtcggcggcgacgtcggc

SEQ ID NO: 29715 - DNA, 19 bp, Homo sapiens
gggtcggcggcgacgtcgg

SEQ ID NO: 29716 - DNA, 20 bp, Homo sapiens
gggtcggcggcgacgtcggc

SEQ ID NO: 29717 - DNA, 19 bp, Homo sapiens
gcgacgtcggctacccacc

SEQ ID NO: 29718 - DNA, 20 bp, Homo sapiens
gcgacgtcggctacccaccc

SEQ ID NO: 29719 - DNA, 21 bp, Homo sapiens
gcgacgtcggctacccacccg

SEQ ID NO: 29720 - DNA, 22 bp, Homo sapiens
gcgacgtcggctacccacccga

SEQ ID NO: 29721 - DNA, 19 bp, Homo sapiens
cgacgtcggctacccaccc

SEQ ID NO: 29722 - DNA, 20 bp, Homo sapiens
cgacgtcggctacccacccg

SEQ ID NO: 29723 - DNA, 21 bp, Homo sapiens
cgacgtcggctacccacccga

SEQ ID NO: 29724 - DNA, 21 bp, Homo sapiens
ggcgcaatgaaggtgaaggcc

SEQ ID NO: 29725 - DNA, 23 bp, Homo sapiens
gcaatgaaggtgaaggccggcgc

SEQ ID NO: 29726 - DNA, 21 bp, Homo sapiens
cgcgctcgccggccgaggtgg

SEQ ID NO: 29727 - DNA, 20 bp, Homo sapiens
gcgctcgccggccgaggtgg

SEQ ID NO: 29728 - DNA, 20 bp, Homo sapiens
ggccgaggtgggatcccgag

SEQ ID NO: 29729 - DNA, 21 bp, Homo sapiens
ggccgaggtgggatcccgagg

SEQ ID NO: 29730 - DNA, 23 bp, Homo sapiens
gtccgccgagggcgcaccaccgg

SEQ ID NO: 29731 - DNA, 21 bp, Homo sapiens
cacgagcgcacgtgttaggac

SEQ ID NO: 29732 - DNA, 22 bp, Homo sapiens
cacgagcgcacgtgttaggacc

SEQ ID NO: 29733 - DNA, 25 bp, Homo sapiens
cacgagcgcacgtgttaggacccga

SEQ ID NO: 29734 - DNA, 28 bp, Homo sapiens
cacgagcgcacgtgttaggacccgaaag

SEQ ID NO: 29735 - DNA, 24 bp, Homo sapiens
acgagcgcacgtgttaggacccga

SEQ ID NO: 29736 - DNA, 23 bp, Homo sapiens
cgagcgcacgtgttaggacccga

SEQ ID NO: 29737 - DNA, 22 bp, Homo sapiens
gagcgcacgtgttaggacccga

SEQ ID NO: 29738 - DNA, 21 bp, Homo sapiens
agcgcacgtgttaggacccga

SEQ ID NO: 29739 - DNA, 23 bp, Homo sapiens
agcgcacgtgttaggacccgaaa

SEQ ID NO: 29740 - DNA, 25 bp, Homo sapiens
agcgcacgtgttaggacccgaaaga

SEQ ID NO: 29741 - DNA, 20 bp, Homo sapiens
gcgcacgtgttaggacccga

SEQ ID NO: 29742 - DNA, 22 bp, Homo sapiens
gcgcacgtgttaggacccgaaa

SEQ ID NO: 29743 - DNA, 24 bp, Homo sapiens
gcgcacgtgttaggacccgaaaga

SEQ ID NO: 29744 - DNA, 19 bp, Homo sapiens
cgcacgtgttaggacccga

SEQ ID NO: 29745 - DNA, 23 bp, Homo sapiens
cgcacgtgttaggacccgaaaga

SEQ ID NO: 29746 - DNA, 18 bp, Homo sapiens
gcacgtgttaggacccga

SEQ ID NO: 29747 - DNA, 22 bp, Homo sapiens
gcacgtgttaggacccgaaaga

SEQ ID NO: 29748 - DNA, 17 bp, Homo sapiens
cacgtgttaggacccga

SEQ ID NO: 29749 - DNA, 20 bp, Homo sapiens
cacgtgttaggacccgaaag

SEQ ID NO: 29750 - DNA, 21 bp, Homo sapiens
cacgtgttaggacccgaaaga

SEQ ID NO: 29751 - DNA, 16 bp, Homo sapiens
acgtgttaggacccga

SEQ ID NO: 29752 - DNA, 18 bp, Homo sapiens
acgtgttaggacccgaaa

SEQ ID NO: 29753 - DNA, 20 bp, Homo sapiens
acgtgttaggacccgaaaga

SEQ ID NO: 29754 - DNA, 17 bp, Homo sapiens
cgtgttaggacccgaaa

SEQ ID NO: 29755 - DNA, 18 bp, Homo sapiens
cgtgttaggacccgaaag

SEQ ID NO: 29756 - DNA, 19 bp, Homo sapiens
cgtgttaggacccgaaaga

SEQ ID NO: 29757 - DNA, 20 bp, Homo sapiens
cgtgttaggacccgaaagat

SEQ ID NO: 29758 - DNA, 21 bp, Homo sapiens
cgtgttaggacccgaaagatg

SEQ ID NO: 29759 - DNA, 22 bp, Homo sapiens
cgtgttaggacccgaaagatgg

SEQ ID NO: 29760 - DNA, 23 bp, Homo sapiens
cgtgttaggacccgaaagatggt

SEQ ID NO: 29761 - DNA, 24 bp, Homo sapiens
cgtgttaggacccgaaagatggtg

SEQ ID NO: 29762 - DNA, 17 bp, Homo sapiens
tgttaggacccgaaaga

SEQ ID NO: 29763 - DNA, 20 bp, Homo sapiens
tgttaggacccgaaagatgg

SEQ ID NO: 29764 - DNA, 21 bp, Homo sapiens
tgttaggacccgaaagatggt

SEQ ID NO: 29765 - DNA, 23 bp, Homo sapiens
atgcctgggcagggcgaagccag

SEQ ID NO: 29766 - DNA, 21 bp, Homo sapiens
gcctgggcagggcgaagccag

SEQ ID NO: 29767 - DNA, 21 bp, Homo sapiens
gccagaggaaactctggtgga

SEQ ID NO: 29768 - DNA, 19 bp, Homo sapiens
aggaaactctggtggaggt

SEQ ID NO: 29769 - DNA, 17 bp, Homo sapiens
ggaaactctggtggagg

SEQ ID NO: 29770 - DNA, 18 bp, Homo sapiens
ggaaactctggtggaggt

SEQ ID NO: 29771 - DNA, 20 bp, Homo sapiens
ggtggaggtccgtagcggtc

SEQ ID NO: 29772 - DNA, 18 bp, Homo sapiens
tggaggtccgtagcggtc

SEQ ID NO: 29773 - DNA, 21 bp, Homo sapiens
aaatcggtcgtccgacctggg

SEQ ID NO: 29774 - DNA, 22 bp, Homo sapiens
aaatcggtcgtccgacctgggt

SEQ ID NO: 29775 - DNA, 20 bp, Homo sapiens
aatcggtcgtccgacctggg

SEQ ID NO: 29776 - DNA, 21 bp, Homo sapiens
aatcggtcgtccgacctgggt

SEQ ID NO: 29777 - DNA, 22 bp, Homo sapiens
aatcggtcgtccgacctgggta

SEQ ID NO: 29778 - DNA, 19 bp, Homo sapiens
atcggtcgtccgacctggg

SEQ ID NO: 29779 - DNA, 20 bp, Homo sapiens
atcggtcgtccgacctgggt

SEQ ID NO: 29780 - DNA, 21 bp, Homo sapiens
atcggtcgtccgacctgggta

SEQ ID NO: 29781 - DNA, 18 bp, Homo sapiens
tcggtcgtccgacctggg

SEQ ID NO: 29782 - DNA, 19 bp, Homo sapiens
tcggtcgtccgacctgggt

SEQ ID NO: 29783 - DNA, 16 bp, Homo sapiens
tcgtccgacctgggta

SEQ ID NO: 29784 - DNA, 21 bp, Homo sapiens
tcgtccgacctgggtataggg

SEQ ID NO: 29785 - DNA, 21 bp, Homo sapiens
ctaatcgaaccatctagtagc

SEQ ID NO: 29786 - DNA, 24 bp, Homo sapiens
atagctggcgctctcgcagacccg

SEQ ID NO: 29787 - DNA, 23 bp, Homo sapiens
tagctggcgctctcgcagacccg

SEQ ID NO: 29788 - DNA, 19 bp, Homo sapiens
gctggcgctctcgcagacc

SEQ ID NO: 29789 - DNA, 20 bp, Homo sapiens
gctggcgctctcgcagaccc

SEQ ID NO: 29790 - DNA, 21 bp, Homo sapiens
gctggcgctctcgcagacccg

SEQ ID NO: 29791 - DNA, 22 bp, Homo sapiens
gctggcgctctcgcagacccga

SEQ ID NO: 29792 - DNA, 23 bp, Homo sapiens
gctggcgctctcgcagacccgac

SEQ ID NO: 29793 - DNA, 24 bp, Homo sapiens
gctggcgctctcgcagacccgacg

SEQ ID NO: 29794 - DNA, 25 bp, Homo sapiens
gctggcgctctcgcagacccgacgc

SEQ ID NO: 29795 - DNA, 22 bp, Homo sapiens
ctggcgctctcgcagacccgac

SEQ ID NO: 29796 - DNA, 23 bp, Homo sapiens
ctggcgctctcgcagacccgacg

SEQ ID NO: 29797 - DNA, 24 bp, Homo sapiens
ctggcgctctcgcagacccgacgc

SEQ ID NO: 29798 - DNA, 23 bp, Homo sapiens
tggcgctctcgcagacccgacgc

SEQ ID NO: 29799 - DNA, 22 bp, Homo sapiens
ggcgctctcgcagacccgacgc

SEQ ID NO: 29800 - DNA, 17 bp, Homo sapiens
gctctcgcagacccgac

SEQ ID NO: 29801 - DNA, 19 bp, Homo sapiens
gctctcgcagacccgacgc

SEQ ID NO: 29802 - DNA, 18 bp, Homo sapiens
ctctcgcagacccgacgc

SEQ ID NO: 29803 - DNA, 21 bp, Homo sapiens
cgcagttttatccggtaaagc

SEQ ID NO: 29804 - DNA, 20 bp, Homo sapiens
gcagttttatccggtaaagc

SEQ ID NO: 29805 - DNA, 21 bp, Homo sapiens
gaatgattagaggtcttgggg

SEQ ID NO: 29806 - DNA, 22 bp, Homo sapiens
gaatgattagaggtcttggggc

SEQ ID NO: 29807 - DNA, 20 bp, Homo sapiens
aatgattagaggtcttgggg

SEQ ID NO: 29808 - DNA, 21 bp, Homo sapiens
aatgattagaggtcttggggc

SEQ ID NO: 29809 - DNA, 22 bp, Homo sapiens
aatgattagaggtcttggggcc

SEQ ID NO: 29810 - DNA, 28 bp, Homo sapiens
aatgattagaggtcttggggccgaaacg

SEQ ID NO: 29811 - DNA, 19 bp, Homo sapiens
atgattagaggtcttgggg

SEQ ID NO: 29812 - DNA, 24 bp, Homo sapiens
agaagcccggctcgctggcgtgga

SEQ ID NO: 29813 - DNA, 22 bp, Homo sapiens
gaagcccggctcgctggcgtgg

SEQ ID NO: 29814 - DNA, 21 bp, Homo sapiens
cccggctcgctggcgtggagc

SEQ ID NO: 29815 - DNA, 17 bp, Homo sapiens
cggctcgctggcgtgga

SEQ ID NO: 29816 - DNA, 18 bp, Homo sapiens
gcgtggagccgggcgtgg

SEQ ID NO: 29817 - DNA, 19 bp, Homo sapiens
gcgtggagccgggcgtgga

SEQ ID NO: 29818 - DNA, 20 bp, Homo sapiens
gcgtggagccgggcgtggaa

SEQ ID NO: 29819 - DNA, 21 bp, Homo sapiens
gcgtggagccgggcgtggaat

SEQ ID NO: 29820 - DNA, 17 bp, Homo sapiens
cgtggagccgggcgtgg

SEQ ID NO: 29821 - DNA, 18 bp, Homo sapiens
cgtggagccgggcgtgga

SEQ ID NO: 29822 - DNA, 23 bp, Homo sapiens
cgtggagccgggcgtggaatgcg

SEQ ID NO: 29823 - DNA, 16 bp, Homo sapiens
gtggagccgggcgtgg

SEQ ID NO: 29824 - DNA, 17 bp, Homo sapiens
gtggagccgggcgtgga

SEQ ID NO: 29825 - DNA, 21 bp, Homo sapiens
gtggagccgggcgtggaatgc

SEQ ID NO: 29826 - DNA, 22 bp, Homo sapiens
gtggagccgggcgtggaatgcg

SEQ ID NO: 29827 - DNA, 23 bp, Homo sapiens
gtggagccgggcgtggaatgcga

SEQ ID NO: 29828 - DNA, 16 bp, Homo sapiens
tggagccgggcgtgga

SEQ ID NO: 29829 - DNA, 18 bp, Homo sapiens
tggagccgggcgtggaat

SEQ ID NO: 29830 - DNA, 19 bp, Homo sapiens
tggagccgggcgtggaatg

SEQ ID NO: 29831 - DNA, 20 bp, Homo sapiens
tggagccgggcgtggaatgc

SEQ ID NO: 29832 - DNA, 21 bp, Homo sapiens
tggagccgggcgtggaatgcg

SEQ ID NO: 29833 - DNA, 22 bp, Homo sapiens
tggagccgggcgtggaatgcga

SEQ ID NO: 29834 - DNA, 23 bp, Homo sapiens
tggagccgggcgtggaatgcgag

SEQ ID NO: 29835 - DNA, 20 bp, Homo sapiens
ggagccgggcgtggaatgcg

SEQ ID NO: 29836 - DNA, 21 bp, Homo sapiens
ggagccgggcgtggaatgcga

SEQ ID NO: 29837 - DNA, 19 bp, Homo sapiens
gagccgggcgtggaatgcg

SEQ ID NO: 29838 - DNA, 20 bp, Homo sapiens
gagccgggcgtggaatgcga

SEQ ID NO: 29839 - DNA, 21 bp, Homo sapiens
gagccgggcgtggaatgcgag

SEQ ID NO: 29840 - DNA, 18 bp, Homo sapiens
ggatgaaccgaacgccgg

SEQ ID NO: 29841 - DNA, 25 bp, Homo sapiens
gcaggacggtggccatggaagtcgg

SEQ ID NO: 29842 - DNA, 24 bp, Homo sapiens
caggacggtggccatggaagtcgg

SEQ ID NO: 29843 - DNA, 25 bp, Homo sapiens
caggacggtggccatggaagtcgga

SEQ ID NO: 29844 - DNA, 30 bp, Homo sapiens
caggacggtggccatggaagtcggaatccg

SEQ ID NO: 29845 - DNA, 23 bp, Homo sapiens
aggacggtggccatggaagtcgg

SEQ ID NO: 29846 - DNA, 24 bp, Homo sapiens
aggacggtggccatggaagtcgga

SEQ ID NO: 29847 - DNA, 30 bp, Homo sapiens
aggacggtggccatggaagtcggaatccgc

SEQ ID NO: 29848 - DNA, 22 bp, Homo sapiens
ggacggtggccatggaagtcgg

SEQ ID NO: 29849 - DNA, 23 bp, Homo sapiens
ggacggtggccatggaagtcgga

SEQ ID NO: 29850 - DNA, 24 bp, Homo sapiens
ggacggtggccatggaagtcggaa

SEQ ID NO: 29851 - DNA, 30 bp, Homo sapiens
ggacggtggccatggaagtcggaatccgct

SEQ ID NO: 29852 - DNA, 21 bp, Homo sapiens
gacggtggccatggaagtcgg

SEQ ID NO: 29853 - DNA, 22 bp, Homo sapiens
gacggtggccatggaagtcgga

SEQ ID NO: 29854 - DNA, 23 bp, Homo sapiens
gacggtggccatggaagtcggaa

SEQ ID NO: 29855 - DNA, 20 bp, Homo sapiens
acggtggccatggaagtcgg

SEQ ID NO: 29856 - DNA, 21 bp, Homo sapiens
acggtggccatggaagtcgga

SEQ ID NO: 29857 - DNA, 18 bp, Homo sapiens
cggtggccatggaagtcg

SEQ ID NO: 29858 - DNA, 19 bp, Homo sapiens
cggtggccatggaagtcgg

SEQ ID NO: 29859 - DNA, 20 bp, Homo sapiens
cggtggccatggaagtcgga

SEQ ID NO: 29860 - DNA, 21 bp, Homo sapiens
cggtggccatggaagtcggaa

SEQ ID NO: 29861 - DNA, 22 bp, Homo sapiens
cggtggccatggaagtcggaat

SEQ ID NO: 29862 - DNA, 24 bp, Homo sapiens
cggtggccatggaagtcggaatcc

SEQ ID NO: 29863 - DNA, 23 bp, Homo sapiens
aatggatggcgctggagcgtcgg

SEQ ID NO: 29864 - DNA, 22 bp, Homo sapiens
atggatggcgctggagcgtcgg

SEQ ID NO: 29865 - DNA, 21 bp, Homo sapiens
tggatggcgctggagcgtcgg

SEQ ID NO: 29866 - DNA, 22 bp, Homo sapiens
tggatggcgctggagcgtcggg

SEQ ID NO: 29867 - DNA, 26 bp, Homo sapiens
tggatggcgctggagcgtcgggccca

SEQ ID NO: 29868 - DNA, 20 bp, Homo sapiens
ggatggcgctggagcgtcgg

SEQ ID NO: 29869 - DNA, 19 bp, Homo sapiens
gatggcgctggagcgtcgg

SEQ ID NO: 29870 - DNA, 20 bp, Homo sapiens
gatggcgctggagcgtcggg

SEQ ID NO: 29871 - DNA, 23 bp, Homo sapiens
gatggcgctggagcgtcgggccc

SEQ ID NO: 29872 - DNA, 24 bp, Homo sapiens
gatggcgctggagcgtcgggccca

SEQ ID NO: 29873 - DNA, 25 bp, Homo sapiens
gatggcgctggagcgtcgggcccat

SEQ ID NO: 29874 - DNA, 21 bp, Homo sapiens
atggcgctggagcgtcgggcc

SEQ ID NO: 29875 - DNA, 22 bp, Homo sapiens
atggcgctggagcgtcgggccc

SEQ ID NO: 29876 - DNA, 20 bp, Homo sapiens
tggcgctggagcgtcgggcc

SEQ ID NO: 29877 - DNA, 21 bp, Homo sapiens
tggcgctggagcgtcgggccc

SEQ ID NO: 29878 - DNA, 22 bp, Homo sapiens
tggcgctggagcgtcgggccca

SEQ ID NO: 29879 - DNA, 19 bp, Homo sapiens
ggcgctggagcgtcgggcc

SEQ ID NO: 29880 - DNA, 20 bp, Homo sapiens
ggcgctggagcgtcgggccc

SEQ ID NO: 29881 - DNA, 21 bp, Homo sapiens
ggcgctggagcgtcgggccca

SEQ ID NO: 29882 - DNA, 18 bp, Homo sapiens
gcgctggagcgtcgggcc

SEQ ID NO: 29883 - DNA, 19 bp, Homo sapiens
gcgctggagcgtcgggccc

SEQ ID NO: 29884 - DNA, 20 bp, Homo sapiens
gcgctggagcgtcgggccca

SEQ ID NO: 29885 - DNA, 21 bp, Homo sapiens
gcgctggagcgtcgggcccat

SEQ ID NO: 29886 - DNA, 17 bp, Homo sapiens
cgctggagcgtcgggcc

SEQ ID NO: 29887 - DNA, 18 bp, Homo sapiens
cgctggagcgtcgggccc

SEQ ID NO: 29888 - DNA, 19 bp, Homo sapiens
cgctggagcgtcgggccca

SEQ ID NO: 29889 - DNA, 16 bp, Homo sapiens
gctggagcgtcgggcc

SEQ ID NO: 29890 - DNA, 17 bp, Homo sapiens
gctggagcgtcgggccc

SEQ ID NO: 29891 - DNA, 21 bp, Homo sapiens
tggagcgtcgggcccataccc

SEQ ID NO: 29892 - DNA, 23 bp, Homo sapiens
tggagcgtcgggcccatacccgg

SEQ ID NO: 29893 - DNA, 24 bp, Homo sapiens
tggagcgtcgggcccatacccggc

SEQ ID NO: 29894 - DNA, 27 bp, Homo sapiens
catacccggccgtcgccggcagtcgag

SEQ ID NO: 29895 - DNA, 21 bp, Homo sapiens
cggccgtcgccggcagtcgag

SEQ ID NO: 29896 - DNA, 22 bp, Homo sapiens
cggccgtcgccggcagtcgaga

SEQ ID NO: 29897 - DNA, 18 bp, Homo sapiens
ccgtcgccggcagtcgag

SEQ ID NO: 29898 - DNA, 19 bp, Homo sapiens
ccgtcgccggcagtcgaga

SEQ ID NO: 29899 - DNA, 17 bp, Homo sapiens
cgtcgccggcagtcgag

SEQ ID NO: 29900 - DNA, 19 bp, Homo sapiens
gagagtggacgggagcggc

SEQ ID NO: 29901 - DNA, 17 bp, Homo sapiens
cgtgtggtgtgcgtcgg

SEQ ID NO: 29902 - DNA, 18 bp, Homo sapiens
cgtgtggtgtgcgtcgga

SEQ ID NO: 29903 - DNA, 19 bp, Homo sapiens
cgtgtggtgtgcgtcggag

SEQ ID NO: 29904 - DNA, 20 bp, Homo sapiens
cgtgtggtgtgcgtcggagg

SEQ ID NO: 29905 - DNA, 21 bp, Homo sapiens
cgtgtggtgtgcgtcggaggg

SEQ ID NO: 29906 - DNA, 16 bp, Homo sapiens
gtgtggtgtgcgtcgg

SEQ ID NO: 29907 - DNA, 19 bp, Homo sapiens
gtgtggtgtgcgtcggagg

SEQ ID NO: 29908 - DNA, 20 bp, Homo sapiens
gtgtggtgtgcgtcggaggg

SEQ ID NO: 29909 - DNA, 18 bp, Homo sapiens
tgtggtgtgcgtcggagg

SEQ ID NO: 29910 - DNA, 19 bp, Homo sapiens
tgtggtgtgcgtcggaggg

SEQ ID NO: 29911 - DNA, 20 bp, Homo sapiens
tgtggtgtgcgtcggagggc

SEQ ID NO: 29912 - DNA, 21 bp, Homo sapiens
tgtggtgtgcgtcggagggcg

SEQ ID NO: 29913 - DNA, 18 bp, Homo sapiens
gtggtgtgcgtcggaggg

SEQ ID NO: 29914 - DNA, 16 bp, Homo sapiens
tggtgtgcgtcggagg

SEQ ID NO: 29915 - DNA, 17 bp, Homo sapiens
tggtgtgcgtcggaggg

SEQ ID NO: 29916 - DNA, 18 bp, Homo sapiens
tggtgtgcgtcggagggc

SEQ ID NO: 29917 - DNA, 19 bp, Homo sapiens
tggtgtgcgtcggagggcg

SEQ ID NO: 29918 - DNA, 16 bp, Homo sapiens
ggtgtgcgtcggaggg

SEQ ID NO: 29919 - DNA, 22 bp, Homo sapiens
gtgtgcgtcggagggcggcggc

SEQ ID NO: 29920 - DNA, 21 bp, Homo sapiens
tgtgcgtcggagggcggcggc

SEQ ID NO: 29921 - DNA, 20 bp, Homo sapiens
gcggcggcgggggtgtgggg

SEQ ID NO: 29922 - DNA, 19 bp, Homo sapiens
ggcggcgggggtgtggggt

SEQ ID NO: 29923 - DNA, 18 bp, Homo sapiens
gcggcgggggtgtggggt

SEQ ID NO: 29924 - DNA, 19 bp, Homo sapiens
gcggcgggggtgtggggtc

SEQ ID NO: 29925 - DNA, 21 bp, Homo sapiens
acgctacgccgcgacgagtag

SEQ ID NO: 29926 - DNA, 20 bp, Homo sapiens
cgctacgccgcgacgagtag

SEQ ID NO: 29927 - DNA, 20 bp, Homo sapiens
ctacgccgcgacgagtagga

SEQ ID NO: 29928 - DNA, 18 bp, Homo sapiens
tacgccgcgacgagtagg

SEQ ID NO: 29929 - DNA, 23 bp, Homo sapiens
ggccgctgcggtgagccttgaag

SEQ ID NO: 29930 - DNA, 28 bp, Homo sapiens
ggccgctgcggtgagccttgaagcctag

SEQ ID NO: 29931 - DNA, 29 bp, Homo sapiens
ggccgctgcggtgagccttgaagcctagg

SEQ ID NO: 29932 - DNA, 20 bp, Homo sapiens
ggcgcgggcccgggtggagc

SEQ ID NO: 29933 - DNA, 22 bp, Homo sapiens
aggtgcagatcttggtggtagt

SEQ ID NO: 29934 - DNA, 21 bp, Homo sapiens
ggtgcagatcttggtggtagt

SEQ ID NO: 29935 - DNA, 25 bp, Homo sapiens
ggtgcagatcttggtggtagtagca

SEQ ID NO: 29936 - DNA, 20 bp, Homo sapiens
gtgcagatcttggtggtagt

SEQ ID NO: 29937 - DNA, 24 bp, Homo sapiens
gtgcagatcttggtggtagtagca

SEQ ID NO: 29938 - DNA, 19 bp, Homo sapiens
tgcagatcttggtggtagt

SEQ ID NO: 29939 - DNA, 22 bp, Homo sapiens
tgcagatcttggtggtagtagc

SEQ ID NO: 29940 - DNA, 23 bp, Homo sapiens
tgcagatcttggtggtagtagca

SEQ ID NO: 29941 - DNA, 18 bp, Homo sapiens
gcagatcttggtggtagt

SEQ ID NO: 29942 - DNA, 21 bp, Homo sapiens
gcagatcttggtggtagtagc

SEQ ID NO: 29943 - DNA, 22 bp, Homo sapiens
gcagatcttggtggtagtagca

SEQ ID NO: 29944 - DNA, 21 bp, Homo sapiens
cagatcttggtggtagtagca

SEQ ID NO: 29945 - DNA, 22 bp, Homo sapiens
cagatcttggtggtagtagcaa

SEQ ID NO: 29946 - DNA, 23 bp, Homo sapiens
cagatcttggtggtagtagcaaa

SEQ ID NO: 29947 - DNA, 20 bp, Homo sapiens
agatcttggtggtagtagca

SEQ ID NO: 29948 - DNA, 19 bp, Homo sapiens
gatcttggtggtagtagca

SEQ ID NO: 29949 - DNA, 21 bp, Homo sapiens
tcaaacgagaactttgaaggc

SEQ ID NO: 29950 - DNA, 19 bp, Homo sapiens
caaacgagaactttgaagg

SEQ ID NO: 29951 - DNA, 20 bp, Homo sapiens
caaacgagaactttgaaggc

SEQ ID NO: 29952 - DNA, 21 bp, Homo sapiens
caaacgagaactttgaaggcc

SEQ ID NO: 29953 - DNA, 22 bp, Homo sapiens
caaacgagaactttgaaggccg

SEQ ID NO: 29954 - DNA, 23 bp, Homo sapiens
caaacgagaactttgaaggccga

SEQ ID NO: 29955 - DNA, 24 bp, Homo sapiens
caaacgagaactttgaaggccgaa

SEQ ID NO: 29956 - DNA, 30 bp, Homo sapiens; identical to SEQ ID NO: 22365

SEQ ID NO: 29957 - DNA, 19 bp, Homo sapiens
aaacgagaactttgaaggc

SEQ ID NO: 29958 - DNA, 20 bp, Homo sapiens
aaacgagaactttgaaggcc

SEQ ID NO: 29959 - DNA, 21 bp, Homo sapiens
aaacgagaactttgaaggccg

SEQ ID NO: 29960 - DNA, 22 bp, Homo sapiens
aaacgagaactttgaaggccga

SEQ ID NO: 29961 - DNA, 23 bp, Homo sapiens
aaacgagaactttgaaggccgaa

SEQ ID NO: 29962 - DNA, 18 bp, Homo sapiens
aacgagaactttgaaggc

SEQ ID NO: 29963 - DNA, 19 bp, Homo sapiens
aacgagaactttgaaggcc

SEQ ID NO: 29964 - DNA, 20 bp, Homo sapiens
aacgagaactttgaaggccg

SEQ ID NO: 29965 - DNA, 21 bp, Homo sapiens
aacgagaactttgaaggccga

SEQ ID NO: 29966 - DNA, 22 bp, Homo sapiens
aacgagaactttgaaggccgaa

SEQ ID NO: 29967 - DNA, 23 bp, Homo sapiens
aacgagaactttgaaggccgaag

SEQ ID NO: 29968 - DNA, 29 bp, Homo sapiens
aacgagaactttgaaggccgaagtggaga

SEQ ID NO: 29969 - DNA, 17 bp, Homo sapiens
acgagaactttgaaggc

SEQ ID NO: 29970 - DNA, 18 bp, Homo sapiens
acgagaactttgaaggcc

SEQ ID NO: 29971 - DNA, 19 bp, Homo sapiens
acgagaactttgaaggccg

SEQ ID NO: 29972 - DNA, 20 bp, Homo sapiens
acgagaactttgaaggccga

SEQ ID NO: 29973 - DNA, 21 bp, Homo sapiens
acgagaactttgaaggccgaa

SEQ ID NO: 29974 - DNA, 22 bp, Homo sapiens
acgagaactttgaaggccgaag

SEQ ID NO: 29975 - DNA, 30 bp, Homo sapiens; identical to SEQ ID NO: 4843

SEQ ID NO: 29976 - DNA, 16 bp, Homo sapiens
cgagaactttgaaggc

SEQ ID NO: 29977 - DNA, 17 bp, Homo sapiens
cgagaactttgaaggcc

SEQ ID NO: 29978 - DNA, 18 bp, Homo sapiens
cgagaactttgaaggccg

SEQ ID NO: 29979 - DNA, 19 bp, Homo sapiens
cgagaactttgaaggccga

SEQ ID NO: 29980 - DNA, 20 bp, Homo sapiens
cgagaactttgaaggccgaa

SEQ ID NO: 29981 - DNA, 21 bp, Homo sapiens
cgagaactttgaaggccgaag

SEQ ID NO: 29982 - DNA, 30 bp, Homo sapiens; identical to SEQ ID NO: 4856

SEQ ID NO: 29983 - DNA, 18 bp, Homo sapiens
gagaactttgaaggccga

SEQ ID NO: 29984 - DNA, 19 bp, Homo sapiens
gagaactttgaaggccgaa

SEQ ID NO: 29985 - DNA, 20 bp, Homo sapiens
gagaactttgaaggccgaag

SEQ ID NO: 29986 - DNA, 19 bp, Homo sapiens
agaactttgaaggccgaag

SEQ ID NO: 29987 - DNA, 20 bp, Homo sapiens
agaactttgaaggccgaagt

SEQ ID NO: 29988 - DNA, 17 bp, Homo sapiens
gaactttgaaggccgaa

SEQ ID NO: 29989 - DNA, 18 bp, Homo sapiens
gaactttgaaggccgaag

SEQ ID NO: 29990 - DNA, 19 bp, Homo sapiens
gaactttgaaggccgaagt

SEQ ID NO: 29991 - DNA, 23 bp, Homo sapiens
gaactttgaaggccgaagtggag

SEQ ID NO: 29992 - DNA, 30 bp, Homo sapiens
gtggagaagggttccatgtgaacagcagtt

SEQ ID NO: 29993 - DNA, 24 bp, Homo sapiens
ggagaagggttccatgtgaacagc

SEQ ID NO: 29994 - DNA, 25 bp, Homo sapiens
cagcagttgaacatgggtcagtcgg

SEQ ID NO: 29995 - DNA, 30 bp, Homo sapiens; identical to SEQ ID NO: 4872

SEQ ID NO: 29996 - DNA, 24 bp, Homo sapiens
agcagttgaacatgggtcagtcgg

SEQ ID NO: 29997 - DNA, 29 bp, Homo sapiens
agcagttgaacatgggtcagtcggtcctg

SEQ ID NO: 29998 - DNA, 23 bp, Homo sapiens
gcagttgaacatgggtcagtcgg

SEQ ID NO: 29999 - DNA, 30 bp, Homo sapiens; identical to SEQ ID NO: 22586

SEQ ID NO: 30000 - DNA, 22 bp, Homo sapiens
cagttgaacatgggtcagtcgg

SEQ ID NO: 30001 - DNA, 20 bp, Homo sapiens
gttgaacatgggtcagtcgg

SEQ ID NO: 30002 - DNA, 17 bp, Homo sapiens
gaacatgggtcagtcgg

SEQ ID NO: 30003 - DNA, 19 bp, Homo sapiens
gaacatgggtcagtcggtc

SEQ ID NO: 30004 - DNA, 20 bp, Homo sapiens
gaacatgggtcagtcggtcc

SEQ ID NO: 30005 - DNA, 24 bp, Homo sapiens
gaacatgggtcagtcggtcctgag

SEQ ID NO: 30006 - DNA, 30 bp, Homo sapiens
gaacatgggtcagtcggtcctgagagatgg

SEQ ID NO: 30007 - DNA, 16 bp, Homo sapiens
aacatgggtcagtcgg

SEQ ID NO: 30008 - DNA, 17 bp, Homo sapiens
aacatgggtcagtcggt

SEQ ID NO: 30009 - DNA, 18 bp, Homo sapiens
aacatgggtcagtcggtc

SEQ ID NO: 30010 - DNA, 19 bp, Homo sapiens
aacatgggtcagtcggtcc

SEQ ID NO: 30011 - DNA, 23 bp, Homo sapiens
aacatgggtcagtcggtcctgag

SEQ ID NO: 30012 - DNA, 30 bp, Homo sapiens
aacatgggtcagtcggtcctgagagatggg

SEQ ID NO: 30013 - DNA, 20 bp, Homo sapiens
acatgggtcagtcggtcctg

SEQ ID NO: 30014 - DNA, 27 bp, Homo sapiens
acatgggtcagtcggtcctgagagatg

SEQ ID NO: 30015 - DNA, 19 bp, Homo sapiens
catgggtcagtcggtcctg

SEQ ID NO: 30016 - DNA, 21 bp, Homo sapiens
catgggtcagtcggtcctgag

SEQ ID NO: 30017 - DNA, 23 bp, Homo sapiens
catgggtcagtcggtcctgagag

SEQ ID NO: 30018 - DNA, 24 bp, Homo sapiens
catgggtcagtcggtcctgagaga

SEQ ID NO: 30019 - DNA, 26 bp, Homo sapiens
catgggtcagtcggtcctgagagatg

SEQ ID NO: 30020 - DNA, 18 bp, Homo sapiens
atgggtcagtcggtcctg

SEQ ID NO: 30021 - DNA, 20 bp, Homo sapiens
atgggtcagtcggtcctgag

SEQ ID NO: 30022 - DNA, 21 bp, Homo sapiens
atgggtcagtcggtcctgaga

SEQ ID NO: 30023 - DNA, 22 bp, Homo sapiens
atgggtcagtcggtcctgagag

SEQ ID NO: 30024 - DNA, 23 bp, Homo sapiens
atgggtcagtcggtcctgagaga

SEQ ID NO: 30025 - DNA, 24 bp, Homo sapiens
atgggtcagtcggtcctgagagat

SEQ ID NO: 30026 - DNA, 25 bp, Homo sapiens
atgggtcagtcggtcctgagagatg

SEQ ID NO: 30027 - DNA, 26 bp, Homo sapiens
atgggtcagtcggtcctgagagatgg

SEQ ID NO: 30028 - DNA, 27 bp, Homo sapiens
atgggtcagtcggtcctgagagatggg

SEQ ID NO: 30029 - DNA, 29 bp, Homo sapiens
atgggtcagtcggtcctgagagatgggcg

SEQ ID NO: 30030 - DNA, 17 bp, Homo sapiens
tgggtcagtcggtcctg

SEQ ID NO: 30031 - DNA, 19 bp, Homo sapiens
tgggtcagtcggtcctgag

SEQ ID NO: 30032 - DNA, 20 bp, Homo sapiens
tgggtcagtcggtcctgaga

SEQ ID NO: 30033 - DNA, 21 bp, Homo sapiens
tgggtcagtcggtcctgagag

SEQ ID NO: 30034 - DNA, 22 bp, Homo sapiens
tgggtcagtcggtcctgagaga

SEQ ID NO: 30035 - DNA, 23 bp, Homo sapiens
tgggtcagtcggtcctgagagat

SEQ ID NO: 30036 - DNA, 24 bp, Homo sapiens
tgggtcagtcggtcctgagagatg

SEQ ID NO: 30037 - DNA, 25 bp, Homo sapiens
tgggtcagtcggtcctgagagatgg

SEQ ID NO: 30038 - DNA, 26 bp, Homo sapiens
tgggtcagtcggtcctgagagatggg

SEQ ID NO: 30039 - DNA, 27 bp, Homo sapiens
tgggtcagtcggtcctgagagatgggc

SEQ ID NO: 30040 - DNA, 28 bp, Homo sapiens
tgggtcagtcggtcctgagagatgggcg

SEQ ID NO: 30041 - DNA, 30 bp, Homo sapiens
tgggtcagtcggtcctgagagatgggcgag

SEQ ID NO: 30042 - DNA, 18 bp, Homo sapiens
gggtcagtcggtcctgag

SEQ ID NO: 30043 - DNA, 19 bp, Homo sapiens
gggtcagtcggtcctgaga

SEQ ID NO: 30044 - DNA, 20 bp, Homo sapiens
gggtcagtcggtcctgagag

SEQ ID NO: 30045 - DNA, 21 bp, Homo sapiens
gggtcagtcggtcctgagaga

SEQ ID NO: 30046 - DNA, 22 bp, Homo sapiens
gggtcagtcggtcctgagagat

SEQ ID NO: 30047 - DNA, 23 bp, Homo sapiens
gggtcagtcggtcctgagagatg

SEQ ID NO: 30048 - DNA, 24 bp, Homo sapiens
gggtcagtcggtcctgagagatgg

SEQ ID NO: 30049 - DNA, 25 bp, Homo sapiens
gggtcagtcggtcctgagagatggg

SEQ ID NO: 30050 - DNA, 26 bp, Homo sapiens
gggtcagtcggtcctgagagatgggc

SEQ ID NO: 30051 - DNA, 18 bp, Homo sapiens
ggtcagtcggtcctgaga

SEQ ID NO: 30052 - DNA, 19 bp, Homo sapiens
ggtcagtcggtcctgagag

SEQ ID NO: 30053 - DNA, 20 bp, Homo sapiens
ggtcagtcggtcctgagaga

SEQ ID NO: 30054 - DNA, 21 bp, Homo sapiens
ggtcagtcggtcctgagagat

SEQ ID NO: 30055 - DNA, 22 bp, Homo sapiens
ggtcagtcggtcctgagagatg

SEQ ID NO: 30056 - DNA, 23 bp, Homo sapiens
ggtcagtcggtcctgagagatgg

SEQ ID NO: 30057 - DNA, 24 bp, Homo sapiens
ggtcagtcggtcctgagagatggg

SEQ ID NO: 30058 - DNA, 25 bp, Homo sapiens
ggtcagtcggtcctgagagatgggc

SEQ ID NO: 30059 - DNA, 17 bp, Homo sapiens
gtcagtcggtcctgaga

SEQ ID NO: 30060 - DNA, 18 bp, Homo sapiens
gtcagtcggtcctgagag

SEQ ID NO: 30061 - DNA, 19 bp, Homo sapiens
gtcagtcggtcctgagaga

SEQ ID NO: 30062 - DNA, 20 bp, Homo sapiens
gtcagtcggtcctgagagat

SEQ ID NO: 30063 - DNA, 21 bp, Homo sapiens
gtcagtcggtcctgagagatg

SEQ ID NO: 30064 - DNA, 24 bp, Homo sapiens
gtcagtcggtcctgagagatgggc

SEQ ID NO: 30065 - DNA, 16 bp, Homo sapiens
tcagtcggtcctgaga

SEQ ID NO: 30066 - DNA, 18 bp, Homo sapiens
tcagtcggtcctgagaga

SEQ ID NO: 30067 - DNA, 19 bp, Homo sapiens
tcagtcggtcctgagagat

SEQ ID NO: 30068 - DNA, 20 bp, Homo sapiens
tcagtcggtcctgagagatg

SEQ ID NO: 30069 - DNA, 23 bp, Homo sapiens
tcagtcggtcctgagagatgggc

SEQ ID NO: 30070 - DNA, 17 bp, Homo sapiens
cagtcggtcctgagaga

SEQ ID NO: 30071 - DNA, 18 bp, Homo sapiens
cagtcggtcctgagagat

SEQ ID NO: 30072 - DNA, 19 bp, Homo sapiens
cagtcggtcctgagagatg

SEQ ID NO: 30073 - DNA, 22 bp, Homo sapiens
cagtcggtcctgagagatgggc

SEQ ID NO: 30074 - DNA, 18 bp, Homo sapiens
ggtcctgagagatgggcg

SEQ ID NO: 30075 - DNA, 22 bp, Homo sapiens
ggtcctgagagatgggcgagcg

SEQ ID NO: 30076 - DNA, 28 bp, Homo sapiens
gggcgatggcctccgttgccctcggccg

SEQ ID NO: 30077 - DNA, 23 bp, Homo sapiens
gcctccgttgccctcggccgatc

SEQ ID NO: 30078 - DNA, 24 bp, Homo sapiens
gcctccgttgccctcggccgatcg

SEQ ID NO: 30079 - DNA, 21 bp, Homo sapiens
ctccgttgccctcggccgatc

SEQ ID NO: 30080 - DNA, 23 bp, Homo sapiens
gttgccctcggccgatcgaaagg

SEQ ID NO: 30081 - DNA, 24 bp, Homo sapiens
gttgccctcggccgatcgaaaggg

SEQ ID NO: 30082 - DNA, 22 bp, Homo sapiens
ttgccctcggccgatcgaaagg

SEQ ID NO: 30083 - DNA, 23 bp, Homo sapiens
ttgccctcggccgatcgaaaggg

SEQ ID NO: 30084 - DNA, 21 bp, Homo sapiens
tgccctcggccgatcgaaagg

SEQ ID NO: 30085 - DNA, 22 bp, Homo sapiens
tgccctcggccgatcgaaaggg

SEQ ID NO: 30086 - DNA, 20 bp, Homo sapiens
gccctcggccgatcgaaagg

SEQ ID NO: 30087 - DNA, 21 bp, Homo sapiens
gccctcggccgatcgaaaggg

SEQ ID NO: 30088 - DNA, 20 bp, Homo sapiens
cctcggccgatcgaaaggga

SEQ ID NO: 30089 - DNA, 17 bp, Homo sapiens
ctcggccgatcgaaagg

SEQ ID NO: 30090 - DNA, 19 bp, Homo sapiens
ctcggccgatcgaaaggga

SEQ ID NO: 30091 - DNA, 20 bp, Homo sapiens
ctcggccgatcgaaagggag

SEQ ID NO: 30092 - DNA, 21 bp, Homo sapiens
ctcggccgatcgaaagggagt

SEQ ID NO: 30093 - DNA, 22 bp, Homo sapiens
ctcggccgatcgaaagggagtc

SEQ ID NO: 30094 - DNA, 20 bp, Homo sapiens
gccgatcgaaagggagtcgg

SEQ ID NO: 30095 - DNA, 19 bp, Homo sapiens
ccgatcgaaagggagtcgg

SEQ ID NO: 30096 - DNA, 21 bp, Homo sapiens
gatcgaaagggagtcgggttc

SEQ ID NO: 30097 - DNA, 22 bp, Homo sapiens
tcgaaagggagtcgggttcaga

SEQ ID NO: 30098 - DNA, 20 bp, Homo sapiens
cgaaagggagtcgggttcag

SEQ ID NO: 30099 - DNA, 21 bp, Homo sapiens
cgaaagggagtcgggttcaga

SEQ ID NO: 30100 - DNA, 17 bp, Homo sapiens
gaaagggagtcgggttc

SEQ ID NO: 30101 - DNA, 19 bp, Homo sapiens
gaaagggagtcgggttcag

SEQ ID NO: 30102 - DNA, 20 bp, Homo sapiens
gaaagggagtcgggttcaga

SEQ ID NO: 30103 - DNA, 18 bp, Homo sapiens
aaagggagtcgggttcag

SEQ ID NO: 30104 - DNA, 19 bp, Homo sapiens
aaagggagtcgggttcaga

SEQ ID NO: 30105 - DNA, 21 bp, Homo sapiens
aaagggagtcgggttcagatc

SEQ ID NO: 30106 - DNA, 21 bp, Homo sapiens
gccgcgaggcgtccagtgcgg

SEQ ID NO: 30107 - DNA, 25 bp, Homo sapiens
gtgcggtaacgcgaccgatcccgga

SEQ ID NO: 30108 - DNA, 27 bp, Homo sapiens
gtgcggtaacgcgaccgatcccggaga

SEQ ID NO: 30109 - DNA, 29 bp, Homo sapiens
gtgcggtaacgcgaccgatcccggagaag

SEQ ID NO: 30110 - DNA, 23 bp, Homo sapiens
gcggtaacgcgaccgatcccgga

SEQ ID NO: 30111 - DNA, 21 bp, Homo sapiens
ggtaacgcgaccgatcccgga

SEQ ID NO: 30112 - DNA, 23 bp, Homo sapiens
ggtaacgcgaccgatcccggaga

SEQ ID NO: 30113 - DNA, 19 bp, Homo sapiens
gtaacgcgaccgatcccgg

SEQ ID NO: 30114 - DNA, 20 bp, Homo sapiens
gtaacgcgaccgatcccgga

SEQ ID NO: 30115 - DNA, 21 bp, Homo sapiens
gtaacgcgaccgatcccggag

SEQ ID NO: 30116 - DNA, 22 bp, Homo sapiens
gtaacgcgaccgatcccggaga

SEQ ID NO: 30117 - DNA, 19 bp, Homo sapiens
taacgcgaccgatcccgga

SEQ ID NO: 30118 - DNA, 20 bp, Homo sapiens
taacgcgaccgatcccggag

SEQ ID NO: 30119 - DNA, 21 bp, Homo sapiens
taacgcgaccgatcccggaga

SEQ ID NO: 30120 - DNA, 19 bp, Homo sapiens
gccggcgggagccccgggg

SEQ ID NO: 30121 - DNA, 20 bp, Homo sapiens
gccggcgggagccccgggga

SEQ ID NO: 30122 - DNA, 23 bp, Homo sapiens
ggcccgtgccttggaaagcgtcg

SEQ ID NO: 30123 - DNA, 25 bp, Homo sapiens
ggcccgtgccttggaaagcgtcgcg

SEQ ID NO: 30124 - DNA, 21 bp, Homo sapiens
gcggcgtccggtgagctctcg

SEQ ID NO: 30125 - DNA, 22 bp, Homo sapiens
gcggcgtccggtgagctctcgc

SEQ ID NO: 30126 - DNA, 20 bp, Homo sapiens
cggcgtccggtgagctctcg

SEQ ID NO: 30127 - DNA, 21 bp, Homo sapiens
cggcgtccggtgagctctcgc

SEQ ID NO: 30128 - DNA, 18 bp, Homo sapiens
gcgtccggtgagctctcg

SEQ ID NO: 30129 - DNA, 19 bp, Homo sapiens
gcgtccggtgagctctcgc

SEQ ID NO: 30130 - DNA, 20 bp, Homo sapiens
gcgtccggtgagctctcgct

SEQ ID NO: 30131 - DNA, 18 bp, Homo sapiens
cgtccggtgagctctcgc

SEQ ID NO: 30132 - DNA, 19 bp, Homo sapiens
cgtccggtgagctctcgct

SEQ ID NO: 30133 - DNA, 23 bp, Homo sapiens
cgtccggtgagctctcgctggcc

SEQ ID NO: 30134 - DNA, 19 bp, Homo sapiens
ccggtgagctctcgctggc

SEQ ID NO: 30135 - DNA, 18 bp, Homo sapiens
cggtgagctctcgctggc

SEQ ID NO: 30136 - DNA, 21 bp, Homo sapiens
taaatctcgcgccgggccgta

SEQ ID NO: 30137 - DNA, 19 bp, Homo sapiens
aatctcgcgccgggccgta

SEQ ID NO: 30138 - DNA, 21 bp, Homo sapiens
aatctcgcgccgggccgtacc

SEQ ID NO: 30139 - DNA, 19 bp, Homo sapiens
gcaggtctccaaggtgaac

SEQ ID NO: 30140 - DNA, 24 bp, Homo sapiens
tctggcatgttggaacaatgtagg

SEQ ID NO: 30141 - DNA, 23 bp, Homo sapiens
ctggcatgttggaacaatgtagg

SEQ ID NO: 30142 - DNA, 21 bp, Homo sapiens
ggcatgttggaacaatgtagg

SEQ ID NO: 30143 - DNA, 20 bp, Homo sapiens
gcatgttggaacaatgtagg

SEQ ID NO: 30144 - DNA, 22 bp, Homo sapiens
gcatgttggaacaatgtaggta

SEQ ID NO: 30145 - DNA, 19 bp, Homo sapiens
catgttggaacaatgtagg

SEQ ID NO: 30146 - DNA, 21 bp, Homo sapiens
catgttggaacaatgtaggta

SEQ ID NO: 30147 - DNA, 24 bp, Homo sapiens
catgttggaacaatgtaggtaagg

SEQ ID NO: 30148 - DNA, 30 bp, Homo sapiens; identical to SEQ ID NO: 23595

SEQ ID NO: 30149 - DNA, 22 bp, Homo sapiens
acaatgtaggtaagggaagtcg

SEQ ID NO: 30150 - DNA, 22 bp, Homo sapiens
aatgtaggtaagggaagtcggc

SEQ ID NO: 30151 - DNA, 21 bp, Homo sapiens
atgtaggtaagggaagtcggc

SEQ ID NO: 30152 - DNA, 21 bp, Homo sapiens
caagccggatccgtaacttcg

SEQ ID NO: 30153 - DNA, 24 bp, Homo sapiens
caagccggatccgtaacttcggga

SEQ ID NO: 30154 - DNA, 24 bp, Homo sapiens
tccgtaacttcgggataaggattg

SEQ ID NO: 30155 - DNA, 24 bp, Homo sapiens
taaggattggctctaagggctggg

SEQ ID NO: 30156 - DNA, 22 bp, Homo sapiens
aaggattggctctaagggctgg

SEQ ID NO: 30157 - DNA, 23 bp, Homo sapiens
aaggattggctctaagggctggg

SEQ ID NO: 30158 - DNA, 24 bp, Homo sapiens
aaggattggctctaagggctgggt

SEQ ID NO: 30159 - DNA, 22 bp, Homo sapiens
aggattggctctaagggctggg

SEQ ID NO: 30160 - DNA, 23 bp, Homo sapiens
aggattggctctaagggctgggt

SEQ ID NO: 30161 - DNA, 19 bp, Homo sapiens
attggctctaagggctggg

SEQ ID NO: 30162 - DNA, 20 bp, Homo sapiens
attggctctaagggctgggt

SEQ ID NO: 30163 - DNA, 17 bp, Homo sapiens
ttggctctaagggctgg

SEQ ID NO: 30164 - DNA, 18 bp, Homo sapiens
ttggctctaagggctggg

SEQ ID NO: 30165 - DNA, 21 bp, Homo sapiens
ttggctctaagggctgggtcg

SEQ ID NO: 30166 - DNA, 17 bp, Homo sapiens
tggctctaagggctggg

SEQ ID NO: 30167 - DNA, 25 bp, Homo sapiens
tggctctaagggctgggtcggtcgg

SEQ ID NO: 30168 - DNA, 26 bp, Homo sapiens
tggctctaagggctgggtcggtcggg

SEQ ID NO: 30169 - DNA, 24 bp, Homo sapiens
ggctctaagggctgggtcggtcgg

SEQ ID NO: 30170 - DNA, 25 bp, Homo sapiens
ggctctaagggctgggtcggtcggg

SEQ ID NO: 30171 - DNA, 29 bp, Homo sapiens
ggctctaagggctgggtcggtcgggctgg

SEQ ID NO: 30172 - DNA, 19 bp, Homo sapiens
gctctaagggctgggtcgg

SEQ ID NO: 30173 - DNA, 22 bp, Homo sapiens
gctctaagggctgggtcggtcg

SEQ ID NO: 30174 - DNA, 23 bp, Homo sapiens
gctctaagggctgggtcggtcgg

SEQ ID NO: 30175 - DNA, 24 bp, Homo sapiens
gctctaagggctgggtcggtcggg

SEQ ID NO: 30176 - DNA, 25 bp, Homo sapiens
gctctaagggctgggtcggtcgggc

SEQ ID NO: 30177 - DNA, 30 bp, Homo sapiens
gctctaagggctgggtcggtcgggctgggg

SEQ ID NO: 30178 - DNA, 18 bp, Homo sapiens
ctctaagggctgggtcgg

SEQ ID NO: 30179 - DNA, 21 bp, Homo sapiens
ctctaagggctgggtcggtcg

SEQ ID NO: 30180 - DNA, 22 bp, Homo sapiens
ctctaagggctgggtcggtcgg

SEQ ID NO: 30181 - DNA, 23 bp, Homo sapiens
ctctaagggctgggtcggtcggg

SEQ ID NO: 30182 - DNA, 24 bp, Homo sapiens
ctctaagggctgggtcggtcgggc

SEQ ID NO: 30183 - DNA, 20 bp, Homo sapiens
tctaagggctgggtcggtcg

SEQ ID NO: 30184 - DNA, 21 bp, Homo sapiens
tctaagggctgggtcggtcgg

SEQ ID NO: 30185 - DNA, 22 bp, Homo sapiens
tctaagggctgggtcggtcggg

SEQ ID NO: 30186 - DNA, 23 bp, Homo sapiens
tctaagggctgggtcggtcgggc

SEQ ID NO: 30187 - DNA, 24 bp, Homo sapiens
tctaagggctgggtcggtcgggct

SEQ ID NO: 30188 - DNA, 26 bp, Homo sapiens
tctaagggctgggtcggtcgggctgg

SEQ ID NO: 30189 - DNA, 19 bp, Homo sapiens
ctaagggctgggtcggtcg

SEQ ID NO: 30190 - DNA, 20 bp, Homo sapiens
ctaagggctgggtcggtcgg

SEQ ID NO: 30191 - DNA, 21 bp, Homo sapiens
ctaagggctgggtcggtcggg

SEQ ID NO: 30192 - DNA, 22 bp, Homo sapiens
ctaagggctgggtcggtcgggc

SEQ ID NO: 30193 - DNA, 23 bp, Homo sapiens
ctaagggctgggtcggtcgggct

SEQ ID NO: 30194 - DNA, 24 bp, Homo sapiens
ctaagggctgggtcggtcgggctg

SEQ ID NO: 30195 - DNA, 25 bp, Homo sapiens
ctaagggctgggtcggtcgggctgg

SEQ ID NO: 30196 - DNA, 26 bp, Homo sapiens
ctaagggctgggtcggtcgggctggg

SEQ ID NO: 30197 - DNA, 22 bp, Homo sapiens
aagggctgggtcggtcgggctg

SEQ ID NO: 30198 - DNA, 24 bp, Homo sapiens
aagggctgggtcggtcgggctggg

SEQ ID NO: 30199 - DNA, 23 bp, Homo sapiens
agggctgggtcggtcgggctggg

SEQ ID NO: 30200 - DNA, 25 bp, Homo sapiens
agggctgggtcggtcgggctggggc

SEQ ID NO: 30201 - DNA, 26 bp, Homo sapiens
agggctgggtcggtcgggctggggcg

SEQ ID NO: 30202 - DNA, 16 bp, Homo sapiens
gctgggtcggtcgggc

SEQ ID NO: 30203 - DNA, 19 bp, Homo sapiens
gctgggtcggtcgggctgg

SEQ ID NO: 30204 - DNA, 20 bp, Homo sapiens
gctgggtcggtcgggctggg

SEQ ID NO: 30205 - DNA, 21 bp, Homo sapiens
gctgggtcggtcgggctgggg

SEQ ID NO: 30206 - DNA, 22 bp, Homo sapiens
gctgggtcggtcgggctggggc

SEQ ID NO: 30207 - DNA, 23 bp, Homo sapiens
gctgggtcggtcgggctggggcg

SEQ ID NO: 30208 - DNA, 24 bp, Homo sapiens
gctgggtcggtcgggctggggcgc

SEQ ID NO: 30209 - DNA, 17 bp, Homo sapiens
ctgggtcggtcgggctg

SEQ ID NO: 30210 - DNA, 18 bp, Homo sapiens
ctgggtcggtcgggctgg

SEQ ID NO: 30211 - DNA, 19 bp, Homo sapiens
ctgggtcggtcgggctggg

SEQ ID NO: 30212 - DNA, 20 bp, Homo sapiens
ctgggtcggtcgggctgggg

SEQ ID NO: 30213 - DNA, 21 bp, Homo sapiens
ctgggtcggtcgggctggggc

SEQ ID NO: 30214 - DNA, 22 bp, Homo sapiens
ctgggtcggtcgggctggggcg

SEQ ID NO: 30215 - DNA, 23 bp, Homo sapiens
ctgggtcggtcgggctggggcgc

SEQ ID NO: 30216 - DNA, 24 bp, Homo sapiens
ctgggtcggtcgggctggggcgcg

SEQ ID NO: 30217 - DNA, 17 bp, Homo sapiens
tgggtcggtcgggctgg

SEQ ID NO: 30218 - DNA, 18 bp, Homo sapiens
tgggtcggtcgggctggg

SEQ ID NO: 30219 - DNA, 19 bp, Homo sapiens
tgggtcggtcgggctgggg

SEQ ID NO: 30220 - DNA, 20 bp, Homo sapiens
tgggtcggtcgggctggggc

SEQ ID NO: 30221 - DNA, 21 bp, Homo sapiens
tgggtcggtcgggctggggcg

SEQ ID NO: 30222 - DNA, 22 bp, Homo sapiens
tgggtcggtcgggctggggcgc

SEQ ID NO: 30223 - DNA, 23 bp, Homo sapiens
tgggtcggtcgggctggggcgcg

SEQ ID NO: 30224 - DNA, 24 bp, Homo sapiens
tgggtcggtcgggctggggcgcga

SEQ ID NO: 30225 - DNA, 16 bp, Homo sapiens
gggtcggtcgggctgg

SEQ ID NO: 30226 - DNA, 17 bp, Homo sapiens
gggtcggtcgggctggg

SEQ ID NO: 30227 - DNA, 18 bp, Homo sapiens
gggtcggtcgggctgggg

SEQ ID NO: 30228 - DNA, 19 bp, Homo sapiens
gggtcggtcgggctggggc

SEQ ID NO: 30229 - DNA, 20 bp, Homo sapiens
gggtcggtcgggctggggcg

SEQ ID NO: 30230 - DNA, 21 bp, Homo sapiens
gggtcggtcgggctggggcgc

SEQ ID NO: 30231 - DNA, 22 bp, Homo sapiens
gggtcggtcgggctggggcgcg

SEQ ID NO: 30232 - DNA, 23 bp, Homo sapiens
gggtcggtcgggctggggcgcga

SEQ ID NO: 30233 - DNA, 26 bp, Homo sapiens
gggtcggtcgggctggggcgcgaagc

SEQ ID NO: 30234 - DNA, 27 bp, Homo sapiens
gggtcggtcgggctggggcgcgaagcg

SEQ ID NO: 30235 - DNA, 30 bp, Homo sapiens
gggtcggtcgggctggggcgcgaagcgggg

SEQ ID NO: 30236 - DNA, 18 bp, Homo sapiens
ggtcggtcgggctggggc

SEQ ID NO: 30237 - DNA, 19 bp, Homo sapiens
ggtcggtcgggctggggcg

SEQ ID NO: 30238 - DNA, 20 bp, Homo sapiens
ggtcggtcgggctggggcgc

SEQ ID NO: 30239 - DNA, 21 bp, Homo sapiens
ggtcggtcgggctggggcgcg

SEQ ID NO: 30240 - DNA, 22 bp, Homo sapiens
ggtcggtcgggctggggcgcga

SEQ ID NO: 30241 - DNA, 17 bp, Homo sapiens
gtcggtcgggctggggc

SEQ ID NO: 30242 - DNA, 18 bp, Homo sapiens
gtcggtcgggctggggcg

SEQ ID NO: 30243 - DNA, 19 bp, Homo sapiens
gtcggtcgggctggggcgc

SEQ ID NO: 30244 - DNA, 20 bp, Homo sapiens
gtcggtcgggctggggcgcg

SEQ ID NO: 30245 - DNA, 21 bp, Homo sapiens
gtcggtcgggctggggcgcga

SEQ ID NO: 30246 - DNA, 23 bp, Homo sapiens
gtcggtcgggctggggcgcgaag

SEQ ID NO: 30247 - DNA, 24 bp, Homo sapiens
gtcggtcgggctggggcgcgaagc

SEQ ID NO: 30248 - DNA, 25 bp, Homo sapiens
gtcggtcgggctggggcgcgaagcg

SEQ ID NO: 30249 - DNA, 26 bp, Homo sapiens
gtcggtcgggctggggcgcgaagcgg

SEQ ID NO: 30250 - DNA, 29 bp, Homo sapiens
gtcggtcgggctggggcgcgaagcggggc

SEQ ID NO: 30251 - DNA, 16 bp, Homo sapiens
tcggtcgggctggggc

SEQ ID NO: 30252 - DNA, 17 bp, Homo sapiens
tcggtcgggctggggcg

SEQ ID NO: 30253 - DNA, 18 bp, Homo sapiens
tcggtcgggctggggcgc

SEQ ID NO: 30254 - DNA, 19 bp, Homo sapiens
tcggtcgggctggggcgcg

SEQ ID NO: 30255 - DNA, 20 bp, Homo sapiens
tcggtcgggctggggcgcga

SEQ ID NO: 30256 - DNA, 21 bp, Homo sapiens
tcggtcgggctggggcgcgaa

SEQ ID NO: 30257 - DNA, 22 bp, Homo sapiens
tcggtcgggctggggcgcgaag

SEQ ID NO: 30258 - DNA, 23 bp, Homo sapiens
tcggtcgggctggggcgcgaagc

SEQ ID NO: 30259 - DNA, 24 bp, Homo sapiens
tcggtcgggctggggcgcgaagcg

SEQ ID NO: 30260 - DNA, 25 bp, Homo sapiens
tcggtcgggctggggcgcgaagcgg

SEQ ID NO: 30261 - DNA, 26 bp, Homo sapiens
tcggtcgggctggggcgcgaagcggg

SEQ ID NO: 30262 - DNA, 28 bp, Homo sapiens
tcggtcgggctggggcgcgaagcggggc

SEQ ID NO: 30263 - DNA, 16 bp, Homo sapiens
cggtcgggctggggcg

SEQ ID NO: 30264 - DNA, 17 bp, Homo sapiens
cggtcgggctggggcgc

SEQ ID NO: 30265 - DNA, 18 bp, Homo sapiens
cggtcgggctggggcgcg

SEQ ID NO: 30266 - DNA, 19 bp, Homo sapiens
cggtcgggctggggcgcga

SEQ ID NO: 30267 - DNA, 20 bp, Homo sapiens
cggtcgggctggggcgcgaa

SEQ ID NO: 30268 - DNA, 21 bp, Homo sapiens
cggtcgggctggggcgcgaag

SEQ ID NO: 30269 - DNA, 22 bp, Homo sapiens
cggtcgggctggggcgcgaagc

SEQ ID NO: 30270 - DNA, 23 bp, Homo sapiens
cggtcgggctggggcgcgaagcg

SEQ ID NO: 30271 - DNA, 24 bp, Homo sapiens
cggtcgggctggggcgcgaagcgg

SEQ ID NO: 30272 - DNA, 25 bp, Homo sapiens
cggtcgggctggggcgcgaagcggg

SEQ ID NO: 30273 - DNA, 27 bp, Homo sapiens
cggtcgggctggggcgcgaagcggggc

SEQ ID NO: 30274 - DNA, 21 bp, Homo sapiens
ggtcgggctggggcgcgaagc

SEQ ID NO: 30275 - DNA, 22 bp, Homo sapiens
ggtcgggctggggcgcgaagcg

SEQ ID NO: 30276 - DNA, 23 bp, Homo sapiens
ggtcgggctggggcgcgaagcgg

SEQ ID NO: 30277 - DNA, 24 bp, Homo sapiens
ggtcgggctggggcgcgaagcggg

SEQ ID NO: 30278 - DNA, 26 bp, Homo sapiens
ggtcgggctggggcgcgaagcggggc

SEQ ID NO: 30279 - DNA, 22 bp, Homo sapiens
gtcgggctggggcgcgaagcgg

SEQ ID NO: 30280 - DNA, 24 bp, Homo sapiens
tcgggctggggcgcgaagcggggc

SEQ ID NO: 30281 - DNA, 23 bp, Homo sapiens
cgggctggggcgcgaagcggggc

SEQ ID NO: 30282 - DNA, 22 bp, Homo sapiens
gggctggggcgcgaagcggggc

SEQ ID NO: 30283 - DNA, 21 bp, Homo sapiens
ggctggggcgcgaagcggggc

SEQ ID NO: 30284 - DNA, 20 bp, Homo sapiens
gctggggcgcgaagcggggc

SEQ ID NO: 30285 - DNA, 19 bp, Homo sapiens
ctggggcgcgaagcggggc

SEQ ID NO: 30286 - DNA, 20 bp, Homo sapiens
ctggggcgcgaagcggggct

SEQ ID NO: 30287 - DNA, 18 bp, Homo sapiens
tggggcgcgaagcggggc

SEQ ID NO: 30288 - DNA, 17 bp, Homo sapiens
ggggcgcgaagcggggc

SEQ ID NO: 30289 - DNA, 21 bp, Homo sapiens
gggcgcgaagcggggctgggc

SEQ ID NO: 30290 - DNA, 18 bp, Homo sapiens
ggcgcgaagcggggctgg

SEQ ID NO: 30291 - DNA, 16 bp, Homo sapiens
gggcgcgcgccgcggc

SEQ ID NO: 30292 - DNA, 17 bp, Homo sapiens
gggcgcgcgccgcggct

SEQ ID NO: 30293 - DNA, 18 bp, Homo sapiens
gggcgcgcgccgcggctg

SEQ ID NO: 30294 - DNA, 19 bp, Homo sapiens
gggcgcgcgccgcggctgg

SEQ ID NO: 30295 - DNA, 20 bp, Homo sapiens
gggcgcgcgccgcggctgga

SEQ ID NO: 30296 - DNA, 21 bp, Homo sapiens
gggcgcgcgccgcggctggac

SEQ ID NO: 30297 - DNA, 22 bp, Homo sapiens
gggcgcgcgccgcggctggacg

SEQ ID NO: 30298 - DNA, 23 bp, Homo sapiens
gggcgcgcgccgcggctggacga

SEQ ID NO: 30299 - DNA, 24 bp, Homo sapiens
gggcgcgcgccgcggctggacgag

SEQ ID NO: 30300 - DNA, 25 bp, Homo sapiens
gggcgcgcgccgcggctggacgagg

SEQ ID NO: 30301 - DNA, 26 bp, Homo sapiens
gggcgcgcgccgcggctggacgaggc

SEQ ID NO: 30302 - DNA, 27 bp, Homo sapiens
gggcgcgcgccgcggctggacgaggcg

SEQ ID NO: 30303 - DNA, 21 bp, Homo sapiens
ggcgcgcgccgcggctggacg

SEQ ID NO: 30304 - DNA, 23 bp, Homo sapiens
ggcgcgcgccgcggctggacgag

SEQ ID NO: 30305 - DNA, 20 bp, Homo sapiens
gcgcgcgccgcggctggacg

SEQ ID NO: 30306 - DNA, 21 bp, Homo sapiens
gcgcgcgccgcggctggacga

SEQ ID NO: 30307 - DNA, 22 bp, Homo sapiens
gcgcgcgccgcggctggacgag

SEQ ID NO: 30308 - DNA, 19 bp, Homo sapiens
cgcgcgccgcggctggacg

SEQ ID NO: 30309 - DNA, 20 bp, Homo sapiens
cgcgcgccgcggctggacga

SEQ ID NO: 30310 - DNA, 17 bp, Homo sapiens
cgcgccgcggctggacg

SEQ ID NO: 30311 - DNA, 18 bp, Homo sapiens
cgcgccgcggctggacga

SEQ ID NO: 30312 - DNA, 18 bp, Homo sapiens
cccccctcgcggccctcc

SEQ ID NO: 30313 - DNA, 19 bp, Homo sapiens
cccccctcgcggccctccc

SEQ ID NO: 30314 - DNA, 20 bp, Homo sapiens
cccccctcgcggccctcccc

SEQ ID NO: 30315 - DNA, 21 bp, Homo sapiens
cccccctcgcggccctccccc

SEQ ID NO: 30316 - DNA, 24 bp, Homo sapiens
cccccctcgcggccctcccccgcc

SEQ ID NO: 30317 - DNA, 18 bp, Homo sapiens
ccccctcgcggccctccc

SEQ ID NO: 30318 - DNA, 19 bp, Homo sapiens
ccccctcgcggccctcccc

SEQ ID NO: 30319 - DNA, 22 bp, Homo sapiens
ccccctcgcggccctcccccgc

SEQ ID NO: 30320 - DNA, 23 bp, Homo sapiens
ccccctcgcggccctcccccgcc

SEQ ID NO: 30321 - DNA, 21 bp, Homo sapiens
cccctcgcggccctcccccgc

SEQ ID NO: 30322 - DNA, 22 bp, Homo sapiens
cccctcgcggccctcccccgcc

SEQ ID NO: 30323 - DNA, 20 bp, Homo sapiens
ccctcgcggccctcccccgc

SEQ ID NO: 30324 - DNA, 21 bp, Homo sapiens
ccctcgcggccctcccccgcc

SEQ ID NO: 30325 - DNA, 20 bp, Homo sapiens
cctcgcggccctcccccgcc

SEQ ID NO: 30326 - DNA, 25 bp, Homo sapiens
ctctctctctcccccgctccccgtc

SEQ ID NO: 30327 - DNA, 21 bp, Homo sapiens
ctctctcccccgctccccgtc

SEQ ID NO: 30328 - DNA, 22 bp, Homo sapiens
cccgctccccgtcctcccccct

SEQ ID NO: 30329 - DNA, 21 bp, Homo sapiens
ccgctccccgtcctcccccct

SEQ ID NO: 30330 - DNA, 19 bp, Homo sapiens
gctccccgtcctcccccct

SEQ ID NO: 30331 - DNA, 20 bp, Homo sapiens
gctccccgtcctcccccctc

SEQ ID NO: 30332 - DNA, 21 bp, Homo sapiens
gctccccgtcctcccccctcc

SEQ ID NO: 30333 - DNA, 22 bp, Homo sapiens
gctccccgtcctcccccctccc

SEQ ID NO: 30334 - DNA, 23 bp, Homo sapiens
gctccccgtcctcccccctcccc

SEQ ID NO: 30335 - DNA, 20 bp, Homo sapiens
ggggggagaagggtcggggc

SEQ ID NO: 30336 - DNA, 21 bp, Homo sapiens
ggggggagaagggtcggggcg

SEQ ID NO: 30337 - DNA, 22 bp, Homo sapiens
ggggggagaagggtcggggcgg

SEQ ID NO: 30338 - DNA, 23 bp, Homo sapiens
ggggggagaagggtcggggcggc

SEQ ID NO: 30339 - DNA, 22 bp, Homo sapiens
gggggagaagggtcggggcggc

SEQ ID NO: 30340 - DNA, 20 bp, Homo sapiens
gggagaagggtcggggcggc

SEQ ID NO: 30341 - DNA, 19 bp, Homo sapiens
ggagaagggtcggggcggc

SEQ ID NO: 30342 - DNA, 18 bp, Homo sapiens
gagaagggtcggggcggc

SEQ ID NO: 30343 - DNA, 16 bp, Homo sapiens
gaagggtcggggcggc

SEQ ID NO: 30344 - DNA, 22 bp, Homo sapiens
aagggtcggggcggcaggggcc

SEQ ID NO: 30345 - DNA, 16 bp, Homo sapiens
aggggccggcggcggc

SEQ ID NO: 30346 - DNA, 22 bp, Homo sapiens
ggcggcggcccgccgcggggcc

SEQ ID NO: 30347 - DNA, 21 bp, Homo sapiens
gcggcggcccgccgcggggcc

SEQ ID NO: 30348 - DNA, 20 bp, Homo sapiens
cggcggcccgccgcggggcc

SEQ ID NO: 30349 - DNA, 21 bp, Homo sapiens
cggcggcccgccgcggggccc

SEQ ID NO: 30350 - DNA, 19 bp, Homo sapiens
ggcggcccgccgcggggcc

SEQ ID NO: 30351 - DNA, 18 bp, Homo sapiens
gcggcccgccgcggggcc

SEQ ID NO: 30352 - DNA, 20 bp, Homo sapiens
cccccgcgaggggggcccgg

SEQ ID NO: 30353 - DNA, 19 bp, Homo sapiens
ccccgcgaggggggcccgg

SEQ ID NO: 30354 - DNA, 18 bp, Homo sapiens
cccgcgaggggggcccgg

SEQ ID NO: 30355 - DNA, 19 bp, Homo sapiens
cccgcgaggggggcccggg

SEQ ID NO: 30356 - DNA, 20 bp, Homo sapiens
cccgcgaggggggcccgggc

SEQ ID NO: 30357 - DNA, 21 bp, Homo sapiens
cccgcgaggggggcccgggca

SEQ ID NO: 30358 - DNA, 19 bp, Homo sapiens
ccgcgaggggggcccgggc

SEQ ID NO: 30359 - DNA, 20 bp, Homo sapiens
ccgcgaggggggcccgggca

SEQ ID NO: 30360 - DNA, 18 bp, Homo sapiens
cgcgaggggggcccgggc

SEQ ID NO: 30361 - DNA, 17 bp, Homo sapiens
gcgaggggggcccgggc

SEQ ID NO: 30362 - DNA, 18 bp, Homo sapiens
gcgaggggggcccgggca

SEQ ID NO: 30363 - DNA, 29 bp, Homo sapiens
cggggggccggcggcggcggcgactctgg

SEQ ID NO: 30364 - DNA, 20 bp, Homo sapiens
ggggggccggcggcggcggc

SEQ ID NO: 30365 - DNA, 21 bp, Homo sapiens
ggggggccggcggcggcggcg

SEQ ID NO: 30366 - DNA, 21 bp, Homo sapiens
ccggcggcggcggcgactctg

SEQ ID NO: 30367 - DNA, 22 bp, Homo sapiens
ccggcggcggcggcgactctgg

SEQ ID NO: 30368 - DNA, 23 bp, Homo sapiens
ccggcggcggcggcgactctgga

SEQ ID NO: 30369 - DNA, 24 bp, Homo sapiens
ccggcggcggcggcgactctggac

SEQ ID NO: 30370 - DNA, 25 bp, Homo sapiens
ccggcggcggcggcgactctggacg

SEQ ID NO: 30371 - DNA, 26 bp, Homo sapiens
ccggcggcggcggcgactctggacgc

SEQ ID NO: 30372 - DNA, 27 bp, Homo sapiens
ccggcggcggcggcgactctggacgcg

SEQ ID NO: 30373 - DNA, 28 bp, Homo sapiens
ccggcggcggcggcgactctggacgcga

SEQ ID NO: 30374 - DNA, 29 bp, Homo sapiens
ccggcggcggcggcgactctggacgcgag

SEQ ID NO: 30375 - DNA, 30 bp, Homo sapiens
ccggcggcggcggcgactctggacgcgagc

SEQ ID NO: 30376 - DNA, 21 bp, Homo sapiens
cggcggcggcggcgactctgg

SEQ ID NO: 30377 - DNA, 22 bp, Homo sapiens
cggcggcggcggcgactctgga

SEQ ID NO: 30378 - DNA, 23 bp, Homo sapiens
cggcggcggcggcgactctggac

SEQ ID NO: 30379 - DNA, 24 bp, Homo sapiens
cggcggcggcggcgactctggacg

SEQ ID NO: 30380 - DNA, 25 bp, Homo sapiens
cggcggcggcggcgactctggacgc

SEQ ID NO: 30381 - DNA, 26 bp, Homo sapiens
cggcggcggcggcgactctggacgcg

SEQ ID NO: 30382 - DNA, 27 bp, Homo sapiens
cggcggcggcggcgactctggacgcga

SEQ ID NO: 30383 - DNA, 28 bp, Homo sapiens
cggcggcggcggcgactctggacgcgag

SEQ ID NO: 30384 - DNA, 29 bp, Homo sapiens
cggcggcggcggcgactctggacgcgagc

SEQ ID NO: 30385 - DNA, 30 bp, Homo sapiens
cggcggcggcggcgactctggacgcgagcc

SEQ ID NO: 30386 - DNA, 22 bp, Homo sapiens
ggcggcggcggcgactctggac

SEQ ID NO: 30387 - DNA, 23 bp, Homo sapiens
ggcggcggcggcgactctggacg

SEQ ID NO: 30388 - DNA, 24 bp, Homo sapiens
ggcggcggcggcgactctggacgc

SEQ ID NO: 30389 - DNA, 25 bp, Homo sapiens
ggcggcggcggcgactctggacgcg

SEQ ID NO: 30390 - DNA, 26 bp, Homo sapiens
ggcggcggcggcgactctggacgcga

SEQ ID NO: 30391 - DNA, 27 bp, Homo sapiens
ggcggcggcggcgactctggacgcgag

SEQ ID NO: 30392 - DNA, 28 bp, Homo sapiens
ggcggcggcggcgactctggacgcgagc

SEQ ID NO: 30393 - DNA, 19 bp, Homo sapiens
gcggcggcggcgactctgg

SEQ ID NO: 30394 - DNA, 20 bp, Homo sapiens
gcggcggcggcgactctgga

SEQ ID NO: 30395 - DNA, 21 bp, Homo sapiens
gcggcggcggcgactctggac

SEQ ID NO: 30396 - DNA, 22 bp, Homo sapiens
gcggcggcggcgactctggacg

SEQ ID NO: 30397 - DNA, 23 bp, Homo sapiens
gcggcggcggcgactctggacgc

SEQ ID NO: 30398 - DNA, 24 bp, Homo sapiens
gcggcggcggcgactctggacgcg

SEQ ID NO: 30399 - DNA, 25 bp, Homo sapiens
gcggcggcggcgactctggacgcga

SEQ ID NO: 30400 - DNA, 26 bp, Homo sapiens
gcggcggcggcgactctggacgcgag

SEQ ID NO: 30401 - DNA, 27 bp, Homo sapiens
gcggcggcggcgactctggacgcgagc

SEQ ID NO: 30402 - DNA, 28 bp, Homo sapiens
gcggcggcggcgactctggacgcgagcc

SEQ ID NO: 30403 - DNA, 30 bp, Homo sapiens
gcggcggcggcgactctggacgcgagccgg

SEQ ID NO: 30404 - DNA, 18 bp, Homo sapiens
cggcggcggcgactctgg

SEQ ID NO: 30405 - DNA, 20 bp, Homo sapiens
cggcggcggcgactctggac

SEQ ID NO: 30406 - DNA, 21 bp, Homo sapiens
cggcggcggcgactctggacg

SEQ ID NO: 30407 - DNA, 22 bp, Homo sapiens
cggcggcggcgactctggacgc

SEQ ID NO: 30408 - DNA, 23 bp, Homo sapiens
cggcggcggcgactctggacgcg

SEQ ID NO: 30409 - DNA, 24 bp, Homo sapiens
cggcggcggcgactctggacgcga

SEQ ID NO: 30410 - DNA, 25 bp, Homo sapiens
cggcggcggcgactctggacgcgag

SEQ ID NO: 30411 - DNA, 26 bp, Homo sapiens
cggcggcggcgactctggacgcgagc

SEQ ID NO: 30412 - DNA, 27 bp, Homo sapiens
cggcggcggcgactctggacgcgagcc

SEQ ID NO: 30413 - DNA, 30 bp, Homo sapiens; identical to SEQ ID NO: 24223

SEQ ID NO: 30414 - DNA, 19 bp, Homo sapiens
ggcggcggcgactctggac

SEQ ID NO: 30415 - DNA, 20 bp, Homo sapiens
ggcggcggcgactctggacg

SEQ ID NO: 30416 - DNA, 21 bp, Homo sapiens
ggcggcggcgactctggacgc

SEQ ID NO: 30417 - DNA, 22 bp, Homo sapiens
ggcggcggcgactctggacgcg

SEQ ID NO: 30418 - DNA, 23 bp, Homo sapiens
ggcggcggcgactctggacgcga

SEQ ID NO: 30419 - DNA, 24 bp, Homo sapiens
ggcggcggcgactctggacgcgag

SEQ ID NO: 30420 - DNA, 25 bp, Homo sapiens
ggcggcggcgactctggacgcgagc

SEQ ID NO: 30421 - DNA, 26 bp, Homo sapiens
ggcggcggcgactctggacgcgagcc

SEQ ID NO: 30422 - DNA, 18 bp, Homo sapiens
gcggcggcgactctggac

SEQ ID NO: 30423 - DNA, 19 bp, Homo sapiens
gcggcggcgactctggacg

SEQ ID NO: 30424 - DNA, 20 bp, Homo sapiens
gcggcggcgactctggacgc

SEQ ID NO: 30425 - DNA, 21 bp, Homo sapiens
gcggcggcgactctggacgcg

SEQ ID NO: 30426 - DNA, 22 bp, Homo sapiens
gcggcggcgactctggacgcga

SEQ ID NO: 30427 - DNA, 23 bp, Homo sapiens
gcggcggcgactctggacgcgag

SEQ ID NO: 30428 - DNA, 24 bp, Homo sapiens
gcggcggcgactctggacgcgagc

SEQ ID NO: 30429 - DNA, 25 bp, Homo sapiens
gcggcggcgactctggacgcgagcc

SEQ ID NO: 30430 - DNA, 28 bp, Homo sapiens
gcggcggcgactctggacgcgagccggg

SEQ ID NO: 30431 - DNA, 17 bp, Homo sapiens
cggcggcgactctggac

SEQ ID NO: 30432 - DNA, 18 bp, Homo sapiens
cggcggcgactctggacg

SEQ ID NO: 30433 - DNA, 19 bp, Homo sapiens
cggcggcgactctggacgc

SEQ ID NO: 30434 - DNA, 20 bp, Homo sapiens
cggcggcgactctggacgcg

SEQ ID NO: 30435 - DNA, 21 bp, Homo sapiens
cggcggcgactctggacgcga

SEQ ID NO: 30436 - DNA, 22 bp, Homo sapiens
cggcggcgactctggacgcgag

SEQ ID NO: 30437 - DNA, 23 bp, Homo sapiens
cggcggcgactctggacgcgagc

SEQ ID NO: 30438 - DNA, 24 bp, Homo sapiens
cggcggcgactctggacgcgagcc

SEQ ID NO: 30439 - DNA, 27 bp, Homo sapiens
cggcggcgactctggacgcgagccggg

SEQ ID NO: 30440 - DNA, 17 bp, Homo sapiens
ggcggcgactctggacg

SEQ ID NO: 30441 - DNA, 18 bp, Homo sapiens
ggcggcgactctggacgc

SEQ ID NO: 30442 - DNA, 19 bp, Homo sapiens
ggcggcgactctggacgcg

SEQ ID NO: 30443 - DNA, 20 bp, Homo sapiens
ggcggcgactctggacgcga

SEQ ID NO: 30444 - DNA, 21 bp, Homo sapiens
ggcggcgactctggacgcgag

SEQ ID NO: 30445 - DNA, 22 bp, Homo sapiens
ggcggcgactctggacgcgagc

SEQ ID NO: 30446 - DNA, 23 bp, Homo sapiens
ggcggcgactctggacgcgagcc

SEQ ID NO: 30447 - DNA, 26 bp, Homo sapiens
ggcggcgactctggacgcgagccggg

SEQ ID NO: 30448 - DNA, 16 bp, Homo sapiens
gcggcgactctggacg

SEQ ID NO: 30449 - DNA, 17 bp, Homo sapiens
gcggcgactctggacgc

SEQ ID NO: 30450 - DNA, 18 bp, Homo sapiens
gcggcgactctggacgcg

SEQ ID NO: 30451 - DNA, 19 bp, Homo sapiens
gcggcgactctggacgcga

SEQ ID NO: 30452 - DNA, 20 bp, Homo sapiens
gcggcgactctggacgcgag

SEQ ID NO: 30453 - DNA, 21 bp, Homo sapiens
gcggcgactctggacgcgagc

SEQ ID NO: 30454 - DNA, 22 bp, Homo sapiens
gcggcgactctggacgcgagcc

SEQ ID NO: 30455 - DNA, 23 bp, Homo sapiens
gcggcgactctggacgcgagccg

SEQ ID NO: 30456 - DNA, 24 bp, Homo sapiens
gcggcgactctggacgcgagccgg

SEQ ID NO: 30457 - DNA, 25 bp, Homo sapiens
gcggcgactctggacgcgagccggg

SEQ ID NO: 30458 - DNA, 26 bp, Homo sapiens
gcggcgactctggacgcgagccgggc

SEQ ID NO: 30459 - DNA, 27 bp, Homo sapiens
gcggcgactctggacgcgagccgggcc

SEQ ID NO: 30460 - DNA, 28 bp, Homo sapiens
gcggcgactctggacgcgagccgggccc

SEQ ID NO: 30461 - DNA, 29 bp, Homo sapiens
gcggcgactctggacgcgagccgggccct

SEQ ID NO: 30462 - DNA, 30 bp, Homo sapiens; identical to SEQ ID NO: 5266

SEQ ID NO: 30463 - DNA, 16 bp, Homo sapiens
cggcgactctggacgc

SEQ ID NO: 30464 - DNA, 17 bp, Homo sapiens
cggcgactctggacgcg

SEQ ID NO: 30465 - DNA, 18 bp, Homo sapiens
cggcgactctggacgcga

SEQ ID NO: 30466 - DNA, 19 bp, Homo sapiens
cggcgactctggacgcgag

SEQ ID NO: 30467 - DNA, 20 bp, Homo sapiens
cggcgactctggacgcgagc

SEQ ID NO: 30468 - DNA, 21 bp, Homo sapiens
cggcgactctggacgcgagcc

SEQ ID NO: 30469 - DNA, 22 bp, Homo sapiens
cggcgactctggacgcgagccg

SEQ ID NO: 30470 - DNA, 23 bp, Homo sapiens
cggcgactctggacgcgagccgg

SEQ ID NO: 30471 - DNA, 24 bp, Homo sapiens
cggcgactctggacgcgagccggg

SEQ ID NO: 30472 - DNA, 25 bp, Homo sapiens
cggcgactctggacgcgagccgggc

SEQ ID NO: 30473 - DNA, 26 bp, Homo sapiens
cggcgactctggacgcgagccgggcc

SEQ ID NO: 30474 - DNA, 27 bp, Homo sapiens
cggcgactctggacgcgagccgggccc

SEQ ID NO: 30475 - DNA, 28 bp, Homo sapiens
cggcgactctggacgcgagccgggccct

SEQ ID NO: 30476 - DNA, 18 bp, Homo sapiens
ggcgactctggacgcgag

SEQ ID NO: 30477 - DNA, 19 bp, Homo sapiens
ggcgactctggacgcgagc

SEQ ID NO: 30478 - DNA, 20 bp, Homo sapiens
ggcgactctggacgcgagcc

SEQ ID NO: 30479 - DNA, 21 bp, Homo sapiens
ggcgactctggacgcgagccg

SEQ ID NO: 30480 - DNA, 22 bp, Homo sapiens
ggcgactctggacgcgagccgg

SEQ ID NO: 30481 - DNA, 23 bp, Homo sapiens
ggcgactctggacgcgagccggg

SEQ ID NO: 30482 - DNA, 24 bp, Homo sapiens
ggcgactctggacgcgagccgggc

SEQ ID NO: 30483 - DNA, 25 bp, Homo sapiens
ggcgactctggacgcgagccgggcc

SEQ ID NO: 30484 - DNA, 26 bp, Homo sapiens
ggcgactctggacgcgagccgggccc

SEQ ID NO: 30485 - DNA, 16 bp, Homo sapiens
gcgactctggacgcga

SEQ ID NO: 30486 - DNA, 17 bp, Homo sapiens
gcgactctggacgcgag

SEQ ID NO: 30487 - DNA, 18 bp, Homo sapiens
gcgactctggacgcgagc

SEQ ID NO: 30488 - DNA, 19 bp, Homo sapiens
gcgactctggacgcgagcc

SEQ ID NO: 30489 - DNA, 20 bp, Homo sapiens
gcgactctggacgcgagccg

SEQ ID NO: 30490 - DNA, 21 bp, Homo sapiens
gcgactctggacgcgagccgg

SEQ ID NO: 30491 - DNA, 22 bp, Homo sapiens
gcgactctggacgcgagccggg

SEQ ID NO: 30492 - DNA, 23 bp, Homo sapiens
gcgactctggacgcgagccgggc

SEQ ID NO: 30493 - DNA, 24 bp, Homo sapiens
gcgactctggacgcgagccgggcc

SEQ ID NO: 30494 - DNA, 25 bp, Homo sapiens
gcgactctggacgcgagccgggccc

SEQ ID NO: 30495 - DNA, 16 bp, Homo sapiens
cgactctggacgcgag

SEQ ID NO: 30496 - DNA, 17 bp, Homo sapiens
cgactctggacgcgagc

SEQ ID NO: 30497 - DNA, 18 bp, Homo sapiens
cgactctggacgcgagcc

SEQ ID NO: 30498 - DNA, 19 bp, Homo sapiens
cgactctggacgcgagccg

SEQ ID NO: 30499 - DNA, 20 bp, Homo sapiens
cgactctggacgcgagccgg

SEQ ID NO: 30500 - DNA, 21 bp, Homo sapiens
cgactctggacgcgagccggg

SEQ ID NO: 30501 - DNA, 22 bp, Homo sapiens
cgactctggacgcgagccgggc

SEQ ID NO: 30502 - DNA, 19 bp, Homo sapiens
actctggacgcgagccggg

SEQ ID NO: 30503 - DNA, 20 bp, Homo sapiens
actctggacgcgagccgggc

SEQ ID NO: 30504 - DNA, 21 bp, Homo sapiens
actctggacgcgagccgggcc

SEQ ID NO: 30505 - DNA, 22 bp, Homo sapiens
actctggacgcgagccgggccc

SEQ ID NO: 30506 - DNA, 17 bp, Homo sapiens
ctctggacgcgagccgg

SEQ ID NO: 30507 - DNA, 18 bp, Homo sapiens
ctctggacgcgagccggg

SEQ ID NO: 30508 - DNA, 19 bp, Homo sapiens
ctctggacgcgagccgggc

SEQ ID NO: 30509 - DNA, 20 bp, Homo sapiens
ctctggacgcgagccgggcc

SEQ ID NO: 30510 - DNA, 21 bp, Homo sapiens
ctctggacgcgagccgggccc

SEQ ID NO: 30511 - DNA, 22 bp, Homo sapiens
ctctggacgcgagccgggccct

SEQ ID NO: 30512 - DNA, 27 bp, Homo sapiens
ctctggacgcgagccgggcccttcccg

SEQ ID NO: 30513 - DNA, 20 bp, Homo sapiens
ggacgcgagccgggcccttc

SEQ ID NO: 30514 - DNA, 22 bp, Homo sapiens
tcccgtggatcgccccagctgc

SEQ ID NO: 30515 - DNA, 21 bp, Homo sapiens
cgtggatcgccccagctgcgg

SEQ ID NO: 30516 - DNA, 20 bp, Homo sapiens
gtggatcgccccagctgcgg

SEQ ID NO: 30517 - DNA, 19 bp, Homo sapiens
tggatcgccccagctgcgg

SEQ ID NO: 30518 - DNA, 22 bp, Homo sapiens
gcgtcgcggccgcccccgggga

SEQ ID NO: 30519 - DNA, 22 bp, Homo sapiens
ccccaccccacgtctcgtcgcg

SEQ ID NO: 30520 - DNA, 21 bp, Homo sapiens
cccaccccacgtctcgtcgcg

SEQ ID NO: 30521 - DNA, 20 bp, Homo sapiens
ccaccccacgtctcgtcgcg

SEQ ID NO: 30522 - DNA, 19 bp, Homo sapiens
caccccacgtctcgtcgcg

SEQ ID NO: 30523 - DNA, 18 bp, Homo sapiens
accccacgtctcgtcgcg

SEQ ID NO: 30524 - DNA, 22 bp, Homo sapiens
accccacgtctcgtcgcgcgcg

SEQ ID NO: 30525 - DNA, 23 bp, Homo sapiens
accccacgtctcgtcgcgcgcgc

SEQ ID NO: 30526 - DNA, 17 bp, Homo sapiens
ccccacgtctcgtcgcg

SEQ ID NO: 30527 - DNA, 18 bp, Homo sapiens
acgtctcgtcgcgcgcgc

SEQ ID NO: 30528 - DNA, 21 bp, Homo sapiens
acgtctcgtcgcgcgcgcgtc

SEQ ID NO: 30529 - DNA, 22 bp, Homo sapiens
acgtctcgtcgcgcgcgcgtcc

SEQ ID NO: 30530 - DNA, 23 bp, Homo sapiens
acgtctcgtcgcgcgcgcgtccg

SEQ ID NO: 30531 - DNA, 24 bp, Homo sapiens
acgtctcgtcgcgcgcgcgtccgc

SEQ ID NO: 30532 - DNA, 23 bp, Homo sapiens
cgtctcgtcgcgcgcgcgtccgc

SEQ ID NO: 30533 - DNA, 21 bp, Homo sapiens
gtctcgtcgcgcgcgcgtccg

SEQ ID NO: 30534 - DNA, 22 bp, Homo sapiens
gtctcgtcgcgcgcgcgtccgc

SEQ ID NO: 30535 - DNA, 23 bp, Homo sapiens
gtctcgtcgcgcgcgcgtccgct

SEQ ID NO: 30536 - DNA, 21 bp, Homo sapiens
tctcgtcgcgcgcgcgtccgc

SEQ ID NO: 30537 - DNA, 18 bp, Homo sapiens
ctcgtcgcgcgcgcgtcc

SEQ ID NO: 30538 - DNA, 19 bp, Homo sapiens
ctcgtcgcgcgcgcgtccg

SEQ ID NO: 30539 - DNA, 20 bp, Homo sapiens
ctcgtcgcgcgcgcgtccgc

SEQ ID NO: 30540 - DNA, 21 bp, Homo sapiens
ctcgtcgcgcgcgcgtccgct

SEQ ID NO: 30541 - DNA, 19 bp, Homo sapiens
tcgtcgcgcgcgcgtccgc

SEQ ID NO: 30542 - DNA, 18 bp, Homo sapiens
gggggcggggagcggtcg

SEQ ID NO: 30543 - DNA, 23 bp, Homo sapiens
gggggcggggagcggtcgggcgg

SEQ ID NO: 30544 - DNA, 22 bp, Homo sapiens
cggggagcggtcgggcggcggc

SEQ ID NO: 30545 - DNA, 21 bp, Homo sapiens
ggggagcggtcgggcggcggc

SEQ ID NO: 30546 - DNA, 20 bp, Homo sapiens
gggagcggtcgggcggcggc

SEQ ID NO: 30547 - DNA, 21 bp, Homo sapiens
gggagcggtcgggcggcggcg

SEQ ID NO: 30548 - DNA, 19 bp, Homo sapiens
ggagcggtcgggcggcggc

SEQ ID NO: 30549 - DNA, 25 bp, Homo sapiens
gagcggtcgggcggcggcggtcggc

SEQ ID NO: 30550 - DNA, 22 bp, Homo sapiens
cgggcggcggcggtcggcgggc

SEQ ID NO: 30551 - DNA, 21 bp, Homo sapiens
gggcggcggcggtcggcgggc

SEQ ID NO: 30552 - DNA, 21 bp, Homo sapiens
gcggcggcggtcggcgggcgg

SEQ ID NO: 30553 - DNA, 18 bp, Homo sapiens
gcggcggtcggcgggcgg

SEQ ID NO: 30554 - DNA, 20 bp, Homo sapiens
gcggcggtcggcgggcggcg

SEQ ID NO: 30555 - DNA, 21 bp, Homo sapiens
gcggcggtcggcgggcggcgg

SEQ ID NO: 30556 - DNA, 22 bp, Homo sapiens
gcggcggtcggcgggcggcggg

SEQ ID NO: 30557 - DNA, 23 bp, Homo sapiens
gcggcggtcggcgggcggcgggg

SEQ ID NO: 30558 - DNA, 24 bp, Homo sapiens
gcggcggtcggcgggcggcggggc

SEQ ID NO: 30559 - DNA, 25 bp, Homo sapiens
gcggcggtcggcgggcggcggggcg

SEQ ID NO: 30560 - DNA, 17 bp, Homo sapiens
cggcggtcggcgggcgg

SEQ ID NO: 30561 - DNA, 18 bp, Homo sapiens
cggcggtcggcgggcggc

SEQ ID NO: 30562 - DNA, 19 bp, Homo sapiens
cggcggtcggcgggcggcg

SEQ ID NO: 30563 - DNA, 20 bp, Homo sapiens
cggcggtcggcgggcggcgg

SEQ ID NO: 30564 - DNA, 21 bp, Homo sapiens
cggcggtcggcgggcggcggg

SEQ ID NO: 30565 - DNA, 22 bp, Homo sapiens
cggcggtcggcgggcggcgggg

SEQ ID NO: 30566 - DNA, 23 bp, Homo sapiens
cggcggtcggcgggcggcggggc

SEQ ID NO: 30567 - DNA, 24 bp, Homo sapiens
cggcggtcggcgggcggcggggcg

SEQ ID NO: 30568 - DNA, 25 bp, Homo sapiens
cggcggtcggcgggcggcggggcgg

SEQ ID NO: 30569 - DNA, 26 bp, Homo sapiens
cggcggtcggcgggcggcggggcggg

SEQ ID NO: 30570 - DNA, 19 bp, Homo sapiens
ggcggtcggcgggcggcgg

SEQ ID NO: 30571 - DNA, 20 bp, Homo sapiens
ggcggtcggcgggcggcggg

SEQ ID NO: 30572 - DNA, 21 bp, Homo sapiens
ggcggtcggcgggcggcgggg

SEQ ID NO: 30573 - DNA, 22 bp, Homo sapiens
ggcggtcggcgggcggcggggc

SEQ ID NO: 30574 - DNA, 23 bp, Homo sapiens
ggcggtcggcgggcggcggggcg

SEQ ID NO: 30575 - DNA, 24 bp, Homo sapiens
ggcggtcggcgggcggcggggcgg

SEQ ID NO: 30576 - DNA, 25 bp, Homo sapiens
ggcggtcggcgggcggcggggcggg

SEQ ID NO: 30577 - DNA, 18 bp, Homo sapiens
gcggtcggcgggcggcgg

SEQ ID NO: 30578 - DNA, 19 bp, Homo sapiens
gcggtcggcgggcggcggg

SEQ ID NO: 30579 - DNA, 20 bp, Homo sapiens
gcggtcggcgggcggcgggg

SEQ ID NO: 30580 - DNA, 21 bp, Homo sapiens
gcggtcggcgggcggcggggc

SEQ ID NO: 30581 - DNA, 22 bp, Homo sapiens
gcggtcggcgggcggcggggcg

SEQ ID NO: 30582 - DNA, 23 bp, Homo sapiens
gcggtcggcgggcggcggggcgg

SEQ ID NO: 30583 - DNA, 24 bp, Homo sapiens
gcggtcggcgggcggcggggcggg

SEQ ID NO: 30584 - DNA, 26 bp, Homo sapiens
gcggtcggcgggcggcggggcggggc

SEQ ID NO: 30585 - DNA, 28 bp, Homo sapiens
gcggtcggcgggcggcggggcggggcgg

SEQ ID NO: 30586 - DNA, 18 bp, Homo sapiens
cggtcggcgggcggcggg

SEQ ID NO: 30587 - DNA, 19 bp, Homo sapiens
cggtcggcgggcggcgggg

SEQ ID NO: 30588 - DNA, 20 bp, Homo sapiens
cggtcggcgggcggcggggc

SEQ ID NO: 30589 - DNA, 21 bp, Homo sapiens
cggtcggcgggcggcggggcg

SEQ ID NO: 30590 - DNA, 22 bp, Homo sapiens
cggtcggcgggcggcggggcgg

SEQ ID NO: 30591 - DNA, 23 bp, Homo sapiens
cggtcggcgggcggcggggcggg

SEQ ID NO: 30592 - DNA, 24 bp, Homo sapiens
cggtcggcgggcggcggggcgggg

SEQ ID NO: 30593 - DNA, 25 bp, Homo sapiens
cggtcggcgggcggcggggcggggc

SEQ ID NO: 30594 - DNA, 26 bp, Homo sapiens
cggtcggcgggcggcggggcggggcg

SEQ ID NO: 30595 - DNA, 27 bp, Homo sapiens
cggtcggcgggcggcggggcggggcgg

SEQ ID NO: 30596 - DNA, 19 bp, Homo sapiens
ggtcggcgggcggcggggc

SEQ ID NO: 30597 - DNA, 20 bp, Homo sapiens
ggtcggcgggcggcggggcg

SEQ ID NO: 30598 - DNA, 21 bp, Homo sapiens
ggtcggcgggcggcggggcgg

SEQ ID NO: 30599 - DNA, 22 bp, Homo sapiens
ggtcggcgggcggcggggcggg

SEQ ID NO: 30600 - DNA, 23 bp, Homo sapiens
ggtcggcgggcggcggggcgggg

SEQ ID NO: 30601 - DNA, 24 bp, Homo sapiens
ggtcggcgggcggcggggcggggc

SEQ ID NO: 30602 - DNA, 25 bp, Homo sapiens
ggtcggcgggcggcggggcggggcg

SEQ ID NO: 30603 - DNA, 26 bp, Homo sapiens
ggtcggcgggcggcggggcggggcgg

SEQ ID NO: 30604 - DNA, 24 bp, Homo sapiens
ccccgccctacccccccggccccg

SEQ ID NO: 30605 - DNA, 21 bp, Homo sapiens
ccctacccccccggccccgtc

SEQ ID NO: 30606 - DNA, 23 bp, Homo sapiens
gttcccccctcctcctcggcgcg

SEQ ID NO: 30607 - DNA, 22 bp, Homo sapiens
cccctcctcctcggcgcgcggc

SEQ ID NO: 30608 - DNA, 19 bp, Homo sapiens
ctcggcgcgcggcggcggc

SEQ ID NO: 30609 - DNA, 22 bp, Homo sapiens
ctcggcgcgcggcggcggcggc

SEQ ID NO: 30610 - DNA, 20 bp, Homo sapiens
cggcgcgcggcggcggcggc

SEQ ID NO: 30611 - DNA, 22 bp, Homo sapiens
cggcgcgcggcggcggcggcgg

SEQ ID NO: 30612 - DNA, 16 bp, Homo sapiens
ggcgcgcggcggcggc

SEQ ID NO: 30613 - DNA, 18 bp, Homo sapiens
ggcgcgcggcggcggcgg

SEQ ID NO: 30614 - DNA, 19 bp, Homo sapiens
ggcgcgcggcggcggcggc

SEQ ID NO: 30615 - DNA, 20 bp, Homo sapiens
ggcgcgcggcggcggcggcg

SEQ ID NO: 30616 - DNA, 21 bp, Homo sapiens
ggcgcgcggcggcggcggcgg

SEQ ID NO: 30617 - DNA, 22 bp, Homo sapiens
ggcgcgcggcggcggcggcggg

SEQ ID NO: 30618 - DNA, 22 bp, Homo sapiens
cggcggaggggccgcgggccgg

SEQ ID NO: 30619 - DNA, 23 bp, Homo sapiens
gcgcggcgcctcgcctcggccgg

SEQ ID NO: 30620 - DNA, 22 bp, Homo sapiens
cgcggcgcctcgcctcggccgg

SEQ ID NO: 30621 - DNA, 21 bp, Homo sapiens
gcggcgcctcgcctcggccgg

SEQ ID NO: 30622 - DNA, 20 bp, Homo sapiens
cggcgcctcgcctcggccgg

SEQ ID NO: 30623 - DNA, 19 bp, Homo sapiens
ggcgcctcgcctcggccgg

SEQ ID NO: 30624 - DNA, 20 bp, Homo sapiens
ggcgcctcgcctcggccggc

SEQ ID NO: 30625 - DNA, 22 bp, Homo sapiens
cgcctagcagccgacttagaac

SEQ ID NO: 30626 - DNA, 19 bp, Homo sapiens
tagcagccgacttagaact

SEQ ID NO: 30627 - DNA, 21 bp, Homo sapiens
tagcagccgacttagaactgg

SEQ ID NO: 30628 - DNA, 20 bp, Homo sapiens
agcagccgacttagaactgg

SEQ ID NO: 30629 - DNA, 17 bp, Homo sapiens
gcagccgacttagaact

SEQ ID NO: 30630 - DNA, 19 bp, Homo sapiens
gcagccgacttagaactgg

SEQ ID NO: 30631 - DNA, 20 bp, Homo sapiens
gcagccgacttagaactggt

SEQ ID NO: 30632 - DNA, 21 bp, Homo sapiens
gcagccgacttagaactggtg

SEQ ID NO: 30633 - DNA, 22 bp, Homo sapiens
gcagccgacttagaactggtgc

SEQ ID NO: 30634 - DNA, 30 bp, Homo sapiens; identical to SEQ ID NO: 24801

SEQ ID NO: 30635 - DNA, 24 bp, Homo sapiens
gccgacttagaactggtgcggacc

SEQ ID NO: 30636 - DNA, 18 bp, Homo sapiens
ccgacttagaactggtgc

SEQ ID NO: 30637 - DNA, 20 bp, Homo sapiens
ccgacttagaactggtgcgg

SEQ ID NO: 30638 - DNA, 22 bp, Homo sapiens
ccgacttagaactggtgcggac

SEQ ID NO: 30639 - DNA, 23 bp, Homo sapiens
ccgacttagaactggtgcggacc

SEQ ID NO: 30640 - DNA, 18 bp, Homo sapiens
cgacttagaactggtgcg

SEQ ID NO: 30641 - DNA, 19 bp, Homo sapiens
cgacttagaactggtgcgg

SEQ ID NO: 30642 - DNA, 20 bp, Homo sapiens
cgacttagaactggtgcgga

SEQ ID NO: 30643 - DNA, 21 bp, Homo sapiens
cgacttagaactggtgcggac

SEQ ID NO: 30644 - DNA, 22 bp, Homo sapiens
cgacttagaactggtgcggacc

SEQ ID NO: 30645 - DNA, 21 bp, Homo sapiens
gacttagaactggtgcggacc

SEQ ID NO: 30646 - DNA, 24 bp, Homo sapiens
cttagaactggtgcggaccagggg

SEQ ID NO: 30647 - DNA, 23 bp, Homo sapiens
ttagaactggtgcggaccagggg

SEQ ID NO: 30648 - DNA, 24 bp, Homo sapiens
ttagaactggtgcggaccagggga

SEQ ID NO: 30649 - DNA, 22 bp, Homo sapiens
tagaactggtgcggaccagggg

SEQ ID NO: 30650 - DNA, 23 bp, Homo sapiens
tagaactggtgcggaccagggga

SEQ ID NO: 30651 - DNA, 21 bp, Homo sapiens
agaactggtgcggaccagggg

SEQ ID NO: 30652 - DNA, 22 bp, Homo sapiens
agaactggtgcggaccagggga

SEQ ID NO: 30653 - DNA, 20 bp, Homo sapiens
gaactggtgcggaccagggg

SEQ ID NO: 30654 - DNA, 21 bp, Homo sapiens
gaactggtgcggaccagggga

SEQ ID NO: 30655 - DNA, 19 bp, Homo sapiens
aactggtgcggaccagggg

SEQ ID NO: 30656 - DNA, 20 bp, Homo sapiens
aactggtgcggaccagggga

SEQ ID NO: 30657 - DNA, 23 bp, Homo sapiens
aactggtgcggaccaggggaatc

SEQ ID NO: 30658 - DNA, 25 bp, Homo sapiens
aactggtgcggaccaggggaatccg

SEQ ID NO: 30659 - DNA, 26 bp, Homo sapiens
aactggtgcggaccaggggaatccga

SEQ ID NO: 30660 - DNA, 27 bp, Homo sapiens
aactggtgcggaccaggggaatccgac

SEQ ID NO: 30661 - DNA, 30 bp, Homo sapiens; identical to SEQ ID NO: 5429

SEQ ID NO: 30662 - DNA, 18 bp, Homo sapiens
actggtgcggaccagggg

SEQ ID NO: 30663 - DNA, 19 bp, Homo sapiens
actggtgcggaccagggga

SEQ ID NO: 30664 - DNA, 20 bp, Homo sapiens
actggtgcggaccaggggaa

SEQ ID NO: 30665 - DNA, 21 bp, Homo sapiens
actggtgcggaccaggggaat

SEQ ID NO: 30666 - DNA, 22 bp, Homo sapiens
actggtgcggaccaggggaatc

SEQ ID NO: 30667 - DNA, 23 bp, Homo sapiens
actggtgcggaccaggggaatcc

SEQ ID NO: 30668 - DNA, 24 bp, Homo sapiens
actggtgcggaccaggggaatccg

SEQ ID NO: 30669 - DNA, 25 bp, Homo sapiens
actggtgcggaccaggggaatccga

SEQ ID NO: 30670 - DNA, 18 bp, Homo sapiens
ctggtgcggaccagggga

SEQ ID NO: 30671 - DNA, 21 bp, Homo sapiens
ctggtgcggaccaggggaatc

SEQ ID NO: 30672 - DNA, 24 bp, Homo sapiens
ctggtgcggaccaggggaatccga

SEQ ID NO: 30673 - DNA, 27 bp, Homo sapiens
ctggtgcggaccaggggaatccgactg

SEQ ID NO: 30674 - DNA, 16 bp, Homo sapiens
tggtgcggaccagggg

SEQ ID NO: 30675 - DNA, 17 bp, Homo sapiens
tggtgcggaccagggga

SEQ ID NO: 30676 - DNA, 18 bp, Homo sapiens
tggtgcggaccaggggaa

SEQ ID NO: 30677 - DNA, 19 bp, Homo sapiens
tggtgcggaccaggggaat

SEQ ID NO: 30678 - DNA, 20 bp, Homo sapiens
tggtgcggaccaggggaatc

SEQ ID NO: 30679 - DNA, 21 bp, Homo sapiens
tggtgcggaccaggggaatcc

SEQ ID NO: 30680 - DNA, 22 bp, Homo sapiens
tggtgcggaccaggggaatccg

SEQ ID NO: 30681 - DNA, 23 bp, Homo sapiens
tggtgcggaccaggggaatccga

SEQ ID NO: 30682 - DNA, 24 bp, Homo sapiens
tggtgcggaccaggggaatccgac

SEQ ID NO: 30683 - DNA, 26 bp, Homo sapiens
tggtgcggaccaggggaatccgactg

SEQ ID NO: 30684 - DNA, 28 bp, Homo sapiens
tggtgcggaccaggggaatccgactgtt

SEQ ID NO: 30685 - DNA, 29 bp, Homo sapiens
tggtgcggaccaggggaatccgactgttt

SEQ ID NO: 30686 - DNA, 16 bp, Homo sapiens
ggtgcggaccagggga

SEQ ID NO: 30687 - DNA, 17 bp, Homo sapiens
ggtgcggaccaggggaa

SEQ ID NO: 30688 - DNA, 18 bp, Homo sapiens
ggtgcggaccaggggaat

SEQ ID NO: 30689 - DNA, 19 bp, Homo sapiens
ggtgcggaccaggggaatc

SEQ ID NO: 30690 - DNA, 20 bp, Homo sapiens
ggtgcggaccaggggaatcc

SEQ ID NO: 30691 - DNA, 21 bp, Homo sapiens
ggtgcggaccaggggaatccg

SEQ ID NO: 30692 - DNA, 22 bp, Homo sapiens
ggtgcggaccaggggaatccga

SEQ ID NO: 30693 - DNA, 23 bp, Homo sapiens
ggtgcggaccaggggaatccgac

SEQ ID NO: 30694 - DNA, 25 bp, Homo sapiens
ggtgcggaccaggggaatccgactg

SEQ ID NO: 30695 - DNA, 27 bp, Homo sapiens
ggtgcggaccaggggaatccgactgtt

SEQ ID NO: 30696 - DNA, 28 bp, Homo sapiens
ggtgcggaccaggggaatccgactgttt

SEQ ID NO: 30697 - DNA, 16 bp, Homo sapiens
gtgcggaccaggggaa

SEQ ID NO: 30698 - DNA, 17 bp, Homo sapiens
gtgcggaccaggggaat

SEQ ID NO: 30699 - DNA, 18 bp, Homo sapiens
gtgcggaccaggggaatc

SEQ ID NO: 30700 - DNA, 19 bp, Homo sapiens
gtgcggaccaggggaatcc

SEQ ID NO: 30701 - DNA, 21 bp, Homo sapiens
gtgcggaccaggggaatccga

SEQ ID NO: 30702 - DNA, 24 bp, Homo sapiens
gtgcggaccaggggaatccgactg

SEQ ID NO: 30703 - DNA, 26 bp, Homo sapiens
gtgcggaccaggggaatccgactgtt

SEQ ID NO: 30704 - DNA, 27 bp, Homo sapiens
gtgcggaccaggggaatccgactgttt

SEQ ID NO: 30705 - DNA, 16 bp, Homo sapiens
tgcggaccaggggaat

SEQ ID NO: 30706 - DNA, 17 bp, Homo sapiens
tgcggaccaggggaatc

SEQ ID NO: 30707 - DNA, 18 bp, Homo sapiens
tgcggaccaggggaatcc

SEQ ID NO: 30708 - DNA, 23 bp, Homo sapiens
tgcggaccaggggaatccgactg

SEQ ID NO: 30709 - DNA, 16 bp, Homo sapiens
gcggaccaggggaatc

SEQ ID NO: 30710 - DNA, 19 bp, Homo sapiens
cggaccaggggaatccgac

SEQ ID NO: 30711 - DNA, 19 bp, Homo sapiens
ccaggggaatccgactgtt

SEQ ID NO: 30712 - DNA, 20 bp, Homo sapiens
ccaggggaatccgactgttt

SEQ ID NO: 30713 - DNA, 18 bp, Homo sapiens
caggggaatccgactgtt

SEQ ID NO: 30714 - DNA, 19 bp, Homo sapiens
caggggaatccgactgttt

SEQ ID NO: 30715 - DNA, 20 bp, Homo sapiens
caggggaatccgactgttta

SEQ ID NO: 30716 - DNA, 17 bp, Homo sapiens
aggggaatccgactgtt

SEQ ID NO: 30717 - DNA, 18 bp, Homo sapiens
aggggaatccgactgttt

SEQ ID NO: 30718 - DNA, 19 bp, Homo sapiens
aggggaatccgactgttta

SEQ ID NO: 30719 - DNA, 21 bp, Homo sapiens
gcgggtgttgacgcgatgtga

SEQ ID NO: 30720 - DNA, 23 bp, Homo sapiens
gacgcgatgtgatttctgcccag

SEQ ID NO: 30721 - DNA, 22 bp, Homo sapiens
acgcgatgtgatttctgcccag

SEQ ID NO: 30722 - DNA, 21 bp, Homo sapiens
cgcgatgtgatttctgcccag

SEQ ID NO: 30723 - DNA, 20 bp, Homo sapiens
gcgatgtgatttctgcccag

SEQ ID NO: 30724 - DNA, 19 bp, Homo sapiens
cgatgtgatttctgcccag

SEQ ID NO: 30725 - DNA, 23 bp, Homo sapiens
gtgatttctgcccagtgctctga

SEQ ID NO: 30726 - DNA, 22 bp, Homo sapiens
tgatttctgcccagtgctctga

SEQ ID NO: 30727 - DNA, 21 bp, Homo sapiens
gatttctgcccagtgctctga

SEQ ID NO: 30728 - DNA, 23 bp, Homo sapiens
gatttctgcccagtgctctgaat

SEQ ID NO: 30729 - DNA, 20 bp, Homo sapiens
atttctgcccagtgctctga

SEQ ID NO: 30730 - DNA, 21 bp, Homo sapiens
atttctgcccagtgctctgaa

SEQ ID NO: 30731 - DNA, 22 bp, Homo sapiens
atttctgcccagtgctctgaat

SEQ ID NO: 30732 - DNA, 23 bp, Homo sapiens
atttctgcccagtgctctgaatg

SEQ ID NO: 30733 - DNA, 25 bp, Homo sapiens
atttctgcccagtgctctgaatgtc

SEQ ID NO: 30734 - DNA, 18 bp, Homo sapiens
tttctgcccagtgctctg

SEQ ID NO: 30735 - DNA, 19 bp, Homo sapiens
tttctgcccagtgctctga

SEQ ID NO: 30736 - DNA, 20 bp, Homo sapiens
tttctgcccagtgctctgaa

SEQ ID NO: 30737 - DNA, 21 bp, Homo sapiens
tttctgcccagtgctctgaat

SEQ ID NO: 30738 - DNA, 22 bp, Homo sapiens
tttctgcccagtgctctgaatg

SEQ ID NO: 30739 - DNA, 18 bp, Homo sapiens
ttctgcccagtgctctga

SEQ ID NO: 30740 - DNA, 19 bp, Homo sapiens
ttctgcccagtgctctgaa

SEQ ID NO: 30741 - DNA, 20 bp, Homo sapiens
ttctgcccagtgctctgaat

SEQ ID NO: 30742 - DNA, 23 bp, Homo sapiens
ttctgcccagtgctctgaatgtc

SEQ ID NO: 30743 - DNA, 17 bp, Homo sapiens
tctgcccagtgctctga

SEQ ID NO: 30744 - DNA, 18 bp, Homo sapiens
tctgcccagtgctctgaa

SEQ ID NO: 30745 - DNA, 19 bp, Homo sapiens
tctgcccagtgctctgaat

SEQ ID NO: 30746 - DNA, 20 bp, Homo sapiens
tctgcccagtgctctgaatg

SEQ ID NO: 30747 - DNA, 22 bp, Homo sapiens
tctgcccagtgctctgaatgtc

SEQ ID NO: 30748 - DNA, 23 bp, Homo sapiens
tctgcccagtgctctgaatgtca

SEQ ID NO: 30749 - DNA, 26 bp, Homo sapiens
tctgcccagtgctctgaatgtcaaag

SEQ ID NO: 30750 - DNA, 19 bp, Homo sapiens
ctgcccagtgctctgaatg

SEQ ID NO: 30751 - DNA, 21 bp, Homo sapiens
ctgcccagtgctctgaatgtc

SEQ ID NO: 30752 - DNA, 20 bp, Homo sapiens
tgcccagtgctctgaatgtc

SEQ ID NO: 30753 - DNA, 19 bp, Homo sapiens
gcccagtgctctgaatgtc

SEQ ID NO: 30754 - DNA, 18 bp, Homo sapiens
cccagtgctctgaatgtc

SEQ ID NO: 30755 - DNA, 21 bp, Homo sapiens
ccagtgctctgaatgtcaaag

SEQ ID NO: 30756 - DNA, 20 bp, Homo sapiens
cagtgctctgaatgtcaaag

SEQ ID NO: 30757 - DNA, 25 bp, Homo sapiens
cagtgctctgaatgtcaaagtgaag

SEQ ID NO: 30758 - DNA, 20 bp, Homo sapiens
ctctgaatgtcaaagtgaag

SEQ ID NO: 30759 - DNA, 20 bp, Homo sapiens
cgcgcatgaatggatgaacg

SEQ ID NO: 30760 - DNA, 25 bp, Homo sapiens
gcatgaatggatgaacgagattccc

SEQ ID NO: 30761 - DNA, 22 bp, Homo sapiens
cccactgtccctacctactatc

SEQ ID NO: 30762 - DNA, 21 bp, Homo sapiens
ccactgtccctacctactatc

SEQ ID NO: 30763 - DNA, 20 bp, Homo sapiens
cactgtccctacctactatc

SEQ ID NO: 30764 - DNA, 21 bp, Homo sapiens
cactgtccctacctactatcc

SEQ ID NO: 30765 - DNA, 19 bp, Homo sapiens
actgtccctacctactatc

SEQ ID NO: 30766 - DNA, 18 bp, Homo sapiens
ctgtccctacctactatc

SEQ ID NO: 30767 - DNA, 19 bp, Homo sapiens
ctgtccctacctactatcc

SEQ ID NO: 30768 - DNA, 18 bp, Homo sapiens
gccaagggaacgggcttg

SEQ ID NO: 30769 - DNA, 23 bp, Homo sapiens
aagaccctgttgagcttgactct

SEQ ID NO: 30770 - DNA, 21 bp, Homo sapiens
gaccctgttgagcttgactct

SEQ ID NO: 30771 - DNA, 20 bp, Homo sapiens
accctgttgagcttgactct

SEQ ID NO: 30772 - DNA, 19 bp, Homo sapiens
ccctgttgagcttgactct

SEQ ID NO: 30773 - DNA, 20 bp, Homo sapiens
ccctgttgagcttgactcta

SEQ ID NO: 30774 - DNA, 17 bp, Homo sapiens
ctgttgagcttgactct

SEQ ID NO: 30775 - DNA, 21 bp, Homo sapiens
ttgactctagtctggcacggt

SEQ ID NO: 30776 - DNA, 20 bp, Homo sapiens
tgactctagtctggcacggt

SEQ ID NO: 30777 - DNA, 21 bp, Homo sapiens
tgactctagtctggcacggtg

SEQ ID NO: 30778 - DNA, 28 bp, Homo sapiens
tgagaggtgtagaataagtgggaggccc

SEQ ID NO: 30779 - DNA, 27 bp, Homo sapiens
gagaggtgtagaataagtgggaggccc

SEQ ID NO: 30780 - DNA, 25 bp, Homo sapiens
agaggtgtagaataagtgggaggcc

SEQ ID NO: 30781 - DNA, 26 bp, Homo sapiens
agaggtgtagaataagtgggaggccc

SEQ ID NO: 30782 - DNA, 24 bp, Homo sapiens
gaggtgtagaataagtgggaggcc

SEQ ID NO: 30783 - DNA, 25 bp, Homo sapiens
gaggtgtagaataagtgggaggccc

SEQ ID NO: 30784 - DNA, 23 bp, Homo sapiens
aggtgtagaataagtgggaggcc

SEQ ID NO: 30785 - DNA, 24 bp, Homo sapiens
aggtgtagaataagtgggaggccc

SEQ ID NO: 30786 - DNA, 23 bp, Homo sapiens
ggtgtagaataagtgggaggccc

SEQ ID NO: 30787 - DNA, 18 bp, Homo sapiens
ccgcgaggggcccggggc

SEQ ID NO: 30788 - DNA, 19 bp, Homo sapiens
ccgcgaggggcccggggcg

SEQ ID NO: 30789 - DNA, 20 bp, Homo sapiens
ccgcgaggggcccggggcgg

SEQ ID NO: 30790 - DNA, 17 bp, Homo sapiens
gcgaggggcccggggcg

SEQ ID NO: 30791 - DNA, 18 bp, Homo sapiens
gcgaggggcccggggcgg

SEQ ID NO: 30792 - DNA, 19 bp, Homo sapiens
gcgaggggcccggggcggg

SEQ ID NO: 30793 - DNA, 20 bp, Homo sapiens
gcgaggggcccggggcgggg

SEQ ID NO: 30794 - DNA, 21 bp, Homo sapiens
gcgaggggcccggggcggggt

SEQ ID NO: 30795 - DNA, 24 bp, Homo sapiens
gggccgccggtgaaataccactac

SEQ ID NO: 30796 - DNA, 28 bp, Homo sapiens
gggccgccggtgaaataccactactctg

SEQ ID NO: 30797 - DNA, 23 bp, Homo sapiens
ggccgccggtgaaataccactac

SEQ ID NO: 30798 - DNA, 24 bp, Homo sapiens
ggccgccggtgaaataccactact

SEQ ID NO: 30799 - DNA, 27 bp, Homo sapiens
ggccgccggtgaaataccactactctg

SEQ ID NO: 30800 - DNA, 28 bp, Homo sapiens
ggccgccggtgaaataccactactctga

SEQ ID NO: 30801 - DNA, 22 bp, Homo sapiens
gccgccggtgaaataccactac

SEQ ID NO: 30802 - DNA, 23 bp, Homo sapiens
gccgccggtgaaataccactact

SEQ ID NO: 30803 - DNA, 26 bp, Homo sapiens
gccgccggtgaaataccactactctg

SEQ ID NO: 30804 - DNA, 27 bp, Homo sapiens
gccgccggtgaaataccactactctga

SEQ ID NO: 30805 - DNA, 28 bp, Homo sapiens
gccgccggtgaaataccactactctgat

SEQ ID NO: 30806 - DNA, 29 bp, Homo sapiens
gccgccggtgaaataccactactctgatc

SEQ ID NO: 30807 - DNA, 30 bp, Homo sapiens; identical to SEQ ID NO: 5864

SEQ ID NO: 30808 - DNA, 23 bp, Homo sapiens
gaggggctctcgcttctggcgcc

SEQ ID NO: 30809 - DNA, 23 bp, Homo sapiens
acccgctccggggacagtgccag

SEQ ID NO: 30810 - DNA, 22 bp, Homo sapiens
cccgctccggggacagtgccag

SEQ ID NO: 30811 - DNA, 24 bp, Homo sapiens
tgccaggtggggagtttgactggg

SEQ ID NO: 30812 - DNA, 21 bp, Homo sapiens
caggtggggagtttgactggg

SEQ ID NO: 30813 - DNA, 20 bp, Homo sapiens
aggtggggagtttgactggg

SEQ ID NO: 30814 - DNA, 21 bp, Homo sapiens
aggtggggagtttgactgggg

SEQ ID NO: 30815 - DNA, 22 bp, Homo sapiens
aggtggggagtttgactggggc

SEQ ID NO: 30816 - DNA, 19 bp, Homo sapiens
ggtggggagtttgactggg

SEQ ID NO: 30817 - DNA, 20 bp, Homo sapiens
ggtggggagtttgactgggg

SEQ ID NO: 30818 - DNA, 21 bp, Homo sapiens
ggtggggagtttgactggggc

SEQ ID NO: 30819 - DNA, 18 bp, Homo sapiens
gtggggagtttgactggg

SEQ ID NO: 30820 - DNA, 19 bp, Homo sapiens
gtggggagtttgactgggg

SEQ ID NO: 30821 - DNA, 20 bp, Homo sapiens
gtggggagtttgactggggc

SEQ ID NO: 30822 - DNA, 21 bp, Homo sapiens
gtggggagtttgactggggcg

SEQ ID NO: 30823 - DNA, 19 bp, Homo sapiens
tggggagtttgactggggc

SEQ ID NO: 30824 - DNA, 20 bp, Homo sapiens
gaagggcaaaagctcgcttg

SEQ ID NO: 30825 - DNA, 23 bp, Homo sapiens
gaagggcaaaagctcgcttgatc

SEQ ID NO: 30826 - DNA, 24 bp, Homo sapiens
gaagggcaaaagctcgcttgatct

SEQ ID NO: 30827 - DNA, 25 bp, Homo sapiens
gaagggcaaaagctcgcttgatctt

SEQ ID NO: 30828 - DNA, 26 bp, Homo sapiens
gaagggcaaaagctcgcttgatcttg

SEQ ID NO: 30829 - DNA, 27 bp, Homo sapiens
gaagggcaaaagctcgcttgatcttga

SEQ ID NO: 30830 - DNA, 29 bp, Homo sapiens
gaagggcaaaagctcgcttgatcttgatt

SEQ ID NO: 30831 - DNA, 30 bp, Homo sapiens; identical to SEQ ID NO: 5941

SEQ ID NO: 30832 - DNA, 19 bp, Homo sapiens
aagggcaaaagctcgcttg

SEQ ID NO: 30833 - DNA, 22 bp, Homo sapiens
aagggcaaaagctcgcttgatc

SEQ ID NO: 30834 - DNA, 25 bp, Homo sapiens
aagggcaaaagctcgcttgatcttg

SEQ ID NO: 30835 - DNA, 18 bp, Homo sapiens
agggcaaaagctcgcttg

SEQ ID NO: 30836 - DNA, 21 bp, Homo sapiens
agggcaaaagctcgcttgatc

SEQ ID NO: 30837 - DNA, 22 bp, Homo sapiens
agggcaaaagctcgcttgatct

SEQ ID NO: 30838 - DNA, 23 bp, Homo sapiens
agggcaaaagctcgcttgatctt

SEQ ID NO: 30839 - DNA, 24 bp, Homo sapiens
agggcaaaagctcgcttgatcttg

SEQ ID NO: 30840 - DNA, 25 bp, Homo sapiens
agggcaaaagctcgcttgatcttga

SEQ ID NO: 30841 - DNA, 27 bp, Homo sapiens
agggcaaaagctcgcttgatcttgatt

SEQ ID NO: 30842 - DNA, 30 bp, Homo sapiens
agggcaaaagctcgcttgatcttgattttc

SEQ ID NO: 30843 - DNA, 17 bp, Homo sapiens
gggcaaaagctcgcttg

SEQ ID NO: 30844 - DNA, 20 bp, Homo sapiens
gggcaaaagctcgcttgatc

SEQ ID NO: 30845 - DNA, 21 bp, Homo sapiens
gggcaaaagctcgcttgatct

SEQ ID NO: 30846 - DNA, 22 bp, Homo sapiens
gggcaaaagctcgcttgatctt

SEQ ID NO: 30847 - DNA, 23 bp, Homo sapiens
gggcaaaagctcgcttgatcttg

SEQ ID NO: 30848 - DNA, 24 bp, Homo sapiens
gggcaaaagctcgcttgatcttga

SEQ ID NO: 30849 - DNA, 26 bp, Homo sapiens
gggcaaaagctcgcttgatcttgatt

SEQ ID NO: 30850 - DNA, 29 bp, Homo sapiens
gggcaaaagctcgcttgatcttgattttc

SEQ ID NO: 30851 - DNA, 16 bp, Homo sapiens
ggcaaaagctcgcttg

SEQ ID NO: 30852 - DNA, 22 bp, Homo sapiens
ggcaaaagctcgcttgatcttg

SEQ ID NO: 30853 - DNA, 18 bp, Homo sapiens
gcaaaagctcgcttgatc

SEQ ID NO: 30854 - DNA, 19 bp, Homo sapiens
gcaaaagctcgcttgatct

SEQ ID NO: 30855 - DNA, 21 bp, Homo sapiens
gcaaaagctcgcttgatcttg

SEQ ID NO: 30856 - DNA, 22 bp, Homo sapiens
gcaaaagctcgcttgatcttga

SEQ ID NO: 30857 - DNA, 24 bp, Homo sapiens
gcaaaagctcgcttgatcttgatt

SEQ ID NO: 30858 - DNA, 18 bp, Homo sapiens
gctcgcttgatcttgatt

SEQ ID NO: 30859 - DNA, 19 bp, Homo sapiens
gctcgcttgatcttgattt

SEQ ID NO: 30860 - DNA, 20 bp, Homo sapiens
gctcgcttgatcttgatttt

SEQ ID NO: 30861 - DNA, 21 bp, Homo sapiens
gctcgcttgatcttgattttc

SEQ ID NO: 30862 - DNA, 25 bp, Homo sapiens
gctcgcttgatcttgattttcagta

SEQ ID NO: 30863 - DNA, 27 bp, Homo sapiens
gctcgcttgatcttgattttcagtacg

SEQ ID NO: 30864 - DNA, 23 bp, Homo sapiens
ggggcctcacgatccttctgacc

SEQ ID NO: 30865 - DNA, 22 bp, Homo sapiens
gggcctcacgatccttctgacc

SEQ ID NO: 30866 - DNA, 21 bp, Homo sapiens
acagggataactggcttgtgg

SEQ ID NO: 30867 - DNA, 20 bp, Homo sapiens
cagggataactggcttgtgg

SEQ ID NO: 30868 - DNA, 19 bp, Homo sapiens
agggataactggcttgtgg

SEQ ID NO: 30869 - DNA, 18 bp, Homo sapiens
gggataactggcttgtgg

SEQ ID NO: 30870 - DNA, 22 bp, Homo sapiens
atagcgacgtcgctttttgatc

SEQ ID NO: 30871 - DNA, 23 bp, Homo sapiens
atagcgacgtcgctttttgatcc

SEQ ID NO: 30872 - DNA, 24 bp, Homo sapiens
atagcgacgtcgctttttgatcct

SEQ ID NO: 30873 - DNA, 25 bp, Homo sapiens
atagcgacgtcgctttttgatcctt

SEQ ID NO: 30874 - DNA, 21 bp, Homo sapiens
tagcgacgtcgctttttgatc

SEQ ID NO: 30875 - DNA, 20 bp, Homo sapiens
agcgacgtcgctttttgatc

SEQ ID NO: 30876 - DNA, 23 bp, Homo sapiens
tttttgatccttcgatgtcggct

SEQ ID NO: 30877 - DNA, 22 bp, Homo sapiens
ttttgatccttcgatgtcggct

SEQ ID NO: 30878 - DNA, 23 bp, Homo sapiens
ttttgatccttcgatgtcggctc

SEQ ID NO: 30879 - DNA, 23 bp, Homo sapiens
tccttcgatgtcggctcttccta

SEQ ID NO: 30880 - DNA, 21 bp, Homo sapiens
ccttcgatgtcggctcttcct

SEQ ID NO: 30881 - DNA, 20 bp, Homo sapiens
ttcgatgtcggctcttccta

SEQ ID NO: 30882 - DNA, 29 bp, Homo sapiens
attgtgaagcagaattcaccaagcgttgg

SEQ ID NO: 30883 - DNA, 28 bp, Homo sapiens
ttgtgaagcagaattcaccaagcgttgg

SEQ ID NO: 30884 - DNA, 30 bp, Homo sapiens
gtgaagcagaattcaccaagcgttggattg

SEQ ID NO: 30885 - DNA, 21 bp, Homo sapiens
gcagaattcaccaagcgttgg

SEQ ID NO: 30886 - DNA, 26 bp, Homo sapiens
gcagaattcaccaagcgttggattgt

SEQ ID NO: 30887 - DNA, 30 bp, Homo sapiens
gcagaattcaccaagcgttggattgttcac

SEQ ID NO: 30888 - DNA, 20 bp, Homo sapiens
cagaattcaccaagcgttgg

SEQ ID NO: 30889 - DNA, 19 bp, Homo sapiens
agaattcaccaagcgttgg

SEQ ID NO: 30890 - DNA, 23 bp, Homo sapiens
agaattcaccaagcgttggattg

SEQ ID NO: 30891 - DNA, 24 bp, Homo sapiens
agaattcaccaagcgttggattgt

SEQ ID NO: 30892 - DNA, 25 bp, Homo sapiens
agaattcaccaagcgttggattgtt

SEQ ID NO: 30893 - DNA, 26 bp, Homo sapiens
agaattcaccaagcgttggattgttc

SEQ ID NO: 30894 - DNA, 30 bp, Homo sapiens; identical to SEQ ID NO: 6134

SEQ ID NO: 30895 - DNA, 18 bp, Homo sapiens
gaattcaccaagcgttgg

SEQ ID NO: 30896 - DNA, 19 bp, Homo sapiens
gaattcaccaagcgttgga

SEQ ID NO: 30897 - DNA, 23 bp, Homo sapiens
gaattcaccaagcgttggattgt

SEQ ID NO: 30898 - DNA, 24 bp, Homo sapiens
gaattcaccaagcgttggattgtt

SEQ ID NO: 30899 - DNA, 25 bp, Homo sapiens
gaattcaccaagcgttggattgttc

SEQ ID NO: 30900 - DNA, 29 bp, Homo sapiens
gaattcaccaagcgttggattgttcaccc

SEQ ID NO: 30901 - DNA, 21 bp, Homo sapiens
attcaccaagcgttggattgt

SEQ ID NO: 30902 - DNA, 22 bp, Homo sapiens
attcaccaagcgttggattgtt

SEQ ID NO: 30903 - DNA, 23 bp, Homo sapiens
attcaccaagcgttggattgttc

SEQ ID NO: 30904 - DNA, 24 bp, Homo sapiens
attcaccaagcgttggattgttca

SEQ ID NO: 30905 - DNA, 26 bp, Homo sapiens
attcaccaagcgttggattgttcacc

SEQ ID NO: 30906 - DNA, 18 bp, Homo sapiens
ttcaccaagcgttggatt

SEQ ID NO: 30907 - DNA, 20 bp, Homo sapiens
ttcaccaagcgttggattgt

SEQ ID NO: 30908 - DNA, 21 bp, Homo sapiens
ttcaccaagcgttggattgtt

SEQ ID NO: 30909 - DNA, 22 bp, Homo sapiens
ttcaccaagcgttggattgttc

SEQ ID NO: 30910 - DNA, 24 bp, Homo sapiens
ttcaccaagcgttggattgttcac

SEQ ID NO: 30911 - DNA, 20 bp, Homo sapiens
tcaccaagcgttggattgtt

SEQ ID NO: 30912 - DNA, 21 bp, Homo sapiens
tcaccaagcgttggattgttc

SEQ ID NO: 30913 - DNA, 23 bp, Homo sapiens
tcaccaagcgttggattgttcac

SEQ ID NO: 30914 - DNA, 24 bp, Homo sapiens
tcaccaagcgttggattgttcacc

SEQ ID NO: 30915 - DNA, 25 bp, Homo sapiens
tcaccaagcgttggattgttcaccc

SEQ ID NO: 30916 - DNA, 19 bp, Homo sapiens
caccaagcgttggattgtt

SEQ ID NO: 30917 - DNA, 20 bp, Homo sapiens
caccaagcgttggattgttc

SEQ ID NO: 30918 - DNA, 21 bp, Homo sapiens
caccaagcgttggattgttca

SEQ ID NO: 30919 - DNA, 23 bp, Homo sapiens
caccaagcgttggattgttcacc

SEQ ID NO: 30920 - DNA, 24 bp, Homo sapiens
caccaagcgttggattgttcaccc

SEQ ID NO: 30921 - DNA, 25 bp, Homo sapiens
caccaagcgttggattgttcaccca

SEQ ID NO: 30922 - DNA, 19 bp, Homo sapiens
accaagcgttggattgttc

SEQ ID NO: 30923 - DNA, 17 bp, Homo sapiens
ccaagcgttggattgtt

SEQ ID NO: 30924 - DNA, 18 bp, Homo sapiens
ccaagcgttggattgttc

SEQ ID NO: 30925 - DNA, 19 bp, Homo sapiens
ccaagcgttggattgttca

SEQ ID NO: 30926 - DNA, 20 bp, Homo sapiens
ccaagcgttggattgttcac

SEQ ID NO: 30927 - DNA, 21 bp, Homo sapiens
ccaagcgttggattgttcacc

SEQ ID NO: 30928 - DNA, 22 bp, Homo sapiens
ccaagcgttggattgttcaccc

SEQ ID NO: 30929 - DNA, 17 bp, Homo sapiens
caagcgttggattgttc

SEQ ID NO: 30930 - DNA, 18 bp, Homo sapiens
caagcgttggattgttca

SEQ ID NO: 30931 - DNA, 19 bp, Homo sapiens
caagcgttggattgttcac

SEQ ID NO: 30932 - DNA, 20 bp, Homo sapiens
caagcgttggattgttcacc

SEQ ID NO: 30933 - DNA, 21 bp, Homo sapiens
caagcgttggattgttcaccc

SEQ ID NO: 30934 - DNA, 23 bp, Homo sapiens
caagcgttggattgttcacccac

SEQ ID NO: 30935 - DNA, 24 bp, Homo sapiens
caagcgttggattgttcacccact

SEQ ID NO: 30936 - DNA, 16 bp, Homo sapiens
aagcgttggattgttc

SEQ ID NO: 30937 - DNA, 17 bp, Homo sapiens
aagcgttggattgttca

SEQ ID NO: 30938 - DNA, 18 bp, Homo sapiens
aagcgttggattgttcac

SEQ ID NO: 30939 - DNA, 19 bp, Homo sapiens
aagcgttggattgttcacc

SEQ ID NO: 30940 - DNA, 20 bp, Homo sapiens
aagcgttggattgttcaccc

SEQ ID NO: 30941 - DNA, 21 bp, Homo sapiens
aagcgttggattgttcaccca

SEQ ID NO: 30942 - DNA, 22 bp, Homo sapiens
aagcgttggattgttcacccac

SEQ ID NO: 30943 - DNA, 23 bp, Homo sapiens
aagcgttggattgttcacccact

SEQ ID NO: 30944 - DNA, 24 bp, Homo sapiens
aagcgttggattgttcacccacta

SEQ ID NO: 30945 - DNA, 16 bp, Homo sapiens
agcgttggattgttca

SEQ ID NO: 30946 - DNA, 17 bp, Homo sapiens
agcgttggattgttcac

SEQ ID NO: 30947 - DNA, 18 bp, Homo sapiens
agcgttggattgttcacc

SEQ ID NO: 30948 - DNA, 19 bp, Homo sapiens
agcgttggattgttcaccc

SEQ ID NO: 30949 - DNA, 20 bp, Homo sapiens
agcgttggattgttcaccca

SEQ ID NO: 30950 - DNA, 21 bp, Homo sapiens
agcgttggattgttcacccac

SEQ ID NO: 30951 - DNA, 22 bp, Homo sapiens
agcgttggattgttcacccact

SEQ ID NO: 30952 - DNA, 23 bp, Homo sapiens
agcgttggattgttcacccacta

SEQ ID NO: 30953 - DNA, 16 bp, Homo sapiens
gcgttggattgttcac

SEQ ID NO: 30954 - DNA, 17 bp, Homo sapiens
gcgttggattgttcacc

SEQ ID NO: 30955 - DNA, 18 bp, Homo sapiens
gcgttggattgttcaccc

SEQ ID NO: 30956 - DNA, 20 bp, Homo sapiens
gcgttggattgttcacccac

SEQ ID NO: 30957 - DNA, 21 bp, Homo sapiens
gcgttggattgttcacccact

SEQ ID NO: 30958 - DNA, 17 bp, Homo sapiens
cgttggattgttcaccc

SEQ ID NO: 30959 - DNA, 21 bp, Homo sapiens
taatagggaacgtgagctggg

SEQ ID NO: 30960 - DNA, 20 bp, Homo sapiens
aatagggaacgtgagctggg

SEQ ID NO: 30961 - DNA, 19 bp, Homo sapiens
atagggaacgtgagctggg

SEQ ID NO: 30962 - DNA, 18 bp, Homo sapiens
tagggaacgtgagctggg

SEQ ID NO: 30963 - DNA, 24 bp, Homo sapiens
gggtttagaccgtcgtgagacagg

SEQ ID NO: 30964 - DNA, 23 bp, Homo sapiens
ggtttagaccgtcgtgagacagg

SEQ ID NO: 30965 - DNA, 22 bp, Homo sapiens
gtttagaccgtcgtgagacagg

SEQ ID NO: 30966 - DNA, 21 bp, Homo sapiens
tttagaccgtcgtgagacagg

SEQ ID NO: 30967 - DNA, 20 bp, Homo sapiens
ttagaccgtcgtgagacagg

SEQ ID NO: 30968 - DNA, 22 bp, Homo sapiens
ctgatgatgtgttgttgccatg

SEQ ID NO: 30969 - DNA, 21 bp, Homo sapiens
tgatgatgtgttgttgccatg

SEQ ID NO: 30970 - DNA, 21 bp, Homo sapiens
ctgctcagtacgagaggaacc

SEQ ID NO: 30971 - DNA, 23 bp, Homo sapiens
ctgctcagtacgagaggaaccgc

SEQ ID NO: 30972 - DNA, 21 bp, Homo sapiens
gcaggttcagacatttggtgt

SEQ ID NO: 30973 - DNA, 19 bp, Homo sapiens
gtgtatgtgcttggctgag

SEQ ID NO: 30974 - DNA, 20 bp, Homo sapiens
gtgtatgtgcttggctgagg

SEQ ID NO: 30975 - DNA, 20 bp, Homo sapiens
ggctgaggagccaatggggc

SEQ ID NO: 30976 - DNA, 25 bp, Homo sapiens
ggctgaggagccaatggggcgaagc

SEQ ID NO: 30977 - DNA, 22 bp, Homo sapiens
accatctgtgggattatgactg

SEQ ID NO: 30978 - DNA, 23 bp, Homo sapiens
accatctgtgggattatgactga

SEQ ID NO: 30979 - DNA, 25 bp, Homo sapiens
accatctgtgggattatgactgaac

SEQ ID NO: 30980 - DNA, 26 bp, Homo sapiens
accatctgtgggattatgactgaacg

SEQ ID NO: 30981 - DNA, 27 bp, Homo sapiens
accatctgtgggattatgactgaacgc

SEQ ID NO: 30982 - DNA, 28 bp, Homo sapiens
accatctgtgggattatgactgaacgcc

SEQ ID NO: 30983 - DNA, 22 bp, Homo sapiens
ccatctgtgggattatgactga

SEQ ID NO: 30984 - DNA, 21 bp, Homo sapiens
catctgtgggattatgactga

SEQ ID NO: 30985 - DNA, 24 bp, Homo sapiens
catctgtgggattatgactgaacg

SEQ ID NO: 30986 - DNA, 19 bp, Homo sapiens
atctgtgggattatgactg

SEQ ID NO: 30987 - DNA, 20 bp, Homo sapiens
atctgtgggattatgactga

SEQ ID NO: 30988 - DNA, 22 bp, Homo sapiens
atctgtgggattatgactgaac

SEQ ID NO: 30989 - DNA, 23 bp, Homo sapiens
atctgtgggattatgactgaacg

SEQ ID NO: 30990 - DNA, 24 bp, Homo sapiens
atctgtgggattatgactgaacgc

SEQ ID NO: 30991 - DNA, 25 bp, Homo sapiens
atctgtgggattatgactgaacgcc

SEQ ID NO: 30992 - DNA, 19 bp, Homo sapiens
tctgtgggattatgactga

SEQ ID NO: 30993 - DNA, 21 bp, Homo sapiens
tctgtgggattatgactgaac

SEQ ID NO: 30994 - DNA, 22 bp, Homo sapiens
tctgtgggattatgactgaacg

SEQ ID NO: 30995 - DNA, 23 bp, Homo sapiens
tctgtgggattatgactgaacgc

SEQ ID NO: 30996 - DNA, 24 bp, Homo sapiens
tctgtgggattatgactgaacgcc

SEQ ID NO: 30997 - DNA, 18 bp, Homo sapiens
ctgtgggattatgactga

SEQ ID NO: 30998 - DNA, 19 bp, Homo sapiens
ctgtgggattatgactgaa

SEQ ID NO: 30999 - DNA, 20 bp, Homo sapiens
ctgtgggattatgactgaac

SEQ ID NO: 31000 - DNA, 21 bp, Homo sapiens
ctgtgggattatgactgaacg

SEQ ID NO: 31001 - DNA, 22 bp, Homo sapiens
ctgtgggattatgactgaacgc

SEQ ID NO: 31002 - DNA, 23 bp, Homo sapiens
ctgtgggattatgactgaacgcc

SEQ ID NO: 31003 - DNA, 24 bp, Homo sapiens
ctgtgggattatgactgaacgcct

SEQ ID NO: 31004 - DNA, 19 bp, Homo sapiens
tgtgggattatgactgaac

SEQ ID NO: 31005 - DNA, 20 bp, Homo sapiens
tgtgggattatgactgaacg

SEQ ID NO: 31006 - DNA, 21 bp, Homo sapiens
tgtgggattatgactgaacgc

SEQ ID NO: 31007 - DNA, 22 bp, Homo sapiens
tgtgggattatgactgaacgcc

SEQ ID NO: 31008 - DNA, 18 bp, Homo sapiens
gtgggattatgactgaac

SEQ ID NO: 31009 - DNA, 19 bp, Homo sapiens
gtgggattatgactgaacg

SEQ ID NO: 31010 - DNA, 20 bp, Homo sapiens
gtgggattatgactgaacgc

SEQ ID NO: 31011 - DNA, 21 bp, Homo sapiens
gtgggattatgactgaacgcc

SEQ ID NO: 31012 - DNA, 18 bp, Homo sapiens
tgggattatgactgaacg

SEQ ID NO: 31013 - DNA, 20 bp, Homo sapiens
tgggattatgactgaacgcc

SEQ ID NO: 31014 - DNA, 21 bp, Homo sapiens
tgggattatgactgaacgcct

SEQ ID NO: 31015 - DNA, 19 bp, Homo sapiens
gggattatgactgaacgcc

SEQ ID NO: 31016 - DNA, 20 bp, Homo sapiens
gcagcgccgcggagcctcgg

SEQ ID NO: 31017 - DNA, 22 bp, Homo sapiens
gcagcgccgcggagcctcggtt

SEQ ID NO: 31018 - DNA, 19 bp, Homo sapiens
cagcgccgcggagcctcgg

SEQ ID NO: 31019 - DNA, 20 bp, Homo sapiens
agcgccgcggagcctcggtt

SEQ ID NO: 31020 - DNA, 20 bp, Homo sapiens
ccgcggagcctcggttggcc

SEQ ID NO: 31021 - DNA, 21 bp, Homo sapiens
cctcggttggcctcggatagc

SEQ ID NO: 31022 - DNA, 23 bp, Homo sapiens
tcggttggcctcggatagccggt

SEQ ID NO: 31023 - DNA, 18 bp, Homo sapiens
tgtccccgccggcgggcc

SEQ ID NO: 31024 - DNA, 20 bp, Homo sapiens
tgtccccgccggcgggccgc

SEQ ID NO: 31025 - DNA, 21 bp, Homo sapiens
tgtccccgccggcgggccgcc

SEQ ID NO: 31026 - DNA, 21 bp, Homo sapiens
cgcacgttcgtggggaacctg

SEQ ID NO: 31027 - DNA, 22 bp, Homo sapiens
cgcacgttcgtggggaacctgg

SEQ ID NO: 31028 - DNA, 20 bp, Homo sapiens
gcacgttcgtggggaacctg

SEQ ID NO: 31029 - DNA, 21 bp, Homo sapiens
gcacgttcgtggggaacctgg

SEQ ID NO: 31030 - DNA, 22 bp, Homo sapiens
gcacgttcgtggggaacctggc

SEQ ID NO: 31031 - DNA, 30 bp, Homo sapiens; identical to SEQ ID NO: 6373

SEQ ID NO: 31032 - DNA, 20 bp, Homo sapiens
cacgttcgtggggaacctgg

SEQ ID NO: 31033 - DNA, 20 bp, Homo sapiens
cgttcgtggggaacctggcg

SEQ ID NO: 31034 - DNA, 21 bp, Homo sapiens
cgttcgtggggaacctggcgc

SEQ ID NO: 31035 - DNA, 30 bp, Homo sapiens; identical to SEQ ID NO: 28054

SEQ ID NO: 31036 - DNA, 30 bp, Homo sapiens
gttcgtggggaacctggcgctaaaccattc

SEQ ID NO: 31037 - DNA, 19 bp, Homo sapiens
ttcgtggggaacctggcgc

SEQ ID NO: 31038 - DNA, 20 bp, Homo sapiens
ttcgtggggaacctggcgct

SEQ ID NO: 31039 - DNA, 25 bp, Homo sapiens
ttcgtggggaacctggcgctaaacc

SEQ ID NO: 31040 - DNA, 30 bp, Homo sapiens
ttcgtggggaacctggcgctaaaccattcg

SEQ ID NO: 31041 - DNA, 18 bp, Homo sapiens
tcgtggggaacctggcgc

SEQ ID NO: 31042 - DNA, 24 bp, Homo sapiens
tcgtggggaacctggcgctaaacc

SEQ ID NO: 31043 - DNA, 30 bp, Homo sapiens
tcgtggggaacctggcgctaaaccattcgt

SEQ ID NO: 31044 - DNA, 17 bp, Homo sapiens
cgtggggaacctggcgc

SEQ ID NO: 31045 - DNA, 23 bp, Homo sapiens
cgtggggaacctggcgctaaacc

SEQ ID NO: 31046 - DNA, 29 bp, Homo sapiens
cgtggggaacctggcgctaaaccattcgt

SEQ ID NO: 31047 - DNA, 22 bp, Homo sapiens
gtggggaacctggcgctaaacc

SEQ ID NO: 31048 - DNA, 28 bp, Homo sapiens
gtggggaacctggcgctaaaccattcgt

SEQ ID NO: 31049 - DNA, 21 bp, Homo sapiens
tggggaacctggcgctaaacc

SEQ ID NO: 31050 - DNA, 20 bp, Homo sapiens
ggggaacctggcgctaaacc

SEQ ID NO: 31051 - DNA, 19 bp, Homo sapiens
gggaacctggcgctaaacc

SEQ ID NO: 31052 - DNA, 18 bp, Homo sapiens
ggaacctggcgctaaacc

SEQ ID NO: 31053 - DNA, 17 bp, Homo sapiens
gaacctggcgctaaacc

SEQ ID NO: 31054 - DNA, 29 bp, Homo sapiens
cgctaaaccattcgtagacgacctgcttc

SEQ ID NO: 31055 - DNA, 28 bp, Homo sapiens
gctaaaccattcgtagacgacctgcttc

SEQ ID NO: 31056 - DNA, 23 bp, Homo sapiens
ctaaaccattcgtagacgacctg

SEQ ID NO: 31057 - DNA, 27 bp, Homo sapiens
ctaaaccattcgtagacgacctgcttc

SEQ ID NO: 31058 - DNA, 22 bp, Homo sapiens
taaaccattcgtagacgacctg

SEQ ID NO: 31059 - DNA, 24 bp, Homo sapiens
taaaccattcgtagacgacctgct

SEQ ID NO: 31060 - DNA, 25 bp, Homo sapiens
taaaccattcgtagacgacctgctt

SEQ ID NO: 31061 - DNA, 26 bp, Homo sapiens
taaaccattcgtagacgacctgcttc

SEQ ID NO: 31062 - DNA, 24 bp, Homo sapiens
aaaccattcgtagacgacctgctt

SEQ ID NO: 31063 - DNA, 25 bp, Homo sapiens
aaaccattcgtagacgacctgcttc

SEQ ID NO: 31064 - DNA, 23 bp, Homo sapiens
aaccattcgtagacgacctgctt

SEQ ID NO: 31065 - DNA, 24 bp, Homo sapiens
aaccattcgtagacgacctgcttc

SEQ ID NO: 31066 - DNA, 22 bp, Homo sapiens
accattcgtagacgacctgctt

SEQ ID NO: 31067 - DNA, 23 bp, Homo sapiens
accattcgtagacgacctgcttc

SEQ ID NO: 31068 - DNA, 22 bp, Homo sapiens
ccattcgtagacgacctgcttc

SEQ ID NO: 31069 - DNA, 21 bp, Homo sapiens
cattcgtagacgacctgcttc

SEQ ID NO: 31070 - DNA, 20 bp, Homo sapiens
attcgtagacgacctgcttc

SEQ ID NO: 31071 - DNA, 19 bp, Homo sapiens
ttcgtagacgacctgcttc

SEQ ID NO: 31072 - DNA, 29 bp, Homo sapiens
acctgcttctgggtcggggtttcgtacgt

SEQ ID NO: 31073 - DNA, 30 bp, Homo sapiens
ttctgggtcggggtttcgtacgtagcagag

SEQ ID NO: 31074 - DNA, 21 bp, Homo sapiens
tctgggtcggggtttcgtacg

SEQ ID NO: 31075 - DNA, 30 bp, Homo sapiens; identical to SEQ ID NO: 6461

SEQ ID NO: 31076 - DNA, 20 bp, Homo sapiens
ctgggtcggggtttcgtacg

SEQ ID NO: 31077 - DNA, 24 bp, Homo sapiens
ctgggtcggggtttcgtacgtagc

SEQ ID NO: 31078 - DNA, 22 bp, Homo sapiens
tgggtcggggtttcgtacgtag

SEQ ID NO: 31079 - DNA, 23 bp, Homo sapiens
tgggtcggggtttcgtacgtagc

SEQ ID NO: 31080 - DNA, 20 bp, Homo sapiens
ggtcggggtttcgtacgtag

SEQ ID NO: 31081 - DNA, 21 bp, Homo sapiens
ggtcggggtttcgtacgtagc

SEQ ID NO: 31082 - DNA, 22 bp, Homo sapiens
ggtcggggtttcgtacgtagca

SEQ ID NO: 31083 - DNA, 19 bp, Homo sapiens
gtcggggtttcgtacgtag

SEQ ID NO: 31084 - DNA, 20 bp, Homo sapiens
gtcggggtttcgtacgtagc

SEQ ID NO: 31085 - DNA, 21 bp, Homo sapiens
gtcggggtttcgtacgtagca

SEQ ID NO: 31086 - DNA, 21 bp, Homo sapiens
gcagagcagctccctcgctgc

SEQ ID NO: 31087 - DNA, 22 bp, Homo sapiens
gcagagcagctccctcgctgcg

SEQ ID NO: 31088 - DNA, 25 bp, Homo sapiens
gcagagcagctccctcgctgcgatc

SEQ ID NO: 31089 - DNA, 30 bp, Homo sapiens
gcagagcagctccctcgctgcgatctattg

SEQ ID NO: 31090 - DNA, 30 bp, Homo sapiens
ctcgctgcgatctattgaaagtcagccctc

SEQ ID NO: 31091 - DNA, 30 bp, Homo sapiens
tcgctgcgatctattgaaagtcagccctcg

SEQ ID NO: 31092 - DNA, 29 bp, Homo sapiens
cgctgcgatctattgaaagtcagccctcg

SEQ ID NO: 31093 - DNA, 30 bp, Homo sapiens
gctgcgatctattgaaagtcagccctcgac

SEQ ID NO: 31094 - DNA, 29 bp, Homo sapiens
gcgatctattgaaagtcagccctcgacac

SEQ ID NO: 31095 - DNA, 30 bp, Homo sapiens
gatctattgaaagtcagccctcgacacaag

SEQ ID NO: 31096 - DNA, 30 bp, Homo sapiens
ctattgaaagtcagccctcgacacaagggt

SEQ ID NO: 31097 - DNA, 29 bp, Homo sapiens
gaaagtcagccctcgacacaagggtttgt

SEQ ID NO: 31098 - DNA, 23 bp, Homo sapiens
cagccctcgacacaagggtttgt

SEQ ID NO: 31099 - DNA, 21 bp, Homo sapiens
agccctcgacacaagggtttg

SEQ ID NO: 31100 - DNA, 22 bp, Homo sapiens
agccctcgacacaagggtttgt

SEQ ID NO: 31101 - DNA, 19 bp, Homo sapiens
gccctcgacacaagggttt

SEQ ID NO: 31102 - DNA, 20 bp, Homo sapiens
gccctcgacacaagggtttg

SEQ ID NO: 31103 - DNA, 21 bp, Homo sapiens
gccctcgacacaagggtttgt

SEQ ID NO: 31104 - DNA, 22 bp, Homo sapiens
gccctcgacacaagggtttgtc

SEQ ID NO: 31105 - DNA, 19 bp, Homo sapiens
ccctcgacacaagggtttg

SEQ ID NO: 31106 - DNA, 20 bp, Homo sapiens
ccctcgacacaagggtttgt

SEQ ID NO: 31107 - DNA, 18 bp, Homo sapiens
cctcgacacaagggtttg

SEQ ID NO: 31108 - DNA, 19 bp, Homo sapiens
cctcgacacaagggtttgt

SEQ ID NO: 31109 - DNA, 17 bp, Homo sapiens
ctcgacacaagggtttg

SEQ ID NO: 31110 - DNA, 18 bp, Homo sapiens
ctcgacacaagggtttgt

SEQ ID NO: 31111 - DNA, 19 bp, Homo sapiens
ctcgacacaagggtttgtc

SEQ ID NO: 31112 - DNA, 17 bp, Homo sapiens
tcgacacaagggtttgt

SEQ ID NO: 31113 - DNA, 16 bp, Homo sapiens
cgacacaagggtttgt

SEQ ID NO: 31114 - DNA, 19 bp, Homo sapiens
gcgggcgtggtggtggggg

SEQ ID NO: 31115 - DNA, 18 bp, Homo sapiens
cgggcgtggtggtggggg

SEQ ID NO: 31116 - DNA, 17 bp, Homo sapiens
tggtgggggtggggggg

SEQ ID NO: 31117 - DNA, 27 bp, Homo sapiens
agcgtctacggccataccaccctgaac

SEQ ID NO: 31118 - DNA, 29 bp, Homo sapiens
agcgtctacggccataccaccctgaacgc

SEQ ID NO: 31119 - DNA, 30 bp, Homo sapiens; identical to SEQ ID NO: 28516

SEQ ID NO: 31120 - DNA, 30 bp, Homo sapiens
gcgtctacggccataccaccctgaacgcgc

SEQ ID NO: 31121 - DNA, 17 bp, Homo sapiens
gtctacggccataccac

SEQ ID NO: 31122 - DNA, 18 bp, Homo sapiens
gtctacggccataccacc

SEQ ID NO: 31123 - DNA, 19 bp, Homo sapiens
gtctacggccataccaccc

SEQ ID NO: 31124 - DNA, 20 bp, Homo sapiens
gtctacggccataccaccct

SEQ ID NO: 31125 - DNA, 21 bp, Homo sapiens
gtctacggccataccaccctg

SEQ ID NO: 31126 - DNA, 22 bp, Homo sapiens
gtctacggccataccaccctga

SEQ ID NO: 31127 - DNA, 23 bp, Homo sapiens
gtctacggccataccaccctgaa

SEQ ID NO: 31128 - DNA, 24 bp, Homo sapiens
gtctacggccataccaccctgaac

SEQ ID NO: 31129 - DNA, 25 bp, Homo sapiens
gtctacggccataccaccctgaacg

SEQ ID NO: 31130 - DNA, 26 bp, Homo sapiens
gtctacggccataccaccctgaacgc

SEQ ID NO: 31131 - DNA, 27 bp, Homo sapiens
gtctacggccataccaccctgaacgcg

SEQ ID NO: 31132 - DNA, 28 bp, Homo sapiens
gtctacggccataccaccctgaacgcgc

SEQ ID NO: 31133 - DNA, 29 bp, Homo sapiens
gtctacggccataccaccctgaacgcgcc

SEQ ID NO: 31134 - DNA, 30 bp, Homo sapiens; identical to SEQ ID NO: 8

SEQ ID NO: 31135 - DNA, 24 bp, Homo sapiens
tctacggccataccaccctgaacg

SEQ ID NO: 31136 - DNA, 25 bp, Homo sapiens
tctacggccataccaccctgaacgc

SEQ ID NO: 31137 - DNA, 26 bp, Homo sapiens
tctacggccataccaccctgaacgcg

SEQ ID NO: 31138 - DNA, 29 bp, Homo sapiens
tctacggccataccaccctgaacgcgccc

SEQ ID NO: 31139 - DNA, 30 bp, Homo sapiens; identical to SEQ ID NO: 6557

SEQ ID NO: 31140 - DNA, 19 bp, Homo sapiens
ctacggccataccaccctg

SEQ ID NO: 31141 - DNA, 20 bp, Homo sapiens
ctacggccataccaccctga

SEQ ID NO: 31142 - DNA, 23 bp, Homo sapiens
ctacggccataccaccctgaacg

SEQ ID NO: 31143 - DNA, 24 bp, Homo sapiens
ctacggccataccaccctgaacgc

SEQ ID NO: 31144 - DNA, 28 bp, Homo sapiens
ctacggccataccaccctgaacgcgccc

SEQ ID NO: 31145 - DNA, 29 bp, Homo sapiens
ctacggccataccaccctgaacgcgcccg

SEQ ID NO: 31146 - DNA, 23 bp, Homo sapiens
tacggccataccaccctgaacgc

SEQ ID NO: 31147 - DNA, 24 bp, Homo sapiens
tacggccataccaccctgaacgcg

SEQ ID NO: 31148 - DNA, 27 bp, Homo sapiens
tacggccataccaccctgaacgcgccc

SEQ ID NO: 31149 - DNA, 28 bp, Homo sapiens
tacggccataccaccctgaacgcgcccg

SEQ ID NO: 31150 - DNA, 20 bp, Homo sapiens
acggccataccaccctgaac

SEQ ID NO: 31151 - DNA, 21 bp, Homo sapiens
acggccataccaccctgaacg

SEQ ID NO: 31152 - DNA, 22 bp, Homo sapiens
acggccataccaccctgaacgc

SEQ ID NO: 31153 - DNA, 23 bp, Homo sapiens
acggccataccaccctgaacgcg

SEQ ID NO: 31154 - DNA, 24 bp, Homo sapiens
acggccataccaccctgaacgcgc

SEQ ID NO: 31155 - DNA, 25 bp, Homo sapiens
acggccataccaccctgaacgcgcc

SEQ ID NO: 31156 - DNA, 26 bp, Homo sapiens
acggccataccaccctgaacgcgccc

SEQ ID NO: 31157 - DNA, 27 bp, Homo sapiens
acggccataccaccctgaacgcgcccg

SEQ ID NO: 31158 - DNA, 20 bp, Homo sapiens
cggccataccaccctgaacg

SEQ ID NO: 31159 - DNA, 21 bp, Homo sapiens
cggccataccaccctgaacgc

SEQ ID NO: 31160 - DNA, 22 bp, Homo sapiens
cggccataccaccctgaacgcg

SEQ ID NO: 31161 - DNA, 23 bp, Homo sapiens
cggccataccaccctgaacgcgc

SEQ ID NO: 31162 - DNA, 24 bp, Homo sapiens
cggccataccaccctgaacgcgcc

SEQ ID NO: 31163 - DNA, 25 bp, Homo sapiens
cggccataccaccctgaacgcgccc

SEQ ID NO: 31164 - DNA, 26 bp, Homo sapiens
cggccataccaccctgaacgcgcccg

SEQ ID NO: 31165 - DNA, 21 bp, Homo sapiens
ggccataccaccctgaacgcg

SEQ ID NO: 31166 - DNA, 24 bp, Homo sapiens
ggccataccaccctgaacgcgccc

SEQ ID NO: 31167 - DNA, 25 bp, Homo sapiens
ggccataccaccctgaacgcgcccg

SEQ ID NO: 31168 - DNA, 17 bp, Homo sapiens
gccataccaccctgaac

SEQ ID NO: 31169 - DNA, 18 bp, Homo sapiens
gccataccaccctgaacg

SEQ ID NO: 31170 - DNA, 19 bp, Homo sapiens
gccataccaccctgaacgc

SEQ ID NO: 31171 - DNA, 20 bp, Homo sapiens
gccataccaccctgaacgcg

SEQ ID NO: 31172 - DNA, 21 bp, Homo sapiens
gccataccaccctgaacgcgc

SEQ ID NO: 31173 - DNA, 22 bp, Homo sapiens
gccataccaccctgaacgcgcc

SEQ ID NO: 31174 - DNA, 23 bp, Homo sapiens
gccataccaccctgaacgcgccc

SEQ ID NO: 31175 - DNA, 24 bp, Homo sapiens
gccataccaccctgaacgcgcccg

SEQ ID NO: 31176 - DNA, 16 bp, Homo sapiens
ccataccaccctgaac

SEQ ID NO: 31177 - DNA, 17 bp, Homo sapiens
ccataccaccctgaacg

SEQ ID NO: 31178 - DNA, 18 bp, Homo sapiens
ccataccaccctgaacgc

SEQ ID NO: 31179 - DNA, 19 bp, Homo sapiens
ccataccaccctgaacgcg

SEQ ID NO: 31180 - DNA, 20 bp, Homo sapiens
ccataccaccctgaacgcgc

SEQ ID NO: 31181 - DNA, 21 bp, Homo sapiens
ccataccaccctgaacgcgcc

SEQ ID NO: 31182 - DNA, 22 bp, Homo sapiens
ccataccaccctgaacgcgccc

SEQ ID NO: 31183 - DNA, 23 bp, Homo sapiens
ccataccaccctgaacgcgcccg

SEQ ID NO: 31184 - DNA, 24 bp, Homo sapiens
ccataccaccctgaacgcgcccga

SEQ ID NO: 31185 - DNA, 25 bp, Homo sapiens
ccataccaccctgaacgcgcccgat

SEQ ID NO: 31186 - DNA, 29 bp, Homo sapiens
ccataccaccctgaacgcgcccgatctcg

SEQ ID NO: 31187 - DNA, 16 bp, Homo sapiens
cataccaccctgaacg

SEQ ID NO: 31188 - DNA, 17 bp, Homo sapiens
cataccaccctgaacgc

SEQ ID NO: 31189 - DNA, 18 bp, Homo sapiens
cataccaccctgaacgcg

SEQ ID NO: 31190 - DNA, 19 bp, Homo sapiens
cataccaccctgaacgcgc

SEQ ID NO: 31191 - DNA, 20 bp, Homo sapiens
cataccaccctgaacgcgcc

SEQ ID NO: 31192 - DNA, 21 bp, Homo sapiens
cataccaccctgaacgcgccc

SEQ ID NO: 31193 - DNA, 22 bp, Homo sapiens
cataccaccctgaacgcgcccg

SEQ ID NO: 31194 - DNA, 30 bp, Homo sapiens; identical to SEQ ID NO: 51

SEQ ID NO: 31195 - DNA, 16 bp, Homo sapiens
ataccaccctgaacgc

SEQ ID NO: 31196 - DNA, 17 bp, Homo sapiens
ataccaccctgaacgcg

SEQ ID NO: 31197 - DNA, 18 bp, Homo sapiens
ataccaccctgaacgcgc

SEQ ID NO: 31198 - DNA, 19 bp, Homo sapiens
ataccaccctgaacgcgcc

SEQ ID NO: 31199 - DNA, 20 bp, Homo sapiens
ataccaccctgaacgcgccc

SEQ ID NO: 31200 - DNA, 21 bp, Homo sapiens
ataccaccctgaacgcgcccg

SEQ ID NO: 31201 - DNA, 22 bp, Homo sapiens
ataccaccctgaacgcgcccga

SEQ ID NO: 31202 - DNA, 23 bp, Homo sapiens
ataccaccctgaacgcgcccgat

SEQ ID NO: 31203 - DNA, 24 bp, Homo sapiens
ataccaccctgaacgcgcccgatc

SEQ ID NO: 31204 - DNA, 16 bp, Homo sapiens
taccaccctgaacgcg

SEQ ID NO: 31205 - DNA, 17 bp, Homo sapiens
taccaccctgaacgcgc

SEQ ID NO: 31206 - DNA, 18 bp, Homo sapiens
taccaccctgaacgcgcc

SEQ ID NO: 31207 - DNA, 19 bp, Homo sapiens
taccaccctgaacgcgccc

SEQ ID NO: 31208 - DNA, 20 bp, Homo sapiens
taccaccctgaacgcgcccg

SEQ ID NO: 31209 - DNA, 21 bp, Homo sapiens
taccaccctgaacgcgcccga

SEQ ID NO: 31210 - DNA, 26 bp, Homo sapiens
taccaccctgaacgcgcccgatctcg

SEQ ID NO: 31211 - DNA, 17 bp, Homo sapiens
accaccctgaacgcgcc

SEQ ID NO: 31212 - DNA, 18 bp, Homo sapiens
accaccctgaacgcgccc

SEQ ID NO: 31213 - DNA, 19 bp, Homo sapiens
accaccctgaacgcgcccg

SEQ ID NO: 31214 - DNA, 20 bp, Homo sapiens
accaccctgaacgcgcccga

SEQ ID NO: 31215 - DNA, 21 bp, Homo sapiens
accaccctgaacgcgcccgat

SEQ ID NO: 31216 - DNA, 22 bp, Homo sapiens
accaccctgaacgcgcccgatc

SEQ ID NO: 31217 - DNA, 23 bp, Homo sapiens
accaccctgaacgcgcccgatct

SEQ ID NO: 31218 - DNA, 25 bp, Homo sapiens
accaccctgaacgcgcccgatctcg

SEQ ID NO: 31219 - DNA, 26 bp, Homo sapiens
accaccctgaacgcgcccgatctcgt

SEQ ID NO: 31220 - DNA, 28 bp, Homo sapiens
accaccctgaacgcgcccgatctcgtct

SEQ ID NO: 31221 - DNA, 29 bp, Homo sapiens
accaccctgaacgcgcccgatctcgtctg

SEQ ID NO: 31222 - DNA, 16 bp, Homo sapiens
ccaccctgaacgcgcc

SEQ ID NO: 31223 - DNA, 17 bp, Homo sapiens
ccaccctgaacgcgccc

SEQ ID NO: 31224 - DNA, 18 bp, Homo sapiens
ccaccctgaacgcgcccg

SEQ ID NO: 31225 - DNA, 19 bp, Homo sapiens
ccaccctgaacgcgcccga

SEQ ID NO: 31226 - DNA, 20 bp, Homo sapiens
ccaccctgaacgcgcccgat

SEQ ID NO: 31227 - DNA, 21 bp, Homo sapiens
ccaccctgaacgcgcccgatc

SEQ ID NO: 31228 - DNA, 22 bp, Homo sapiens
ccaccctgaacgcgcccgatct

SEQ ID NO: 31229 - DNA, 24 bp, Homo sapiens
ccaccctgaacgcgcccgatctcg

SEQ ID NO: 31230 - DNA, 25 bp, Homo sapiens
ccaccctgaacgcgcccgatctcgt

SEQ ID NO: 31231 - DNA, 26 bp, Homo sapiens
ccaccctgaacgcgcccgatctcgtc

SEQ ID NO: 31232 - DNA, 27 bp, Homo sapiens
ccaccctgaacgcgcccgatctcgtct

SEQ ID NO: 31233 - DNA, 28 bp, Homo sapiens
ccaccctgaacgcgcccgatctcgtctg

SEQ ID NO: 31234 - DNA, 16 bp, Homo sapiens
caccctgaacgcgccc

SEQ ID NO: 31235 - DNA, 17 bp, Homo sapiens
caccctgaacgcgcccg

SEQ ID NO: 31236 - DNA, 18 bp, Homo sapiens
caccctgaacgcgcccga

SEQ ID NO: 31237 - DNA, 19 bp, Homo sapiens
caccctgaacgcgcccgat

SEQ ID NO: 31238 - DNA, 20 bp, Homo sapiens
caccctgaacgcgcccgatc

SEQ ID NO: 31239 - DNA, 21 bp, Homo sapiens
caccctgaacgcgcccgatct

SEQ ID NO: 31240 - DNA, 23 bp, Homo sapiens
caccctgaacgcgcccgatctcg

SEQ ID NO: 31241 - DNA, 25 bp, Homo sapiens
caccctgaacgcgcccgatctcgtc

SEQ ID NO: 31242 - DNA, 27 bp, Homo sapiens
caccctgaacgcgcccgatctcgtctg

SEQ ID NO: 31243 - DNA, 16 bp, Homo sapiens
accctgaacgcgcccg

SEQ ID NO: 31244 - DNA, 17 bp, Homo sapiens
accctgaacgcgcccga

SEQ ID NO: 31245 - DNA, 18 bp, Homo sapiens
accctgaacgcgcccgat

SEQ ID NO: 31246 - DNA, 19 bp, Homo sapiens
accctgaacgcgcccgatc

SEQ ID NO: 31247 - DNA, 20 bp, Homo sapiens
accctgaacgcgcccgatct

SEQ ID NO: 31248 - DNA, 21 bp, Homo sapiens
accctgaacgcgcccgatctc

SEQ ID NO: 31249 - DNA, 22 bp, Homo sapiens
accctgaacgcgcccgatctcg

SEQ ID NO: 31250 - DNA, 23 bp, Homo sapiens
accctgaacgcgcccgatctcgt

SEQ ID NO: 31251 - DNA, 24 bp, Homo sapiens
accctgaacgcgcccgatctcgtc

SEQ ID NO: 31252 - DNA, 26 bp, Homo sapiens
accctgaacgcgcccgatctcgtctg

SEQ ID NO: 31253 - DNA, 16 bp, Homo sapiens
ccctgaacgcgcccga

SEQ ID NO: 31254 - DNA, 17 bp, Homo sapiens
ccctgaacgcgcccgat

SEQ ID NO: 31255 - DNA, 18 bp, Homo sapiens
ccctgaacgcgcccgatc

SEQ ID NO: 31256 - DNA, 19 bp, Homo sapiens
ccctgaacgcgcccgatct

SEQ ID NO: 31257 - DNA, 20 bp, Homo sapiens
ccctgaacgcgcccgatctc

SEQ ID NO: 31258 - DNA, 21 bp, Homo sapiens
ccctgaacgcgcccgatctcg

SEQ ID NO: 31259 - DNA, 22 bp, Homo sapiens
ccctgaacgcgcccgatctcgt

SEQ ID NO: 31260 - DNA, 23 bp, Homo sapiens
ccctgaacgcgcccgatctcgtc

SEQ ID NO: 31261 - DNA, 24 bp, Homo sapiens
ccctgaacgcgcccgatctcgtct

SEQ ID NO: 31262 - DNA, 25 bp, Homo sapiens
ccctgaacgcgcccgatctcgtctg

SEQ ID NO: 31263 - DNA, 26 bp, Homo sapiens
ccctgaacgcgcccgatctcgtctga

SEQ ID NO: 31264 - DNA, 28 bp, Homo sapiens
ccctgaacgcgcccgatctcgtctgatc

SEQ ID NO: 31265 - DNA, 16 bp, Homo sapiens
cctgaacgcgcccgat

SEQ ID NO: 31266 - DNA, 17 bp, Homo sapiens
cctgaacgcgcccgatc

SEQ ID NO: 31267 - DNA, 18 bp, Homo sapiens
cctgaacgcgcccgatct

SEQ ID NO: 31268 - DNA, 19 bp, Homo sapiens
cctgaacgcgcccgatctc

SEQ ID NO: 31269 - DNA, 20 bp, Homo sapiens
cctgaacgcgcccgatctcg

SEQ ID NO: 31270 - DNA, 21 bp, Homo sapiens
cctgaacgcgcccgatctcgt

SEQ ID NO: 31271 - DNA, 22 bp, Homo sapiens
cctgaacgcgcccgatctcgtc

SEQ ID NO: 31272 - DNA, 23 bp, Homo sapiens
cctgaacgcgcccgatctcgtct

SEQ ID NO: 31273 - DNA, 24 bp, Homo sapiens
cctgaacgcgcccgatctcgtctg

SEQ ID NO: 31274 - DNA, 25 bp, Homo sapiens
cctgaacgcgcccgatctcgtctga

SEQ ID NO: 31275 - DNA, 26 bp, Homo sapiens
cctgaacgcgcccgatctcgtctgat

SEQ ID NO: 31276 - DNA, 27 bp, Homo sapiens
cctgaacgcgcccgatctcgtctgatc

SEQ ID NO: 31277 - DNA, 19 bp, Homo sapiens
ctgaacgcgcccgatctcg

SEQ ID NO: 31278 - DNA, 20 bp, Homo sapiens
ctgaacgcgcccgatctcgt

SEQ ID NO: 31279 - DNA, 21 bp, Homo sapiens
ctgaacgcgcccgatctcgtc

SEQ ID NO: 31280 - DNA, 22 bp, Homo sapiens
ctgaacgcgcccgatctcgtct

SEQ ID NO: 31281 - DNA, 23 bp, Homo sapiens
ctgaacgcgcccgatctcgtctg

SEQ ID NO: 31282 - DNA, 24 bp, Homo sapiens
ctgaacgcgcccgatctcgtctga

SEQ ID NO: 31283 - DNA, 25 bp, Homo sapiens
ctgaacgcgcccgatctcgtctgat

SEQ ID NO: 31284 - DNA, 26 bp, Homo sapiens
ctgaacgcgcccgatctcgtctgatc

SEQ ID NO: 31285 - DNA, 29 bp, Homo sapiens
ctgaacgcgcccgatctcgtctgatctcg

SEQ ID NO: 31286 - DNA, 30 bp, Homo sapiens
ctgaacgcgcccgatctcgtctgatctcgg

SEQ ID NO: 31287 - DNA, 20 bp, Homo sapiens
tgaacgcgcccgatctcgtc

SEQ ID NO: 31288 - DNA, 21 bp, Homo sapiens
tgaacgcgcccgatctcgtct

SEQ ID NO: 31289 - DNA, 22 bp, Homo sapiens
tgaacgcgcccgatctcgtctg

SEQ ID NO: 31290 - DNA, 23 bp, Homo sapiens
tgaacgcgcccgatctcgtctga

SEQ ID NO: 31291 - DNA, 24 bp, Homo sapiens
tgaacgcgcccgatctcgtctgat

SEQ ID NO: 31292 - DNA, 25 bp, Homo sapiens
tgaacgcgcccgatctcgtctgatc

SEQ ID NO: 31293 - DNA, 26 bp, Homo sapiens
tgaacgcgcccgatctcgtctgatct

SEQ ID NO: 31294 - DNA, 27 bp, Homo sapiens
tgaacgcgcccgatctcgtctgatctc

SEQ ID NO: 31295 - DNA, 28 bp, Homo sapiens
tgaacgcgcccgatctcgtctgatctcg

SEQ ID NO: 31296 - DNA, 29 bp, Homo sapiens
tgaacgcgcccgatctcgtctgatctcgg

SEQ ID NO: 31297 - DNA, 19 bp, Homo sapiens
gaacgcgcccgatctcgtc

SEQ ID NO: 31298 - DNA, 20 bp, Homo sapiens
gaacgcgcccgatctcgtct

SEQ ID NO: 31299 - DNA, 21 bp, Homo sapiens
gaacgcgcccgatctcgtctg

SEQ ID NO: 31300 - DNA, 22 bp, Homo sapiens
gaacgcgcccgatctcgtctga

SEQ ID NO: 31301 - DNA, 23 bp, Homo sapiens
gaacgcgcccgatctcgtctgat

SEQ ID NO: 31302 - DNA, 29 bp, Homo sapiens
gaacgcgcccgatctcgtctgatctcgga

SEQ ID NO: 31303 - DNA, 20 bp, Homo sapiens
aacgcgcccgatctcgtctg

SEQ ID NO: 31304 - DNA, 21 bp, Homo sapiens
aacgcgcccgatctcgtctga

SEQ ID NO: 31305 - DNA, 22 bp, Homo sapiens
aacgcgcccgatctcgtctgat

SEQ ID NO: 31306 - DNA, 23 bp, Homo sapiens
aacgcgcccgatctcgtctgatc

SEQ ID NO: 31307 - DNA, 26 bp, Homo sapiens
aacgcgcccgatctcgtctgatctcg

SEQ ID NO: 31308 - DNA, 19 bp, Homo sapiens
acgcgcccgatctcgtctg

SEQ ID NO: 31309 - DNA, 20 bp, Homo sapiens
acgcgcccgatctcgtctga

SEQ ID NO: 31310 - DNA, 21 bp, Homo sapiens
acgcgcccgatctcgtctgat

SEQ ID NO: 31311 - DNA, 22 bp, Homo sapiens
acgcgcccgatctcgtctgatc

SEQ ID NO: 31312 - DNA, 25 bp, Homo sapiens
acgcgcccgatctcgtctgatctcg

SEQ ID NO: 31313 - DNA, 27 bp, Homo sapiens
acgcgcccgatctcgtctgatctcgga

SEQ ID NO: 31314 - DNA, 30 bp, Homo sapiens
acgcgcccgatctcgtctgatctcggaagc

SEQ ID NO: 31315 - DNA, 17 bp, Homo sapiens
cgcgcccgatctcgtct

SEQ ID NO: 31316 - DNA, 18 bp, Homo sapiens
cgcgcccgatctcgtctg

SEQ ID NO: 31317 - DNA, 19 bp, Homo sapiens
cgcgcccgatctcgtctga

SEQ ID NO: 31318 - DNA, 20 bp, Homo sapiens
cgcgcccgatctcgtctgat

SEQ ID NO: 31319 - DNA, 21 bp, Homo sapiens
cgcgcccgatctcgtctgatc

SEQ ID NO: 31320 - DNA, 22 bp, Homo sapiens
cgcgcccgatctcgtctgatct

SEQ ID NO: 31321 - DNA, 24 bp, Homo sapiens
cgcgcccgatctcgtctgatctcg

SEQ ID NO: 31322 - DNA, 25 bp, Homo sapiens
cgcgcccgatctcgtctgatctcgg

SEQ ID NO: 31323 - DNA, 26 bp, Homo sapiens
cgcgcccgatctcgtctgatctcgga

SEQ ID NO: 31324 - DNA, 28 bp, Homo sapiens
cgcgcccgatctcgtctgatctcggaag

SEQ ID NO: 31325 - DNA, 29 bp, Homo sapiens
cgcgcccgatctcgtctgatctcggaagc

SEQ ID NO: 31326 - DNA, 17 bp, Homo sapiens
gcgcccgatctcgtctg

SEQ ID NO: 31327 - DNA, 18 bp, Homo sapiens
gcgcccgatctcgtctga

SEQ ID NO: 31328 - DNA, 19 bp, Homo sapiens
gcgcccgatctcgtctgat

SEQ ID NO: 31329 - DNA, 20 bp, Homo sapiens
gcgcccgatctcgtctgatc

SEQ ID NO: 31330 - DNA, 21 bp, Homo sapiens
gcgcccgatctcgtctgatct

SEQ ID NO: 31331 - DNA, 23 bp, Homo sapiens
gcgcccgatctcgtctgatctcg

SEQ ID NO: 31332 - DNA, 24 bp, Homo sapiens
gcgcccgatctcgtctgatctcgg

SEQ ID NO: 31333 - DNA, 25 bp, Homo sapiens
gcgcccgatctcgtctgatctcgga

SEQ ID NO: 31334 - DNA, 27 bp, Homo sapiens
gcgcccgatctcgtctgatctcggaag

SEQ ID NO: 31335 - DNA, 28 bp, Homo sapiens
gcgcccgatctcgtctgatctcggaagc

SEQ ID NO: 31336 - DNA, 16 bp, Homo sapiens
cgcccgatctcgtctg

SEQ ID NO: 31337 - DNA, 17 bp, Homo sapiens
cgcccgatctcgtctga

SEQ ID NO: 31338 - DNA, 18 bp, Homo sapiens
cgcccgatctcgtctgat

SEQ ID NO: 31339 - DNA, 19 bp, Homo sapiens
cgcccgatctcgtctgatc

SEQ ID NO: 31340 - DNA, 20 bp, Homo sapiens
cgcccgatctcgtctgatct

SEQ ID NO: 31341 - DNA, 21 bp, Homo sapiens
cgcccgatctcgtctgatctc

SEQ ID NO: 31342 - DNA, 22 bp, Homo sapiens
cgcccgatctcgtctgatctcg

SEQ ID NO: 31343 - DNA, 23 bp, Homo sapiens
cgcccgatctcgtctgatctcgg

SEQ ID NO: 31344 - DNA, 26 bp, Homo sapiens
cgcccgatctcgtctgatctcggaag

SEQ ID NO: 31345 - DNA, 27 bp, Homo sapiens
cgcccgatctcgtctgatctcggaagc

SEQ ID NO: 31346 - DNA, 29 bp, Homo sapiens
cgcccgatctcgtctgatctcggaagcta

SEQ ID NO: 31347 - DNA, 16 bp, Homo sapiens
cccgatctcgtctgat

SEQ ID NO: 31348 - DNA, 20 bp, Homo sapiens
cccgatctcgtctgatctcg

SEQ ID NO: 31349 - DNA, 25 bp, Homo sapiens
cccgatctcgtctgatctcggaagc

SEQ ID NO: 31350 - DNA, 20 bp, Homo sapiens
ccgatctcgtctgatctcgg

SEQ ID NO: 31351 - DNA, 24 bp, Homo sapiens
ccgatctcgtctgatctcggaagc

SEQ ID NO: 31352 - DNA, 18 bp, Homo sapiens
cgatctcgtctgatctcg

SEQ ID NO: 31353 - DNA, 19 bp, Homo sapiens
cgatctcgtctgatctcgg

SEQ ID NO: 31354 - DNA, 20 bp, Homo sapiens
cgatctcgtctgatctcgga

SEQ ID NO: 31355 - DNA, 22 bp, Homo sapiens
cgatctcgtctgatctcggaag

SEQ ID NO: 31356 - DNA, 23 bp, Homo sapiens
cgatctcgtctgatctcggaagc

SEQ ID NO: 31357 - DNA, 24 bp, Homo sapiens
cgatctcgtctgatctcggaagct

SEQ ID NO: 31358 - DNA, 27 bp, Homo sapiens
cgatctcgtctgatctcggaagctaag

SEQ ID NO: 31359 - DNA, 30 bp, Homo sapiens
cgatctcgtctgatctcggaagctaagcag

SEQ ID NO: 31360 - DNA, 17 bp, Homo sapiens
gatctcgtctgatctcg

SEQ ID NO: 31361 - DNA, 18 bp, Homo sapiens
gatctcgtctgatctcgg

SEQ ID NO: 31362 - DNA, 19 bp, Homo sapiens
gatctcgtctgatctcgga

SEQ ID NO: 31363 - DNA, 21 bp, Homo sapiens
gatctcgtctgatctcggaag

SEQ ID NO: 31364 - DNA, 22 bp, Homo sapiens
gatctcgtctgatctcggaagc

SEQ ID NO: 31365 - DNA, 23 bp, Homo sapiens
gatctcgtctgatctcggaagct

SEQ ID NO: 31366 - DNA, 26 bp, Homo sapiens
gatctcgtctgatctcggaagctaag

SEQ ID NO: 31367 - DNA, 17 bp, Homo sapiens
atctcgtctgatctcgg

SEQ ID NO: 31368 - DNA, 18 bp, Homo sapiens
atctcgtctgatctcgga

SEQ ID NO: 31369 - DNA, 19 bp, Homo sapiens
atctcgtctgatctcggaa

SEQ ID NO: 31370 - DNA, 20 bp, Homo sapiens
atctcgtctgatctcggaag

SEQ ID NO: 31371 - DNA, 21 bp, Homo sapiens
atctcgtctgatctcggaagc

SEQ ID NO: 31372 - DNA, 22 bp, Homo sapiens
atctcgtctgatctcggaagct

SEQ ID NO: 31373 - DNA, 23 bp, Homo sapiens
atctcgtctgatctcggaagcta

SEQ ID NO: 31374 - DNA, 24 bp, Homo sapiens
atctcgtctgatctcggaagctaa

SEQ ID NO: 31375 - DNA, 25 bp, Homo sapiens
atctcgtctgatctcggaagctaag

SEQ ID NO: 31376 - DNA, 26 bp, Homo sapiens
atctcgtctgatctcggaagctaagc

SEQ ID NO: 31377 - DNA, 27 bp, Homo sapiens
atctcgtctgatctcggaagctaagca

SEQ ID NO: 31378 - DNA, 28 bp, Homo sapiens
atctcgtctgatctcggaagctaagcag

SEQ ID NO: 31379 - DNA, 29 bp, Homo sapiens
atctcgtctgatctcggaagctaagcagg

SEQ ID NO: 31380 - DNA, 30 bp, Homo sapiens
atctcgtctgatctcggaagctaagcaggg

SEQ ID NO: 31381 - DNA, 16 bp, Homo sapiens
tctcgtctgatctcgg

SEQ ID NO: 31382 - DNA, 17 bp, Homo sapiens
tctcgtctgatctcgga

SEQ ID NO: 31383 - DNA, 18 bp, Homo sapiens
tctcgtctgatctcggaa

SEQ ID NO: 31384 - DNA, 19 bp, Homo sapiens
tctcgtctgatctcggaag

SEQ ID NO: 31385 - DNA, 20 bp, Homo sapiens
tctcgtctgatctcggaagc

SEQ ID NO: 31386 - DNA, 21 bp, Homo sapiens
tctcgtctgatctcggaagct

SEQ ID NO: 31387 - DNA, 22 bp, Homo sapiens
tctcgtctgatctcggaagcta

SEQ ID NO: 31388 - DNA, 23 bp, Homo sapiens
tctcgtctgatctcggaagctaa

SEQ ID NO: 31389 - DNA, 24 bp, Homo sapiens
tctcgtctgatctcggaagctaag

SEQ ID NO: 31390 - DNA, 25 bp, Homo sapiens
tctcgtctgatctcggaagctaagc

SEQ ID NO: 31391 - DNA, 26 bp, Homo sapiens
tctcgtctgatctcggaagctaagca

SEQ ID NO: 31392 - DNA, 27 bp, Homo sapiens
tctcgtctgatctcggaagctaagcag

SEQ ID NO: 31393 - DNA, 28 bp, Homo sapiens
tctcgtctgatctcggaagctaagcagg

SEQ ID NO: 31394 - DNA, 30 bp, Homo sapiens
tctcgtctgatctcggaagctaagcagggt

SEQ ID NO: 31395 - DNA, 16 bp, Homo sapiens
ctcgtctgatctcgga

SEQ ID NO: 31396 - DNA, 17 bp, Homo sapiens
ctcgtctgatctcggaa

SEQ ID NO: 31397 - DNA, 18 bp, Homo sapiens
ctcgtctgatctcggaag

SEQ ID NO: 31398 - DNA, 19 bp, Homo sapiens
ctcgtctgatctcggaagc

SEQ ID NO: 31399 - DNA, 20 bp, Homo sapiens
ctcgtctgatctcggaagct

SEQ ID NO: 31400 - DNA, 21 bp, Homo sapiens
ctcgtctgatctcggaagcta

SEQ ID NO: 31401 - DNA, 22 bp, Homo sapiens
ctcgtctgatctcggaagctaa

SEQ ID NO: 31402 - DNA, 23 bp, Homo sapiens
ctcgtctgatctcggaagctaag

SEQ ID NO: 31403 - DNA, 24 bp, Homo sapiens
ctcgtctgatctcggaagctaagc

SEQ ID NO: 31404 - DNA, 25 bp, Homo sapiens
ctcgtctgatctcggaagctaagca

SEQ ID NO: 31405 - DNA, 26 bp, Homo sapiens
ctcgtctgatctcggaagctaagcag

SEQ ID NO: 31406 - DNA, 27 bp, Homo sapiens
ctcgtctgatctcggaagctaagcagg

SEQ ID NO: 31407 - DNA, 28 bp, Homo sapiens
ctcgtctgatctcggaagctaagcaggg

SEQ ID NO: 31408 - DNA, 29 bp, Homo sapiens
ctcgtctgatctcggaagctaagcagggt

SEQ ID NO: 31409 - DNA, 30 bp, Homo sapiens
ctcgtctgatctcggaagctaagcagggtc

SEQ ID NO: 31410 - DNA, 16 bp, Homo sapiens
tcgtctgatctcggaa

SEQ ID NO: 31411 - DNA, 17 bp, Homo sapiens
tcgtctgatctcggaag

SEQ ID NO: 31412 - DNA, 18 bp, Homo sapiens
tcgtctgatctcggaagc

SEQ ID NO: 31413 - DNA, 19 bp, Homo sapiens
tcgtctgatctcggaagct

SEQ ID NO: 31414 - DNA, 20 bp, Homo sapiens
tcgtctgatctcggaagcta

SEQ ID NO: 31415 - DNA, 21 bp, Homo sapiens
tcgtctgatctcggaagctaa

SEQ ID NO: 31416 - DNA, 22 bp, Homo sapiens
tcgtctgatctcggaagctaag

SEQ ID NO: 31417 - DNA, 23 bp, Homo sapiens
tcgtctgatctcggaagctaagc

SEQ ID NO: 31418 - DNA, 24 bp, Homo sapiens
tcgtctgatctcggaagctaagca

SEQ ID NO: 31419 - DNA, 25 bp, Homo sapiens
tcgtctgatctcggaagctaagcag

SEQ ID NO: 31420 - DNA, 26 bp, Homo sapiens
tcgtctgatctcggaagctaagcagg

SEQ ID NO: 31421 - DNA, 27 bp, Homo sapiens
tcgtctgatctcggaagctaagcaggg

SEQ ID NO: 31422 - DNA, 28 bp, Homo sapiens
tcgtctgatctcggaagctaagcagggt

SEQ ID NO: 31423 - DNA, 29 bp, Homo sapiens
tcgtctgatctcggaagctaagcagggtc

SEQ ID NO: 31424 - DNA, 30 bp, Homo sapiens
tcgtctgatctcggaagctaagcagggtcg

SEQ ID NO: 31425 - DNA, 16 bp, Homo sapiens
cgtctgatctcggaag

SEQ ID NO: 31426 - DNA, 17 bp, Homo sapiens
cgtctgatctcggaagc

SEQ ID NO: 31427 - DNA, 18 bp, Homo sapiens
cgtctgatctcggaagct

SEQ ID NO: 31428 - DNA, 19 bp, Homo sapiens
cgtctgatctcggaagcta

SEQ ID NO: 31429 - DNA, 20 bp, Homo sapiens
cgtctgatctcggaagctaa

SEQ ID NO: 31430 - DNA, 21 bp, Homo sapiens
cgtctgatctcggaagctaag

SEQ ID NO: 31431 - DNA, 22 bp, Homo sapiens
cgtctgatctcggaagctaagc

SEQ ID NO: 31432 - DNA, 23 bp, Homo sapiens
cgtctgatctcggaagctaagca

SEQ ID NO: 31433 - DNA, 24 bp, Homo sapiens
cgtctgatctcggaagctaagcag

SEQ ID NO: 31434 - DNA, 25 bp, Homo sapiens
cgtctgatctcggaagctaagcagg

SEQ ID NO: 31435 - DNA, 26 bp, Homo sapiens
cgtctgatctcggaagctaagcaggg

SEQ ID NO: 31436 - DNA, 27 bp, Homo sapiens
cgtctgatctcggaagctaagcagggt

SEQ ID NO: 31437 - DNA, 28 bp, Homo sapiens
cgtctgatctcggaagctaagcagggtc

SEQ ID NO: 31438 - DNA, 29 bp, Homo sapiens
cgtctgatctcggaagctaagcagggtcg

SEQ ID NO: 31439 - DNA, 30 bp, Homo sapiens
cgtctgatctcggaagctaagcagggtcgg

SEQ ID NO: 31440 - DNA, 16 bp, Homo sapiens
gtctgatctcggaagc

SEQ ID NO: 31441 - DNA, 17 bp, Homo sapiens
gtctgatctcggaagct

SEQ ID NO: 31442 - DNA, 18 bp, Homo sapiens
gtctgatctcggaagcta

SEQ ID NO: 31443 - DNA, 19 bp, Homo sapiens
gtctgatctcggaagctaa

SEQ ID NO: 31444 - DNA, 20 bp, Homo sapiens
gtctgatctcggaagctaag

SEQ ID NO: 31445 - DNA, 21 bp, Homo sapiens
gtctgatctcggaagctaagc

SEQ ID NO: 31446 - DNA, 22 bp, Homo sapiens
gtctgatctcggaagctaagca

SEQ ID NO: 31447 - DNA, 23 bp, Homo sapiens
gtctgatctcggaagctaagcag

SEQ ID NO: 31448 - DNA, 24 bp, Homo sapiens
gtctgatctcggaagctaagcagg

SEQ ID NO: 31449 - DNA, 25 bp, Homo sapiens
gtctgatctcggaagctaagcaggg

SEQ ID NO: 31450 - DNA, 26 bp, Homo sapiens
gtctgatctcggaagctaagcagggt

SEQ ID NO: 31451 - DNA, 27 bp, Homo sapiens
gtctgatctcggaagctaagcagggtc

SEQ ID NO: 31452 - DNA, 28 bp, Homo sapiens
gtctgatctcggaagctaagcagggtcg

SEQ ID NO: 31453 - DNA, 29 bp, Homo sapiens
gtctgatctcggaagctaagcagggtcgg

SEQ ID NO: 31454 - DNA, 30 bp, Homo sapiens
gtctgatctcggaagctaagcagggtcggg

SEQ ID NO: 31455 - DNA, 16 bp, Homo sapiens
tctgatctcggaagct

SEQ ID NO: 31456 - DNA, 17 bp, Homo sapiens
tctgatctcggaagcta

SEQ ID NO: 31457 - DNA, 18 bp, Homo sapiens
tctgatctcggaagctaa

SEQ ID NO: 31458 - DNA, 19 bp, Homo sapiens
tctgatctcggaagctaag

SEQ ID NO: 31459 - DNA, 20 bp, Homo sapiens
tctgatctcggaagctaagc

SEQ ID NO: 31460 - DNA, 21 bp, Homo sapiens
tctgatctcggaagctaagca

SEQ ID NO: 31461 - DNA, 22 bp, Homo sapiens
tctgatctcggaagctaagcag

SEQ ID NO: 31462 - DNA, 23 bp, Homo sapiens
tctgatctcggaagctaagcagg

SEQ ID NO: 31463 - DNA, 24 bp, Homo sapiens
tctgatctcggaagctaagcaggg

SEQ ID NO: 31464 - DNA, 25 bp, Homo sapiens
tctgatctcggaagctaagcagggt

SEQ ID NO: 31465 - DNA, 26 bp, Homo sapiens
tctgatctcggaagctaagcagggtc

SEQ ID NO: 31466 - DNA, 27 bp, Homo sapiens
tctgatctcggaagctaagcagggtcg

SEQ ID NO: 31467 - DNA, 28 bp, Homo sapiens
tctgatctcggaagctaagcagggtcgg

SEQ ID NO: 31468 - DNA, 29 bp, Homo sapiens
tctgatctcggaagctaagcagggtcggg

SEQ ID NO: 31469 - DNA, 30 bp, Homo sapiens
tctgatctcggaagctaagcagggtcgggc

SEQ ID NO: 31470 - DNA, 16 bp, Homo sapiens
ctgatctcggaagcta

SEQ ID NO: 31471 - DNA, 17 bp, Homo sapiens
ctgatctcggaagctaa

SEQ ID NO: 31472 - DNA, 18 bp, Homo sapiens
ctgatctcggaagctaag

SEQ ID NO: 31473 - DNA, 19 bp, Homo sapiens
ctgatctcggaagctaagc

SEQ ID NO: 31474 - DNA, 20 bp, Homo sapiens
ctgatctcggaagctaagca

SEQ ID NO: 31475 - DNA, 21 bp, Homo sapiens
ctgatctcggaagctaagcag

SEQ ID NO: 31476 - DNA, 22 bp, Homo sapiens
ctgatctcggaagctaagcagg

SEQ ID NO: 31477 - DNA, 23 bp, Homo sapiens
ctgatctcggaagctaagcaggg

SEQ ID NO: 31478 - DNA, 24 bp, Homo sapiens
ctgatctcggaagctaagcagggt

SEQ ID NO: 31479 - DNA, 25 bp, Homo sapiens
ctgatctcggaagctaagcagggtc

SEQ ID NO: 31480 - DNA, 26 bp, Homo sapiens
ctgatctcggaagctaagcagggtcg

SEQ ID NO: 31481 - DNA, 27 bp, Homo sapiens
ctgatctcggaagctaagcagggtcgg

SEQ ID NO: 31482 - DNA, 28 bp, Homo sapiens
ctgatctcggaagctaagcagggtcggg

SEQ ID NO: 31483 - DNA, 29 bp, Homo sapiens
ctgatctcggaagctaagcagggtcgggc

SEQ ID NO: 31484 - DNA, 30 bp, Homo sapiens
ctgatctcggaagctaagcagggtcgggcc

SEQ ID NO: 31485 - DNA, 17 bp, Homo sapiens
tgatctcggaagctaag

SEQ ID NO: 31486 - DNA, 18 bp, Homo sapiens
tgatctcggaagctaagc

SEQ ID NO: 31487 - DNA, 19 bp, Homo sapiens
tgatctcggaagctaagca

SEQ ID NO: 31488 - DNA, 20 bp, Homo sapiens
tgatctcggaagctaagcag

SEQ ID NO: 31489 - DNA, 21 bp, Homo sapiens
tgatctcggaagctaagcagg

SEQ ID NO: 31490 - DNA, 22 bp, Homo sapiens
tgatctcggaagctaagcaggg

SEQ ID NO: 31491 - DNA, 23 bp, Homo sapiens
tgatctcggaagctaagcagggt

SEQ ID NO: 31492 - DNA, 24 bp, Homo sapiens
tgatctcggaagctaagcagggtc

SEQ ID NO: 31493 - DNA, 25 bp, Homo sapiens
tgatctcggaagctaagcagggtcg

SEQ ID NO: 31494 - DNA, 26 bp, Homo sapiens
tgatctcggaagctaagcagggtcgg

SEQ ID NO: 31495 - DNA, 27 bp, Homo sapiens
tgatctcggaagctaagcagggtcggg

SEQ ID NO: 31496 - DNA, 28 bp, Homo sapiens
tgatctcggaagctaagcagggtcgggc

SEQ ID NO: 31497 - DNA, 29 bp, Homo sapiens
tgatctcggaagctaagcagggtcgggcc

SEQ ID NO: 31498 - DNA, 30 bp, Homo sapiens
tgatctcggaagctaagcagggtcgggcct

SEQ ID NO: 31499 - DNA, 16 bp, Homo sapiens
gatctcggaagctaag

SEQ ID NO: 31500 - DNA, 17 bp, Homo sapiens
gatctcggaagctaagc

SEQ ID NO: 31501 - DNA, 19 bp, Homo sapiens
gatctcggaagctaagcag

SEQ ID NO: 31502 - DNA, 20 bp, Homo sapiens
gatctcggaagctaagcagg

SEQ ID NO: 31503 - DNA, 21 bp, Homo sapiens
gatctcggaagctaagcaggg

SEQ ID NO: 31504 - DNA, 22 bp, Homo sapiens
gatctcggaagctaagcagggt

SEQ ID NO: 31505 - DNA, 23 bp, Homo sapiens
gatctcggaagctaagcagggtc

SEQ ID NO: 31506 - DNA, 24 bp, Homo sapiens
gatctcggaagctaagcagggtcg

SEQ ID NO: 31507 - DNA, 25 bp, Homo sapiens
gatctcggaagctaagcagggtcgg

SEQ ID NO: 31508 - DNA, 26 bp, Homo sapiens
gatctcggaagctaagcagggtcggg

SEQ ID NO: 31509 - DNA, 27 bp, Homo sapiens
gatctcggaagctaagcagggtcgggc

SEQ ID NO: 31510 - DNA, 28 bp, Homo sapiens
gatctcggaagctaagcagggtcgggcc

SEQ ID NO: 31511 - DNA, 30 bp, Homo sapiens; identical to SEQ ID NO: 6852

SEQ ID NO: 31512 - DNA, 23 bp, Homo sapiens
atctcggaagctaagcagggtcg

SEQ ID NO: 31513 - DNA, 22 bp, Homo sapiens
tctcggaagctaagcagggtcg

SEQ ID NO: 31514 - DNA, 16 bp, Homo sapiens
ctcggaagctaagcag

SEQ ID NO: 31515 - DNA, 17 bp, Homo sapiens
ctcggaagctaagcagg

SEQ ID NO: 31516 - DNA, 18 bp, Homo sapiens
ctcggaagctaagcaggg

SEQ ID NO: 31517 - DNA, 19 bp, Homo sapiens
ctcggaagctaagcagggt

SEQ ID NO: 31518 - DNA, 20 bp, Homo sapiens
ctcggaagctaagcagggtc

SEQ ID NO: 31519 - DNA, 21 bp, Homo sapiens
ctcggaagctaagcagggtcg

SEQ ID NO: 31520 - DNA, 22 bp, Homo sapiens
ctcggaagctaagcagggtcgg

SEQ ID NO: 31521 - DNA, 23 bp, Homo sapiens
ctcggaagctaagcagggtcggg

SEQ ID NO: 31522 - DNA, 24 bp, Homo sapiens
ctcggaagctaagcagggtcgggc

SEQ ID NO: 31523 - DNA, 25 bp, Homo sapiens
ctcggaagctaagcagggtcgggcc

SEQ ID NO: 31524 - DNA, 26 bp, Homo sapiens
ctcggaagctaagcagggtcgggcct

SEQ ID NO: 31525 - DNA, 27 bp, Homo sapiens
ctcggaagctaagcagggtcgggcctg

SEQ ID NO: 31526 - DNA, 28 bp, Homo sapiens
ctcggaagctaagcagggtcgggcctgg

SEQ ID NO: 31527 - DNA, 30 bp, Homo sapiens; identical to SEQ ID NO: 135

SEQ ID NO: 31528 - DNA, 25 bp, Homo sapiens
cggaagctaagcagggtcgggcctg

SEQ ID NO: 31529 - DNA, 23 bp, Homo sapiens
gaagctaagcagggtcgggcctg

SEQ ID NO: 31530 - DNA, 24 bp, Homo sapiens
gaagctaagcagggtcgggcctgg

SEQ ID NO: 31531 - DNA, 22 bp, Homo sapiens
aagctaagcagggtcgggcctg

SEQ ID NO: 31532 - DNA, 23 bp, Homo sapiens
aagctaagcagggtcgggcctgg

SEQ ID NO: 31533 - DNA, 24 bp, Homo sapiens
aagctaagcagggtcgggcctggt

SEQ ID NO: 31534 - DNA, 25 bp, Homo sapiens
aagctaagcagggtcgggcctggtt

SEQ ID NO: 31535 - DNA, 27 bp, Homo sapiens
aagctaagcagggtcgggcctggttag

SEQ ID NO: 31536 - DNA, 21 bp, Homo sapiens
agctaagcagggtcgggcctg

SEQ ID NO: 31537 - DNA, 22 bp, Homo sapiens
agctaagcagggtcgggcctgg

SEQ ID NO: 31538 - DNA, 23 bp, Homo sapiens
agctaagcagggtcgggcctggt

SEQ ID NO: 31539 - DNA, 26 bp, Homo sapiens
agctaagcagggtcgggcctggttag

SEQ ID NO: 31540 - DNA, 20 bp, Homo sapiens
gctaagcagggtcgggcctg

SEQ ID NO: 31541 - DNA, 21 bp, Homo sapiens
gctaagcagggtcgggcctgg

SEQ ID NO: 31542 - DNA, 22 bp, Homo sapiens
gctaagcagggtcgggcctggt

SEQ ID NO: 31543 - DNA, 23 bp, Homo sapiens
gctaagcagggtcgggcctggtt

SEQ ID NO: 31544 - DNA, 25 bp, Homo sapiens
gctaagcagggtcgggcctggttag

SEQ ID NO: 31545 - DNA, 19 bp, Homo sapiens
ctaagcagggtcgggcctg

SEQ ID NO: 31546 - DNA, 20 bp, Homo sapiens
ctaagcagggtcgggcctgg

SEQ ID NO: 31547 - DNA, 21 bp, Homo sapiens
ctaagcagggtcgggcctggt

SEQ ID NO: 31548 - DNA, 22 bp, Homo sapiens
ctaagcagggtcgggcctggtt

SEQ ID NO: 31549 - DNA, 23 bp, Homo sapiens
ctaagcagggtcgggcctggtta

SEQ ID NO: 31550 - DNA, 24 bp, Homo sapiens
ctaagcagggtcgggcctggttag

SEQ ID NO: 31551 - DNA, 25 bp, Homo sapiens
ctaagcagggtcgggcctggttagt

SEQ ID NO: 31552 - DNA, 30 bp, Homo sapiens
ctaagcagggtcgggcctggttagtacttg

SEQ ID NO: 31553 - DNA, 18 bp, Homo sapiens
taagcagggtcgggcctg

SEQ ID NO: 31554 - DNA, 19 bp, Homo sapiens
taagcagggtcgggcctgg

SEQ ID NO: 31555 - DNA, 20 bp, Homo sapiens
taagcagggtcgggcctggt

SEQ ID NO: 31556 - DNA, 23 bp, Homo sapiens
taagcagggtcgggcctggttag

SEQ ID NO: 31557 - DNA, 24 bp, Homo sapiens
taagcagggtcgggcctggttagt

SEQ ID NO: 31558 - DNA, 30 bp, Homo sapiens
taagcagggtcgggcctggttagtacttgg

SEQ ID NO: 31559 - DNA, 17 bp, Homo sapiens
aagcagggtcgggcctg

SEQ ID NO: 31560 - DNA, 18 bp, Homo sapiens
aagcagggtcgggcctgg

SEQ ID NO: 31561 - DNA, 19 bp, Homo sapiens
aagcagggtcgggcctggt

SEQ ID NO: 31562 - DNA, 20 bp, Homo sapiens
aagcagggtcgggcctggtt

SEQ ID NO: 31563 - DNA, 22 bp, Homo sapiens
aagcagggtcgggcctggttag

SEQ ID NO: 31564 - DNA, 23 bp, Homo sapiens
aagcagggtcgggcctggttagt

SEQ ID NO: 31565 - DNA, 24 bp, Homo sapiens
aagcagggtcgggcctggttagta

SEQ ID NO: 31566 - DNA, 28 bp, Homo sapiens
aagcagggtcgggcctggttagtacttg

SEQ ID NO: 31567 - DNA, 29 bp, Homo sapiens
aagcagggtcgggcctggttagtacttgg

SEQ ID NO: 31568 - DNA, 16 bp, Homo sapiens
agcagggtcgggcctg

SEQ ID NO: 31569 - DNA, 17 bp, Homo sapiens
agcagggtcgggcctgg

SEQ ID NO: 31570 - DNA, 18 bp, Homo sapiens
agcagggtcgggcctggt

SEQ ID NO: 31571 - DNA, 19 bp, Homo sapiens
agcagggtcgggcctggtt

SEQ ID NO: 31572 - DNA, 21 bp, Homo sapiens
agcagggtcgggcctggttag

SEQ ID NO: 31573 - DNA, 22 bp, Homo sapiens
agcagggtcgggcctggttagt

SEQ ID NO: 31574 - DNA, 23 bp, Homo sapiens
agcagggtcgggcctggttagta

SEQ ID NO: 31575 - DNA, 25 bp, Homo sapiens
agcagggtcgggcctggttagtact

SEQ ID NO: 31576 - DNA, 26 bp, Homo sapiens
agcagggtcgggcctggttagtactt

SEQ ID NO: 31577 - DNA, 27 bp, Homo sapiens
agcagggtcgggcctggttagtacttg

SEQ ID NO: 31578 - DNA, 28 bp, Homo sapiens
agcagggtcgggcctggttagtacttgg

SEQ ID NO: 31579 - DNA, 29 bp, Homo sapiens
agcagggtcgggcctggttagtacttgga

SEQ ID NO: 31580 - DNA, 16 bp, Homo sapiens
gcagggtcgggcctgg

SEQ ID NO: 31581 - DNA, 17 bp, Homo sapiens
gcagggtcgggcctggt

SEQ ID NO: 31582 - DNA, 20 bp, Homo sapiens
gcagggtcgggcctggttag

SEQ ID NO: 31583 - DNA, 21 bp, Homo sapiens
gcagggtcgggcctggttagt

SEQ ID NO: 31584 - DNA, 22 bp, Homo sapiens
gcagggtcgggcctggttagta

SEQ ID NO: 31585 - DNA, 24 bp, Homo sapiens
gcagggtcgggcctggttagtact

SEQ ID NO: 31586 - DNA, 25 bp, Homo sapiens
gcagggtcgggcctggttagtactt

SEQ ID NO: 31587 - DNA, 26 bp, Homo sapiens
gcagggtcgggcctggttagtacttg

SEQ ID NO: 31588 - DNA, 27 bp, Homo sapiens
gcagggtcgggcctggttagtacttgg

SEQ ID NO: 31589 - DNA, 28 bp, Homo sapiens
gcagggtcgggcctggttagtacttgga

SEQ ID NO: 31590 - DNA, 30 bp, Homo sapiens; identical to SEQ ID NO: 6925

SEQ ID NO: 31591 - DNA, 16 bp, Homo sapiens
cagggtcgggcctggt

SEQ ID NO: 31592 - DNA, 17 bp, Homo sapiens
cagggtcgggcctggtt

SEQ ID NO: 31593 - DNA, 18 bp, Homo sapiens
cagggtcgggcctggtta

SEQ ID NO: 31594 - DNA, 19 bp, Homo sapiens
cagggtcgggcctggttag

SEQ ID NO: 31595 - DNA, 20 bp, Homo sapiens
cagggtcgggcctggttagt

SEQ ID NO: 31596 - DNA, 21 bp, Homo sapiens
cagggtcgggcctggttagta

SEQ ID NO: 31597 - DNA, 23 bp, Homo sapiens
cagggtcgggcctggttagtact

SEQ ID NO: 31598 - DNA, 24 bp, Homo sapiens
cagggtcgggcctggttagtactt

SEQ ID NO: 31599 - DNA, 25 bp, Homo sapiens
cagggtcgggcctggttagtacttg

SEQ ID NO: 31600 - DNA, 26 bp, Homo sapiens
cagggtcgggcctggttagtacttgg

SEQ ID NO: 31601 - DNA, 27 bp, Homo sapiens
cagggtcgggcctggttagtacttgga

SEQ ID NO: 31602 - DNA, 29 bp, Homo sapiens
cagggtcgggcctggttagtacttggatg

SEQ ID NO: 31603 - DNA, 30 bp, Homo sapiens
cagggtcgggcctggttagtacttggatgg

SEQ ID NO: 31604 - DNA, 16 bp, Homo sapiens
agggtcgggcctggtt

SEQ ID NO: 31605 - DNA, 18 bp, Homo sapiens
agggtcgggcctggttag

SEQ ID NO: 31606 - DNA, 19 bp, Homo sapiens
agggtcgggcctggttagt

SEQ ID NO: 31607 - DNA, 20 bp, Homo sapiens
agggtcgggcctggttagta

SEQ ID NO: 31608 - DNA, 21 bp, Homo sapiens
agggtcgggcctggttagtac

SEQ ID NO: 31609 - DNA, 22 bp, Homo sapiens
agggtcgggcctggttagtact

SEQ ID NO: 31610 - DNA, 23 bp, Homo sapiens
agggtcgggcctggttagtactt

SEQ ID NO: 31611 - DNA, 24 bp, Homo sapiens
agggtcgggcctggttagtacttg

SEQ ID NO: 31612 - DNA, 25 bp, Homo sapiens
agggtcgggcctggttagtacttgg

SEQ ID NO: 31613 - DNA, 26 bp, Homo sapiens
agggtcgggcctggttagtacttgga

SEQ ID NO: 31614 - DNA, 27 bp, Homo sapiens
agggtcgggcctggttagtacttggat

SEQ ID NO: 31615 - DNA, 28 bp, Homo sapiens
agggtcgggcctggttagtacttggatg

SEQ ID NO: 31616 - DNA, 30 bp, Homo sapiens
agggtcgggcctggttagtacttggatggg

SEQ ID NO: 31617 - DNA, 16 bp, Homo sapiens
gggtcgggcctggtta

SEQ ID NO: 31618 - DNA, 17 bp, Homo sapiens
gggtcgggcctggttag

SEQ ID NO: 31619 - DNA, 18 bp, Homo sapiens
gggtcgggcctggttagt

SEQ ID NO: 31620 - DNA, 19 bp, Homo sapiens
gggtcgggcctggttagta

SEQ ID NO: 31621 - DNA, 20 bp, Homo sapiens
gggtcgggcctggttagtac

SEQ ID NO: 31622 - DNA, 21 bp, Homo sapiens
gggtcgggcctggttagtact

SEQ ID NO: 31623 - DNA, 22 bp, Homo sapiens
gggtcgggcctggttagtactt

SEQ ID NO: 31624 - DNA, 23 bp, Homo sapiens
gggtcgggcctggttagtacttg

SEQ ID NO: 31625 - DNA, 24 bp, Homo sapiens
gggtcgggcctggttagtacttgg

SEQ ID NO: 31626 - DNA, 25 bp, Homo sapiens
gggtcgggcctggttagtacttgga

SEQ ID NO: 31627 - DNA, 26 bp, Homo sapiens
gggtcgggcctggttagtacttggat

SEQ ID NO: 31628 - DNA, 27 bp, Homo sapiens
gggtcgggcctggttagtacttggatg

SEQ ID NO: 31629 - DNA, 28 bp, Homo sapiens
gggtcgggcctggttagtacttggatgg

SEQ ID NO: 31630 - DNA, 29 bp, Homo sapiens
gggtcgggcctggttagtacttggatggg

SEQ ID NO: 31631 - DNA, 30 bp, Homo sapiens; identical to SEQ ID NO: 6940

SEQ ID NO: 31632 - DNA, 16 bp, Homo sapiens
ggtcgggcctggttag

SEQ ID NO: 31633 - DNA, 17 bp, Homo sapiens
ggtcgggcctggttagt

SEQ ID NO: 31634 - DNA, 18 bp, Homo sapiens
ggtcgggcctggttagta

SEQ ID NO: 31635 - DNA, 19 bp, Homo sapiens
ggtcgggcctggttagtac

SEQ ID NO: 31636 - DNA, 20 bp, Homo sapiens
ggtcgggcctggttagtact

SEQ ID NO: 31637 - DNA, 21 bp, Homo sapiens
ggtcgggcctggttagtactt

SEQ ID NO: 31638 - DNA, 22 bp, Homo sapiens
ggtcgggcctggttagtacttg

SEQ ID NO: 31639 - DNA, 23 bp, Homo sapiens
ggtcgggcctggttagtacttgg

SEQ ID NO: 31640 - DNA, 24 bp, Homo sapiens
ggtcgggcctggttagtacttgga

SEQ ID NO: 31641 - DNA, 25 bp, Homo sapiens
ggtcgggcctggttagtacttggat

SEQ ID NO: 31642 - DNA, 26 bp, Homo sapiens
ggtcgggcctggttagtacttggatg

SEQ ID NO: 31643 - DNA, 27 bp, Homo sapiens
ggtcgggcctggttagtacttggatgg

SEQ ID NO: 31644 - DNA, 28 bp, Homo sapiens
ggtcgggcctggttagtacttggatggg

SEQ ID NO: 31645 - DNA, 29 bp, Homo sapiens
ggtcgggcctggttagtacttggatggga

SEQ ID NO: 31646 - DNA, 30 bp, Homo sapiens
ggtcgggcctggttagtacttggatgggag

SEQ ID NO: 31647 - DNA, 22 bp, Homo sapiens
gtcgggcctggttagtacttgg

SEQ ID NO: 31648 - DNA, 29 bp, Homo sapiens
gtcgggcctggttagtacttggatgggag

SEQ ID NO: 31649 - DNA, 21 bp, Homo sapiens
tcgggcctggttagtacttgg

SEQ ID NO: 31650 - DNA, 22 bp, Homo sapiens
tcgggcctggttagtacttgga

SEQ ID NO: 31651 - DNA, 30 bp, Homo sapiens
tcgggcctggttagtacttggatgggagac

SEQ ID NO: 31652 - DNA, 20 bp, Homo sapiens
cgggcctggttagtacttgg

SEQ ID NO: 31653 - DNA, 21 bp, Homo sapiens
cgggcctggttagtacttgga

SEQ ID NO: 31654 - DNA, 24 bp, Homo sapiens
cgggcctggttagtacttggatgg

SEQ ID NO: 31655 - DNA, 25 bp, Homo sapiens
cgggcctggttagtacttggatggg

SEQ ID NO: 31656 - DNA, 22 bp, Homo sapiens
ggcctggttagtacttggatgg

SEQ ID NO: 31657 - DNA, 20 bp, Homo sapiens
gcctggttagtacttggatg

SEQ ID NO: 31658 - DNA, 21 bp, Homo sapiens
gcctggttagtacttggatgg

SEQ ID NO: 31659 - DNA, 24 bp, Homo sapiens
gcctggttagtacttggatgggag

SEQ ID NO: 31660 - DNA, 20 bp, Homo sapiens
cctggttagtacttggatgg

SEQ ID NO: 31661 - DNA, 21 bp, Homo sapiens
cctggttagtacttggatggg

SEQ ID NO: 31662 - DNA, 23 bp, Homo sapiens
cctggttagtacttggatgggag

SEQ ID NO: 31663 - DNA, 24 bp, Homo sapiens
cctggttagtacttggatgggaga

SEQ ID NO: 31664 - DNA, 30 bp, Homo sapiens
cctggttagtacttggatgggagaccgcct

SEQ ID NO: 31665 - DNA, 16 bp, Homo sapiens
ctggttagtacttgga

SEQ ID NO: 31666 - DNA, 18 bp, Homo sapiens
ctggttagtacttggatg

SEQ ID NO: 31667 - DNA, 19 bp, Homo sapiens
ctggttagtacttggatgg

SEQ ID NO: 31668 - DNA, 20 bp, Homo sapiens
ctggttagtacttggatggg

SEQ ID NO: 31669 - DNA, 21 bp, Homo sapiens
ctggttagtacttggatggga

SEQ ID NO: 31670 - DNA, 22 bp, Homo sapiens
ctggttagtacttggatgggag

SEQ ID NO: 31671 - DNA, 23 bp, Homo sapiens
ctggttagtacttggatgggaga

SEQ ID NO: 31672 - DNA, 24 bp, Homo sapiens
ctggttagtacttggatgggagac

SEQ ID NO: 31673 - DNA, 25 bp, Homo sapiens
ctggttagtacttggatgggagacc

SEQ ID NO: 31674 - DNA, 26 bp, Homo sapiens
ctggttagtacttggatgggagaccg

SEQ ID NO: 31675 - DNA, 27 bp, Homo sapiens
ctggttagtacttggatgggagaccgc

SEQ ID NO: 31676 - DNA, 30 bp, Homo sapiens
ctggttagtacttggatgggagaccgcctg

SEQ ID NO: 31677 - DNA, 20 bp, Homo sapiens
tggttagtacttggatggga

SEQ ID NO: 31678 - DNA, 21 bp, Homo sapiens
tggttagtacttggatgggag

SEQ ID NO: 31679 - DNA, 22 bp, Homo sapiens
tggttagtacttggatgggaga

SEQ ID NO: 31680 - DNA, 24 bp, Homo sapiens
tggttagtacttggatgggagacc

SEQ ID NO: 31681 - DNA, 26 bp, Homo sapiens
tggttagtacttggatgggagaccgc

SEQ ID NO: 31682 - DNA, 30 bp, Homo sapiens
tggttagtacttggatgggagaccgcctgg

SEQ ID NO: 31683 - DNA, 21 bp, Homo sapiens
ggttagtacttggatgggaga

SEQ ID NO: 31684 - DNA, 29 bp, Homo sapiens
ggttagtacttggatgggagaccgcctgg

SEQ ID NO: 31685 - DNA, 30 bp, Homo sapiens
ggttagtacttggatgggagaccgcctggg

SEQ ID NO: 31686 - DNA, 16 bp, Homo sapiens
gttagtacttggatgg

SEQ ID NO: 31687 - DNA, 18 bp, Homo sapiens
gttagtacttggatggga

SEQ ID NO: 31688 - DNA, 19 bp, Homo sapiens
gttagtacttggatgggag

SEQ ID NO: 31689 - DNA, 20 bp, Homo sapiens
gttagtacttggatgggaga

SEQ ID NO: 31690 - DNA, 29 bp, Homo sapiens
gttagtacttggatgggagaccgcctggg

SEQ ID NO: 31691 - DNA, 17 bp, Homo sapiens
ttagtacttggatggga

SEQ ID NO: 31692 - DNA, 18 bp, Homo sapiens
ttagtacttggatgggag

SEQ ID NO: 31693 - DNA, 19 bp, Homo sapiens
ttagtacttggatgggaga

SEQ ID NO: 31694 - DNA, 21 bp, Homo sapiens
ttagtacttggatgggagacc

SEQ ID NO: 31695 - DNA, 29 bp, Homo sapiens
ttagtacttggatgggagaccgcctggga

SEQ ID NO: 31696 - DNA, 17 bp, Homo sapiens
tagtacttggatgggag

SEQ ID NO: 31697 - DNA, 18 bp, Homo sapiens
tagtacttggatgggaga

SEQ ID NO: 31698 - DNA, 20 bp, Homo sapiens
tagtacttggatgggagacc

SEQ ID NO: 31699 - DNA, 28 bp, Homo sapiens
tagtacttggatgggagaccgcctggga

SEQ ID NO: 31700 - DNA, 17 bp, Homo sapiens
agtacttggatgggaga

SEQ ID NO: 31701 - DNA, 18 bp, Homo sapiens
agtacttggatgggagac

SEQ ID NO: 31702 - DNA, 19 bp, Homo sapiens
agtacttggatgggagacc

SEQ ID NO: 31703 - DNA, 29 bp, Homo sapiens
agtacttggatgggagaccgcctgggaat

SEQ ID NO: 31704 - DNA, 30 bp, Homo sapiens
agtacttggatgggagaccgcctgggaata

SEQ ID NO: 31705 - DNA, 30 bp, Homo sapiens
gtacttggatgggagaccgcctgggaatac

SEQ ID NO: 31706 - DNA, 30 bp, Homo sapiens
tacttggatgggagaccgcctgggaatacc

SEQ ID NO: 31707 - DNA, 30 bp, Homo sapiens
acttggatgggagaccgcctgggaataccg

SEQ ID NO: 31708 - DNA, 18 bp, Homo sapiens
cttggatgggagaccgcc

SEQ ID NO: 31709 - DNA, 23 bp, Homo sapiens
cttggatgggagaccgcctggga

SEQ ID NO: 31710 - DNA, 30 bp, Homo sapiens; identical to SEQ ID NO: 6980

SEQ ID NO: 31711 - DNA, 19 bp, Homo sapiens
ttggatgggagaccgcctg

SEQ ID NO: 31712 - DNA, 20 bp, Homo sapiens
ttggatgggagaccgcctgg

SEQ ID NO: 31713 - DNA, 30 bp, Homo sapiens; identical to SEQ ID NO: 28639

SEQ ID NO: 31714 - DNA, 29 bp, Homo sapiens
tggatgggagaccgcctgggaataccggg

SEQ ID NO: 31715 - DNA, 30 bp, Homo sapiens; identical to SEQ ID NO: 28640

SEQ ID NO: 31716 - DNA, 30 bp, Homo sapiens; identical to SEQ ID NO: 28641

SEQ ID NO: 31717 - DNA, 17 bp, Homo sapiens
gatgggagaccgcctgg

SEQ ID NO: 31718 - DNA, 18 bp, Homo sapiens
gatgggagaccgcctggg

SEQ ID NO: 31719 - DNA, 19 bp, Homo sapiens
gatgggagaccgcctggga

SEQ ID NO: 31720 - DNA, 30 bp, Homo sapiens
gatgggagaccgcctgggaataccgggtgc

SEQ ID NO: 31721 - DNA, 20 bp, Homo sapiens
gagaccgcctgggaataccg

SEQ ID NO: 31722 - DNA, 30 bp, Homo sapiens
gagaccgcctgggaataccgggtgctgtag

SEQ ID NO: 31723 - DNA, 30 bp, Homo sapiens
agaccgcctgggaataccgggtgctgtagg

SEQ ID NO: 31724 - DNA, 19 bp, Homo sapiens
gaccgcctgggaataccgg

SEQ ID NO: 31725 - DNA, 20 bp, Homo sapiens
gaccgcctgggaataccggg

SEQ ID NO: 31726 - DNA, 29 bp, Homo sapiens
gaccgcctgggaataccgggtgctgtagg

SEQ ID NO: 31727 - DNA, 30 bp, Homo sapiens
gaccgcctgggaataccgggtgctgtaggc

SEQ ID NO: 31728 - DNA, 28 bp, Homo sapiens
accgcctgggaataccgggtgctgtagg

SEQ ID NO: 31729 - DNA, 26 bp, Homo sapiens
ccgcctgggaataccgggtgctgtag

SEQ ID NO: 31730 - DNA, 27 bp, Homo sapiens
ccgcctgggaataccgggtgctgtagg

SEQ ID NO: 31731 - DNA, 29 bp, Homo sapiens
ccgcctgggaataccgggtgctgtaggct

SEQ ID NO: 31732 - DNA, 30 bp, Homo sapiens; identical to SEQ ID NO: 171

SEQ ID NO: 31733 - DNA, 26 bp, Homo sapiens
cgcctgggaataccgggtgctgtagg

SEQ ID NO: 31734 - DNA, 29 bp, Homo sapiens
cgcctgggaataccgggtgctgtaggctt

SEQ ID NO: 31735 - DNA, 30 bp, Homo sapiens; identical to SEQ ID NO: 174

SEQ ID NO: 31736 - DNA, 23 bp, Homo sapiens
gcctgggaataccgggtgctgta

SEQ ID NO: 31737 - DNA, 24 bp, Homo sapiens
gcctgggaataccgggtgctgtag

SEQ ID NO: 31738 - DNA, 25 bp, Homo sapiens
gcctgggaataccgggtgctgtagg

SEQ ID NO: 31739 - DNA, 26 bp, Homo sapiens
gcctgggaataccgggtgctgtaggc

SEQ ID NO: 31740 - DNA, 27 bp, Homo sapiens
gcctgggaataccgggtgctgtaggct

SEQ ID NO: 31741 - DNA, 28 bp, Homo sapiens
gcctgggaataccgggtgctgtaggctt

SEQ ID NO: 31742 - DNA, 29 bp, Homo sapiens
gcctgggaataccgggtgctgtaggcttt

SEQ ID NO: 31743 - DNA, 30 bp, Homo sapiens
gcctgggaataccgggtgctgtaggctttt

SEQ ID NO: 31744 - DNA, 22 bp, Homo sapiens
cctgggaataccgggtgctgta

SEQ ID NO: 31745 - DNA, 23 bp, Homo sapiens
cctgggaataccgggtgctgtag

SEQ ID NO: 31746 - DNA, 24 bp, Homo sapiens
cctgggaataccgggtgctgtagg

SEQ ID NO: 31747 - DNA, 25 bp, Homo sapiens
cctgggaataccgggtgctgtaggc

SEQ ID NO: 31748 - DNA, 26 bp, Homo sapiens
cctgggaataccgggtgctgtaggct

SEQ ID NO: 31749 - DNA, 27 bp, Homo sapiens
cctgggaataccgggtgctgtaggctt

SEQ ID NO: 31750 - DNA, 28 bp, Homo sapiens
cctgggaataccgggtgctgtaggcttt

SEQ ID NO: 31751 - DNA, 29 bp, Homo sapiens
cctgggaataccgggtgctgtaggctttt

SEQ ID NO: 31752 - DNA, 30 bp, Homo sapiens
cctgggaataccgggtgctgtaggcttttt

SEQ ID NO: 31753 - DNA, 21 bp, Homo sapiens
ctgggaataccgggtgctgta

SEQ ID NO: 31754 - DNA, 22 bp, Homo sapiens
ctgggaataccgggtgctgtag

SEQ ID NO: 31755 - DNA, 23 bp, Homo sapiens
ctgggaataccgggtgctgtagg

SEQ ID NO: 31756 - DNA, 24 bp, Homo sapiens
ctgggaataccgggtgctgtaggc

SEQ ID NO: 31757 - DNA, 25 bp, Homo sapiens
ctgggaataccgggtgctgtaggct

SEQ ID NO: 31758 - DNA, 26 bp, Homo sapiens
ctgggaataccgggtgctgtaggctt

SEQ ID NO: 31759 - DNA, 27 bp, Homo sapiens
ctgggaataccgggtgctgtaggcttt

SEQ ID NO: 31760 - DNA, 20 bp, Homo sapiens
tgggaataccgggtgctgta

SEQ ID NO: 31761 - DNA, 21 bp, Homo sapiens
tgggaataccgggtgctgtag

SEQ ID NO: 31762 - DNA, 22 bp, Homo sapiens
tgggaataccgggtgctgtagg

SEQ ID NO: 31763 - DNA, 23 bp, Homo sapiens
tgggaataccgggtgctgtaggc

SEQ ID NO: 31764 - DNA, 24 bp, Homo sapiens
tgggaataccgggtgctgtaggct

SEQ ID NO: 31765 - DNA, 25 bp, Homo sapiens
tgggaataccgggtgctgtaggctt

SEQ ID NO: 31766 - DNA, 26 bp, Homo sapiens
tgggaataccgggtgctgtaggcttt

SEQ ID NO: 31767 - DNA, 27 bp, Homo sapiens
tgggaataccgggtgctgtaggctttt

SEQ ID NO: 31768 - DNA, 28 bp, Homo sapiens
tgggaataccgggtgctgtaggcttttt

SEQ ID NO: 31769 - DNA, 20 bp, Homo sapiens
gggaataccgggtgctgtag

SEQ ID NO: 31770 - DNA, 21 bp, Homo sapiens
gggaataccgggtgctgtagg

SEQ ID NO: 31771 - DNA, 22 bp, Homo sapiens
gggaataccgggtgctgtaggc

SEQ ID NO: 31772 - DNA, 23 bp, Homo sapiens
gggaataccgggtgctgtaggct

SEQ ID NO: 31773 - DNA, 24 bp, Homo sapiens
gggaataccgggtgctgtaggctt

SEQ ID NO: 31774 - DNA, 25 bp, Homo sapiens
gggaataccgggtgctgtaggcttt

SEQ ID NO: 31775 - DNA, 26 bp, Homo sapiens
gggaataccgggtgctgtaggctttt

SEQ ID NO: 31776 - DNA, 27 bp, Homo sapiens
gggaataccgggtgctgtaggcttttt

SEQ ID NO: 31777 - DNA, 17 bp, Homo sapiens
ggaataccgggtgctgt

SEQ ID NO: 31778 - DNA, 18 bp, Homo sapiens
ggaataccgggtgctgta

SEQ ID NO: 31779 - DNA, 19 bp, Homo sapiens
ggaataccgggtgctgtag

SEQ ID NO: 31780 - DNA, 20 bp, Homo sapiens
ggaataccgggtgctgtagg

SEQ ID NO: 31781 - DNA, 21 bp, Homo sapiens
ggaataccgggtgctgtaggc

SEQ ID NO: 31782 - DNA, 22 bp, Homo sapiens
ggaataccgggtgctgtaggct

SEQ ID NO: 31783 - DNA, 23 bp, Homo sapiens
ggaataccgggtgctgtaggctt

SEQ ID NO: 31784 - DNA, 24 bp, Homo sapiens
ggaataccgggtgctgtaggcttt

SEQ ID NO: 31785 - DNA, 25 bp, Homo sapiens
ggaataccgggtgctgtaggctttt

SEQ ID NO: 31786 - DNA, 26 bp, Homo sapiens
ggaataccgggtgctgtaggcttttt

SEQ ID NO: 31787 - DNA, 17 bp, Homo sapiens
gaataccgggtgctgta

SEQ ID NO: 31788 - DNA, 18 bp, Homo sapiens
gaataccgggtgctgtag

SEQ ID NO: 31789 - DNA, 19 bp, Homo sapiens
gaataccgggtgctgtagg

SEQ ID NO: 31790 - DNA, 20 bp, Homo sapiens
gaataccgggtgctgtaggc

SEQ ID NO: 31791 - DNA, 21 bp, Homo sapiens
gaataccgggtgctgtaggct

SEQ ID NO: 31792 - DNA, 22 bp, Homo sapiens
gaataccgggtgctgtaggctt

SEQ ID NO: 31793 - DNA, 23 bp, Homo sapiens
gaataccgggtgctgtaggcttt

SEQ ID NO: 31794 - DNA, 24 bp, Homo sapiens
gaataccgggtgctgtaggctttt

SEQ ID NO: 31795 - DNA, 25 bp, Homo sapiens
gaataccgggtgctgtaggcttttt

SEQ ID NO: 31796 - DNA, 17 bp, Homo sapiens
aataccgggtgctgtag

SEQ ID NO: 31797 - DNA, 18 bp, Homo sapiens
aataccgggtgctgtagg

SEQ ID NO: 31798 - DNA, 19 bp, Homo sapiens
aataccgggtgctgtaggc

SEQ ID NO: 31799 - DNA, 20 bp, Homo sapiens
aataccgggtgctgtaggct

SEQ ID NO: 31800 - DNA, 21 bp, Homo sapiens
aataccgggtgctgtaggctt

SEQ ID NO: 31801 - DNA, 22 bp, Homo sapiens
aataccgggtgctgtaggcttt

SEQ ID NO: 31802 - DNA, 23 bp, Homo sapiens
aataccgggtgctgtaggctttt

SEQ ID NO: 31803 - DNA, 24 bp, Homo sapiens
aataccgggtgctgtaggcttttt

SEQ ID NO: 31804 - DNA, 16 bp, Homo sapiens
ataccgggtgctgtag

SEQ ID NO: 31805 - DNA, 17 bp, Homo sapiens
ataccgggtgctgtagg

SEQ ID NO: 31806 - DNA, 18 bp, Homo sapiens
ataccgggtgctgtaggc

SEQ ID NO: 31807 - DNA, 19 bp, Homo sapiens
ataccgggtgctgtaggct

SEQ ID NO: 31808 - DNA, 20 bp, Homo sapiens
ataccgggtgctgtaggctt

SEQ ID NO: 31809 - DNA, 21 bp, Homo sapiens
ataccgggtgctgtaggcttt

SEQ ID NO: 31810 - DNA, 22 bp, Homo sapiens
ataccgggtgctgtaggctttt

SEQ ID NO: 31811 - DNA, 23 bp, Homo sapiens
ataccgggtgctgtaggcttttt

SEQ ID NO: 31812 - DNA, 16 bp, Homo sapiens
taccgggtgctgtagg

SEQ ID NO: 31813 - DNA, 17 bp, Homo sapiens
taccgggtgctgtaggc

SEQ ID NO: 31814 - DNA, 18 bp, Homo sapiens
taccgggtgctgtaggct

SEQ ID NO: 31815 - DNA, 19 bp, Homo sapiens
taccgggtgctgtaggctt

SEQ ID NO: 31816 - DNA, 20 bp, Homo sapiens
taccgggtgctgtaggcttt

SEQ ID NO: 31817 - DNA, 21 bp, Homo sapiens
taccgggtgctgtaggctttt

SEQ ID NO: 31818 - DNA, 22 bp, Homo sapiens
taccgggtgctgtaggcttttt

SEQ ID NO: 31819 - DNA, 16 bp, Homo sapiens
accgggtgctgtaggc

SEQ ID NO: 31820 - DNA, 17 bp, Homo sapiens
accgggtgctgtaggct

SEQ ID NO: 31821 - DNA, 18 bp, Homo sapiens
accgggtgctgtaggctt

SEQ ID NO: 31822 - DNA, 19 bp, Homo sapiens
accgggtgctgtaggcttt

SEQ ID NO: 31823 - DNA, 20 bp, Homo sapiens
accgggtgctgtaggctttt

SEQ ID NO: 31824 - DNA, 21 bp, Homo sapiens
accgggtgctgtaggcttttt

SEQ ID NO: 31825 - DNA, 22 bp, Homo sapiens
accgggtgctgtaggctttttc

SEQ ID NO: 31826 - DNA, 23 bp, Homo sapiens
accgggtgctgtaggctttttct

SEQ ID NO: 31827 - DNA, 24 bp, Homo sapiens
accgggtgctgtaggctttttctt

SEQ ID NO: 31828 - DNA, 25 bp, Homo sapiens
accgggtgctgtaggctttttcttt

SEQ ID NO: 31829 - DNA, 16 bp, Homo sapiens
ccgggtgctgtaggct

SEQ ID NO: 31830 - DNA, 17 bp, Homo sapiens
ccgggtgctgtaggctt

SEQ ID NO: 31831 - DNA, 18 bp, Homo sapiens
ccgggtgctgtaggcttt

SEQ ID NO: 31832 - DNA, 19 bp, Homo sapiens
ccgggtgctgtaggctttt

SEQ ID NO: 31833 - DNA, 20 bp, Homo sapiens
ccgggtgctgtaggcttttt

SEQ ID NO: 31834 - DNA, 24 bp, Homo sapiens
ccgggtgctgtaggctttttcttt

SEQ ID NO: 31835 - DNA, 16 bp, Homo sapiens
cgggtgctgtaggctt

SEQ ID NO: 31836 - DNA, 17 bp, Homo sapiens
cgggtgctgtaggcttt

SEQ ID NO: 31837 - DNA, 18 bp, Homo sapiens
cgggtgctgtaggctttt

SEQ ID NO: 31838 - DNA, 19 bp, Homo sapiens
cgggtgctgtaggcttttt

SEQ ID NO: 31839 - DNA, 20 bp, Homo sapiens
cgggtgctgtaggctttttc

SEQ ID NO: 31840 - DNA, 21 bp, Homo sapiens
cgggtgctgtaggctttttct

SEQ ID NO: 31841 - DNA, 22 bp, Homo sapiens
cgggtgctgtaggctttttctt

SEQ ID NO: 31842 - DNA, 23 bp, Homo sapiens
cgggtgctgtaggctttttcttt

SEQ ID NO: 31843 - DNA, 16 bp, Homo sapiens
gggtgctgtaggcttt

SEQ ID NO: 31844 - DNA, 17 bp, Homo sapiens
gggtgctgtaggctttt

SEQ ID NO: 31845 - DNA, 18 bp, Homo sapiens
gggtgctgtaggcttttt

SEQ ID NO: 31846 - DNA, 21 bp, Homo sapiens
gggtgctgtaggctttttctt

SEQ ID NO: 31847 - DNA, 22 bp, Homo sapiens
gggtgctgtaggctttttcttt

SEQ ID NO: 31848 - DNA, 16 bp, Homo sapiens
ggtgctgtaggctttt

SEQ ID NO: 31849 - DNA, 17 bp, Homo sapiens
ggtgctgtaggcttttt

SEQ ID NO: 31850 - DNA, 20 bp, Homo sapiens
ggtgctgtaggctttttctt

SEQ ID NO: 31851 - DNA, 21 bp, Homo sapiens
ggtgctgtaggctttttcttt

SEQ ID NO: 31852 - DNA, 16 bp, Homo sapiens
gtgctgtaggcttttt

SEQ ID NO: 31853 - DNA, 19 bp, Homo sapiens
gtgctgtaggctttttctt

SEQ ID NO: 31854 - DNA, 20 bp, Homo sapiens
gtgctgtaggctttttcttt

SEQ ID NO: 31855 - DNA, 19 bp, Homo sapiens
tgctgtaggctttttcttt

SEQ ID NO: 31856 - DNA, 16 bp, Homo sapiens
ctgtaggctttttctt

SEQ ID NO: 31857 - DNA, 17 bp, Homo sapiens
ctgtaggctttttcttt

SEQ ID NO: 31858 - DNA, 30 bp, Homo sapiens
aataggtttggtcctagcctttctattagc

SEQ ID NO: 31859 - DNA, 20 bp, Homo sapiens
ataggtttggtcctagcctt

SEQ ID NO: 31860 - DNA, 21 bp, Homo sapiens
ataggtttggtcctagccttt

SEQ ID NO: 31861 - DNA, 23 bp, Homo sapiens
ataggtttggtcctagcctttct

SEQ ID NO: 31862 - DNA, 30 bp, Homo sapiens; identical to SEQ ID NO: 213

SEQ ID NO: 31863 - DNA, 30 bp, Homo sapiens
taggtttggtcctagcctttctattagctc

SEQ ID NO: 31864 - DNA, 16 bp, Homo sapiens
catgcaagcatccccg

SEQ ID NO: 31865 - DNA, 19 bp, Homo sapiens
catgcaagcatccccgttc

SEQ ID NO: 31866 - DNA, 20 bp, Homo sapiens
catgcaagcatccccgttcc

SEQ ID NO: 31867 - DNA, 21 bp, Homo sapiens
catgcaagcatccccgttcca

SEQ ID NO: 31868 - DNA, 24 bp, Homo sapiens
catgcaagcatccccgttccagtg

SEQ ID NO: 31869 - DNA, 16 bp, Homo sapiens
tgcaagcatccccgtt

SEQ ID NO: 31870 - DNA, 17 bp, Homo sapiens
tgcaagcatccccgttc

SEQ ID NO: 31871 - DNA, 18 bp, Homo sapiens
tgcaagcatccccgttcc

SEQ ID NO: 31872 - DNA, 19 bp, Homo sapiens
tgcaagcatccccgttcca

SEQ ID NO: 31873 - DNA, 20 bp, Homo sapiens
tgcaagcatccccgttccag

SEQ ID NO: 31874 - DNA, 22 bp, Homo sapiens
tgcaagcatccccgttccagtg

SEQ ID NO: 31875 - DNA, 17 bp, Homo sapiens
gcaagcatccccgttcc

SEQ ID NO: 31876 - DNA, 21 bp, Homo sapiens
gcaagcatccccgttccagtg

SEQ ID NO: 31877 - DNA, 18 bp, Homo sapiens
cgttccagtgagttcacc

SEQ ID NO: 31878 - DNA, 19 bp, Homo sapiens
cgttccagtgagttcaccc

SEQ ID NO: 31879 - DNA, 17 bp, Homo sapiens
gttccagtgagttcacc

SEQ ID NO: 31880 - DNA, 18 bp, Homo sapiens
gttccagtgagttcaccc

SEQ ID NO: 31881 - DNA, 20 bp, Homo sapiens
gttccagtgagttcaccctc

SEQ ID NO: 31882 - DNA, 21 bp, Homo sapiens
gttccagtgagttcaccctct

SEQ ID NO: 31883 - DNA, 21 bp, Homo sapiens
gagttcaccctctaaatcacc

SEQ ID NO: 31884 - DNA, 22 bp, Homo sapiens
gagttcaccctctaaatcacca

SEQ ID NO: 31885 - DNA, 23 bp, Homo sapiens
gagttcaccctctaaatcaccac

SEQ ID NO: 31886 - DNA, 18 bp, Homo sapiens
ctctaaatcaccacgatc

SEQ ID NO: 31887 - DNA, 19 bp, Homo sapiens
ctctaaatcaccacgatca

SEQ ID NO: 31888 - DNA, 23 bp, Homo sapiens
ctctaaatcaccacgatcaaaag

SEQ ID NO: 31889 - DNA, 24 bp, Homo sapiens
ctctaaatcaccacgatcaaaagg

SEQ ID NO: 31890 - DNA, 22 bp, Homo sapiens
tctaaatcaccacgatcaaaag

SEQ ID NO: 31891 - DNA, 23 bp, Homo sapiens
tctaaatcaccacgatcaaaagg

SEQ ID NO: 31892 - DNA, 21 bp, Homo sapiens
ctaaatcaccacgatcaaaag

SEQ ID NO: 31893 - DNA, 22 bp, Homo sapiens
ctaaatcaccacgatcaaaagg

SEQ ID NO: 31894 - DNA, 25 bp, Homo sapiens
ctaaatcaccacgatcaaaaggaac

SEQ ID NO: 31895 - DNA, 20 bp, Homo sapiens
taaatcaccacgatcaaaag

SEQ ID NO: 31896 - DNA, 21 bp, Homo sapiens
taaatcaccacgatcaaaagg

SEQ ID NO: 31897 - DNA, 19 bp, Homo sapiens
aaatcaccacgatcaaaag

SEQ ID NO: 31898 - DNA, 20 bp, Homo sapiens
aaatcaccacgatcaaaagg

SEQ ID NO: 31899 - DNA, 21 bp, Homo sapiens
aaatcaccacgatcaaaagga

SEQ ID NO: 31900 - DNA, 23 bp, Homo sapiens
aaatcaccacgatcaaaaggaac

SEQ ID NO: 31901 - DNA, 18 bp, Homo sapiens
aatcaccacgatcaaaag

SEQ ID NO: 31902 - DNA, 19 bp, Homo sapiens
aatcaccacgatcaaaagg

SEQ ID NO: 31903 - DNA, 20 bp, Homo sapiens
aatcaccacgatcaaaagga

SEQ ID NO: 31904 - DNA, 22 bp, Homo sapiens
aatcaccacgatcaaaaggaac

SEQ ID NO: 31905 - DNA, 23 bp, Homo sapiens
aatcaccacgatcaaaaggaaca

SEQ ID NO: 31906 - DNA, 18 bp, Homo sapiens
atcaccacgatcaaaagg

SEQ ID NO: 31907 - DNA, 19 bp, Homo sapiens
atcaccacgatcaaaagga

SEQ ID NO: 31908 - DNA, 21 bp, Homo sapiens
atcaccacgatcaaaaggaac

SEQ ID NO: 31909 - DNA, 22 bp, Homo sapiens
atcaccacgatcaaaaggaaca

SEQ ID NO: 31910 - DNA, 17 bp, Homo sapiens
tcaccacgatcaaaagg

SEQ ID NO: 31911 - DNA, 21 bp, Homo sapiens
tcaccacgatcaaaaggaaca

SEQ ID NO: 31912 - DNA, 16 bp, Homo sapiens
caccacgatcaaaagg

SEQ ID NO: 31913 - DNA, 22 bp, Homo sapiens
caccacgatcaaaaggaacaag

SEQ ID NO: 31914 - DNA, 24 bp, Homo sapiens
caccacgatcaaaaggaacaagca

SEQ ID NO: 31915 - DNA, 18 bp, Homo sapiens
acgatcaaaaggaacaag

SEQ ID NO: 31916 - DNA, 17 bp, Homo sapiens
gctcaaaacgcttagcc

SEQ ID NO: 31917 - DNA, 22 bp, Homo sapiens
gctcaaaacgcttagcctagcc

SEQ ID NO: 31918 - DNA, 24 bp, Homo sapiens
cacgggaaacagcagtgattaacc

SEQ ID NO: 31919 - DNA, 22 bp, Homo sapiens
aatttcgtgccagccaccgcgg

SEQ ID NO: 31920 - DNA, 23 bp, Homo sapiens
cgtaaagagtgttttagatcacc

SEQ ID NO: 31921 - DNA, 24 bp, Homo sapiens
cgtaaagagtgttttagatcaccc

SEQ ID NO: 31922 - DNA, 25 bp, Homo sapiens
cgtaaagagtgttttagatcacccc

SEQ ID NO: 31923 - DNA, 26 bp, Homo sapiens
cgtaaagagtgttttagatcaccccc

SEQ ID NO: 31924 - DNA, 27 bp, Homo sapiens
cgtaaagagtgttttagatcaccccct

SEQ ID NO: 31925 - DNA, 18 bp, Homo sapiens
gtgttttagatcaccccc

SEQ ID NO: 31926 - DNA, 19 bp, Homo sapiens
gtgttttagatcaccccct

SEQ ID NO: 31927 - DNA, 20 bp, Homo sapiens
gtgttttagatcaccccctc

SEQ ID NO: 31928 - DNA, 21 bp, Homo sapiens
gtgttttagatcaccccctcc

SEQ ID NO: 31929 - DNA, 30 bp, Homo sapiens
aaaactcacctgagttgtaaaaaactccag

SEQ ID NO: 31930 - DNA, 25 bp, Homo sapiens
aactcacctgagttgtaaaaaactc

SEQ ID NO: 31931 - DNA, 22 bp, Homo sapiens
ctcacctgagttgtaaaaaact

SEQ ID NO: 31932 - DNA, 23 bp, Homo sapiens
ctcacctgagttgtaaaaaactc

SEQ ID NO: 31933 - DNA, 29 bp, Homo sapiens
ctcacctgagttgtaaaaaactccagttg

SEQ ID NO: 31934 - DNA, 20 bp, Homo sapiens
cacctgagttgtaaaaaact

SEQ ID NO: 31935 - DNA, 21 bp, Homo sapiens
cacctgagttgtaaaaaactc

SEQ ID NO: 31936 - DNA, 29 bp, Homo sapiens
cacctgagttgtaaaaaactccagttgac

SEQ ID NO: 31937 - DNA, 18 bp, Homo sapiens
ctgagttgtaaaaaactc

SEQ ID NO: 31938 - DNA, 22 bp, Homo sapiens
ttgtaaaaaactccagttgaca

SEQ ID NO: 31939 - DNA, 29 bp, Homo sapiens
actccagttgacacaaaatagactacgaa

SEQ ID NO: 31940 - DNA, 30 bp, Homo sapiens
ctccagttgacacaaaatagactacgaaag

SEQ ID NO: 31941 - DNA, 28 bp, Homo sapiens
caaaatagactacgaaagtggctttaac

SEQ ID NO: 31942 - DNA, 29 bp, Homo sapiens
aaaatagactacgaaagtggctttaacat

SEQ ID NO: 31943 - DNA, 28 bp, Homo sapiens
aaatagactacgaaagtggctttaacat

SEQ ID NO: 31944 - DNA, 27 bp, Homo sapiens
aatagactacgaaagtggctttaacat

SEQ ID NO: 31945 - DNA, 29 bp, Homo sapiens
agactacgaaagtggctttaacatatctg

SEQ ID NO: 31946 - DNA, 30 bp, Homo sapiens
actacgaaagtggctttaacatatctgaac

SEQ ID NO: 31947 - DNA, 29 bp, Homo sapiens
ctacgaaagtggctttaacatatctgaac

SEQ ID NO: 31948 - DNA, 28 bp, Homo sapiens
tacgaaagtggctttaacatatctgaac

SEQ ID NO: 31949 - DNA, 29 bp, Homo sapiens
tacgaaagtggctttaacatatctgaaca

SEQ ID NO: 31950 - DNA, 30 bp, Homo sapiens; identical to SEQ ID NO: 311

SEQ ID NO: 31951 - DNA, 27 bp, Homo sapiens
acgaaagtggctttaacatatctgaac

SEQ ID NO: 31952 - DNA, 28 bp, Homo sapiens
acgaaagtggctttaacatatctgaaca

SEQ ID NO: 31953 - DNA, 29 bp, Homo sapiens
acgaaagtggctttaacatatctgaacac

SEQ ID NO: 31954 - DNA, 30 bp, Homo sapiens
cgaaagtggctttaacatatctgaacacac

SEQ ID NO: 31955 - DNA, 25 bp, Homo sapiens
gaaagtggctttaacatatctgaac

SEQ ID NO: 31956 - DNA, 26 bp, Homo sapiens
gaaagtggctttaacatatctgaaca

SEQ ID NO: 31957 - DNA, 29 bp, Homo sapiens
gaaagtggctttaacatatctgaacacac

SEQ ID NO: 31958 - DNA, 24 bp, Homo sapiens
aaagtggctttaacatatctgaac

SEQ ID NO: 31959 - DNA, 25 bp, Homo sapiens
aaagtggctttaacatatctgaaca

SEQ ID NO: 31960 - DNA, 26 bp, Homo sapiens
aaagtggctttaacatatctgaacac

SEQ ID NO: 31961 - DNA, 27 bp, Homo sapiens
aaagtggctttaacatatctgaacaca

SEQ ID NO: 31962 - DNA, 28 bp, Homo sapiens
aaagtggctttaacatatctgaacacac

SEQ ID NO: 31963 - DNA, 29 bp, Homo sapiens
aaagtggctttaacatatctgaacacaca

SEQ ID NO: 31964 - DNA, 23 bp, Homo sapiens
aagtggctttaacatatctgaac

SEQ ID NO: 31965 - DNA, 24 bp, Homo sapiens
aagtggctttaacatatctgaaca

SEQ ID NO: 31966 - DNA, 25 bp, Homo sapiens
aagtggctttaacatatctgaacac

SEQ ID NO: 31967 - DNA, 26 bp, Homo sapiens
aagtggctttaacatatctgaacaca

SEQ ID NO: 31968 - DNA, 27 bp, Homo sapiens
aagtggctttaacatatctgaacacac

SEQ ID NO: 31969 - DNA, 28 bp, Homo sapiens
aagtggctttaacatatctgaacacaca

SEQ ID NO: 31970 - DNA, 23 bp, Homo sapiens
agtggctttaacatatctgaaca

SEQ ID NO: 31971 - DNA, 25 bp, Homo sapiens
agtggctttaacatatctgaacaca

SEQ ID NO: 31972 - DNA, 22 bp, Homo sapiens
gtggctttaacatatctgaaca

SEQ ID NO: 31973 - DNA, 24 bp, Homo sapiens
gtggctttaacatatctgaacaca

SEQ ID NO: 31974 - DNA, 22 bp, Homo sapiens
ggctttaacatatctgaacaca

SEQ ID NO: 31975 - DNA, 23 bp, Homo sapiens
ggctttaacatatctgaacacac

SEQ ID NO: 31976 - DNA, 24 bp, Homo sapiens
ggctttaacatatctgaacacaca

SEQ ID NO: 31977 - DNA, 21 bp, Homo sapiens
gctttaacatatctgaacaca

SEQ ID NO: 31978 - DNA, 22 bp, Homo sapiens
gctttaacatatctgaacacac

SEQ ID NO: 31979 - DNA, 23 bp, Homo sapiens
gctttaacatatctgaacacaca

SEQ ID NO: 31980 - DNA, 29 bp, Homo sapiens
gctttaacatatctgaacacacaatagct

SEQ ID NO: 31981 - DNA, 18 bp, Homo sapiens
ctttaacatatctgaaca

SEQ ID NO: 31982 - DNA, 19 bp, Homo sapiens
ctttaacatatctgaacac

SEQ ID NO: 31983 - DNA, 20 bp, Homo sapiens
ctttaacatatctgaacaca

SEQ ID NO: 31984 - DNA, 21 bp, Homo sapiens
ctttaacatatctgaacacac

SEQ ID NO: 31985 - DNA, 22 bp, Homo sapiens
ctttaacatatctgaacacaca

SEQ ID NO: 31986 - DNA, 19 bp, Homo sapiens
tttaacatatctgaacaca

SEQ ID NO: 31987 - DNA, 20 bp, Homo sapiens
tttaacatatctgaacacac

SEQ ID NO: 31988 - DNA, 21 bp, Homo sapiens
tttaacatatctgaacacaca

SEQ ID NO: 31989 - DNA, 26 bp, Homo sapiens
tttaacatatctgaacacacaatagc

SEQ ID NO: 31990 - DNA, 18 bp, Homo sapiens
ttaacatatctgaacaca

SEQ ID NO: 31991 - DNA, 19 bp, Homo sapiens
ttaacatatctgaacacac

SEQ ID NO: 31992 - DNA, 20 bp, Homo sapiens
ttaacatatctgaacacaca

SEQ ID NO: 31993 - DNA, 25 bp, Homo sapiens
ttaacatatctgaacacacaatagc

SEQ ID NO: 31994 - DNA, 26 bp, Homo sapiens
ttaacatatctgaacacacaatagct

SEQ ID NO: 31995 - DNA, 29 bp, Homo sapiens
ttaacatatctgaacacacaatagctaag

SEQ ID NO: 31996 - DNA, 17 bp, Homo sapiens
taacatatctgaacaca

SEQ ID NO: 31997 - DNA, 18 bp, Homo sapiens
taacatatctgaacacac

SEQ ID NO: 31998 - DNA, 19 bp, Homo sapiens
taacatatctgaacacaca

SEQ ID NO: 31999 - DNA, 21 bp, Homo sapiens
taacatatctgaacacacaat

SEQ ID NO: 32000 - DNA, 24 bp, Homo sapiens
taacatatctgaacacacaatagc

SEQ ID NO: 32001 - DNA, 30 bp, Homo sapiens
taacatatctgaacacacaatagctaagac

SEQ ID NO: 32002 - DNA, 16 bp, Homo sapiens
aacatatctgaacaca

SEQ ID NO: 32003 - DNA, 17 bp, Homo sapiens
aacatatctgaacacac

SEQ ID NO: 32004 - DNA, 18 bp, Homo sapiens
aacatatctgaacacaca

SEQ ID NO: 32005 - DNA, 20 bp, Homo sapiens
aacatatctgaacacacaat

SEQ ID NO: 32006 - DNA, 21 bp, Homo sapiens
aacatatctgaacacacaata

SEQ ID NO: 32007 - DNA, 22 bp, Homo sapiens
aacatatctgaacacacaatag

SEQ ID NO: 32008 - DNA, 23 bp, Homo sapiens
aacatatctgaacacacaatagc

SEQ ID NO: 32009 - DNA, 24 bp, Homo sapiens
aacatatctgaacacacaatagct

SEQ ID NO: 32010 - DNA, 26 bp, Homo sapiens
aacatatctgaacacacaatagctaa

SEQ ID NO: 32011 - DNA, 30 bp, Homo sapiens; identical to SEQ ID NO: 340

SEQ ID NO: 32012 - DNA, 16 bp, Homo sapiens
acatatctgaacacac

SEQ ID NO: 32013 - DNA, 17 bp, Homo sapiens
acatatctgaacacaca

SEQ ID NO: 32014 - DNA, 19 bp, Homo sapiens
acatatctgaacacacaat

SEQ ID NO: 32015 - DNA, 20 bp, Homo sapiens
acatatctgaacacacaata

SEQ ID NO: 32016 - DNA, 21 bp, Homo sapiens
acatatctgaacacacaatag

SEQ ID NO: 32017 - DNA, 22 bp, Homo sapiens
acatatctgaacacacaatagc

SEQ ID NO: 32018 - DNA, 23 bp, Homo sapiens
acatatctgaacacacaatagct

SEQ ID NO: 32019 - DNA, 29 bp, Homo sapiens
acatatctgaacacacaatagctaagacc

SEQ ID NO: 32020 - DNA, 30 bp, Homo sapiens; identical to SEQ ID NO: 347

SEQ ID NO: 32021 - DNA, 16 bp, Homo sapiens
catatctgaacacaca

SEQ ID NO: 32022 - DNA, 18 bp, Homo sapiens
catatctgaacacacaat

SEQ ID NO: 32023 - DNA, 19 bp, Homo sapiens
catatctgaacacacaata

SEQ ID NO: 32024 - DNA, 21 bp, Homo sapiens
catatctgaacacacaatagc

SEQ ID NO: 32025 - DNA, 22 bp, Homo sapiens
catatctgaacacacaatagct

SEQ ID NO: 32026 - DNA, 23 bp, Homo sapiens
catatctgaacacacaatagcta

SEQ ID NO: 32027 - DNA, 28 bp, Homo sapiens
catatctgaacacacaatagctaagacc

SEQ ID NO: 32028 - DNA, 29 bp, Homo sapiens
catatctgaacacacaatagctaagaccc

SEQ ID NO: 32029 - DNA, 20 bp, Homo sapiens
atatctgaacacacaatagc

SEQ ID NO: 32030 - DNA, 21 bp, Homo sapiens
atatctgaacacacaatagct

SEQ ID NO: 32031 - DNA, 22 bp, Homo sapiens
atatctgaacacacaatagcta

SEQ ID NO: 32032 - DNA, 23 bp, Homo sapiens
atatctgaacacacaatagctaa

SEQ ID NO: 32033 - DNA, 24 bp, Homo sapiens
atatctgaacacacaatagctaag

SEQ ID NO: 32034 - DNA, 26 bp, Homo sapiens
atatctgaacacacaatagctaagac

SEQ ID NO: 32035 - DNA, 27 bp, Homo sapiens
atatctgaacacacaatagctaagacc

SEQ ID NO: 32036 - DNA, 28 bp, Homo sapiens
atatctgaacacacaatagctaagaccc

SEQ ID NO: 32037 - DNA, 29 bp, Homo sapiens
atatctgaacacacaatagctaagaccca

SEQ ID NO: 32038 - DNA, 19 bp, Homo sapiens
tatctgaacacacaatagc

SEQ ID NO: 32039 - DNA, 20 bp, Homo sapiens
tatctgaacacacaatagct

SEQ ID NO: 32040 - DNA, 21 bp, Homo sapiens
tatctgaacacacaatagcta

SEQ ID NO: 32041 - DNA, 23 bp, Homo sapiens
tatctgaacacacaatagctaag

SEQ ID NO: 32042 - DNA, 24 bp, Homo sapiens
tatctgaacacacaatagctaaga

SEQ ID NO: 32043 - DNA, 25 bp, Homo sapiens
tatctgaacacacaatagctaagac

SEQ ID NO: 32044 - DNA, 26 bp, Homo sapiens
tatctgaacacacaatagctaagacc

SEQ ID NO: 32045 - DNA, 27 bp, Homo sapiens
tatctgaacacacaatagctaagaccc

SEQ ID NO: 32046 - DNA, 28 bp, Homo sapiens
tatctgaacacacaatagctaagaccca

SEQ ID NO: 32047 - DNA, 29 bp, Homo sapiens
tatctgaacacacaatagctaagacccaa

SEQ ID NO: 32048 - DNA, 19 bp, Homo sapiens
atctgaacacacaatagct

SEQ ID NO: 32049 - DNA, 22 bp, Homo sapiens
atctgaacacacaatagctaag

SEQ ID NO: 32050 - DNA, 25 bp, Homo sapiens
atctgaacacacaatagctaagacc

SEQ ID NO: 32051 - DNA, 26 bp, Homo sapiens
atctgaacacacaatagctaagaccc

SEQ ID NO: 32052 - DNA, 27 bp, Homo sapiens
atctgaacacacaatagctaagaccca

SEQ ID NO: 32053 - DNA, 30 bp, Homo sapiens
atctgaacacacaatagctaagacccaaac

SEQ ID NO: 32054 - DNA, 18 bp, Homo sapiens
tctgaacacacaatagct

SEQ ID NO: 32055 - DNA, 21 bp, Homo sapiens
tctgaacacacaatagctaag

SEQ ID NO: 32056 - DNA, 22 bp, Homo sapiens
tctgaacacacaatagctaaga

SEQ ID NO: 32057 - DNA, 23 bp, Homo sapiens
tctgaacacacaatagctaagac

SEQ ID NO: 32058 - DNA, 24 bp, Homo sapiens
tctgaacacacaatagctaagacc

SEQ ID NO: 32059 - DNA, 25 bp, Homo sapiens
tctgaacacacaatagctaagaccc

SEQ ID NO: 32060 - DNA, 26 bp, Homo sapiens
tctgaacacacaatagctaagaccca

SEQ ID NO: 32061 - DNA, 30 bp, Homo sapiens; identical to SEQ ID NO: 376

SEQ ID NO: 32062 - DNA, 23 bp, Homo sapiens
ctgaacacacaatagctaagacc

SEQ ID NO: 32063 - DNA, 24 bp, Homo sapiens
ctgaacacacaatagctaagaccc

SEQ ID NO: 32064 - DNA, 25 bp, Homo sapiens
ctgaacacacaatagctaagaccca

SEQ ID NO: 32065 - DNA, 23 bp, Homo sapiens
tgaacacacaatagctaagaccc

SEQ ID NO: 32066 - DNA, 21 bp, Homo sapiens
gaacacacaatagctaagacc

SEQ ID NO: 32067 - DNA, 22 bp, Homo sapiens
gaacacacaatagctaagaccc

SEQ ID NO: 32068 - DNA, 23 bp, Homo sapiens
gaacacacaatagctaagaccca

SEQ ID NO: 32069 - DNA, 17 bp, Homo sapiens
cacaatagctaagaccc

SEQ ID NO: 32070 - DNA, 22 bp, Homo sapiens
aatagctaagacccaaactggg

SEQ ID NO: 32071 - DNA, 23 bp, Homo sapiens
aatagctaagacccaaactggga

SEQ ID NO: 32072 - DNA, 19 bp, Homo sapiens
gctaagacccaaactggga

SEQ ID NO: 32073 - DNA, 18 bp, Homo sapiens
aaactgggattagatacc

SEQ ID NO: 32074 - DNA, 21 bp, Homo sapiens
gattagataccccactatgct

SEQ ID NO: 32075 - DNA, 22 bp, Homo sapiens
ccactatgcttagccctaaacc

SEQ ID NO: 32076 - DNA, 21 bp, Homo sapiens
cactatgcttagccctaaacc

SEQ ID NO: 32077 - DNA, 19 bp, Homo sapiens
ctatgcttagccctaaacc

SEQ ID NO: 32078 - DNA, 17 bp, Homo sapiens
atgcttagccctaaacc

SEQ ID NO: 32079 - DNA, 18 bp, Homo sapiens
atgcttagccctaaacct

SEQ ID NO: 32080 - DNA, 19 bp, Homo sapiens
atgcttagccctaaacctc

SEQ ID NO: 32081 - DNA, 16 bp, Homo sapiens
tgcttagccctaaacc

SEQ ID NO: 32082 - DNA, 17 bp, Homo sapiens
tgcttagccctaaacct

SEQ ID NO: 32083 - DNA, 21 bp, Homo sapiens
actgctcgccagaacactacg

SEQ ID NO: 32084 - DNA, 20 bp, Homo sapiens
ctgctcgccagaacactacg

SEQ ID NO: 32085 - DNA, 21 bp, Homo sapiens
ctgctcgccagaacactacga

SEQ ID NO: 32086 - DNA, 27 bp, Homo sapiens
ctgctcgccagaacactacgagccaca

SEQ ID NO: 32087 - DNA, 18 bp, Homo sapiens
gctcgccagaacactacg

SEQ ID NO: 32088 - DNA, 17 bp, Homo sapiens
ctcgccagaacactacg

SEQ ID NO: 32089 - DNA, 17 bp, Homo sapiens
gaacactacgagccaca

SEQ ID NO: 32090 - DNA, 20 bp, Homo sapiens
gaacactacgagccacagct

SEQ ID NO: 32091 - DNA, 19 bp, Homo sapiens
aactcaaaggacctggcgg

SEQ ID NO: 32092 - DNA, 25 bp, Homo sapiens
aactcaaaggacctggcggtgcttc

SEQ ID NO: 32093 - DNA, 20 bp, Homo sapiens
ctcaaaggacctggcggtgc

SEQ ID NO: 32094 - DNA, 21 bp, Homo sapiens
ctcaaaggacctggcggtgct

SEQ ID NO: 32095 - DNA, 16 bp, Homo sapiens
aaggacctggcggtgc

SEQ ID NO: 32096 - DNA, 17 bp, Homo sapiens
aaggacctggcggtgct

SEQ ID NO: 32097 - DNA, 20 bp, Homo sapiens
aaggacctggcggtgcttca

SEQ ID NO: 32098 - DNA, 22 bp, Homo sapiens
ctctagaggagcctgttctgta

SEQ ID NO: 32099 - DNA, 25 bp, Homo sapiens
ctctagaggagcctgttctgtaatc

SEQ ID NO: 32100 - DNA, 26 bp, Homo sapiens
ctctagaggagcctgttctgtaatcg

SEQ ID NO: 32101 - DNA, 21 bp, Homo sapiens
tctagaggagcctgttctgta

SEQ ID NO: 32102 - DNA, 25 bp, Homo sapiens
tctagaggagcctgttctgtaatcg

SEQ ID NO: 32103 - DNA, 16 bp, Homo sapiens
ctagaggagcctgttc

SEQ ID NO: 32104 - DNA, 17 bp, Homo sapiens
ctagaggagcctgttct

SEQ ID NO: 32105 - DNA, 19 bp, Homo sapiens
ctagaggagcctgttctgt

SEQ ID NO: 32106 - DNA, 20 bp, Homo sapiens
ctagaggagcctgttctgta

SEQ ID NO: 32107 - DNA, 23 bp, Homo sapiens
ctagaggagcctgttctgtaatc

SEQ ID NO: 32108 - DNA, 24 bp, Homo sapiens
ctagaggagcctgttctgtaatcg

SEQ ID NO: 32109 - DNA, 27 bp, Homo sapiens
ctagaggagcctgttctgtaatcgata

SEQ ID NO: 32110 - DNA, 17 bp, Homo sapiens
agaggagcctgttctgt

SEQ ID NO: 32111 - DNA, 19 bp, Homo sapiens
agaggagcctgttctgtaa

SEQ ID NO: 32112 - DNA, 22 bp, Homo sapiens
cctgttctgtaatcgataaacc

SEQ ID NO: 32113 - DNA, 17 bp, Homo sapiens
ctgttctgtaatcgata

SEQ ID NO: 32114 - DNA, 21 bp, Homo sapiens
ctgttctgtaatcgataaacc

SEQ ID NO: 32115 - DNA, 22 bp, Homo sapiens
ctgttctgtaatcgataaaccc

SEQ ID NO: 32116 - DNA, 23 bp, Homo sapiens
ctgttctgtaatcgataaacccc

SEQ ID NO: 32117 - DNA, 20 bp, Homo sapiens
tgttctgtaatcgataaacc

SEQ ID NO: 32118 - DNA, 21 bp, Homo sapiens
gttctgtaatcgataaacccc

SEQ ID NO: 32119 - DNA, 16 bp, Homo sapiens
ctgtaatcgataaacc

SEQ ID NO: 32120 - DNA, 17 bp, Homo sapiens
ctgtaatcgataaaccc

SEQ ID NO: 32121 - DNA, 18 bp, Homo sapiens
ctgtaatcgataaacccc

SEQ ID NO: 32122 - DNA, 19 bp, Homo sapiens
ctgtaatcgataaaccccg

SEQ ID NO: 32123 - DNA, 20 bp, Homo sapiens
ctgtaatcgataaaccccga

SEQ ID NO: 32124 - DNA, 21 bp, Homo sapiens
ctgtaatcgataaaccccgat

SEQ ID NO: 32125 - DNA, 22 bp, Homo sapiens
ctgtaatcgataaaccccgatc

SEQ ID NO: 32126 - DNA, 23 bp, Homo sapiens
ctgtaatcgataaaccccgatca

SEQ ID NO: 32127 - DNA, 26 bp, Homo sapiens
ctgtaatcgataaaccccgatcaacc

SEQ ID NO: 32128 - DNA, 17 bp, Homo sapiens
tgtaatcgataaacccc

SEQ ID NO: 32129 - DNA, 21 bp, Homo sapiens
tgtaatcgataaaccccgatc

SEQ ID NO: 32130 - DNA, 22 bp, Homo sapiens
tgtaatcgataaaccccgatca

SEQ ID NO: 32131 - DNA, 16 bp, Homo sapiens
gtaatcgataaacccc

SEQ ID NO: 32132 - DNA, 20 bp, Homo sapiens
gtaatcgataaaccccgatc

SEQ ID NO: 32133 - DNA, 18 bp, Homo sapiens
gataaaccccgatcaacc

SEQ ID NO: 32134 - DNA, 17 bp, Homo sapiens
ataaaccccgatcaacc

SEQ ID NO: 32135 - DNA, 18 bp, Homo sapiens
ccgatcaacctcaccacc

SEQ ID NO: 32136 - DNA, 21 bp, Homo sapiens
ccgatcaacctcaccacctct

SEQ ID NO: 32137 - DNA, 23 bp, Homo sapiens
ccgatcaacctcaccacctcttg

SEQ ID NO: 32138 - DNA, 17 bp, Homo sapiens
cgatcaacctcaccacc

SEQ ID NO: 32139 - DNA, 20 bp, Homo sapiens
cgatcaacctcaccacctct

SEQ ID NO: 32140 - DNA, 22 bp, Homo sapiens
cgatcaacctcaccacctcttg

SEQ ID NO: 32141 - DNA, 23 bp, Homo sapiens
cgatcaacctcaccacctcttgc

SEQ ID NO: 32142 - DNA, 24 bp, Homo sapiens
cgatcaacctcaccacctcttgct

SEQ ID NO: 32143 - DNA, 25 bp, Homo sapiens
cgatcaacctcaccacctcttgctc

SEQ ID NO: 32144 - DNA, 16 bp, Homo sapiens
gatcaacctcaccacc

SEQ ID NO: 32145 - DNA, 17 bp, Homo sapiens
gatcaacctcaccacct

SEQ ID NO: 32146 - DNA, 19 bp, Homo sapiens
gatcaacctcaccacctct

SEQ ID NO: 32147 - DNA, 20 bp, Homo sapiens
gatcaacctcaccacctctt

SEQ ID NO: 32148 - DNA, 21 bp, Homo sapiens
gatcaacctcaccacctcttg

SEQ ID NO: 32149 - DNA, 22 bp, Homo sapiens
gatcaacctcaccacctcttgc

SEQ ID NO: 32150 - DNA, 23 bp, Homo sapiens
gatcaacctcaccacctcttgct

SEQ ID NO: 32151 - DNA, 24 bp, Homo sapiens
gatcaacctcaccacctcttgctc

SEQ ID NO: 32152 - DNA, 25 bp, Homo sapiens
gatcaacctcaccacctcttgctca

SEQ ID NO: 32153 - DNA, 26 bp, Homo sapiens
gatcaacctcaccacctcttgctcag

SEQ ID NO: 32154 - DNA, 22 bp, Homo sapiens
atcaacctcaccacctcttgct

SEQ ID NO: 32155 - DNA, 20 bp, Homo sapiens
caacctcaccacctcttgct

SEQ ID NO: 32156 - DNA, 19 bp, Homo sapiens
aacctcaccacctcttgct

SEQ ID NO: 32157 - DNA, 24 bp, Homo sapiens
aacctcaccacctcttgctcagcc

SEQ ID NO: 32158 - DNA, 18 bp, Homo sapiens
acctcaccacctcttgct

SEQ ID NO: 32159 - DNA, 23 bp, Homo sapiens
acctcaccacctcttgctcagcc

SEQ ID NO: 32160 - DNA, 22 bp, Homo sapiens
cctcaccacctcttgctcagcc

SEQ ID NO: 32161 - DNA, 16 bp, Homo sapiens
ctcaccacctcttgct

SEQ ID NO: 32162 - DNA, 17 bp, Homo sapiens
ctcaccacctcttgctc

SEQ ID NO: 32163 - DNA, 18 bp, Homo sapiens
ctcaccacctcttgctca

SEQ ID NO: 32164 - DNA, 20 bp, Homo sapiens
ctcaccacctcttgctcagc

SEQ ID NO: 32165 - DNA, 21 bp, Homo sapiens
ctcaccacctcttgctcagcc

SEQ ID NO: 32166 - DNA, 16 bp, Homo sapiens
tcaccacctcttgctc

SEQ ID NO: 32167 - DNA, 17 bp, Homo sapiens
tcaccacctcttgctca

SEQ ID NO: 32168 - DNA, 19 bp, Homo sapiens
tcaccacctcttgctcagc

SEQ ID NO: 32169 - DNA, 20 bp, Homo sapiens
tcaccacctcttgctcagcc

SEQ ID NO: 32170 - DNA, 21 bp, Homo sapiens
tcaccacctcttgctcagcct

SEQ ID NO: 32171 - DNA, 16 bp, Homo sapiens
caccacctcttgctca

SEQ ID NO: 32172 - DNA, 18 bp, Homo sapiens
caccacctcttgctcagc

SEQ ID NO: 32173 - DNA, 19 bp, Homo sapiens
caccacctcttgctcagcc

SEQ ID NO: 32174 - DNA, 21 bp, Homo sapiens
ctcttgctcagcctatatacc

SEQ ID NO: 32175 - DNA, 17 bp, Homo sapiens
gccatcttcagcaaacc

SEQ ID NO: 32176 - DNA, 18 bp, Homo sapiens
gccatcttcagcaaaccc

SEQ ID NO: 32177 - DNA, 23 bp, Homo sapiens
gccatcttcagcaaaccctgatg

SEQ ID NO: 32178 - DNA, 17 bp, Homo sapiens
ccatcttcagcaaaccc

SEQ ID NO: 32179 - DNA, 22 bp, Homo sapiens
gatgaaggctacaaagtaagcg

SEQ ID NO: 32180 - DNA, 19 bp, Homo sapiens
gaaggctacaaagtaagcg

SEQ ID NO: 32181 - DNA, 21 bp, Homo sapiens
gaaggctacaaagtaagcgca

SEQ ID NO: 32182 - DNA, 18 bp, Homo sapiens
aaggctacaaagtaagcg

SEQ ID NO: 32183 - DNA, 19 bp, Homo sapiens
aaggctacaaagtaagcgc

SEQ ID NO: 32184 - DNA, 20 bp, Homo sapiens
aaggctacaaagtaagcgca

SEQ ID NO: 32185 - DNA, 26 bp, Homo sapiens
aaggctacaaagtaagcgcaagtacc

SEQ ID NO: 32186 - DNA, 16 bp, Homo sapiens
agcgcaagtacccacg

SEQ ID NO: 32187 - DNA, 22 bp, Homo sapiens
agtacccacgtaaagacgttag

SEQ ID NO: 32188 - DNA, 28 bp, Homo sapiens
cacgtaaagacgttaggtcaaggtgtag

SEQ ID NO: 32189 - DNA, 27 bp, Homo sapiens
acgtaaagacgttaggtcaaggtgtag

SEQ ID NO: 32190 - DNA, 21 bp, Homo sapiens
cgtaaagacgttaggtcaagg

SEQ ID NO: 32191 - DNA, 26 bp, Homo sapiens
cgtaaagacgttaggtcaaggtgtag

SEQ ID NO: 32192 - DNA, 27 bp, Homo sapiens
cgtaaagacgttaggtcaaggtgtagc

SEQ ID NO: 32193 - DNA, 28 bp, Homo sapiens
cgtaaagacgttaggtcaaggtgtagcc

SEQ ID NO: 32194 - DNA, 25 bp, Homo sapiens
gtaaagacgttaggtcaaggtgtag

SEQ ID NO: 32195 - DNA, 24 bp, Homo sapiens
taaagacgttaggtcaaggtgtag

SEQ ID NO: 32196 - DNA, 23 bp, Homo sapiens
aaagacgttaggtcaaggtgtag

SEQ ID NO: 32197 - DNA, 22 bp, Homo sapiens
aagacgttaggtcaaggtgtag

SEQ ID NO: 32198 - DNA, 21 bp, Homo sapiens
agacgttaggtcaaggtgtag

SEQ ID NO: 32199 - DNA, 20 bp, Homo sapiens
gacgttaggtcaaggtgtag

SEQ ID NO: 32200 - DNA, 22 bp, Homo sapiens
gacgttaggtcaaggtgtagcc

SEQ ID NO: 32201 - DNA, 23 bp, Homo sapiens
gacgttaggtcaaggtgtagccc

SEQ ID NO: 32202 - DNA, 18 bp, Homo sapiens
acgttaggtcaaggtgta

SEQ ID NO: 32203 - DNA, 19 bp, Homo sapiens
acgttaggtcaaggtgtag

SEQ ID NO: 32204 - DNA, 20 bp, Homo sapiens
acgttaggtcaaggtgtagc

SEQ ID NO: 32205 - DNA, 21 bp, Homo sapiens
acgttaggtcaaggtgtagcc

SEQ ID NO: 32206 - DNA, 22 bp, Homo sapiens
acgttaggtcaaggtgtagccc

SEQ ID NO: 32207 - DNA, 26 bp, Homo sapiens
acgttaggtcaaggtgtagcccatga

SEQ ID NO: 32208 - DNA, 18 bp, Homo sapiens
cgttaggtcaaggtgtag

SEQ ID NO: 32209 - DNA, 19 bp, Homo sapiens
cgttaggtcaaggtgtagc

SEQ ID NO: 32210 - DNA, 20 bp, Homo sapiens
cgttaggtcaaggtgtagcc

SEQ ID NO: 32211 - DNA, 21 bp, Homo sapiens
cgttaggtcaaggtgtagccc

SEQ ID NO: 32212 - DNA, 16 bp, Homo sapiens
gttaggtcaaggtgta

SEQ ID NO: 32213 - DNA, 17 bp, Homo sapiens
gttaggtcaaggtgtag

SEQ ID NO: 32214 - DNA, 18 bp, Homo sapiens
gttaggtcaaggtgtagc

SEQ ID NO: 32215 - DNA, 19 bp, Homo sapiens
gttaggtcaaggtgtagcc

SEQ ID NO: 32216 - DNA, 20 bp, Homo sapiens
gttaggtcaaggtgtagccc

SEQ ID NO: 32217 - DNA, 21 bp, Homo sapiens
gttaggtcaaggtgtagccca

SEQ ID NO: 32218 - DNA, 22 bp, Homo sapiens
gttaggtcaaggtgtagcccat

SEQ ID NO: 32219 - DNA, 23 bp, Homo sapiens
gttaggtcaaggtgtagcccatg

SEQ ID NO: 32220 - DNA, 24 bp, Homo sapiens
gttaggtcaaggtgtagcccatga

SEQ ID NO: 32221 - DNA, 27 bp, Homo sapiens
gttaggtcaaggtgtagcccatgaggt

SEQ ID NO: 32222 - DNA, 30 bp, Homo sapiens; identical to SEQ ID NO: 8370

SEQ ID NO: 32223 - DNA, 16 bp, Homo sapiens
ttaggtcaaggtgtag

SEQ ID NO: 32224 - DNA, 17 bp, Homo sapiens
ttaggtcaaggtgtagc

SEQ ID NO: 32225 - DNA, 18 bp, Homo sapiens
ttaggtcaaggtgtagcc

SEQ ID NO: 32226 - DNA, 19 bp, Homo sapiens
ttaggtcaaggtgtagccc

SEQ ID NO: 32227 - DNA, 20 bp, Homo sapiens
ttaggtcaaggtgtagccca

SEQ ID NO: 32228 - DNA, 23 bp, Homo sapiens
ttaggtcaaggtgtagcccatga

SEQ ID NO: 32229 - DNA, 26 bp, Homo sapiens
ttaggtcaaggtgtagcccatgaggt

SEQ ID NO: 32230 - DNA, 29 bp, Homo sapiens
ttaggtcaaggtgtagcccatgaggtggc

SEQ ID NO: 32231 - DNA, 16 bp, Homo sapiens
taggtcaaggtgtagc

SEQ ID NO: 32232 - DNA, 17 bp, Homo sapiens
taggtcaaggtgtagcc

SEQ ID NO: 32233 - DNA, 22 bp, Homo sapiens
taggtcaaggtgtagcccatga

SEQ ID NO: 32234 - DNA, 28 bp, Homo sapiens
taggtcaaggtgtagcccatgaggtggc

SEQ ID NO: 32235 - DNA, 16 bp, Homo sapiens
aggtcaaggtgtagcc

SEQ ID NO: 32236 - DNA, 21 bp, Homo sapiens
aggtcaaggtgtagcccatga

SEQ ID NO: 32237 - DNA, 16 bp, Homo sapiens
ggtcaaggtgtagccc

SEQ ID NO: 32238 - DNA, 22 bp, Homo sapiens
ggtcaaggtgtagcccatgagg

SEQ ID NO: 32239 - DNA, 23 bp, Homo sapiens
ggtcaaggtgtagcccatgaggt

SEQ ID NO: 32240 - DNA, 17 bp, Homo sapiens
aaggtgtagcccatgag

SEQ ID NO: 32241 - DNA, 18 bp, Homo sapiens
aaggtgtagcccatgagg

SEQ ID NO: 32242 - DNA, 19 bp, Homo sapiens
aaggtgtagcccatgaggt

SEQ ID NO: 32243 - DNA, 20 bp, Homo sapiens
aaggtgtagcccatgaggtg

SEQ ID NO: 32244 - DNA, 21 bp, Homo sapiens
aaggtgtagcccatgaggtgg

SEQ ID NO: 32245 - DNA, 22 bp, Homo sapiens
aaggtgtagcccatgaggtggc

SEQ ID NO: 32246 - DNA, 23 bp, Homo sapiens
aaggtgtagcccatgaggtggca

SEQ ID NO: 32247 - DNA, 24 bp, Homo sapiens
aaggtgtagcccatgaggtggcaa

SEQ ID NO: 32248 - DNA, 25 bp, Homo sapiens
aaggtgtagcccatgaggtggcaag

SEQ ID NO: 32249 - DNA, 16 bp, Homo sapiens
aggtgtagcccatgag

SEQ ID NO: 32250 - DNA, 17 bp, Homo sapiens
aggtgtagcccatgagg

SEQ ID NO: 32251 - DNA, 18 bp, Homo sapiens
aggtgtagcccatgaggt

SEQ ID NO: 32252 - DNA, 19 bp, Homo sapiens
aggtgtagcccatgaggtg

SEQ ID NO: 32253 - DNA, 21 bp, Homo sapiens
aggtgtagcccatgaggtggc

SEQ ID NO: 32254 - DNA, 22 bp, Homo sapiens
aggtgtagcccatgaggtggca

SEQ ID NO: 32255 - DNA, 24 bp, Homo sapiens
aggtgtagcccatgaggtggcaag

SEQ ID NO: 32256 - DNA, 20 bp, Homo sapiens
ggtgtagcccatgaggtggc

SEQ ID NO: 32257 - DNA, 21 bp, Homo sapiens
ggtgtagcccatgaggtggca

SEQ ID NO: 32258 - DNA, 20 bp, Homo sapiens
gtgtagcccatgaggtggca

SEQ ID NO: 32259 - DNA, 22 bp, Homo sapiens
catgaggtggcaagaaatgggc

SEQ ID NO: 32260 - DNA, 21 bp, Homo sapiens
atgaggtggcaagaaatgggc

SEQ ID NO: 32261 - DNA, 17 bp, Homo sapiens
gaggtggcaagaaatgg

SEQ ID NO: 32262 - DNA, 19 bp, Homo sapiens
gaggtggcaagaaatgggc

SEQ ID NO: 32263 - DNA, 23 bp, Homo sapiens
gaggtggcaagaaatgggctaca

SEQ ID NO: 32264 - DNA, 22 bp, Homo sapiens
gaaatgggctacattttctacc

SEQ ID NO: 32265 - DNA, 21 bp, Homo sapiens
aaatgggctacattttctacc

SEQ ID NO: 32266 - DNA, 20 bp, Homo sapiens
aatgggctacattttctacc

SEQ ID NO: 32267 - DNA, 19 bp, Homo sapiens
atgggctacattttctacc

SEQ ID NO: 32268 - DNA, 19 bp, Homo sapiens
ggctacattttctacccca

SEQ ID NO: 32269 - DNA, 20 bp, Homo sapiens
ggctacattttctaccccag

SEQ ID NO: 32270 - DNA, 17 bp, Homo sapiens
gctacattttctacccc

SEQ ID NO: 32271 - DNA, 16 bp, Homo sapiens
ttctaccccagaaaac

SEQ ID NO: 32272 - DNA, 17 bp, Homo sapiens
tatcgtagttttctggg

SEQ ID NO: 32273 - DNA, 22 bp, Homo sapiens
cagaaaactacgatagccctta

SEQ ID NO: 32274 - DNA, 24 bp, Homo sapiens
cagaaaactacgatagcccttatg

SEQ ID NO: 32275 - DNA, 21 bp, Homo sapiens
agaaaactacgatagccctta

SEQ ID NO: 32276 - DNA, 23 bp, Homo sapiens
agaaaactacgatagcccttatg

SEQ ID NO: 32277 - DNA, 20 bp, Homo sapiens
gaaaactacgatagccctta

SEQ ID NO: 32278 - DNA, 22 bp, Homo sapiens
gaaaactacgatagcccttatg

SEQ ID NO: 32279 - DNA, 23 bp, Homo sapiens
gaaaactacgatagcccttatga

SEQ ID NO: 32280 - DNA, 19 bp, Homo sapiens
cttatgaaacttaagggtc

SEQ ID NO: 32281 - DNA, 20 bp, Homo sapiens
tgaaacttaagggtcgaagg

SEQ ID NO: 32282 - DNA, 19 bp, Homo sapiens
gaaacttaagggtcgaagg

SEQ ID NO: 32283 - DNA, 18 bp, Homo sapiens
aaacttaagggtcgaagg

SEQ ID NO: 32284 - DNA, 27 bp, Homo sapiens
aaacttaagggtcgaaggtggatttag

SEQ ID NO: 32285 - DNA, 20 bp, Homo sapiens
aacttaagggtcgaaggtgg

SEQ ID NO: 32286 - DNA, 21 bp, Homo sapiens
aacttaagggtcgaaggtgga

SEQ ID NO: 32287 - DNA, 26 bp, Homo sapiens
aacttaagggtcgaaggtggatttag

SEQ ID NO: 32288 - DNA, 25 bp, Homo sapiens
acttaagggtcgaaggtggatttag

SEQ ID NO: 32289 - DNA, 27 bp, Homo sapiens
acttaagggtcgaaggtggatttagca

SEQ ID NO: 32290 - DNA, 24 bp, Homo sapiens
cttaagggtcgaaggtggatttag

SEQ ID NO: 32291 - DNA, 26 bp, Homo sapiens
cttaagggtcgaaggtggatttagca

SEQ ID NO: 32292 - DNA, 16 bp, Homo sapiens
ttaagggtcgaaggtg

SEQ ID NO: 32293 - DNA, 23 bp, Homo sapiens
ttaagggtcgaaggtggatttag

SEQ ID NO: 32294 - DNA, 24 bp, Homo sapiens
ttaagggtcgaaggtggatttagc

SEQ ID NO: 32295 - DNA, 25 bp, Homo sapiens
ttaagggtcgaaggtggatttagca

SEQ ID NO: 32296 - DNA, 26 bp, Homo sapiens
ttaagggtcgaaggtggatttagcag

SEQ ID NO: 32297 - DNA, 29 bp, Homo sapiens
ttaagggtcgaaggtggatttagcagtaa

SEQ ID NO: 32298 - DNA, 17 bp, Homo sapiens
taagggtcgaaggtgga

SEQ ID NO: 32299 - DNA, 20 bp, Homo sapiens
taagggtcgaaggtggattt

SEQ ID NO: 32300 - DNA, 22 bp, Homo sapiens
taagggtcgaaggtggatttag

SEQ ID NO: 32301 - DNA, 23 bp, Homo sapiens
taagggtcgaaggtggatttagc

SEQ ID NO: 32302 - DNA, 24 bp, Homo sapiens
taagggtcgaaggtggatttagca

SEQ ID NO: 32303 - DNA, 25 bp, Homo sapiens
taagggtcgaaggtggatttagcag

SEQ ID NO: 32304 - DNA, 27 bp, Homo sapiens
taagggtcgaaggtggatttagcagta

SEQ ID NO: 32305 - DNA, 30 bp, Homo sapiens
taagggtcgaaggtggatttagcagtaaac

SEQ ID NO: 32306 - DNA, 21 bp, Homo sapiens
aagggtcgaaggtggatttag

SEQ ID NO: 32307 - DNA, 22 bp, Homo sapiens
aagggtcgaaggtggatttagc

SEQ ID NO: 32308 - DNA, 23 bp, Homo sapiens
aagggtcgaaggtggatttagca

SEQ ID NO: 32309 - DNA, 24 bp, Homo sapiens
aagggtcgaaggtggatttagcag

SEQ ID NO: 32310 - DNA, 26 bp, Homo sapiens
aagggtcgaaggtggatttagcagta

SEQ ID NO: 32311 - DNA, 30 bp, Homo sapiens
aagggtcgaaggtggatttagcagtaaact

SEQ ID NO: 32312 - DNA, 20 bp, Homo sapiens
agggtcgaaggtggatttag

SEQ ID NO: 32313 - DNA, 22 bp, Homo sapiens
agggtcgaaggtggatttagca

SEQ ID NO: 32314 - DNA, 18 bp, Homo sapiens
ggtcgaaggtggatttag

SEQ ID NO: 32315 - DNA, 20 bp, Homo sapiens
ggtcgaaggtggatttagca

SEQ ID NO: 32316 - DNA, 23 bp, Homo sapiens
ggtcgaaggtggatttagcagta

SEQ ID NO: 32317 - DNA, 18 bp, Homo sapiens
aaggtggatttagcagta

SEQ ID NO: 32318 - DNA, 26 bp, Homo sapiens
taagagtagagtgcttagttgaacag

SEQ ID NO: 32319 - DNA, 24 bp, Homo sapiens
agagtagagtgcttagttgaacag

SEQ ID NO: 32320 - DNA, 28 bp, Homo sapiens
agagtagagtgcttagttgaacagggcc

SEQ ID NO: 32321 - DNA, 23 bp, Homo sapiens
gagtagagtgcttagttgaacag

SEQ ID NO: 32322 - DNA, 27 bp, Homo sapiens
gagtagagtgcttagttgaacagggcc

SEQ ID NO: 32323 - DNA, 21 bp, Homo sapiens
agtagagtgcttagttgaaca

SEQ ID NO: 32324 - DNA, 22 bp, Homo sapiens
agtagagtgcttagttgaacag

SEQ ID NO: 32325 - DNA, 25 bp, Homo sapiens
agtagagtgcttagttgaacagggc

SEQ ID NO: 32326 - DNA, 26 bp, Homo sapiens
agtagagtgcttagttgaacagggcc

SEQ ID NO: 32327 - DNA, 27 bp, Homo sapiens
agtagagtgcttagttgaacagggccc

SEQ ID NO: 32328 - DNA, 20 bp, Homo sapiens
gtagagtgcttagttgaaca

SEQ ID NO: 32329 - DNA, 21 bp, Homo sapiens
gtagagtgcttagttgaacag

SEQ ID NO: 32330 - DNA, 24 bp, Homo sapiens
gtagagtgcttagttgaacagggc

SEQ ID NO: 32331 - DNA, 25 bp, Homo sapiens
gtagagtgcttagttgaacagggcc

SEQ ID NO: 32332 - DNA, 26 bp, Homo sapiens
gtagagtgcttagttgaacagggccc

SEQ ID NO: 32333 - DNA, 29 bp, Homo sapiens
gtagagtgcttagttgaacagggccctga

SEQ ID NO: 32334 - DNA, 20 bp, Homo sapiens
tagagtgcttagttgaacag

SEQ ID NO: 32335 - DNA, 22 bp, Homo sapiens
gagtgcttagttgaacagggcc

SEQ ID NO: 32336 - DNA, 23 bp, Homo sapiens
gagtgcttagttgaacagggccc

SEQ ID NO: 32337 - DNA, 24 bp, Homo sapiens
gtgcttagttgaacagggccctga

SEQ ID NO: 32338 - DNA, 23 bp, Homo sapiens
tgcttagttgaacagggccctga

SEQ ID NO: 32339 - DNA, 25 bp, Homo sapiens
tgcttagttgaacagggccctgaag

SEQ ID NO: 32340 - DNA, 26 bp, Homo sapiens
tgcttagttgaacagggccctgaagc

SEQ ID NO: 32341 - DNA, 18 bp, Homo sapiens
gcttagttgaacagggcc

SEQ ID NO: 32342 - DNA, 22 bp, Homo sapiens
gcttagttgaacagggccctga

SEQ ID NO: 32343 - DNA, 25 bp, Homo sapiens
gcttagttgaacagggccctgaagc

SEQ ID NO: 32344 - DNA, 16 bp, Homo sapiens
cttagttgaacagggc

SEQ ID NO: 32345 - DNA, 17 bp, Homo sapiens
cttagttgaacagggcc

SEQ ID NO: 32346 - DNA, 18 bp, Homo sapiens
cttagttgaacagggccc

SEQ ID NO: 32347 - DNA, 19 bp, Homo sapiens
cttagttgaacagggccct

SEQ ID NO: 32348 - DNA, 20 bp, Homo sapiens
cttagttgaacagggccctg

SEQ ID NO: 32349 - DNA, 21 bp, Homo sapiens
cttagttgaacagggccctga

SEQ ID NO: 32350 - DNA, 22 bp, Homo sapiens
cttagttgaacagggccctgaa

SEQ ID NO: 32351 - DNA, 23 bp, Homo sapiens
cttagttgaacagggccctgaag

SEQ ID NO: 32352 - DNA, 24 bp, Homo sapiens
cttagttgaacagggccctgaagc

SEQ ID NO: 32353 - DNA, 25 bp, Homo sapiens
cttagttgaacagggccctgaagcg

SEQ ID NO: 32354 - DNA, 26 bp, Homo sapiens
cttagttgaacagggccctgaagcgc

SEQ ID NO: 32355 - DNA, 27 bp, Homo sapiens
cttagttgaacagggccctgaagcgcg

SEQ ID NO: 32356 - DNA, 16 bp, Homo sapiens
ttagttgaacagggcc

SEQ ID NO: 32357 - DNA, 17 bp, Homo sapiens
ttagttgaacagggccc

SEQ ID NO: 32358 - DNA, 19 bp, Homo sapiens
ttagttgaacagggccctg

SEQ ID NO: 32359 - DNA, 20 bp, Homo sapiens
ttagttgaacagggccctga

SEQ ID NO: 32360 - DNA, 21 bp, Homo sapiens
ttagttgaacagggccctgaa

SEQ ID NO: 32361 - DNA, 22 bp, Homo sapiens
ttagttgaacagggccctgaag

SEQ ID NO: 32362 - DNA, 23 bp, Homo sapiens
ttagttgaacagggccctgaagc

SEQ ID NO: 32363 - DNA, 24 bp, Homo sapiens
ttagttgaacagggccctgaagcg

SEQ ID NO: 32364 - DNA, 25 bp, Homo sapiens
ttagttgaacagggccctgaagcgc

SEQ ID NO: 32365 - DNA, 26 bp, Homo sapiens
ttagttgaacagggccctgaagcgcg

SEQ ID NO: 32366 - DNA, 18 bp, Homo sapiens
tagttgaacagggccctg

SEQ ID NO: 32367 - DNA, 19 bp, Homo sapiens
tagttgaacagggccctga

SEQ ID NO: 32368 - DNA, 20 bp, Homo sapiens
tagttgaacagggccctgaa

SEQ ID NO: 32369 - DNA, 21 bp, Homo sapiens
tagttgaacagggccctgaag

SEQ ID NO: 32370 - DNA, 22 bp, Homo sapiens
tagttgaacagggccctgaagc

SEQ ID NO: 32371 - DNA, 23 bp, Homo sapiens
tagttgaacagggccctgaagcg

SEQ ID NO: 32372 - DNA, 25 bp, Homo sapiens
tagttgaacagggccctgaagcgcg

SEQ ID NO: 32373 - DNA, 21 bp, Homo sapiens
gttgaacagggccctgaagcg

SEQ ID NO: 32374 - DNA, 23 bp, Homo sapiens
gttgaacagggccctgaagcgcg

SEQ ID NO: 32375 - DNA, 18 bp, Homo sapiens
gaacagggccctgaagcg

SEQ ID NO: 32376 - DNA, 22 bp, Homo sapiens
gaacagggccctgaagcgcgta

SEQ ID NO: 32377 - DNA, 23 bp, Homo sapiens
gcgcgtacacaccgcccgtcacc

SEQ ID NO: 32378 - DNA, 22 bp, Homo sapiens
cgcgtacacaccgcccgtcacc

SEQ ID NO: 32379 - DNA, 20 bp, Homo sapiens
cgtacacaccgcccgtcacc

SEQ ID NO: 32380 - DNA, 21 bp, Homo sapiens
ctcctcaagtatacttcaaag

SEQ ID NO: 32381 - DNA, 22 bp, Homo sapiens
ctcaagtatacttcaaaggaca

SEQ ID NO: 32382 - DNA, 23 bp, Homo sapiens
tcaaaggacatttaactaaaacc

SEQ ID NO: 32383 - DNA, 30 bp, Homo sapiens
tcaaaggacatttaactaaaacccctacgc

SEQ ID NO: 32384 - DNA, 20 bp, Homo sapiens
aaggacatttaactaaaacc

SEQ ID NO: 32385 - DNA, 21 bp, Homo sapiens
aaggacatttaactaaaaccc

SEQ ID NO: 32386 - DNA, 18 bp, Homo sapiens
ggacatttaactaaaacc

SEQ ID NO: 32387 - DNA, 18 bp, Homo sapiens
gacatttaactaaaaccc

SEQ ID NO: 32388 - DNA, 19 bp, Homo sapiens
gacatttaactaaaacccc

SEQ ID NO: 32389 - DNA, 20 bp, Homo sapiens
gacatttaactaaaacccct

SEQ ID NO: 32390 - DNA, 23 bp, Homo sapiens
gacatttaactaaaacccctacg

SEQ ID NO: 32391 - DNA, 24 bp, Homo sapiens
cctacgcatttatatagaggagac

SEQ ID NO: 32392 - DNA, 25 bp, Homo sapiens
cctacgcatttatatagaggagaca

SEQ ID NO: 32393 - DNA, 30 bp, Homo sapiens; identical to SEQ ID NO: 8658

SEQ ID NO: 32394 - DNA, 19 bp, Homo sapiens
catttatatagaggagaca

SEQ ID NO: 32395 - DNA, 17 bp, Homo sapiens
tttatatagaggagaca

SEQ ID NO: 32396 - DNA, 22 bp, Homo sapiens
ggtaagtgtactggaaagtgca

SEQ ID NO: 32397 - DNA, 25 bp, Homo sapiens
gtgtactggaaagtgcacttggacg

SEQ ID NO: 32398 - DNA, 20 bp, Homo sapiens
tactggaaagtgcacttgga

SEQ ID NO: 32399 - DNA, 21 bp, Homo sapiens
actggaaagtgcacttggacg

SEQ ID NO: 32400 - DNA, 24 bp, Homo sapiens
actggaaagtgcacttggacgaac

SEQ ID NO: 32401 - DNA, 18 bp, Homo sapiens
ctggaaagtgcacttgga

SEQ ID NO: 32402 - DNA, 19 bp, Homo sapiens
ctggaaagtgcacttggac

SEQ ID NO: 32403 - DNA, 20 bp, Homo sapiens
ctggaaagtgcacttggacg

SEQ ID NO: 32404 - DNA, 21 bp, Homo sapiens
ctggaaagtgcacttggacga

SEQ ID NO: 32405 - DNA, 22 bp, Homo sapiens
ctggaaagtgcacttggacgaa

SEQ ID NO: 32406 - DNA, 23 bp, Homo sapiens
ctggaaagtgcacttggacgaac

SEQ ID NO: 32407 - DNA, 17 bp, Homo sapiens
tggaaagtgcacttgga

SEQ ID NO: 32408 - DNA, 22 bp, Homo sapiens
tggaaagtgcacttggacgaac

SEQ ID NO: 32409 - DNA, 18 bp, Homo sapiens
ggaaagtgcacttggacg

SEQ ID NO: 32410 - DNA, 21 bp, Homo sapiens
ggaaagtgcacttggacgaac

SEQ ID NO: 32411 - DNA, 22 bp, Homo sapiens
gctctgagctaaacctagcccc

SEQ ID NO: 32412 - DNA, 21 bp, Homo sapiens
ctctgagctaaacctagcccc

SEQ ID NO: 32413 - DNA, 16 bp, Homo sapiens
gctaaacctagcccca

SEQ ID NO: 32414 - DNA, 17 bp, Homo sapiens
gctaaacctagccccaa

SEQ ID NO: 32415 - DNA, 18 bp, Homo sapiens
gctaaacctagccccaaa

SEQ ID NO: 32416 - DNA, 19 bp, Homo sapiens
gctaaacctagccccaaac

SEQ ID NO: 32417 - DNA, 20 bp, Homo sapiens
gctaaacctagccccaaacc

SEQ ID NO: 32418 - DNA, 21 bp, Homo sapiens
gctaaacctagccccaaaccc

SEQ ID NO: 32419 - DNA, 22 bp, Homo sapiens
gctaaacctagccccaaaccca

SEQ ID NO: 32420 - DNA, 23 bp, Homo sapiens
gctaaacctagccccaaacccac

SEQ ID NO: 32421 - DNA, 24 bp, Homo sapiens
gctaaacctagccccaaacccact

SEQ ID NO: 32422 - DNA, 25 bp, Homo sapiens
gctaaacctagccccaaacccactc

SEQ ID NO: 32423 - DNA, 26 bp, Homo sapiens
gctaaacctagccccaaacccactcc

SEQ ID NO: 32424 - DNA, 27 bp, Homo sapiens
gctaaacctagccccaaacccactcca

SEQ ID NO: 32425 - DNA, 28 bp, Homo sapiens
gctaaacctagccccaaacccactccac

SEQ ID NO: 32426 - DNA, 29 bp, Homo sapiens
gctaaacctagccccaaacccactccacc

SEQ ID NO: 32427 - DNA, 30 bp, Homo sapiens; identical to SEQ ID NO: 832

SEQ ID NO: 32428 - DNA, 19 bp, Homo sapiens
ctaaacctagccccaaacc

SEQ ID NO: 32429 - DNA, 16 bp, Homo sapiens
acctagccccaaaccc

SEQ ID NO: 32430 - DNA, 19 bp, Homo sapiens
acctagccccaaacccact

SEQ ID NO: 32431 - DNA, 22 bp, Homo sapiens
aaacccactccaccttactacc

SEQ ID NO: 32432 - DNA, 17 bp, Homo sapiens
cactccaccttactacc

SEQ ID NO: 32433 - DNA, 24 bp, Homo sapiens
actccaccttactaccagacaacc

SEQ ID NO: 32434 - DNA, 23 bp, Homo sapiens
ctccaccttactaccagacaacc

SEQ ID NO: 32435 - DNA, 20 bp, Homo sapiens
caccttactaccagacaacc

SEQ ID NO: 32436 - DNA, 26 bp, Homo sapiens
caccttactaccagacaaccttagcc

SEQ ID NO: 32437 - DNA, 25 bp, Homo sapiens
accttactaccagacaaccttagcc

SEQ ID NO: 32438 - DNA, 18 bp, Homo sapiens
ccttactaccagacaacc

SEQ ID NO: 32439 - DNA, 24 bp, Homo sapiens
ccttactaccagacaaccttagcc

SEQ ID NO: 32440 - DNA, 16 bp, Homo sapiens
ttactaccagacaacc

SEQ ID NO: 32441 - DNA, 20 bp, Homo sapiens
ttactaccagacaaccttag

SEQ ID NO: 32442 - DNA, 22 bp, Homo sapiens
ttactaccagacaaccttagcc

SEQ ID NO: 32443 - DNA, 23 bp, Homo sapiens
ttactaccagacaaccttagcca

SEQ ID NO: 32444 - DNA, 27 bp, Homo sapiens
ttactaccagacaaccttagccaaacc

SEQ ID NO: 32445 - DNA, 21 bp, Homo sapiens
tactaccagacaaccttagcc

SEQ ID NO: 32446 - DNA, 26 bp, Homo sapiens
tactaccagacaaccttagccaaacc

SEQ ID NO: 32447 - DNA, 18 bp, Homo sapiens
actaccagacaaccttag

SEQ ID NO: 32448 - DNA, 24 bp, Homo sapiens
ctaccagacaaccttagccaaacc

SEQ ID NO: 32449 - DNA, 19 bp, Homo sapiens
agacaaccttagccaaacc

SEQ ID NO: 32450 - DNA, 18 bp, Homo sapiens
gacaaccttagccaaacc

SEQ ID NO: 32451 - DNA, 18 bp, Homo sapiens
ttagccaaaccatttacc

SEQ ID NO: 32452 - DNA, 19 bp, Homo sapiens
ttagccaaaccatttaccc

SEQ ID NO: 32453 - DNA, 20 bp, Homo sapiens
ttagccaaaccatttaccca

SEQ ID NO: 32454 - DNA, 22 bp, Homo sapiens
ataggcgatagaaattgaaacc

SEQ ID NO: 32455 - DNA, 23 bp, Homo sapiens
ataggcgatagaaattgaaacct

SEQ ID NO: 32456 - DNA, 22 bp, Homo sapiens
ttctgcataatgaattaactag

SEQ ID NO: 32457 - DNA, 22 bp, Homo sapiens
aaggagagccaaagctaagacc

SEQ ID NO: 32458 - DNA, 23 bp, Homo sapiens
aaggagagccaaagctaagaccc

SEQ ID NO: 32459 - DNA, 22 bp, Homo sapiens
aggagagccaaagctaagaccc

SEQ ID NO: 32460 - DNA, 23 bp, Homo sapiens
aggagagccaaagctaagacccc

SEQ ID NO: 32461 - DNA, 20 bp, Homo sapiens
gagagccaaagctaagaccc

SEQ ID NO: 32462 - DNA, 21 bp, Homo sapiens
gagagccaaagctaagacccc

SEQ ID NO: 32463 - DNA, 22 bp, Homo sapiens
gagagccaaagctaagaccccc

SEQ ID NO: 32464 - DNA, 19 bp, Homo sapiens
ctaagacccccgaaaccag

SEQ ID NO: 32465 - DNA, 29 bp, Homo sapiens
acccccgaaaccagacgagctacctaaga

SEQ ID NO: 32466 - DNA, 30 bp, Homo sapiens
cccccgaaaccagacgagctacctaagaac

SEQ ID NO: 32467 - DNA, 29 bp, Homo sapiens
ccccgaaaccagacgagctacctaagaac

SEQ ID NO: 32468 - DNA, 27 bp, Homo sapiens
ccgaaaccagacgagctacctaagaac

SEQ ID NO: 32469 - DNA, 23 bp, Homo sapiens
cgaaaccagacgagctacctaag

SEQ ID NO: 32470 - DNA, 26 bp, Homo sapiens
cgaaaccagacgagctacctaagaac

SEQ ID NO: 32471 - DNA, 27 bp, Homo sapiens
cgaaaccagacgagctacctaagaaca

SEQ ID NO: 32472 - DNA, 29 bp, Homo sapiens
gaaaccagacgagctacctaagaacagct

SEQ ID NO: 32473 - DNA, 29 bp, Homo sapiens
aaaccagacgagctacctaagaacagcta

SEQ ID NO: 32474 - DNA, 24 bp, Homo sapiens
gacgagctacctaagaacagctaa

SEQ ID NO: 32475 - DNA, 21 bp, Homo sapiens
cgagctacctaagaacagcta

SEQ ID NO: 32476 - DNA, 22 bp, Homo sapiens
cgagctacctaagaacagctaa

SEQ ID NO: 32477 - DNA, 21 bp, Homo sapiens
gagctacctaagaacagctaa

SEQ ID NO: 32478 - DNA, 22 bp, Homo sapiens
gagctacctaagaacagctaaa

SEQ ID NO: 32479 - DNA, 18 bp, Homo sapiens
ctacctaagaacagctaa

SEQ ID NO: 32480 - DNA, 18 bp, Homo sapiens
gctaaaagagcacacccg

SEQ ID NO: 32481 - DNA, 27 bp, Homo sapiens
gctaaaagagcacacccgtctatgtag

SEQ ID NO: 32482 - DNA, 25 bp, Homo sapiens
taaaagagcacacccgtctatgtag

SEQ ID NO: 32483 - DNA, 27 bp, Homo sapiens
taaaagagcacacccgtctatgtagca

SEQ ID NO: 32484 - DNA, 24 bp, Homo sapiens
aaaagagcacacccgtctatgtag

SEQ ID NO: 32485 - DNA, 26 bp, Homo sapiens
aaaagagcacacccgtctatgtagca

SEQ ID NO: 32486 - DNA, 23 bp, Homo sapiens
aaagagcacacccgtctatgtag

SEQ ID NO: 32487 - DNA, 22 bp, Homo sapiens
aagagcacacccgtctatgtag

SEQ ID NO: 32488 - DNA, 24 bp, Homo sapiens
aagagcacacccgtctatgtagca

SEQ ID NO: 32489 - DNA, 21 bp, Homo sapiens
agagcacacccgtctatgtag

SEQ ID NO: 32490 - DNA, 23 bp, Homo sapiens
agagcacacccgtctatgtagca

SEQ ID NO: 32491 - DNA, 20 bp, Homo sapiens
gagcacacccgtctatgtag

SEQ ID NO: 32492 - DNA, 21 bp, Homo sapiens
gagcacacccgtctatgtagc

SEQ ID NO: 32493 - DNA, 22 bp, Homo sapiens
gagcacacccgtctatgtagca

SEQ ID NO: 32494 - DNA, 19 bp, Homo sapiens
agcacacccgtctatgtag

SEQ ID NO: 32495 - DNA, 20 bp, Homo sapiens
agcacacccgtctatgtagc

SEQ ID NO: 32496 - DNA, 21 bp, Homo sapiens
agcacacccgtctatgtagca

SEQ ID NO: 32497 - DNA, 17 bp, Homo sapiens
gcacacccgtctatgta

SEQ ID NO: 32498 - DNA, 18 bp, Homo sapiens
gcacacccgtctatgtag

SEQ ID NO: 32499 - DNA, 19 bp, Homo sapiens
gcacacccgtctatgtagc

SEQ ID NO: 32500 - DNA, 20 bp, Homo sapiens
gcacacccgtctatgtagca

SEQ ID NO: 32501 - DNA, 17 bp, Homo sapiens
cacacccgtctatgtag

SEQ ID NO: 32502 - DNA, 18 bp, Homo sapiens
cacacccgtctatgtagc

SEQ ID NO: 32503 - DNA, 19 bp, Homo sapiens
cacacccgtctatgtagca

SEQ ID NO: 32504 - DNA, 16 bp, Homo sapiens
acacccgtctatgtag

SEQ ID NO: 32505 - DNA, 18 bp, Homo sapiens
acacccgtctatgtagca

SEQ ID NO: 32506 - DNA, 16 bp, Homo sapiens
cacccgtctatgtagc

SEQ ID NO: 32507 - DNA, 17 bp, Homo sapiens
cacccgtctatgtagca

SEQ ID NO: 32508 - DNA, 18 bp, Homo sapiens
cacccgtctatgtagcaa

SEQ ID NO: 32509 - DNA, 19 bp, Homo sapiens
cacccgtctatgtagcaaa

SEQ ID NO: 32510 - DNA, 16 bp, Homo sapiens
acccgtctatgtagca

SEQ ID NO: 32511 - DNA, 23 bp, Homo sapiens
gggaagatttataggtagaggcg

SEQ ID NO: 32512 - DNA, 22 bp, Homo sapiens
ggaagatttataggtagaggcg

SEQ ID NO: 32513 - DNA, 18 bp, Homo sapiens
ttataggtagaggcgaca

SEQ ID NO: 32514 - DNA, 26 bp, Homo sapiens
ccgagcctggtgatagctggttgtcc

SEQ ID NO: 32515 - DNA, 29 bp, Homo sapiens
ccgagcctggtgatagctggttgtccaag

SEQ ID NO: 32516 - DNA, 25 bp, Homo sapiens
cgagcctggtgatagctggttgtcc

SEQ ID NO: 32517 - DNA, 28 bp, Homo sapiens
cgagcctggtgatagctggttgtccaag

SEQ ID NO: 32518 - DNA, 21 bp, Homo sapiens
cctggtgatagctggttgtcc

SEQ ID NO: 32519 - DNA, 24 bp, Homo sapiens
cctggtgatagctggttgtccaag

SEQ ID NO: 32520 - DNA, 20 bp, Homo sapiens
ctggtgatagctggttgtcc

SEQ ID NO: 32521 - DNA, 21 bp, Homo sapiens
ctggtgatagctggttgtcca

SEQ ID NO: 32522 - DNA, 23 bp, Homo sapiens
ctggtgatagctggttgtccaag

SEQ ID NO: 32523 - DNA, 24 bp, Homo sapiens
ctggtgatagctggttgtccaaga

SEQ ID NO: 32524 - DNA, 25 bp, Homo sapiens
ctggtgatagctggttgtccaagat

SEQ ID NO: 32525 - DNA, 19 bp, Homo sapiens
tggtgatagctggttgtcc

SEQ ID NO: 32526 - DNA, 20 bp, Homo sapiens
tggtgatagctggttgtcca

SEQ ID NO: 32527 - DNA, 22 bp, Homo sapiens
tggtgatagctggttgtccaag

SEQ ID NO: 32528 - DNA, 23 bp, Homo sapiens
tggtgatagctggttgtccaaga

SEQ ID NO: 32529 - DNA, 24 bp, Homo sapiens
tggtgatagctggttgtccaagat

SEQ ID NO: 32530 - DNA, 25 bp, Homo sapiens
tggtgatagctggttgtccaagata

SEQ ID NO: 32531 - DNA, 22 bp, Homo sapiens
ggtgatagctggttgtccaaga

SEQ ID NO: 32532 - DNA, 24 bp, Homo sapiens
ggtgatagctggttgtccaagata

SEQ ID NO: 32533 - DNA, 23 bp, Homo sapiens
gatagctggttgtccaagataga

SEQ ID NO: 32534 - DNA, 21 bp, Homo sapiens
tagctggttgtccaagataga

SEQ ID NO: 32535 - DNA, 19 bp, Homo sapiens
agctggttgtccaagatag

SEQ ID NO: 32536 - DNA, 20 bp, Homo sapiens
agctggttgtccaagataga

SEQ ID NO: 32537 - DNA, 19 bp, Homo sapiens
gctggttgtccaagataga

SEQ ID NO: 32538 - DNA, 25 bp, Homo sapiens
tcttagttcaactttaaatttgccc

SEQ ID NO: 32539 - DNA, 26 bp, Homo sapiens
tcttagttcaactttaaatttgccca

SEQ ID NO: 32540 - DNA, 16 bp, Homo sapiens
actttaaatttgccca

SEQ ID NO: 32541 - DNA, 17 bp, Homo sapiens
actttaaatttgcccac

SEQ ID NO: 32542 - DNA, 18 bp, Homo sapiens
actttaaatttgcccaca

SEQ ID NO: 32543 - DNA, 19 bp, Homo sapiens
actttaaatttgcccacag

SEQ ID NO: 32544 - DNA, 23 bp, Homo sapiens
actttaaatttgcccacagaacc

SEQ ID NO: 32545 - DNA, 24 bp, Homo sapiens
actttaaatttgcccacagaaccc

SEQ ID NO: 32546 - DNA, 20 bp, Homo sapiens
acagaaccctctaaatcccc

SEQ ID NO: 32547 - DNA, 16 bp, Homo sapiens
gaaccctctaaatccc

SEQ ID NO: 32548 - DNA, 16 bp, Homo sapiens
cttgtaaatttaactg

SEQ ID NO: 32549 - DNA, 27 bp, Homo sapiens
cttgtaaatttaactgttagtccaaag

SEQ ID NO: 32550 - DNA, 26 bp, Homo sapiens
ttgtaaatttaactgttagtccaaag

SEQ ID NO: 32551 - DNA, 27 bp, Homo sapiens
ttgtaaatttaactgttagtccaaaga

SEQ ID NO: 32552 - DNA, 23 bp, Homo sapiens
aactgttagtccaaagaggaaca

SEQ ID NO: 32553 - DNA, 22 bp, Homo sapiens
actgttagtccaaagaggaaca

SEQ ID NO: 32554 - DNA, 16 bp, Homo sapiens
ctgttagtccaaagag

SEQ ID NO: 32555 - DNA, 20 bp, Homo sapiens
ctgttagtccaaagaggaac

SEQ ID NO: 32556 - DNA, 21 bp, Homo sapiens
ctgttagtccaaagaggaaca

SEQ ID NO: 32557 - DNA, 20 bp, Homo sapiens
tgttagtccaaagaggaaca

SEQ ID NO: 32558 - DNA, 16 bp, Homo sapiens
gttagtccaaagagga

SEQ ID NO: 32559 - DNA, 17 bp, Homo sapiens
gttagtccaaagaggaa

SEQ ID NO: 32560 - DNA, 18 bp, Homo sapiens
gttagtccaaagaggaac

SEQ ID NO: 32561 - DNA, 19 bp, Homo sapiens
gttagtccaaagaggaaca

SEQ ID NO: 32562 - DNA, 20 bp, Homo sapiens
gttagtccaaagaggaacag

SEQ ID NO: 32563 - DNA, 26 bp, Homo sapiens
aagaggaacagctctttggacactag

SEQ ID NO: 32564 - DNA, 20 bp, Homo sapiens
agaggaacagctctttggac

SEQ ID NO: 32565 - DNA, 22 bp, Homo sapiens
agaggaacagctctttggacac

SEQ ID NO: 32566 - DNA, 25 bp, Homo sapiens
agaggaacagctctttggacactag

SEQ ID NO: 32567 - DNA, 26 bp, Homo sapiens
agaggaacagctctttggacactagg

SEQ ID NO: 32568 - DNA, 20 bp, Homo sapiens
gaggaacagctctttggaca

SEQ ID NO: 32569 - DNA, 21 bp, Homo sapiens
gaggaacagctctttggacac

SEQ ID NO: 32570 - DNA, 22 bp, Homo sapiens
gaggaacagctctttggacact

SEQ ID NO: 32571 - DNA, 24 bp, Homo sapiens
gaggaacagctctttggacactag

SEQ ID NO: 32572 - DNA, 25 bp, Homo sapiens
gaggaacagctctttggacactagg

SEQ ID NO: 32573 - DNA, 26 bp, Homo sapiens
gaggaacagctctttggacactagga

SEQ ID NO: 32574 - DNA, 16 bp, Homo sapiens
aggaacagctctttgg

SEQ ID NO: 32575 - DNA, 18 bp, Homo sapiens
aggaacagctctttggac

SEQ ID NO: 32576 - DNA, 19 bp, Homo sapiens
aggaacagctctttggaca

SEQ ID NO: 32577 - DNA, 20 bp, Homo sapiens
aggaacagctctttggacac

SEQ ID NO: 32578 - DNA, 21 bp, Homo sapiens
aggaacagctctttggacact

SEQ ID NO: 32579 - DNA, 22 bp, Homo sapiens
aggaacagctctttggacacta

SEQ ID NO: 32580 - DNA, 23 bp, Homo sapiens
aggaacagctctttggacactag

SEQ ID NO: 32581 - DNA, 24 bp, Homo sapiens
aggaacagctctttggacactagg

SEQ ID NO: 32582 - DNA, 25 bp, Homo sapiens
aggaacagctctttggacactagga

SEQ ID NO: 32583 - DNA, 26 bp, Homo sapiens
aggaacagctctttggacactaggaa

SEQ ID NO: 32584 - DNA, 27 bp, Homo sapiens
aggaacagctctttggacactaggaaa

SEQ ID NO: 32585 - DNA, 28 bp, Homo sapiens
aggaacagctctttggacactaggaaaa

SEQ ID NO: 32586 - DNA, 29 bp, Homo sapiens
aggaacagctctttggacactaggaaaaa

SEQ ID NO: 32587 - DNA, 17 bp, Homo sapiens
ggaacagctctttggac

SEQ ID NO: 32588 - DNA, 18 bp, Homo sapiens
ggaacagctctttggaca

SEQ ID NO: 32589 - DNA, 19 bp, Homo sapiens
ggaacagctctttggacac

SEQ ID NO: 32590 - DNA, 20 bp, Homo sapiens
ggaacagctctttggacact

SEQ ID NO: 32591 - DNA, 21 bp, Homo sapiens
ggaacagctctttggacacta

SEQ ID NO: 32592 - DNA, 22 bp, Homo sapiens
ggaacagctctttggacactag

SEQ ID NO: 32593 - DNA, 23 bp, Homo sapiens
ggaacagctctttggacactagg

SEQ ID NO: 32594 - DNA, 24 bp, Homo sapiens
ggaacagctctttggacactagga

SEQ ID NO: 32595 - DNA, 25 bp, Homo sapiens
ggaacagctctttggacactaggaa

SEQ ID NO: 32596 - DNA, 26 bp, Homo sapiens
ggaacagctctttggacactaggaaa

SEQ ID NO: 32597 - DNA, 30 bp, Homo sapiens
ggaacagctctttggacactaggaaaaaac

SEQ ID NO: 32598 - DNA, 19 bp, Homo sapiens
gaacagctctttggacact

SEQ ID NO: 32599 - DNA, 20 bp, Homo sapiens
gaacagctctttggacacta

SEQ ID NO: 32600 - DNA, 21 bp, Homo sapiens
gaacagctctttggacactag

SEQ ID NO: 32601 - DNA, 22 bp, Homo sapiens
gaacagctctttggacactagg

SEQ ID NO: 32602 - DNA, 23 bp, Homo sapiens
gaacagctctttggacactagga

SEQ ID NO: 32603 - DNA, 24 bp, Homo sapiens
gaacagctctttggacactaggaa

SEQ ID NO: 32604 - DNA, 25 bp, Homo sapiens
gaacagctctttggacactaggaaa

SEQ ID NO: 32605 - DNA, 26 bp, Homo sapiens
gaacagctctttggacactaggaaaa

SEQ ID NO: 32606 - DNA, 30 bp, Homo sapiens; identical to SEQ ID NO: 1163

SEQ ID NO: 32607 - DNA, 20 bp, Homo sapiens
aacagctctttggacactag

SEQ ID NO: 32608 - DNA, 21 bp, Homo sapiens
aacagctctttggacactagg

SEQ ID NO: 32609 - DNA, 22 bp, Homo sapiens
aacagctctttggacactagga

SEQ ID NO: 32610 - DNA, 23 bp, Homo sapiens
aacagctctttggacactaggaa

SEQ ID NO: 32611 - DNA, 24 bp, Homo sapiens
aacagctctttggacactaggaaa

SEQ ID NO: 32612 - DNA, 25 bp, Homo sapiens
aacagctctttggacactaggaaaa

SEQ ID NO: 32613 - DNA, 26 bp, Homo sapiens
aacagctctttggacactaggaaaaa

SEQ ID NO: 32614 - DNA, 29 bp, Homo sapiens
aacagctctttggacactaggaaaaaacc

SEQ ID NO: 32615 - DNA, 16 bp, Homo sapiens
acagctctttggacac

SEQ ID NO: 32616 - DNA, 17 bp, Homo sapiens
acagctctttggacact

SEQ ID NO: 32617 - DNA, 19 bp, Homo sapiens
acagctctttggacactag

SEQ ID NO: 32618 - DNA, 20 bp, Homo sapiens
acagctctttggacactagg

SEQ ID NO: 32619 - DNA, 21 bp, Homo sapiens
acagctctttggacactagga

SEQ ID NO: 32620 - DNA, 22 bp, Homo sapiens
acagctctttggacactaggaa

SEQ ID NO: 32621 - DNA, 18 bp, Homo sapiens
cagctctttggacactag

SEQ ID NO: 32622 - DNA, 19 bp, Homo sapiens
cagctctttggacactagg

SEQ ID NO: 32623 - DNA, 20 bp, Homo sapiens
cagctctttggacactagga

SEQ ID NO: 32624 - DNA, 21 bp, Homo sapiens
cagctctttggacactaggaa

SEQ ID NO: 32625 - DNA, 27 bp, Homo sapiens
cagctctttggacactaggaaaaaacc

SEQ ID NO: 32626 - DNA, 16 bp, Homo sapiens
gctctttggacactag

SEQ ID NO: 32627 - DNA, 17 bp, Homo sapiens
gctctttggacactagg

SEQ ID NO: 32628 - DNA, 18 bp, Homo sapiens
gctctttggacactagga

SEQ ID NO: 32629 - DNA, 19 bp, Homo sapiens
gctctttggacactaggaa

SEQ ID NO: 32630 - DNA, 20 bp, Homo sapiens
gctctttggacactaggaaa

SEQ ID NO: 32631 - DNA, 21 bp, Homo sapiens
gctctttggacactaggaaaa

SEQ ID NO: 32632 - DNA, 24 bp, Homo sapiens
gctctttggacactaggaaaaaac

SEQ ID NO: 32633 - DNA, 25 bp, Homo sapiens
gctctttggacactaggaaaaaacc

SEQ ID NO: 32634 - DNA, 26 bp, Homo sapiens
gctctttggacactaggaaaaaacct

SEQ ID NO: 32635 - DNA, 16 bp, Homo sapiens
ctctttggacactagg

SEQ ID NO: 32636 - DNA, 23 bp, Homo sapiens
ctctttggacactaggaaaaaac

SEQ ID NO: 32637 - DNA, 24 bp, Homo sapiens
ctctttggacactaggaaaaaacc

SEQ ID NO: 32638 - DNA, 25 bp, Homo sapiens
ctctttggacactaggaaaaaacct

SEQ ID NO: 32639 - DNA, 21 bp, Homo sapiens
ctttggacactaggaaaaaac

SEQ ID NO: 32640 - DNA, 22 bp, Homo sapiens
ctttggacactaggaaaaaacc

SEQ ID NO: 32641 - DNA, 23 bp, Homo sapiens
ctttggacactaggaaaaaacct

SEQ ID NO: 32642 - DNA, 18 bp, Homo sapiens
cttgtagagagagtaaaa

SEQ ID NO: 32643 - DNA, 19 bp, Homo sapiens
cttgtagagagagtaaaaa

SEQ ID NO: 32644 - DNA, 16 bp, Homo sapiens
ttgtagagagagtaaa

SEQ ID NO: 32645 - DNA, 17 bp, Homo sapiens
ttgtagagagagtaaaa

SEQ ID NO: 32646 - DNA, 18 bp, Homo sapiens
ttgtagagagagtaaaaa

SEQ ID NO: 32647 - DNA, 19 bp, Homo sapiens
ttgtagagagagtaaaaaa

SEQ ID NO: 32648 - DNA, 20 bp, Homo sapiens
ttgtagagagagtaaaaaat

SEQ ID NO: 32649 - DNA, 21 bp, Homo sapiens
ttgtagagagagtaaaaaatt

SEQ ID NO: 32650 - DNA, 22 bp, Homo sapiens
ttgtagagagagtaaaaaattt

SEQ ID NO: 32651 - DNA, 23 bp, Homo sapiens
ttgtagagagagtaaaaaattta

SEQ ID NO: 32652 - DNA, 26 bp, Homo sapiens
ttgtagagagagtaaaaaatttaaca

SEQ ID NO: 32653 - DNA, 19 bp, Homo sapiens
catagtaggcctaaaagca

SEQ ID NO: 32654 - DNA, 20 bp, Homo sapiens
catagtaggcctaaaagcag

SEQ ID NO: 32655 - DNA, 21 bp, Homo sapiens
catagtaggcctaaaagcagc

SEQ ID NO: 32656 - DNA, 22 bp, Homo sapiens
catagtaggcctaaaagcagcc

SEQ ID NO: 32657 - DNA, 25 bp, Homo sapiens
catagtaggcctaaaagcagccacc

SEQ ID NO: 32658 - DNA, 19 bp, Homo sapiens
atagtaggcctaaaagcag

SEQ ID NO: 32659 - DNA, 24 bp, Homo sapiens
atagtaggcctaaaagcagccacc

SEQ ID NO: 32660 - DNA, 21 bp, Homo sapiens
gtaggcctaaaagcagccacc

SEQ ID NO: 32661 - DNA, 18 bp, Homo sapiens
cgttcaagctcaacaccc

SEQ ID NO: 32662 - DNA, 19 bp, Homo sapiens
gttcaagctcaacacccac

SEQ ID NO: 32663 - DNA, 20 bp, Homo sapiens
gttcaagctcaacacccact

SEQ ID NO: 32664 - DNA, 18 bp, Homo sapiens
cactacctaaaaaatccc

SEQ ID NO: 32665 - DNA, 27 bp, Homo sapiens
caaacatataactgaactcctcacacc

SEQ ID NO: 32666 - DNA, 26 bp, Homo sapiens
aaacatataactgaactcctcacacc

SEQ ID NO: 32667 - DNA, 27 bp, Homo sapiens
aaacatataactgaactcctcacaccc

SEQ ID NO: 32668 - DNA, 25 bp, Homo sapiens
aacatataactgaactcctcacacc

SEQ ID NO: 32669 - DNA, 26 bp, Homo sapiens
aacatataactgaactcctcacaccc

SEQ ID NO: 32670 - DNA, 24 bp, Homo sapiens
acatataactgaactcctcacacc

SEQ ID NO: 32671 - DNA, 25 bp, Homo sapiens
acatataactgaactcctcacaccc

SEQ ID NO: 32672 - DNA, 23 bp, Homo sapiens
catataactgaactcctcacacc

SEQ ID NO: 32673 - DNA, 24 bp, Homo sapiens
catataactgaactcctcacaccc

SEQ ID NO: 32674 - DNA, 22 bp, Homo sapiens
atataactgaactcctcacacc

SEQ ID NO: 32675 - DNA, 23 bp, Homo sapiens
atataactgaactcctcacaccc

SEQ ID NO: 32676 - DNA, 29 bp, Homo sapiens
atataactgaactcctcacacccaattgg

SEQ ID NO: 32677 - DNA, 21 bp, Homo sapiens
tataactgaactcctcacacc

SEQ ID NO: 32678 - DNA, 22 bp, Homo sapiens
tataactgaactcctcacaccc

SEQ ID NO: 32679 - DNA, 23 bp, Homo sapiens
tataactgaactcctcacaccca

SEQ ID NO: 32680 - DNA, 30 bp, Homo sapiens; identical to SEQ ID NO: 10183

SEQ ID NO: 32681 - DNA, 20 bp, Homo sapiens
ataactgaactcctcacacc

SEQ ID NO: 32682 - DNA, 21 bp, Homo sapiens
ataactgaactcctcacaccc

SEQ ID NO: 32683 - DNA, 22 bp, Homo sapiens
ataactgaactcctcacaccca

SEQ ID NO: 32684 - DNA, 19 bp, Homo sapiens
taactgaactcctcacacc

SEQ ID NO: 32685 - DNA, 20 bp, Homo sapiens
taactgaactcctcacaccc

SEQ ID NO: 32686 - DNA, 18 bp, Homo sapiens
aactgaactcctcacacc

SEQ ID NO: 32687 - DNA, 19 bp, Homo sapiens
aactgaactcctcacaccc

SEQ ID NO: 32688 - DNA, 17 bp, Homo sapiens
actgaactcctcacacc

SEQ ID NO: 32689 - DNA, 18 bp, Homo sapiens
actgaactcctcacaccc

SEQ ID NO: 32690 - DNA, 16 bp, Homo sapiens
ctgaactcctcacacc

SEQ ID NO: 32691 - DNA, 17 bp, Homo sapiens
ctgaactcctcacaccc

SEQ ID NO: 32692 - DNA, 16 bp, Homo sapiens
gaactcctcacaccca

SEQ ID NO: 32693 - DNA, 24 bp, Homo sapiens
gaactcctcacacccaattggacc

SEQ ID NO: 32694 - DNA, 23 bp, Homo sapiens
cctcacacccaattggaccaatc

SEQ ID NO: 32695 - DNA, 19 bp, Homo sapiens
caattggaccaatctatca

SEQ ID NO: 32696 - DNA, 21 bp, Homo sapiens
caattggaccaatctatcacc

SEQ ID NO: 32697 - DNA, 22 bp, Homo sapiens
caattggaccaatctatcaccc

SEQ ID NO: 32698 - DNA, 23 bp, Homo sapiens
caattggaccaatctatcaccct

SEQ ID NO: 32699 - DNA, 24 bp, Homo sapiens
caattggaccaatctatcacccta

SEQ ID NO: 32700 - DNA, 27 bp, Homo sapiens
caattggaccaatctatcaccctatag

SEQ ID NO: 32701 - DNA, 28 bp, Homo sapiens
caattggaccaatctatcaccctataga

SEQ ID NO: 32702 - DNA, 29 bp, Homo sapiens
caattggaccaatctatcaccctatagaa

SEQ ID NO: 32703 - DNA, 30 bp, Homo sapiens; identical to SEQ ID NO: 1342

SEQ ID NO: 32704 - DNA, 20 bp, Homo sapiens
aattggaccaatctatcacc

SEQ ID NO: 32705 - DNA, 21 bp, Homo sapiens
aattggaccaatctatcaccc

SEQ ID NO: 32706 - DNA, 22 bp, Homo sapiens
aattggaccaatctatcaccct

SEQ ID NO: 32707 - DNA, 23 bp, Homo sapiens
aattggaccaatctatcacccta

SEQ ID NO: 32708 - DNA, 26 bp, Homo sapiens
aattggaccaatctatcaccctatag

SEQ ID NO: 32709 - DNA, 27 bp, Homo sapiens
aattggaccaatctatcaccctataga

SEQ ID NO: 32710 - DNA, 28 bp, Homo sapiens
aattggaccaatctatcaccctatagaa

SEQ ID NO: 32711 - DNA, 29 bp, Homo sapiens
aattggaccaatctatcaccctatagaag

SEQ ID NO: 32712 - DNA, 29 bp, Homo sapiens
gcataagcctgcgtcagattaaaacactg

SEQ ID NO: 32713 - DNA, 16 bp, Homo sapiens
cataagcctgcgtcag

SEQ ID NO: 32714 - DNA, 17 bp, Homo sapiens
cataagcctgcgtcaga

SEQ ID NO: 32715 - DNA, 25 bp, Homo sapiens
cataagcctgcgtcagattaaaaca

SEQ ID NO: 32716 - DNA, 27 bp, Homo sapiens
cataagcctgcgtcagattaaaacact

SEQ ID NO: 32717 - DNA, 28 bp, Homo sapiens
cataagcctgcgtcagattaaaacactg

SEQ ID NO: 32718 - DNA, 29 bp, Homo sapiens
cataagcctgcgtcagattaaaacactga

SEQ ID NO: 32719 - DNA, 22 bp, Homo sapiens
taagcctgcgtcagattaaaac

SEQ ID NO: 32720 - DNA, 23 bp, Homo sapiens
taagcctgcgtcagattaaaaca

SEQ ID NO: 32721 - DNA, 24 bp, Homo sapiens
taagcctgcgtcagattaaaacac

SEQ ID NO: 32722 - DNA, 25 bp, Homo sapiens
taagcctgcgtcagattaaaacact

SEQ ID NO: 32723 - DNA, 26 bp, Homo sapiens
taagcctgcgtcagattaaaacactg

SEQ ID NO: 32724 - DNA, 25 bp, Homo sapiens
aagcctgcgtcagattaaaacactg

SEQ ID NO: 32725 - DNA, 20 bp, Homo sapiens
gcctgcgtcagattaaaaca

SEQ ID NO: 32726 - DNA, 22 bp, Homo sapiens
gcctgcgtcagattaaaacact

SEQ ID NO: 32727 - DNA, 23 bp, Homo sapiens
gcctgcgtcagattaaaacactg

SEQ ID NO: 32728 - DNA, 17 bp, Homo sapiens
ctgcgtcagattaaaac

SEQ ID NO: 32729 - DNA, 18 bp, Homo sapiens
ctgcgtcagattaaaaca

SEQ ID NO: 32730 - DNA, 19 bp, Homo sapiens
ctgcgtcagattaaaacac

SEQ ID NO: 32731 - DNA, 20 bp, Homo sapiens
ctgcgtcagattaaaacact

SEQ ID NO: 32732 - DNA, 21 bp, Homo sapiens
ctgcgtcagattaaaacactg

SEQ ID NO: 32733 - DNA, 25 bp, Homo sapiens
ctgcgtcagattaaaacactgaact

SEQ ID NO: 32734 - DNA, 21 bp, Homo sapiens
tgcgtcagattaaaacactga

SEQ ID NO: 32735 - DNA, 23 bp, Homo sapiens
tgcgtcagattaaaacactgaac

SEQ ID NO: 32736 - DNA, 24 bp, Homo sapiens
tgcgtcagattaaaacactgaact

SEQ ID NO: 32737 - DNA, 27 bp, Homo sapiens
tgcgtcagattaaaacactgaactgac

SEQ ID NO: 32738 - DNA, 28 bp, Homo sapiens
tgcgtcagattaaaacactgaactgaca

SEQ ID NO: 32739 - DNA, 19 bp, Homo sapiens
gattaaaacactgaactga

SEQ ID NO: 32740 - DNA, 20 bp, Homo sapiens
gattaaaacactgaactgac

SEQ ID NO: 32741 - DNA, 21 bp, Homo sapiens
gattaaaacactgaactgaca

SEQ ID NO: 32742 - DNA, 18 bp, Homo sapiens
attaaaacactgaactga

SEQ ID NO: 32743 - DNA, 19 bp, Homo sapiens
attaaaacactgaactgac

SEQ ID NO: 32744 - DNA, 20 bp, Homo sapiens
attaaaacactgaactgaca

SEQ ID NO: 32745 - DNA, 20 bp, Homo sapiens
aaaacactgaactgacaatt

SEQ ID NO: 32746 - DNA, 16 bp, Homo sapiens
aaacactgaactgaca

SEQ ID NO: 32747 - DNA, 18 bp, Homo sapiens
aacactgaactgacaatt

SEQ ID NO: 32748 - DNA, 19 bp, Homo sapiens
cactgaactgacaattaac

SEQ ID NO: 32749 - DNA, 20 bp, Homo sapiens
cactgaactgacaattaaca

SEQ ID NO: 32750 - DNA, 21 bp, Homo sapiens
cactgaactgacaattaacag

SEQ ID NO: 32751 - DNA, 22 bp, Homo sapiens
cactgaactgacaattaacagc

SEQ ID NO: 32752 - DNA, 23 bp, Homo sapiens
cactgaactgacaattaacagcc

SEQ ID NO: 32753 - DNA, 24 bp, Homo sapiens
cactgaactgacaattaacagccc

SEQ ID NO: 32754 - DNA, 17 bp, Homo sapiens
ctgaactgacaattaac

SEQ ID NO: 32755 - DNA, 18 bp, Homo sapiens
ctgaactgacaattaaca

SEQ ID NO: 32756 - DNA, 20 bp, Homo sapiens
ctgaactgacaattaacagc

SEQ ID NO: 32757 - DNA, 21 bp, Homo sapiens
ctgaactgacaattaacagcc

SEQ ID NO: 32758 - DNA, 22 bp, Homo sapiens
ctgaactgacaattaacagccc

SEQ ID NO: 32759 - DNA, 23 bp, Homo sapiens
ctgaactgacaattaacagccca

SEQ ID NO: 32760 - DNA, 20 bp, Homo sapiens
gaactgacaattaacagccc

SEQ ID NO: 32761 - DNA, 20 bp, Homo sapiens
agatattgggctgttaattg

SEQ ID NO: 32762 - DNA, 19 bp, Homo sapiens
agatattgggctgttaatt

SEQ ID NO: 32763 - DNA, 17 bp, Homo sapiens
agatattgggctgttaa

SEQ ID NO: 32764 - DNA, 20 bp, Homo sapiens
ttaacagcccaatatctaca

SEQ ID NO: 32765 - DNA, 16 bp, Homo sapiens
agatattgggctgtta

SEQ ID NO: 32766 - DNA, 25 bp, Homo sapiens
aacagcccaatatctacaatcaacc

SEQ ID NO: 32767 - DNA, 26 bp, Homo sapiens
aacagcccaatatctacaatcaacca

SEQ ID NO: 32768 - DNA, 24 bp, Homo sapiens
acagcccaatatctacaatcaacc

SEQ ID NO: 32769 - DNA, 23 bp, Homo sapiens
cagcccaatatctacaatcaacc

SEQ ID NO: 32770 - DNA, 22 bp, Homo sapiens
agcccaatatctacaatcaacc

SEQ ID NO: 32771 - DNA, 21 bp, Homo sapiens
gcccaatatctacaatcaacc

SEQ ID NO: 32772 - DNA, 22 bp, Homo sapiens
gcccaatatctacaatcaacca

SEQ ID NO: 32773 - DNA, 25 bp, Homo sapiens
gcccaatatctacaatcaaccaaca

SEQ ID NO: 32774 - DNA, 18 bp, Homo sapiens
caatatctacaatcaacc

SEQ ID NO: 32775 - DNA, 21 bp, Homo sapiens
caatatctacaatcaaccaac

SEQ ID NO: 32776 - DNA, 22 bp, Homo sapiens
caatatctacaatcaaccaaca

SEQ ID NO: 32777 - DNA, 26 bp, Homo sapiens
caatatctacaatcaaccaacaagtc

SEQ ID NO: 32778 - DNA, 21 bp, Homo sapiens
aatatctacaatcaaccaaca

SEQ ID NO: 32779 - DNA, 19 bp, Homo sapiens
tatctacaatcaaccaaca

SEQ ID NO: 32780 - DNA, 23 bp, Homo sapiens
tatctacaatcaaccaacaagtc

SEQ ID NO: 32781 - DNA, 19 bp, Homo sapiens
tctacaatcaaccaacaag

SEQ ID NO: 32782 - DNA, 22 bp, Homo sapiens
attattaccctcactgtcaacc

SEQ ID NO: 32783 - DNA, 23 bp, Homo sapiens
attattaccctcactgtcaaccc

SEQ ID NO: 32784 - DNA, 18 bp, Homo sapiens
ctgtcaacccaacacagg

SEQ ID NO: 32785 - DNA, 19 bp, Homo sapiens
ctgtcaacccaacacaggc

SEQ ID NO: 32786 - DNA, 23 bp, Homo sapiens
ctgtcaacccaacacaggcatgc

SEQ ID NO: 32787 - DNA, 24 bp, Homo sapiens
ctgtcaacccaacacaggcatgct

SEQ ID NO: 32788 - DNA, 22 bp, Homo sapiens
gtaaaaggaactcggcaaatct

SEQ ID NO: 32789 - DNA, 21 bp, Homo sapiens
taaaaggaactcggcaaatct

SEQ ID NO: 32790 - DNA, 19 bp, Homo sapiens
aaaaggaactcggcaaatc

SEQ ID NO: 32791 - DNA, 20 bp, Homo sapiens
aaaaggaactcggcaaatct

SEQ ID NO: 32792 - DNA, 18 bp, Homo sapiens
aaaggaactcggcaaatc

SEQ ID NO: 32793 - DNA, 19 bp, Homo sapiens
aaaggaactcggcaaatct

SEQ ID NO: 32794 - DNA, 23 bp, Homo sapiens
aaaggaactcggcaaatcttacc

SEQ ID NO: 32795 - DNA, 24 bp, Homo sapiens
aaaggaactcggcaaatcttaccc

SEQ ID NO: 32796 - DNA, 25 bp, Homo sapiens
aaaggaactcggcaaatcttacccc

SEQ ID NO: 32797 - DNA, 19 bp, Homo sapiens
gaactcggcaaatcttacc

SEQ ID NO: 32798 - DNA, 20 bp, Homo sapiens
gaactcggcaaatcttaccc

SEQ ID NO: 32799 - DNA, 21 bp, Homo sapiens
gaactcggcaaatcttacccc

SEQ ID NO: 32800 - DNA, 22 bp, Homo sapiens
gaactcggcaaatcttaccccg

SEQ ID NO: 32801 - DNA, 23 bp, Homo sapiens
gaactcggcaaatcttaccccgc

SEQ ID NO: 32802 - DNA, 24 bp, Homo sapiens
gaactcggcaaatcttaccccgcc

SEQ ID NO: 32803 - DNA, 21 bp, Homo sapiens
ctcggcaaatcttaccccgcc

SEQ ID NO: 32804 - DNA, 20 bp, Homo sapiens
tcggcaaatcttaccccgcc

SEQ ID NO: 32805 - DNA, 19 bp, Homo sapiens
cggcaaatcttaccccgcc

SEQ ID NO: 32806 - DNA, 27 bp, Homo sapiens
cggcaaatcttaccccgcctgtttacc

SEQ ID NO: 32807 - DNA, 28 bp, Homo sapiens
cggcaaatcttaccccgcctgtttacca

SEQ ID NO: 32808 - DNA, 18 bp, Homo sapiens
ggcaaatcttaccccgcc

SEQ ID NO: 32809 - DNA, 19 bp, Homo sapiens
ggcaaatcttaccccgcct

SEQ ID NO: 32810 - DNA, 20 bp, Homo sapiens
ggcaaatcttaccccgcctg

SEQ ID NO: 32811 - DNA, 17 bp, Homo sapiens
gcaaatcttaccccgcc

SEQ ID NO: 32812 - DNA, 18 bp, Homo sapiens
gcaaatcttaccccgcct

SEQ ID NO: 32813 - DNA, 21 bp, Homo sapiens
gcaaatcttaccccgcctgtt

SEQ ID NO: 32814 - DNA, 25 bp, Homo sapiens
gcaaatcttaccccgcctgtttacc

SEQ ID NO: 32815 - DNA, 22 bp, Homo sapiens
aatcttaccccgcctgtttacc

SEQ ID NO: 32816 - DNA, 21 bp, Homo sapiens
atcttaccccgcctgtttacc

SEQ ID NO: 32817 - DNA, 19 bp, Homo sapiens
cttaccccgcctgtttacc

SEQ ID NO: 32818 - DNA, 20 bp, Homo sapiens
cttaccccgcctgtttacca

SEQ ID NO: 32819 - DNA, 18 bp, Homo sapiens
ttaccccgcctgtttacc

SEQ ID NO: 32820 - DNA, 19 bp, Homo sapiens
ttaccccgcctgtttacca

SEQ ID NO: 32821 - DNA, 17 bp, Homo sapiens
taccccgcctgtttacc

SEQ ID NO: 32822 - DNA, 19 bp, Homo sapiens
aaaaacatcacctctagca

SEQ ID NO: 32823 - DNA, 24 bp, Homo sapiens
aaaaacatcacctctagcatcacc

SEQ ID NO: 32824 - DNA, 25 bp, Homo sapiens
aaaaacatcacctctagcatcacca

SEQ ID NO: 32825 - DNA, 23 bp, Homo sapiens
aaaacatcacctctagcatcacc

SEQ ID NO: 32826 - DNA, 22 bp, Homo sapiens
aaacatcacctctagcatcacc

SEQ ID NO: 32827 - DNA, 21 bp, Homo sapiens
aacatcacctctagcatcacc

SEQ ID NO: 32828 - DNA, 19 bp, Homo sapiens
catcacctctagcatcacc

SEQ ID NO: 32829 - DNA, 20 bp, Homo sapiens
atcacctctagcatcaccag

SEQ ID NO: 32830 - DNA, 23 bp, Homo sapiens
cctctagcatcaccagtattaga

SEQ ID NO: 32831 - DNA, 22 bp, Homo sapiens
ctctagcatcaccagtattaga

SEQ ID NO: 32832 - DNA, 21 bp, Homo sapiens
tctagcatcaccagtattaga

SEQ ID NO: 32833 - DNA, 23 bp, Homo sapiens
tctagcatcaccagtattagagg

SEQ ID NO: 32834 - DNA, 25 bp, Homo sapiens
tctagcatcaccagtattagaggca

SEQ ID NO: 32835 - DNA, 27 bp, Homo sapiens
tctagcatcaccagtattagaggcacc

SEQ ID NO: 32836 - DNA, 19 bp, Homo sapiens
ctagcatcaccagtattag

SEQ ID NO: 32837 - DNA, 20 bp, Homo sapiens
ctagcatcaccagtattaga

SEQ ID NO: 32838 - DNA, 21 bp, Homo sapiens
ctagcatcaccagtattagag

SEQ ID NO: 32839 - DNA, 22 bp, Homo sapiens
ctagcatcaccagtattagagg

SEQ ID NO: 32840 - DNA, 23 bp, Homo sapiens
ctagcatcaccagtattagaggc

SEQ ID NO: 32841 - DNA, 24 bp, Homo sapiens
ctagcatcaccagtattagaggca

SEQ ID NO: 32842 - DNA, 25 bp, Homo sapiens
ctagcatcaccagtattagaggcac

SEQ ID NO: 32843 - DNA, 26 bp, Homo sapiens
ctagcatcaccagtattagaggcacc

SEQ ID NO: 32844 - DNA, 27 bp, Homo sapiens
ctagcatcaccagtattagaggcaccg

SEQ ID NO: 32845 - DNA, 19 bp, Homo sapiens
tagcatcaccagtattaga

SEQ ID NO: 32846 - DNA, 21 bp, Homo sapiens
tagcatcaccagtattagagg

SEQ ID NO: 32847 - DNA, 25 bp, Homo sapiens
tagcatcaccagtattagaggcacc

SEQ ID NO: 32848 - DNA, 20 bp, Homo sapiens
agcatcaccagtattagagg

SEQ ID NO: 32849 - DNA, 24 bp, Homo sapiens
agcatcaccagtattagaggcacc

SEQ ID NO: 32850 - DNA, 19 bp, Homo sapiens
gcatcaccagtattagagg

SEQ ID NO: 32851 - DNA, 18 bp, Homo sapiens
catcaccagtattagagg

SEQ ID NO: 32852 - DNA, 25 bp, Homo sapiens
catcaccagtattagaggcaccgcc

SEQ ID NO: 32853 - DNA, 17 bp, Homo sapiens
atcaccagtattagagg

SEQ ID NO: 32854 - DNA, 24 bp, Homo sapiens
atcaccagtattagaggcaccgcc

SEQ ID NO: 32855 - DNA, 16 bp, Homo sapiens
tcaccagtattagagg

SEQ ID NO: 32856 - DNA, 20 bp, Homo sapiens
tcaccagtattagaggcacc

SEQ ID NO: 32857 - DNA, 19 bp, Homo sapiens
caccagtattagaggcacc

SEQ ID NO: 32858 - DNA, 17 bp, Homo sapiens
ccagtattagaggcacc

SEQ ID NO: 32859 - DNA, 22 bp, Homo sapiens
agtattagaggcaccgcctgcc

SEQ ID NO: 32860 - DNA, 25 bp, Homo sapiens
agtattagaggcaccgcctgcccag

SEQ ID NO: 32861 - DNA, 27 bp, Homo sapiens
agtattagaggcaccgcctgcccagtg

SEQ ID NO: 32862 - DNA, 17 bp, Homo sapiens
gtattagaggcaccgcc

SEQ ID NO: 32863 - DNA, 18 bp, Homo sapiens
gtattagaggcaccgcct

SEQ ID NO: 32864 - DNA, 21 bp, Homo sapiens
gtattagaggcaccgcctgcc

SEQ ID NO: 32865 - DNA, 22 bp, Homo sapiens
gtattagaggcaccgcctgccc

SEQ ID NO: 32866 - DNA, 24 bp, Homo sapiens
gtattagaggcaccgcctgcccag

SEQ ID NO: 32867 - DNA, 25 bp, Homo sapiens
gtattagaggcaccgcctgcccagt

SEQ ID NO: 32868 - DNA, 26 bp, Homo sapiens
gtattagaggcaccgcctgcccagtg

SEQ ID NO: 32869 - DNA, 16 bp, Homo sapiens
ggcaccgcctgcccag

SEQ ID NO: 32870 - DNA, 17 bp, Homo sapiens
gcctgcccagtgacaca

SEQ ID NO: 32871 - DNA, 23 bp, Homo sapiens
tgcccagtgacacatgtttaacg

SEQ ID NO: 32872 - DNA, 22 bp, Homo sapiens
gcccagtgacacatgtttaacg

SEQ ID NO: 32873 - DNA, 22 bp, Homo sapiens
cagtgacacatgtttaacggcc

SEQ ID NO: 32874 - DNA, 30 bp, Homo sapiens; identical to SEQ ID NO: 1525

SEQ ID NO: 32875 - DNA, 21 bp, Homo sapiens
agtgacacatgtttaacggcc

SEQ ID NO: 32876 - DNA, 20 bp, Homo sapiens
gtgacacatgtttaacggcc

SEQ ID NO: 32877 - DNA, 24 bp, Homo sapiens
cacatgtttaacggccgcggtacc

SEQ ID NO: 32878 - DNA, 25 bp, Homo sapiens
cacatgtttaacggccgcggtaccc

SEQ ID NO: 32879 - DNA, 17 bp, Homo sapiens
catgtttaacggccgcg

SEQ ID NO: 32880 - DNA, 22 bp, Homo sapiens
catgtttaacggccgcggtacc

SEQ ID NO: 32881 - DNA, 23 bp, Homo sapiens
catgtttaacggccgcggtaccc

SEQ ID NO: 32882 - DNA, 24 bp, Homo sapiens
catgtttaacggccgcggtaccct

SEQ ID NO: 32883 - DNA, 20 bp, Homo sapiens
tgtttaacggccgcggtacc

SEQ ID NO: 32884 - DNA, 21 bp, Homo sapiens
tgtttaacggccgcggtaccc

SEQ ID NO: 32885 - DNA, 23 bp, Homo sapiens
tgtttaacggccgcggtacccta

SEQ ID NO: 32886 - DNA, 19 bp, Homo sapiens
gtttaacggccgcggtacc

SEQ ID NO: 32887 - DNA, 20 bp, Homo sapiens
gtttaacggccgcggtaccc

SEQ ID NO: 32888 - DNA, 21 bp, Homo sapiens
gtttaacggccgcggtaccct

SEQ ID NO: 32889 - DNA, 22 bp, Homo sapiens
gtttaacggccgcggtacccta

SEQ ID NO: 32890 - DNA, 19 bp, Homo sapiens
tttaacggccgcggtaccc

SEQ ID NO: 32891 - DNA, 17 bp, Homo sapiens
taacggccgcggtaccc

SEQ ID NO: 32892 - DNA, 16 bp, Homo sapiens
aacggccgcggtaccc

SEQ ID NO: 32893 - DNA, 18 bp, Homo sapiens
aacggccgcggtacccta

SEQ ID NO: 32894 - DNA, 16 bp, Homo sapiens
ggccgcggtaccctaa

SEQ ID NO: 32895 - DNA, 17 bp, Homo sapiens
ggccgcggtaccctaac

SEQ ID NO: 32896 - DNA, 18 bp, Homo sapiens
ggccgcggtaccctaacc

SEQ ID NO: 32897 - DNA, 19 bp, Homo sapiens
ggccgcggtaccctaaccg

SEQ ID NO: 32898 - DNA, 17 bp, Homo sapiens
gccgcggtaccctaacc

SEQ ID NO: 32899 - DNA, 18 bp, Homo sapiens
aaccgtgcaaaggtagca

SEQ ID NO: 32900 - DNA, 17 bp, Homo sapiens
accgtgcaaaggtagca

SEQ ID NO: 32901 - DNA, 24 bp, Homo sapiens
gtgcaaaggtagcataatcacttg

SEQ ID NO: 32902 - DNA, 16 bp, Homo sapiens
aaggtagcataatcac

SEQ ID NO: 32903 - DNA, 20 bp, Homo sapiens
aaggtagcataatcacttgt

SEQ ID NO: 32904 - DNA, 23 bp, Homo sapiens
aaggtagcataatcacttgttcc

SEQ ID NO: 32905 - DNA, 21 bp, Homo sapiens
ggtagcataatcacttgttcc

SEQ ID NO: 32906 - DNA, 20 bp, Homo sapiens
gtagcataatcacttgttcc

SEQ ID NO: 32907 - DNA, 16 bp, Homo sapiens
cttaaatagggacctg

SEQ ID NO: 32908 - DNA, 20 bp, Homo sapiens
cttaaatagggacctgtatg

SEQ ID NO: 32909 - DNA, 21 bp, Homo sapiens
cttaaatagggacctgtatga

SEQ ID NO: 32910 - DNA, 19 bp, Homo sapiens
ttaaatagggacctgtatg

SEQ ID NO: 32911 - DNA, 20 bp, Homo sapiens
ttaaatagggacctgtatga

SEQ ID NO: 32912 - DNA, 25 bp, Homo sapiens
ttaaatagggacctgtatgaatggc

SEQ ID NO: 32913 - DNA, 18 bp, Homo sapiens
taaatagggacctgtatg

SEQ ID NO: 32914 - DNA, 19 bp, Homo sapiens
taaatagggacctgtatga

SEQ ID NO: 32915 - DNA, 24 bp, Homo sapiens
taaatagggacctgtatgaatggc

SEQ ID NO: 32916 - DNA, 17 bp, Homo sapiens
aaatagggacctgtatg

SEQ ID NO: 32917 - DNA, 16 bp, Homo sapiens
aatagggacctgtatg

SEQ ID NO: 32918 - DNA, 17 bp, Homo sapiens
aatagggacctgtatga

SEQ ID NO: 32919 - DNA, 22 bp, Homo sapiens
aatagggacctgtatgaatggc

SEQ ID NO: 32920 - DNA, 23 bp, Homo sapiens
aatagggacctgtatgaatggct

SEQ ID NO: 32921 - DNA, 16 bp, Homo sapiens
atagggacctgtatga

SEQ ID NO: 32922 - DNA, 21 bp, Homo sapiens
atagggacctgtatgaatggc

SEQ ID NO: 32923 - DNA, 22 bp, Homo sapiens
atagggacctgtatgaatggct

SEQ ID NO: 32924 - DNA, 16 bp, Homo sapiens
tagggacctgtatgaa

SEQ ID NO: 32925 - DNA, 18 bp, Homo sapiens
tagggacctgtatgaatg

SEQ ID NO: 32926 - DNA, 20 bp, Homo sapiens
tagggacctgtatgaatggc

SEQ ID NO: 32927 - DNA, 21 bp, Homo sapiens
tagggacctgtatgaatggct

SEQ ID NO: 32928 - DNA, 22 bp, Homo sapiens
tagggacctgtatgaatggctc

SEQ ID NO: 32929 - DNA, 30 bp, Homo sapiens
tagggacctgtatgaatggctccacgaggg

SEQ ID NO: 32930 - DNA, 16 bp, Homo sapiens
agggacctgtatgaat

SEQ ID NO: 32931 - DNA, 17 bp, Homo sapiens
agggacctgtatgaatg

SEQ ID NO: 32932 - DNA, 18 bp, Homo sapiens
agggacctgtatgaatgg

SEQ ID NO: 32933 - DNA, 19 bp, Homo sapiens
agggacctgtatgaatggc

SEQ ID NO: 32934 - DNA, 20 bp, Homo sapiens
agggacctgtatgaatggct

SEQ ID NO: 32935 - DNA, 21 bp, Homo sapiens
agggacctgtatgaatggctc

SEQ ID NO: 32936 - DNA, 22 bp, Homo sapiens
agggacctgtatgaatggctcc

SEQ ID NO: 32937 - DNA, 25 bp, Homo sapiens
agggacctgtatgaatggctccacg

SEQ ID NO: 32938 - DNA, 16 bp, Homo sapiens
gggacctgtatgaatg

SEQ ID NO: 32939 - DNA, 17 bp, Homo sapiens
gggacctgtatgaatgg

SEQ ID NO: 32940 - DNA, 18 bp, Homo sapiens
gggacctgtatgaatggc

SEQ ID NO: 32941 - DNA, 19 bp, Homo sapiens
gggacctgtatgaatggct

SEQ ID NO: 32942 - DNA, 20 bp, Homo sapiens
gggacctgtatgaatggctc

SEQ ID NO: 32943 - DNA, 21 bp, Homo sapiens
gggacctgtatgaatggctcc

SEQ ID NO: 32944 - DNA, 17 bp, Homo sapiens
ggacctgtatgaatggc

SEQ ID NO: 32945 - DNA, 18 bp, Homo sapiens
ggacctgtatgaatggct

SEQ ID NO: 32946 - DNA, 19 bp, Homo sapiens
ggacctgtatgaatggctc

SEQ ID NO: 32947 - DNA, 20 bp, Homo sapiens
ggacctgtatgaatggctcc

SEQ ID NO: 32948 - DNA, 19 bp, Homo sapiens
gacctgtatgaatggctcc

SEQ ID NO: 32949 - DNA, 22 bp, Homo sapiens
gacctgtatgaatggctccacg

SEQ ID NO: 32950 - DNA, 21 bp, Homo sapiens
acctgtatgaatggctccacg

SEQ ID NO: 32951 - DNA, 16 bp, Homo sapiens
ctgtatgaatggctcc

SEQ ID NO: 32952 - DNA, 17 bp, Homo sapiens
ctgtatgaatggctcca

SEQ ID NO: 32953 - DNA, 18 bp, Homo sapiens
ctgtatgaatggctccac

SEQ ID NO: 32954 - DNA, 19 bp, Homo sapiens
ctgtatgaatggctccacg

SEQ ID NO: 32955 - DNA, 20 bp, Homo sapiens
ctgtatgaatggctccacga

SEQ ID NO: 32956 - DNA, 21 bp, Homo sapiens
ctgtatgaatggctccacgag

SEQ ID NO: 32957 - DNA, 22 bp, Homo sapiens
ctgtatgaatggctccacgagg

SEQ ID NO: 32958 - DNA, 25 bp, Homo sapiens
ctgtatgaatggctccacgagggtt

SEQ ID NO: 32959 - DNA, 21 bp, Homo sapiens
agggttcagctgtctcttact

SEQ ID NO: 32960 - DNA, 20 bp, Homo sapiens
gctgtctcttacttttaacc

SEQ ID NO: 32961 - DNA, 22 bp, Homo sapiens
gctgtctcttacttttaaccag

SEQ ID NO: 32962 - DNA, 23 bp, Homo sapiens
gctgtctcttacttttaaccagt

SEQ ID NO: 32963 - DNA, 24 bp, Homo sapiens
gctgtctcttacttttaaccagtg

SEQ ID NO: 32964 - DNA, 19 bp, Homo sapiens
ctgtctcttacttttaacc

SEQ ID NO: 32965 - DNA, 21 bp, Homo sapiens
ctgtctcttacttttaaccag

SEQ ID NO: 32966 - DNA, 19 bp, Homo sapiens
gtctcttacttttaaccag

SEQ ID NO: 32967 - DNA, 20 bp, Homo sapiens
gtctcttacttttaaccagt

SEQ ID NO: 32968 - DNA, 21 bp, Homo sapiens
gtctcttacttttaaccagtg

SEQ ID NO: 32969 - DNA, 18 bp, Homo sapiens
tctcttacttttaaccag

SEQ ID NO: 32970 - DNA, 29 bp, Homo sapiens
tctcttacttttaaccagtgaaattgacc

SEQ ID NO: 32971 - DNA, 28 bp, Homo sapiens
ctcttacttttaaccagtgaaattgacc

SEQ ID NO: 32972 - DNA, 27 bp, Homo sapiens
tcttacttttaaccagtgaaattgacc

SEQ ID NO: 32973 - DNA, 25 bp, Homo sapiens
ttacttttaaccagtgaaattgacc

SEQ ID NO: 32974 - DNA, 21 bp, Homo sapiens
ttttaaccagtgaaattgacc

SEQ ID NO: 32975 - DNA, 22 bp, Homo sapiens
ttttaaccagtgaaattgacct

SEQ ID NO: 32976 - DNA, 24 bp, Homo sapiens
ttttaaccagtgaaattgacctgc

SEQ ID NO: 32977 - DNA, 19 bp, Homo sapiens
tttaaccagtgaaattgac

SEQ ID NO: 32978 - DNA, 20 bp, Homo sapiens
tttaaccagtgaaattgacc

SEQ ID NO: 32979 - DNA, 21 bp, Homo sapiens
tttaaccagtgaaattgacct

SEQ ID NO: 32980 - DNA, 22 bp, Homo sapiens
tttaaccagtgaaattgacctg

SEQ ID NO: 32981 - DNA, 23 bp, Homo sapiens
tttaaccagtgaaattgacctgc

SEQ ID NO: 32982 - DNA, 24 bp, Homo sapiens
tttaaccagtgaaattgacctgcc

SEQ ID NO: 32983 - DNA, 25 bp, Homo sapiens
tttaaccagtgaaattgacctgccc

SEQ ID NO: 32984 - DNA, 19 bp, Homo sapiens
ttaaccagtgaaattgacc

SEQ ID NO: 32985 - DNA, 20 bp, Homo sapiens
ttaaccagtgaaattgacct

SEQ ID NO: 32986 - DNA, 21 bp, Homo sapiens
ttaaccagtgaaattgacctg

SEQ ID NO: 32987 - DNA, 22 bp, Homo sapiens
ttaaccagtgaaattgacctgc

SEQ ID NO: 32988 - DNA, 26 bp, Homo sapiens
ttaaccagtgaaattgacctgcccgt

SEQ ID NO: 32989 - DNA, 27 bp, Homo sapiens
ttaaccagtgaaattgacctgcccgtg

SEQ ID NO: 32990 - DNA, 30 bp, Homo sapiens
ttaaccagtgaaattgacctgcccgtgaag

SEQ ID NO: 32991 - DNA, 18 bp, Homo sapiens
taaccagtgaaattgacc

SEQ ID NO: 32992 - DNA, 19 bp, Homo sapiens
aaccagtgaaattgacctg

SEQ ID NO: 32993 - DNA, 18 bp, Homo sapiens
accagtgaaattgacctg

SEQ ID NO: 32994 - DNA, 21 bp, Homo sapiens
agtgaaattgacctgcccgtg

SEQ ID NO: 32995 - DNA, 24 bp, Homo sapiens
agtgaaattgacctgcccgtgaag

SEQ ID NO: 32996 - DNA, 25 bp, Homo sapiens
agtgaaattgacctgcccgtgaaga

SEQ ID NO: 32997 - DNA, 26 bp, Homo sapiens
agtgaaattgacctgcccgtgaagag

SEQ ID NO: 32998 - DNA, 16 bp, Homo sapiens
gtgaaattgacctgcc

SEQ ID NO: 32999 - DNA, 17 bp, Homo sapiens
gtgaaattgacctgccc

SEQ ID NO: 33000 - DNA, 19 bp, Homo sapiens
gtgaaattgacctgcccgt

SEQ ID NO: 33001 - DNA, 20 bp, Homo sapiens
gtgaaattgacctgcccgtg

SEQ ID NO: 33002 - DNA, 21 bp, Homo sapiens
gtgaaattgacctgcccgtga

SEQ ID NO: 33003 - DNA, 23 bp, Homo sapiens
gtgaaattgacctgcccgtgaag

SEQ ID NO: 33004 - DNA, 24 bp, Homo sapiens
gtgaaattgacctgcccgtgaaga

SEQ ID NO: 33005 - DNA, 25 bp, Homo sapiens
gtgaaattgacctgcccgtgaagag

SEQ ID NO: 33006 - DNA, 16 bp, Homo sapiens
tgaaattgacctgccc

SEQ ID NO: 33007 - DNA, 17 bp, Homo sapiens
tgaaattgacctgcccg

SEQ ID NO: 33008 - DNA, 19 bp, Homo sapiens
tgaaattgacctgcccgtg

SEQ ID NO: 33009 - DNA, 22 bp, Homo sapiens
tgaaattgacctgcccgtgaag

SEQ ID NO: 33010 - DNA, 23 bp, Homo sapiens
tgaaattgacctgcccgtgaaga

SEQ ID NO: 33011 - DNA, 24 bp, Homo sapiens
tgaaattgacctgcccgtgaagag

SEQ ID NO: 33012 - DNA, 18 bp, Homo sapiens
gaaattgacctgcccgtg

SEQ ID NO: 33013 - DNA, 21 bp, Homo sapiens
gaaattgacctgcccgtgaag

SEQ ID NO: 33014 - DNA, 22 bp, Homo sapiens
gaaattgacctgcccgtgaaga

SEQ ID NO: 33015 - DNA, 23 bp, Homo sapiens
gaaattgacctgcccgtgaagag

SEQ ID NO: 33016 - DNA, 17 bp, Homo sapiens
aaattgacctgcccgtg

SEQ ID NO: 33017 - DNA, 20 bp, Homo sapiens
aaattgacctgcccgtgaag

SEQ ID NO: 33018 - DNA, 21 bp, Homo sapiens
aaattgacctgcccgtgaaga

SEQ ID NO: 33019 - DNA, 22 bp, Homo sapiens
aaattgacctgcccgtgaagag

SEQ ID NO: 33020 - DNA, 22 bp, Homo sapiens
gcgggcataacacagcaagacg

SEQ ID NO: 33021 - DNA, 16 bp, Homo sapiens
aagaccctatggagct

SEQ ID NO: 33022 - DNA, 22 bp, Homo sapiens
aacccacaggtcctaaactacc

SEQ ID NO: 33023 - DNA, 23 bp, Homo sapiens
aacccacaggtcctaaactacca

SEQ ID NO: 33024 - DNA, 21 bp, Homo sapiens
acccacaggtcctaaactacc

SEQ ID NO: 33025 - DNA, 22 bp, Homo sapiens
acccacaggtcctaaactacca

SEQ ID NO: 33026 - DNA, 20 bp, Homo sapiens
cccacaggtcctaaactacc

SEQ ID NO: 33027 - DNA, 21 bp, Homo sapiens
cccacaggtcctaaactacca

SEQ ID NO: 33028 - DNA, 17 bp, Homo sapiens
cacaggtcctaaactac

SEQ ID NO: 33029 - DNA, 18 bp, Homo sapiens
cacaggtcctaaactacc

SEQ ID NO: 33030 - DNA, 28 bp, Homo sapiens
caaacctgcattaaaaatttcggttggg

SEQ ID NO: 33031 - DNA, 20 bp, Homo sapiens
ctgcattaaaaatttcggtt

SEQ ID NO: 33032 - DNA, 22 bp, Homo sapiens
ctgcattaaaaatttcggttgg

SEQ ID NO: 33033 - DNA, 23 bp, Homo sapiens
ctgcattaaaaatttcggttggg

SEQ ID NO: 33034 - DNA, 22 bp, Homo sapiens
tgcattaaaaatttcggttggg

SEQ ID NO: 33035 - DNA, 21 bp, Homo sapiens
gcattaaaaatttcggttggg

SEQ ID NO: 33036 - DNA, 20 bp, Homo sapiens
cattaaaaatttcggttggg

SEQ ID NO: 33037 - DNA, 19 bp, Homo sapiens
attaaaaatttcggttggg

SEQ ID NO: 33038 - DNA, 18 bp, Homo sapiens
ttaaaaatttcggttggg

SEQ ID NO: 33039 - DNA, 16 bp, Homo sapiens
taaaaatttcggttgg

SEQ ID NO: 33040 - DNA, 17 bp, Homo sapiens
taaaaatttcggttggg

SEQ ID NO: 33041 - DNA, 18 bp, Homo sapiens
taaaaatttcggttgggg

SEQ ID NO: 33042 - DNA, 16 bp, Homo sapiens
aaaaatttcggttggg

SEQ ID NO: 33043 - DNA, 17 bp, Homo sapiens
aaaaatttcggttgggg

SEQ ID NO: 33044 - DNA, 16 bp, Homo sapiens
aaaatttcggttgggg

SEQ ID NO: 33045 - DNA, 16 bp, Homo sapiens
aatttcggttggggcg

SEQ ID NO: 33046 - DNA, 26 bp, Homo sapiens
tttcggttggggcgacctcggagcag

SEQ ID NO: 33047 - DNA, 16 bp, Homo sapiens
ttcggttggggcgacc

SEQ ID NO: 33048 - DNA, 25 bp, Homo sapiens
ttcggttggggcgacctcggagcag

SEQ ID NO: 33049 - DNA, 22 bp, Homo sapiens
tcggttggggcgacctcggagc

SEQ ID NO: 33050 - DNA, 23 bp, Homo sapiens
tcggttggggcgacctcggagca

SEQ ID NO: 33051 - DNA, 24 bp, Homo sapiens
tcggttggggcgacctcggagcag

SEQ ID NO: 33052 - DNA, 22 bp, Homo sapiens
cggttggggcgacctcggagca

SEQ ID NO: 33053 - DNA, 23 bp, Homo sapiens
cggttggggcgacctcggagcag

SEQ ID NO: 33054 - DNA, 19 bp, Homo sapiens
ggttggggcgacctcggag

SEQ ID NO: 33055 - DNA, 20 bp, Homo sapiens
ggttggggcgacctcggagc

SEQ ID NO: 33056 - DNA, 21 bp, Homo sapiens
ggttggggcgacctcggagca

SEQ ID NO: 33057 - DNA, 22 bp, Homo sapiens
ggttggggcgacctcggagcag

SEQ ID NO: 33058 - DNA, 20 bp, Homo sapiens
gttggggcgacctcggagca

SEQ ID NO: 33059 - DNA, 21 bp, Homo sapiens
gttggggcgacctcggagcag

SEQ ID NO: 33060 - DNA, 17 bp, Homo sapiens
ggggcgacctcggagca

SEQ ID NO: 33061 - DNA, 18 bp, Homo sapiens
ggggcgacctcggagcag

SEQ ID NO: 33062 - DNA, 22 bp, Homo sapiens
ggggcgacctcggagcagaacc

SEQ ID NO: 33063 - DNA, 23 bp, Homo sapiens
ggggcgacctcggagcagaaccc

SEQ ID NO: 33064 - DNA, 17 bp, Homo sapiens
gggcgacctcggagcag

SEQ ID NO: 33065 - DNA, 21 bp, Homo sapiens
gggcgacctcggagcagaacc

SEQ ID NO: 33066 - DNA, 22 bp, Homo sapiens
gggcgacctcggagcagaaccc

SEQ ID NO: 33067 - DNA, 20 bp, Homo sapiens
ggcgacctcggagcagaacc

SEQ ID NO: 33068 - DNA, 17 bp, Homo sapiens
gacctcggagcagaacc

SEQ ID NO: 33069 - DNA, 18 bp, Homo sapiens
gacctcggagcagaaccc

SEQ ID NO: 33070 - DNA, 22 bp, Homo sapiens
ctcggagcagaacccaacctcc

SEQ ID NO: 33071 - DNA, 21 bp, Homo sapiens
tcggagcagaacccaacctcc

SEQ ID NO: 33072 - DNA, 20 bp, Homo sapiens
cggagcagaacccaacctcc

SEQ ID NO: 33073 - DNA, 16 bp, Homo sapiens
gcagaacccaacctcc

SEQ ID NO: 33074 - DNA, 16 bp, Homo sapiens
cagaacccaacctccg

SEQ ID NO: 33075 - DNA, 30 bp, Homo sapiens
gaacccaacctccgagcagtacatgctaag

SEQ ID NO: 33076 - DNA, 16 bp, Homo sapiens
caacctccgagcagta

SEQ ID NO: 33077 - DNA, 18 bp, Homo sapiens
caacctccgagcagtaca

SEQ ID NO: 33078 - DNA, 25 bp, Homo sapiens
caacctccgagcagtacatgctaag

SEQ ID NO: 33079 - DNA, 28 bp, Homo sapiens
caacctccgagcagtacatgctaagact

SEQ ID NO: 33080 - DNA, 30 bp, Homo sapiens; identical to SEQ ID NO: 11251

SEQ ID NO: 33081 - DNA, 26 bp, Homo sapiens
aacctccgagcagtacatgctaagac

SEQ ID NO: 33082 - DNA, 27 bp, Homo sapiens
aacctccgagcagtacatgctaagact

SEQ ID NO: 33083 - DNA, 29 bp, Homo sapiens
aacctccgagcagtacatgctaagacttc

SEQ ID NO: 33084 - DNA, 26 bp, Homo sapiens
ctccgagcagtacatgctaagacttc

SEQ ID NO: 33085 - DNA, 30 bp, Homo sapiens
tccgagcagtacatgctaagacttcaccag

SEQ ID NO: 33086 - DNA, 21 bp, Homo sapiens
gtacatgctaagacttcacca

SEQ ID NO: 33087 - DNA, 22 bp, Homo sapiens
gtacatgctaagacttcaccag

SEQ ID NO: 33088 - DNA, 23 bp, Homo sapiens
gtacatgctaagacttcaccagt

SEQ ID NO: 33089 - DNA, 30 bp, Homo sapiens
gtacatgctaagacttcaccagtcaaagcg

SEQ ID NO: 33090 - DNA, 16 bp, Homo sapiens
gctaagacttcaccag

SEQ ID NO: 33091 - DNA, 17 bp, Homo sapiens
gctaagacttcaccagt

SEQ ID NO: 33092 - DNA, 22 bp, Homo sapiens
gctaagacttcaccagtcaaag

SEQ ID NO: 33093 - DNA, 20 bp, Homo sapiens
cttcaccagtcaaagcgaac

SEQ ID NO: 33094 - DNA, 21 bp, Homo sapiens
cttcaccagtcaaagcgaact

SEQ ID NO: 33095 - DNA, 22 bp, Homo sapiens
cttcaccagtcaaagcgaacta

SEQ ID NO: 33096 - DNA, 24 bp, Homo sapiens
cttcaccagtcaaagcgaactact

SEQ ID NO: 33097 - DNA, 16 bp, Homo sapiens
ttcaccagtcaaagcg

SEQ ID NO: 33098 - DNA, 17 bp, Homo sapiens
ttcaccagtcaaagcga

SEQ ID NO: 33099 - DNA, 20 bp, Homo sapiens
ttcaccagtcaaagcgaact

SEQ ID NO: 33100 - DNA, 21 bp, Homo sapiens
ttcaccagtcaaagcgaacta

SEQ ID NO: 33101 - DNA, 22 bp, Homo sapiens
ttcaccagtcaaagcgaactac

SEQ ID NO: 33102 - DNA, 23 bp, Homo sapiens
ttcaccagtcaaagcgaactact

SEQ ID NO: 33103 - DNA, 24 bp, Homo sapiens
ttcaccagtcaaagcgaactacta

SEQ ID NO: 33104 - DNA, 22 bp, Homo sapiens
tcaccagtcaaagcgaactact

SEQ ID NO: 33105 - DNA, 22 bp, Homo sapiens
gtcaaagcgaactactatactc

SEQ ID NO: 33106 - DNA, 27 bp, Homo sapiens
gtcaaagcgaactactatactcaattg

SEQ ID NO: 33107 - DNA, 18 bp, Homo sapiens
tactatactcaattgatc

SEQ ID NO: 33108 - DNA, 19 bp, Homo sapiens
tactatactcaattgatcc

SEQ ID NO: 33109 - DNA, 20 bp, Homo sapiens
tactatactcaattgatcca

SEQ ID NO: 33110 - DNA, 18 bp, Homo sapiens
actatactcaattgatcc

SEQ ID NO: 33111 - DNA, 24 bp, Homo sapiens
ctcaattgatccaataacttgacc

SEQ ID NO: 33112 - DNA, 22 bp, Homo sapiens
caattgatccaataacttgacc

SEQ ID NO: 33113 - DNA, 23 bp, Homo sapiens
caattgatccaataacttgacca

SEQ ID NO: 33114 - DNA, 21 bp, Homo sapiens
aattgatccaataacttgacc

SEQ ID NO: 33115 - DNA, 22 bp, Homo sapiens
aattgatccaataacttgacca

SEQ ID NO: 33116 - DNA, 25 bp, Homo sapiens
aattgatccaataacttgaccaacg

SEQ ID NO: 33117 - DNA, 20 bp, Homo sapiens
attgatccaataacttgacc

SEQ ID NO: 33118 - DNA, 21 bp, Homo sapiens
attgatccaataacttgacca

SEQ ID NO: 33119 - DNA, 24 bp, Homo sapiens
attgatccaataacttgaccaacg

SEQ ID NO: 33120 - DNA, 25 bp, Homo sapiens
attgatccaataacttgaccaacgg

SEQ ID NO: 33121 - DNA, 19 bp, Homo sapiens
ttgatccaataacttgacc

SEQ ID NO: 33122 - DNA, 20 bp, Homo sapiens
ttgatccaataacttgacca

SEQ ID NO: 33123 - DNA, 23 bp, Homo sapiens
ttgatccaataacttgaccaacg

SEQ ID NO: 33124 - DNA, 18 bp, Homo sapiens
tgatccaataacttgacc

SEQ ID NO: 33125 - DNA, 19 bp, Homo sapiens
tgatccaataacttgacca

SEQ ID NO: 33126 - DNA, 22 bp, Homo sapiens
tgatccaataacttgaccaacg

SEQ ID NO: 33127 - DNA, 17 bp, Homo sapiens
gatccaataacttgacc

SEQ ID NO: 33128 - DNA, 18 bp, Homo sapiens
gatccaataacttgacca

SEQ ID NO: 33129 - DNA, 19 bp, Homo sapiens
gatccaataacttgaccaa

SEQ ID NO: 33130 - DNA, 20 bp, Homo sapiens
gatccaataacttgaccaac

SEQ ID NO: 33131 - DNA, 21 bp, Homo sapiens
gatccaataacttgaccaacg

SEQ ID NO: 33132 - DNA, 22 bp, Homo sapiens
gatccaataacttgaccaacgg

SEQ ID NO: 33133 - DNA, 23 bp, Homo sapiens
gatccaataacttgaccaacgga

SEQ ID NO: 33134 - DNA, 24 bp, Homo sapiens
gatccaataacttgaccaacggaa

SEQ ID NO: 33135 - DNA, 25 bp, Homo sapiens
gatccaataacttgaccaacggaac

SEQ ID NO: 33136 - DNA, 26 bp, Homo sapiens
gatccaataacttgaccaacggaaca

SEQ ID NO: 33137 - DNA, 29 bp, Homo sapiens
gatccaataacttgaccaacggaacaagt

SEQ ID NO: 33138 - DNA, 30 bp, Homo sapiens
gatccaataacttgaccaacggaacaagtt

SEQ ID NO: 33139 - DNA, 20 bp, Homo sapiens
atccaataacttgaccaacg

SEQ ID NO: 33140 - DNA, 21 bp, Homo sapiens
atccaataacttgaccaacgg

SEQ ID NO: 33141 - DNA, 18 bp, Homo sapiens
ccaataacttgaccaacg

SEQ ID NO: 33142 - DNA, 19 bp, Homo sapiens
ccaataacttgaccaacgg

SEQ ID NO: 33143 - DNA, 17 bp, Homo sapiens
caataacttgaccaacg

SEQ ID NO: 33144 - DNA, 18 bp, Homo sapiens
caataacttgaccaacgg

SEQ ID NO: 33145 - DNA, 22 bp, Homo sapiens
caataacttgaccaacggaaca

SEQ ID NO: 33146 - DNA, 24 bp, Homo sapiens
caataacttgaccaacggaacaag

SEQ ID NO: 33147 - DNA, 16 bp, Homo sapiens
aataacttgaccaacg

SEQ ID NO: 33148 - DNA, 17 bp, Homo sapiens
aataacttgaccaacgg

SEQ ID NO: 33149 - DNA, 18 bp, Homo sapiens
aataacttgaccaacgga

SEQ ID NO: 33150 - DNA, 19 bp, Homo sapiens
aataacttgaccaacggaa

SEQ ID NO: 33151 - DNA, 20 bp, Homo sapiens
aataacttgaccaacggaac

SEQ ID NO: 33152 - DNA, 21 bp, Homo sapiens
aataacttgaccaacggaaca

SEQ ID NO: 33153 - DNA, 22 bp, Homo sapiens
aataacttgaccaacggaacaa

SEQ ID NO: 33154 - DNA, 23 bp, Homo sapiens
aataacttgaccaacggaacaag

SEQ ID NO: 33155 - DNA, 24 bp, Homo sapiens
aataacttgaccaacggaacaagt

SEQ ID NO: 33156 - DNA, 16 bp, Homo sapiens
ataacttgaccaacgg

SEQ ID NO: 33157 - DNA, 17 bp, Homo sapiens
ataacttgaccaacgga

SEQ ID NO: 33158 - DNA, 18 bp, Homo sapiens
ataacttgaccaacggaa

SEQ ID NO: 33159 - DNA, 19 bp, Homo sapiens
ataacttgaccaacggaac

SEQ ID NO: 33160 - DNA, 20 bp, Homo sapiens
ataacttgaccaacggaaca

SEQ ID NO: 33161 - DNA, 21 bp, Homo sapiens
ataacttgaccaacggaacaa

SEQ ID NO: 33162 - DNA, 22 bp, Homo sapiens
ataacttgaccaacggaacaag

SEQ ID NO: 33163 - DNA, 23 bp, Homo sapiens
ataacttgaccaacggaacaagt

SEQ ID NO: 33164 - DNA, 16 bp, Homo sapiens
taacttgaccaacgga

SEQ ID NO: 33165 - DNA, 17 bp, Homo sapiens
taacttgaccaacggaa

SEQ ID NO: 33166 - DNA, 18 bp, Homo sapiens
taacttgaccaacggaac

SEQ ID NO: 33167 - DNA, 19 bp, Homo sapiens
taacttgaccaacggaaca

SEQ ID NO: 33168 - DNA, 20 bp, Homo sapiens
taacttgaccaacggaacaa

SEQ ID NO: 33169 - DNA, 21 bp, Homo sapiens
taacttgaccaacggaacaag

SEQ ID NO: 33170 - DNA, 22 bp, Homo sapiens
taacttgaccaacggaacaagt

SEQ ID NO: 33171 - DNA, 16 bp, Homo sapiens
aacttgaccaacggaa

SEQ ID NO: 33172 - DNA, 17 bp, Homo sapiens
aacttgaccaacggaac

SEQ ID NO: 33173 - DNA, 18 bp, Homo sapiens
aacttgaccaacggaaca

SEQ ID NO: 33174 - DNA, 19 bp, Homo sapiens
aacttgaccaacggaacaa

SEQ ID NO: 33175 - DNA, 20 bp, Homo sapiens
aacttgaccaacggaacaag

SEQ ID NO: 33176 - DNA, 21 bp, Homo sapiens
aacttgaccaacggaacaagt

SEQ ID NO: 33177 - DNA, 16 bp, Homo sapiens
acttgaccaacggaac

SEQ ID NO: 33178 - DNA, 17 bp, Homo sapiens
acttgaccaacggaaca

SEQ ID NO: 33179 - DNA, 19 bp, Homo sapiens
acttgaccaacggaacaag

SEQ ID NO: 33180 - DNA, 16 bp, Homo sapiens
cttgaccaacggaaca

SEQ ID NO: 33181 - DNA, 23 bp, Homo sapiens
cttgaccaacggaacaagttacc

SEQ ID NO: 33182 - DNA, 24 bp, Homo sapiens
cttgaccaacggaacaagttaccc

SEQ ID NO: 33183 - DNA, 18 bp, Homo sapiens
caacggaacaagttaccc

SEQ ID NO: 33184 - DNA, 21 bp, Homo sapiens
ggaacaagttaccctagggat

SEQ ID NO: 33185 - DNA, 19 bp, Homo sapiens
gaacaagttaccctaggga

SEQ ID NO: 33186 - DNA, 20 bp, Homo sapiens
gaacaagttaccctagggat

SEQ ID NO: 33187 - DNA, 21 bp, Homo sapiens
gaacaagttaccctagggata

SEQ ID NO: 33188 - DNA, 16 bp, Homo sapiens
aagttaccctagggat

SEQ ID NO: 33189 - DNA, 23 bp, Homo sapiens
aagttaccctagggataacagcg

SEQ ID NO: 33190 - DNA, 17 bp, Homo sapiens
ctagggataacagcgca

SEQ ID NO: 33191 - DNA, 28 bp, Homo sapiens
tagggataacagcgcaatcctattctag

SEQ ID NO: 33192 - DNA, 17 bp, Homo sapiens
gcgcaatcctattctag

SEQ ID NO: 33193 - DNA, 21 bp, Homo sapiens
gcgcaatcctattctagagtc

SEQ ID NO: 33194 - DNA, 22 bp, Homo sapiens
gcgcaatcctattctagagtcc

SEQ ID NO: 33195 - DNA, 23 bp, Homo sapiens
gcgcaatcctattctagagtcca

SEQ ID NO: 33196 - DNA, 28 bp, Homo sapiens
caatcctattctagagtccatatcaaca

SEQ ID NO: 33197 - DNA, 29 bp, Homo sapiens
aatcctattctagagtccatatcaacaat

SEQ ID NO: 33198 - DNA, 17 bp, Homo sapiens
tagagtccatatcaaca

SEQ ID NO: 33199 - DNA, 20 bp, Homo sapiens
tagagtccatatcaacaata

SEQ ID NO: 33200 - DNA, 21 bp, Homo sapiens
tagagtccatatcaacaatag

SEQ ID NO: 33201 - DNA, 16 bp, Homo sapiens
agagtccatatcaaca

SEQ ID NO: 33202 - DNA, 16 bp, Homo sapiens
agtccatatcaacaat

SEQ ID NO: 33203 - DNA, 17 bp, Homo sapiens
agtccatatcaacaata

SEQ ID NO: 33204 - DNA, 18 bp, Homo sapiens
agtccatatcaacaatag

SEQ ID NO: 33205 - DNA, 26 bp, Homo sapiens
agtccatatcaacaatagggtttacg

SEQ ID NO: 33206 - DNA, 30 bp, Homo sapiens
agtccatatcaacaatagggtttacgacct

SEQ ID NO: 33207 - DNA, 22 bp, Homo sapiens
catatcaacaatagggtttacg

SEQ ID NO: 33208 - DNA, 17 bp, Homo sapiens
caacaatagggtttacg

SEQ ID NO: 33209 - DNA, 18 bp, Homo sapiens
caacaatagggtttacga

SEQ ID NO: 33210 - DNA, 19 bp, Homo sapiens
caacaatagggtttacgac

SEQ ID NO: 33211 - DNA, 30 bp, Homo sapiens; identical to SEQ ID NO: 28742

SEQ ID NO: 33212 - DNA, 19 bp, Homo sapiens
aacaatagggtttacgacc

SEQ ID NO: 33213 - DNA, 29 bp, Homo sapiens
aacaatagggtttacgacctcgatgttgg

SEQ ID NO: 33214 - DNA, 28 bp, Homo sapiens
acaatagggtttacgacctcgatgttgg

SEQ ID NO: 33215 - DNA, 27 bp, Homo sapiens
caatagggtttacgacctcgatgttgg

SEQ ID NO: 33216 - DNA, 29 bp, Homo sapiens
aatagggtttacgacctcgatgttggatc

SEQ ID NO: 33217 - DNA, 25 bp, Homo sapiens
atagggtttacgacctcgatgttgg

SEQ ID NO: 33218 - DNA, 30 bp, Homo sapiens
atagggtttacgacctcgatgttggatcag

SEQ ID NO: 33219 - DNA, 29 bp, Homo sapiens
tagggtttacgacctcgatgttggatcag

SEQ ID NO: 33220 - DNA, 23 bp, Homo sapiens
agggtttacgacctcgatgttgg

SEQ ID NO: 33221 - DNA, 22 bp, Homo sapiens
gggtttacgacctcgatgttgg

SEQ ID NO: 33222 - DNA, 20 bp, Homo sapiens
ggtttacgacctcgatgttg

SEQ ID NO: 33223 - DNA, 21 bp, Homo sapiens
ggtttacgacctcgatgttgg

SEQ ID NO: 33224 - DNA, 23 bp, Homo sapiens
ggtttacgacctcgatgttggat

SEQ ID NO: 33225 - DNA, 24 bp, Homo sapiens
ggtttacgacctcgatgttggatc

SEQ ID NO: 33226 - DNA, 25 bp, Homo sapiens
ggtttacgacctcgatgttggatca

SEQ ID NO: 33227 - DNA, 26 bp, Homo sapiens
ggtttacgacctcgatgttggatcag

SEQ ID NO: 33228 - DNA, 27 bp, Homo sapiens
ggtttacgacctcgatgttggatcagg

SEQ ID NO: 33229 - DNA, 29 bp, Homo sapiens
ggtttacgacctcgatgttggatcaggac

SEQ ID NO: 33230 - DNA, 20 bp, Homo sapiens
gtttacgacctcgatgttgg

SEQ ID NO: 33231 - DNA, 21 bp, Homo sapiens
gtttacgacctcgatgttgga

SEQ ID NO: 33232 - DNA, 22 bp, Homo sapiens
gtttacgacctcgatgttggat

SEQ ID NO: 33233 - DNA, 23 bp, Homo sapiens
gtttacgacctcgatgttggatc

SEQ ID NO: 33234 - DNA, 24 bp, Homo sapiens
gtttacgacctcgatgttggatca

SEQ ID NO: 33235 - DNA, 25 bp, Homo sapiens
gtttacgacctcgatgttggatcag

SEQ ID NO: 33236 - DNA, 26 bp, Homo sapiens
gtttacgacctcgatgttggatcagg

SEQ ID NO: 33237 - DNA, 27 bp, Homo sapiens
gtttacgacctcgatgttggatcagga

SEQ ID NO: 33238 - DNA, 28 bp, Homo sapiens
gtttacgacctcgatgttggatcaggac

SEQ ID NO: 33239 - DNA, 29 bp, Homo sapiens
gtttacgacctcgatgttggatcaggaca

SEQ ID NO: 33240 - DNA, 19 bp, Homo sapiens
tttacgacctcgatgttgg

SEQ ID NO: 33241 - DNA, 20 bp, Homo sapiens
tttacgacctcgatgttgga

SEQ ID NO: 33242 - DNA, 21 bp, Homo sapiens
tttacgacctcgatgttggat

SEQ ID NO: 33243 - DNA, 22 bp, Homo sapiens
tttacgacctcgatgttggatc

SEQ ID NO: 33244 - DNA, 23 bp, Homo sapiens
tttacgacctcgatgttggatca

SEQ ID NO: 33245 - DNA, 24 bp, Homo sapiens
tttacgacctcgatgttggatcag

SEQ ID NO: 33246 - DNA, 27 bp, Homo sapiens
tttacgacctcgatgttggatcaggac

SEQ ID NO: 33247 - DNA, 22 bp, Homo sapiens
tacgacctcgatgttggatcag

SEQ ID NO: 33248 - DNA, 21 bp, Homo sapiens
acgacctcgatgttggatcag

SEQ ID NO: 33249 - DNA, 20 bp, Homo sapiens
cgacctcgatgttggatcag

SEQ ID NO: 33250 - DNA, 16 bp, Homo sapiens
acctcgatgttggatc

SEQ ID NO: 33251 - DNA, 17 bp, Homo sapiens
acctcgatgttggatca

SEQ ID NO: 33252 - DNA, 18 bp, Homo sapiens
acctcgatgttggatcag

SEQ ID NO: 33253 - DNA, 19 bp, Homo sapiens
acctcgatgttggatcagg

SEQ ID NO: 33254 - DNA, 20 bp, Homo sapiens
acctcgatgttggatcagga

SEQ ID NO: 33255 - DNA, 21 bp, Homo sapiens
acctcgatgttggatcaggac

SEQ ID NO: 33256 - DNA, 22 bp, Homo sapiens
acctcgatgttggatcaggaca

SEQ ID NO: 33257 - DNA, 17 bp, Homo sapiens
cctcgatgttggatcag

SEQ ID NO: 33258 - DNA, 18 bp, Homo sapiens
cctcgatgttggatcagg

SEQ ID NO: 33259 - DNA, 16 bp, Homo sapiens
ctcgatgttggatcag

SEQ ID NO: 33260 - DNA, 17 bp, Homo sapiens
ctcgatgttggatcagg

SEQ ID NO: 33261 - DNA, 18 bp, Homo sapiens
ctcgatgttggatcagga

SEQ ID NO: 33262 - DNA, 19 bp, Homo sapiens
ctcgatgttggatcaggac

SEQ ID NO: 33263 - DNA, 20 bp, Homo sapiens
ctcgatgttggatcaggaca

SEQ ID NO: 33264 - DNA, 21 bp, Homo sapiens
ctcgatgttggatcaggacat

SEQ ID NO: 33265 - DNA, 22 bp, Homo sapiens
ctcgatgttggatcaggacatc

SEQ ID NO: 33266 - DNA, 23 bp, Homo sapiens
ctcgatgttggatcaggacatcc

SEQ ID NO: 33267 - DNA, 24 bp, Homo sapiens
ctcgatgttggatcaggacatccc

SEQ ID NO: 33268 - DNA, 25 bp, Homo sapiens
ctcgatgttggatcaggacatcccg

SEQ ID NO: 33269 - DNA, 16 bp, Homo sapiens
tcgatgttggatcagg

SEQ ID NO: 33270 - DNA, 17 bp, Homo sapiens
tcgatgttggatcagga

SEQ ID NO: 33271 - DNA, 18 bp, Homo sapiens
tcgatgttggatcaggac

SEQ ID NO: 33272 - DNA, 19 bp, Homo sapiens
tcgatgttggatcaggaca

SEQ ID NO: 33273 - DNA, 20 bp, Homo sapiens
tcgatgttggatcaggacat

SEQ ID NO: 33274 - DNA, 21 bp, Homo sapiens
tcgatgttggatcaggacatc

SEQ ID NO: 33275 - DNA, 22 bp, Homo sapiens
tcgatgttggatcaggacatcc

SEQ ID NO: 33276 - DNA, 23 bp, Homo sapiens
tcgatgttggatcaggacatccc

SEQ ID NO: 33277 - DNA, 24 bp, Homo sapiens
tcgatgttggatcaggacatcccg

SEQ ID NO: 33278 - DNA, 16 bp, Homo sapiens
cgatgttggatcagga

SEQ ID NO: 33279 - DNA, 17 bp, Homo sapiens
cgatgttggatcaggac

SEQ ID NO: 33280 - DNA, 18 bp, Homo sapiens
cgatgttggatcaggaca

SEQ ID NO: 33281 - DNA, 21 bp, Homo sapiens
cgatgttggatcaggacatcc

SEQ ID NO: 33282 - DNA, 22 bp, Homo sapiens
cgatgttggatcaggacatccc

SEQ ID NO: 33283 - DNA, 23 bp, Homo sapiens
cgatgttggatcaggacatcccg

SEQ ID NO: 33284 - DNA, 16 bp, Homo sapiens
gatgttggatcaggac

SEQ ID NO: 33285 - DNA, 17 bp, Homo sapiens
gatgttggatcaggaca

SEQ ID NO: 33286 - DNA, 20 bp, Homo sapiens
gatgttggatcaggacatcc

SEQ ID NO: 33287 - DNA, 21 bp, Homo sapiens
gatgttggatcaggacatccc

SEQ ID NO: 33288 - DNA, 22 bp, Homo sapiens
gatgttggatcaggacatcccg

SEQ ID NO: 33289 - DNA, 23 bp, Homo sapiens
gatgttggatcaggacatcccga

SEQ ID NO: 33290 - DNA, 16 bp, Homo sapiens
atgttggatcaggaca

SEQ ID NO: 33291 - DNA, 17 bp, Homo sapiens
atgttggatcaggacat

SEQ ID NO: 33292 - DNA, 18 bp, Homo sapiens
atgttggatcaggacatc

SEQ ID NO: 33293 - DNA, 19 bp, Homo sapiens
atgttggatcaggacatcc

SEQ ID NO: 33294 - DNA, 20 bp, Homo sapiens
atgttggatcaggacatccc

SEQ ID NO: 33295 - DNA, 21 bp, Homo sapiens
atgttggatcaggacatcccg

SEQ ID NO: 33296 - DNA, 22 bp, Homo sapiens
atgttggatcaggacatcccga

SEQ ID NO: 33297 - DNA, 23 bp, Homo sapiens
atgttggatcaggacatcccgat

SEQ ID NO: 33298 - DNA, 24 bp, Homo sapiens
atgttggatcaggacatcccgatg

SEQ ID NO: 33299 - DNA, 26 bp, Homo sapiens
atgttggatcaggacatcccgatggt

SEQ ID NO: 33300 - DNA, 16 bp, Homo sapiens
tgttggatcaggacat

SEQ ID NO: 33301 - DNA, 17 bp, Homo sapiens
tgttggatcaggacatc

SEQ ID NO: 33302 - DNA, 18 bp, Homo sapiens
tgttggatcaggacatcc

SEQ ID NO: 33303 - DNA, 19 bp, Homo sapiens
tgttggatcaggacatccc

SEQ ID NO: 33304 - DNA, 20 bp, Homo sapiens
tgttggatcaggacatcccg

SEQ ID NO: 33305 - DNA, 21 bp, Homo sapiens
tgttggatcaggacatcccga

SEQ ID NO: 33306 - DNA, 24 bp, Homo sapiens
tgttggatcaggacatcccgatgg

SEQ ID NO: 33307 - DNA, 16 bp, Homo sapiens
gttggatcaggacatc

SEQ ID NO: 33308 - DNA, 17 bp, Homo sapiens
gttggatcaggacatcc

SEQ ID NO: 33309 - DNA, 18 bp, Homo sapiens
gttggatcaggacatccc

SEQ ID NO: 33310 - DNA, 19 bp, Homo sapiens
gttggatcaggacatcccg

SEQ ID NO: 33311 - DNA, 20 bp, Homo sapiens
gttggatcaggacatcccga

SEQ ID NO: 33312 - DNA, 22 bp, Homo sapiens
gttggatcaggacatcccgatg

SEQ ID NO: 33313 - DNA, 23 bp, Homo sapiens
gttggatcaggacatcccgatgg

SEQ ID NO: 33314 - DNA, 24 bp, Homo sapiens
gttggatcaggacatcccgatggt

SEQ ID NO: 33315 - DNA, 25 bp, Homo sapiens
gttggatcaggacatcccgatggtg

SEQ ID NO: 33316 - DNA, 17 bp, Homo sapiens
ttggatcaggacatccc

SEQ ID NO: 33317 - DNA, 19 bp, Homo sapiens
ttggatcaggacatcccga

SEQ ID NO: 33318 - DNA, 22 bp, Homo sapiens
ttggatcaggacatcccgatgg

SEQ ID NO: 33319 - DNA, 23 bp, Homo sapiens
ttggatcaggacatcccgatggt

SEQ ID NO: 33320 - DNA, 24 bp, Homo sapiens
ttggatcaggacatcccgatggtg

SEQ ID NO: 33321 - DNA, 21 bp, Homo sapiens
tggatcaggacatcccgatgg

SEQ ID NO: 33322 - DNA, 23 bp, Homo sapiens
tggatcaggacatcccgatggtg

SEQ ID NO: 33323 - DNA, 22 bp, Homo sapiens
ggatcaggacatcccgatggtg

SEQ ID NO: 33324 - DNA, 16 bp, Homo sapiens
gatcaggacatcccga

SEQ ID NO: 33325 - DNA, 19 bp, Homo sapiens
gatcaggacatcccgatgg

SEQ ID NO: 33326 - DNA, 20 bp, Homo sapiens
gatcaggacatcccgatggt

SEQ ID NO: 33327 - DNA, 21 bp, Homo sapiens
gatcaggacatcccgatggtg

SEQ ID NO: 33328 - DNA, 22 bp, Homo sapiens
gatcaggacatcccgatggtgc

SEQ ID NO: 33329 - DNA, 23 bp, Homo sapiens
gatcaggacatcccgatggtgca

SEQ ID NO: 33330 - DNA, 21 bp, Homo sapiens
aggacatcccgatggtgcagc

SEQ ID NO: 33331 - DNA, 18 bp, Homo sapiens
ggacatcccgatggtgca

SEQ ID NO: 33332 - DNA, 20 bp, Homo sapiens
ggacatcccgatggtgcagc

SEQ ID NO: 33333 - DNA, 21 bp, Homo sapiens
ggacatcccgatggtgcagcc

SEQ ID NO: 33334 - DNA, 22 bp, Homo sapiens
ggacatcccgatggtgcagccg

SEQ ID NO: 33335 - DNA, 24 bp, Homo sapiens
ggacatcccgatggtgcagccgct

SEQ ID NO: 33336 - DNA, 20 bp, Homo sapiens
gacatcccgatggtgcagcc

SEQ ID NO: 33337 - DNA, 21 bp, Homo sapiens
gacatcccgatggtgcagccg

SEQ ID NO: 33338 - DNA, 16 bp, Homo sapiens
cgatggtgcagccgct

SEQ ID NO: 33339 - DNA, 17 bp, Homo sapiens
cgatggtgcagccgcta

SEQ ID NO: 33340 - DNA, 20 bp, Homo sapiens
cgatggtgcagccgctatta

SEQ ID NO: 33341 - DNA, 16 bp, Homo sapiens
gatggtgcagccgcta

SEQ ID NO: 33342 - DNA, 18 bp, Homo sapiens
gatggtgcagccgctatt

SEQ ID NO: 33343 - DNA, 19 bp, Homo sapiens
gatggtgcagccgctatta

SEQ ID NO: 33344 - DNA, 22 bp, Homo sapiens
gatggtgcagccgctattaaag

SEQ ID NO: 33345 - DNA, 23 bp, Homo sapiens
gatggtgcagccgctattaaagg

SEQ ID NO: 33346 - DNA, 25 bp, Homo sapiens
gatggtgcagccgctattaaaggtt

SEQ ID NO: 33347 - DNA, 16 bp, Homo sapiens
ggtgcagccgctatta

SEQ ID NO: 33348 - DNA, 22 bp, Homo sapiens
ggtgcagccgctattaaaggtt

SEQ ID NO: 33349 - DNA, 23 bp, Homo sapiens
ggtgcagccgctattaaaggttc

SEQ ID NO: 33350 - DNA, 21 bp, Homo sapiens
gtgcagccgctattaaaggtt

SEQ ID NO: 33351 - DNA, 22 bp, Homo sapiens
gtgcagccgctattaaaggttc

SEQ ID NO: 33352 - DNA, 18 bp, Homo sapiens
gccgctattaaaggttcg

SEQ ID NO: 33353 - DNA, 24 bp, Homo sapiens
cgctattaaaggttcgtttgttca

SEQ ID NO: 33354 - DNA, 20 bp, Homo sapiens
gctattaaaggttcgtttgt

SEQ ID NO: 33355 - DNA, 21 bp, Homo sapiens
gctattaaaggttcgtttgtt

SEQ ID NO: 33356 - DNA, 22 bp, Homo sapiens
gctattaaaggttcgtttgttc

SEQ ID NO: 33357 - DNA, 23 bp, Homo sapiens
gctattaaaggttcgtttgttca

SEQ ID NO: 33358 - DNA, 22 bp, Homo sapiens
ctattaaaggttcgtttgttca

SEQ ID NO: 33359 - DNA, 17 bp, Homo sapiens
tattaaaggttcgtttg

SEQ ID NO: 33360 - DNA, 18 bp, Homo sapiens
tattaaaggttcgtttgt

SEQ ID NO: 33361 - DNA, 17 bp, Homo sapiens
attaaaggttcgtttgt

SEQ ID NO: 33362 - DNA, 19 bp, Homo sapiens
attaaaggttcgtttgttc

SEQ ID NO: 33363 - DNA, 20 bp, Homo sapiens
attaaaggttcgtttgttca

SEQ ID NO: 33364 - DNA, 22 bp, Homo sapiens
attaaaggttcgtttgttcaac

SEQ ID NO: 33365 - DNA, 16 bp, Homo sapiens
ttaaaggttcgtttgt

SEQ ID NO: 33366 - DNA, 19 bp, Homo sapiens
ttaaaggttcgtttgttca

SEQ ID NO: 33367 - DNA, 16 bp, Homo sapiens
aaaggttcgtttgttc

SEQ ID NO: 33368 - DNA, 17 bp, Homo sapiens
aaaggttcgtttgttca

SEQ ID NO: 33369 - DNA, 19 bp, Homo sapiens
aaaggttcgtttgttcaac

SEQ ID NO: 33370 - DNA, 20 bp, Homo sapiens
aaaggttcgtttgttcaacg

SEQ ID NO: 33371 - DNA, 16 bp, Homo sapiens
aaggttcgtttgttca

SEQ ID NO: 33372 - DNA, 17 bp, Homo sapiens
aaggttcgtttgttcaa

SEQ ID NO: 33373 - DNA, 18 bp, Homo sapiens
aaggttcgtttgttcaac

SEQ ID NO: 33374 - DNA, 19 bp, Homo sapiens
aaggttcgtttgttcaacg

SEQ ID NO: 33375 - DNA, 22 bp, Homo sapiens
aaggttcgtttgttcaacgatt

SEQ ID NO: 33376 - DNA, 17 bp, Homo sapiens
aggttcgtttgttcaac

SEQ ID NO: 33377 - DNA, 16 bp, Homo sapiens
ggttcgtttgttcaac

SEQ ID NO: 33378 - DNA, 23 bp, Homo sapiens
cgtttgttcaacgattaaagtcc

SEQ ID NO: 33379 - DNA, 22 bp, Homo sapiens
gtttgttcaacgattaaagtcc

SEQ ID NO: 33380 - DNA, 23 bp, Homo sapiens
gtttgttcaacgattaaagtcct

SEQ ID NO: 33381 - DNA, 24 bp, Homo sapiens
gtttgttcaacgattaaagtccta

SEQ ID NO: 33382 - DNA, 28 bp, Homo sapiens
gtttgttcaacgattaaagtcctacgtg

SEQ ID NO: 33383 - DNA, 24 bp, Homo sapiens
acgattaaagtcctacgtgatctg

SEQ ID NO: 33384 - DNA, 23 bp, Homo sapiens
cgattaaagtcctacgtgatctg

SEQ ID NO: 33385 - DNA, 20 bp, Homo sapiens
gattaaagtcctacgtgatc

SEQ ID NO: 33386 - DNA, 22 bp, Homo sapiens
gattaaagtcctacgtgatctg

SEQ ID NO: 33387 - DNA, 23 bp, Homo sapiens
gattaaagtcctacgtgatctga

SEQ ID NO: 33388 - DNA, 21 bp, Homo sapiens
attaaagtcctacgtgatctg

SEQ ID NO: 33389 - DNA, 22 bp, Homo sapiens
attaaagtcctacgtgatctga

SEQ ID NO: 33390 - DNA, 23 bp, Homo sapiens
attaaagtcctacgtgatctgag

SEQ ID NO: 33391 - DNA, 20 bp, Homo sapiens
aaagtcctacgtgatctgag

SEQ ID NO: 33392 - DNA, 17 bp, Homo sapiens
aagtcctacgtgatctg

SEQ ID NO: 33393 - DNA, 21 bp, Homo sapiens
aagtcctacgtgatctgagtt

SEQ ID NO: 33394 - DNA, 22 bp, Homo sapiens
aagtcctacgtgatctgagttc

SEQ ID NO: 33395 - DNA, 16 bp, Homo sapiens
ctacgtgatctgagtt

SEQ ID NO: 33396 - DNA, 17 bp, Homo sapiens
ctacgtgatctgagttc

SEQ ID NO: 33397 - DNA, 18 bp, Homo sapiens
ctacgtgatctgagttca

SEQ ID NO: 33398 - DNA, 21 bp, Homo sapiens
ctacgtgatctgagttcagac

SEQ ID NO: 33399 - DNA, 22 bp, Homo sapiens
ctacgtgatctgagttcagacc

SEQ ID NO: 33400 - DNA, 23 bp, Homo sapiens
ctacgtgatctgagttcagaccg

SEQ ID NO: 33401 - DNA, 28 bp, Homo sapiens
ctacgtgatctgagttcagaccggagta

SEQ ID NO: 33402 - DNA, 21 bp, Homo sapiens
tacgtgatctgagttcagacc

SEQ ID NO: 33403 - DNA, 25 bp, Homo sapiens
tacgtgatctgagttcagaccggag

SEQ ID NO: 33404 - DNA, 20 bp, Homo sapiens
acgtgatctgagttcagacc

SEQ ID NO: 33405 - DNA, 24 bp, Homo sapiens
acgtgatctgagttcagaccggag

SEQ ID NO: 33406 - DNA, 19 bp, Homo sapiens
cgtgatctgagttcagacc

SEQ ID NO: 33407 - DNA, 19 bp, Homo sapiens
ctgagttcagaccggagta

SEQ ID NO: 33408 - DNA, 17 bp, Homo sapiens
gagttcagaccggagta

SEQ ID NO: 33409 - DNA, 20 bp, Homo sapiens
gagttcagaccggagtaatc

SEQ ID NO: 33410 - DNA, 22 bp, Homo sapiens
gagttcagaccggagtaatcca

SEQ ID NO: 33411 - DNA, 23 bp, Homo sapiens
gagttcagaccggagtaatccag

SEQ ID NO: 33412 - DNA, 21 bp, Homo sapiens
gttcagaccggagtaatccag

SEQ ID NO: 33413 - DNA, 27 bp, Homo sapiens
gttcagaccggagtaatccaggtcggt

SEQ ID NO: 33414 - DNA, 19 bp, Homo sapiens
ccggagtaatccaggtcgg

SEQ ID NO: 33415 - DNA, 17 bp, Homo sapiens
cggagtaatccaggtcg

SEQ ID NO: 33416 - DNA, 18 bp, Homo sapiens
cggagtaatccaggtcgg

SEQ ID NO: 33417 - DNA, 20 bp, Homo sapiens
cggagtaatccaggtcggtt

SEQ ID NO: 33418 - DNA, 21 bp, Homo sapiens
cggagtaatccaggtcggttt

SEQ ID NO: 33419 - DNA, 22 bp, Homo sapiens
cggagtaatccaggtcggtttc

SEQ ID NO: 33420 - DNA, 23 bp, Homo sapiens
cggagtaatccaggtcggtttct

SEQ ID NO: 33421 - DNA, 16 bp, Homo sapiens
ggagtaatccaggtcg

SEQ ID NO: 33422 - DNA, 17 bp, Homo sapiens
ggagtaatccaggtcgg

SEQ ID NO: 33423 - DNA, 19 bp, Homo sapiens
ggagtaatccaggtcggtt

SEQ ID NO: 33424 - DNA, 21 bp, Homo sapiens
ggagtaatccaggtcggtttc

SEQ ID NO: 33425 - DNA, 22 bp, Homo sapiens
ggagtaatccaggtcggtttct

SEQ ID NO: 33426 - DNA, 23 bp, Homo sapiens
ggagtaatccaggtcggtttcta

SEQ ID NO: 33427 - DNA, 16 bp, Homo sapiens
gagtaatccaggtcgg

SEQ ID NO: 33428 - DNA, 18 bp, Homo sapiens
gagtaatccaggtcggtt

SEQ ID NO: 33429 - DNA, 19 bp, Homo sapiens
gagtaatccaggtcggttt

SEQ ID NO: 33430 - DNA, 20 bp, Homo sapiens
gagtaatccaggtcggtttc

SEQ ID NO: 33431 - DNA, 21 bp, Homo sapiens
gagtaatccaggtcggtttct

SEQ ID NO: 33432 - DNA, 22 bp, Homo sapiens
gagtaatccaggtcggtttcta

SEQ ID NO: 33433 - DNA, 24 bp, Homo sapiens
gagtaatccaggtcggtttctatc

SEQ ID NO: 33434 - DNA, 17 bp, Homo sapiens
agtaatccaggtcggtt

SEQ ID NO: 33435 - DNA, 18 bp, Homo sapiens
agtaatccaggtcggttt

SEQ ID NO: 33436 - DNA, 19 bp, Homo sapiens
agtaatccaggtcggtttc

SEQ ID NO: 33437 - DNA, 20 bp, Homo sapiens
agtaatccaggtcggtttct

SEQ ID NO: 33438 - DNA, 23 bp, Homo sapiens
agtaatccaggtcggtttctatc

SEQ ID NO: 33439 - DNA, 24 bp, Homo sapiens
agtaatccaggtcggtttctatct

SEQ ID NO: 33440 - DNA, 16 bp, Homo sapiens
gtaatccaggtcggtt

SEQ ID NO: 33441 - DNA, 17 bp, Homo sapiens
gtaatccaggtcggttt

SEQ ID NO: 33442 - DNA, 18 bp, Homo sapiens
gtaatccaggtcggtttc

SEQ ID NO: 33443 - DNA, 19 bp, Homo sapiens
gtaatccaggtcggtttct

SEQ ID NO: 33444 - DNA, 20 bp, Homo sapiens
gtaatccaggtcggtttcta

SEQ ID NO: 33445 - DNA, 22 bp, Homo sapiens
gtaatccaggtcggtttctatc

SEQ ID NO: 33446 - DNA, 23 bp, Homo sapiens
gtaatccaggtcggtttctatct

SEQ ID NO: 33447 - DNA, 16 bp, Homo sapiens
taatccaggtcggttt

SEQ ID NO: 33448 - DNA, 17 bp, Homo sapiens
taatccaggtcggtttc

SEQ ID NO: 33449 - DNA, 18 bp, Homo sapiens
taatccaggtcggtttct

SEQ ID NO: 33450 - DNA, 19 bp, Homo sapiens
taatccaggtcggtttcta

SEQ ID NO: 33451 - DNA, 21 bp, Homo sapiens
taatccaggtcggtttctatc

SEQ ID NO: 33452 - DNA, 22 bp, Homo sapiens
taatccaggtcggtttctatct

SEQ ID NO: 33453 - DNA, 23 bp, Homo sapiens
taatccaggtcggtttctatcta

SEQ ID NO: 33454 - DNA, 24 bp, Homo sapiens
taatccaggtcggtttctatctac

SEQ ID NO: 33455 - DNA, 16 bp, Homo sapiens
aatccaggtcggtttc

SEQ ID NO: 33456 - DNA, 17 bp, Homo sapiens
aatccaggtcggtttct

SEQ ID NO: 33457 - DNA, 18 bp, Homo sapiens
aatccaggtcggtttcta

SEQ ID NO: 33458 - DNA, 20 bp, Homo sapiens
aatccaggtcggtttctatc

SEQ ID NO: 33459 - DNA, 21 bp, Homo sapiens
aatccaggtcggtttctatct

SEQ ID NO: 33460 - DNA, 16 bp, Homo sapiens
atccaggtcggtttct

SEQ ID NO: 33461 - DNA, 17 bp, Homo sapiens
atccaggtcggtttcta

SEQ ID NO: 33462 - DNA, 19 bp, Homo sapiens
atccaggtcggtttctatc

SEQ ID NO: 33463 - DNA, 20 bp, Homo sapiens
atccaggtcggtttctatct

SEQ ID NO: 33464 - DNA, 21 bp, Homo sapiens
atccaggtcggtttctatcta

SEQ ID NO: 33465 - DNA, 22 bp, Homo sapiens
atccaggtcggtttctatctac

SEQ ID NO: 33466 - DNA, 16 bp, Homo sapiens
aggtcggtttctatct

SEQ ID NO: 33467 - DNA, 16 bp, Homo sapiens
ggtcggtttctatcta

SEQ ID NO: 33468 - DNA, 17 bp, Homo sapiens
ggtcggtttctatctac

SEQ ID NO: 33469 - DNA, 17 bp, Homo sapiens
aaattcctccctgtacg

SEQ ID NO: 33470 - DNA, 16 bp, Homo sapiens
aattcctccctgtacg

SEQ ID NO: 33471 - DNA, 21 bp, Homo sapiens
ctccctgtacgaaaggacaag

SEQ ID NO: 33472 - DNA, 22 bp, Homo sapiens
ctccctgtacgaaaggacaaga

SEQ ID NO: 33473 - DNA, 23 bp, Homo sapiens
ctccctgtacgaaaggacaagag

SEQ ID NO: 33474 - DNA, 16 bp, Homo sapiens
ctgtacgaaaggacaa

SEQ ID NO: 33475 - DNA, 17 bp, Homo sapiens
ctgtacgaaaggacaag

SEQ ID NO: 33476 - DNA, 18 bp, Homo sapiens
ctgtacgaaaggacaaga

SEQ ID NO: 33477 - DNA, 19 bp, Homo sapiens
ctgtacgaaaggacaagag

SEQ ID NO: 33478 - DNA, 20 bp, Homo sapiens
ctgtacgaaaggacaagaga

SEQ ID NO: 33479 - DNA, 21 bp, Homo sapiens
ctgtacgaaaggacaagagaa

SEQ ID NO: 33480 - DNA, 22 bp, Homo sapiens
ctgtacgaaaggacaagagaaa

SEQ ID NO: 33481 - DNA, 23 bp, Homo sapiens
ctgtacgaaaggacaagagaaat

SEQ ID NO: 33482 - DNA, 30 bp, Homo sapiens; identical to SEQ ID NO: 1836

SEQ ID NO: 33483 - DNA, 16 bp, Homo sapiens
tgtacgaaaggacaag

SEQ ID NO: 33484 - DNA, 17 bp, Homo sapiens
tgtacgaaaggacaaga

SEQ ID NO: 33485 - DNA, 16 bp, Homo sapiens
gtacgaaaggacaaga

SEQ ID NO: 33486 - DNA, 30 bp, Homo sapiens
aaaggacaagagaaataaggcctacttcac

SEQ ID NO: 33487 - DNA, 30 bp, Homo sapiens
gagaaataaggcctacttcacaaagcgcct

SEQ ID NO: 33488 - DNA, 19 bp, Homo sapiens
aggcctacttcacaaagcg

SEQ ID NO: 33489 - DNA, 20 bp, Homo sapiens
aggcctacttcacaaagcgc

SEQ ID NO: 33490 - DNA, 26 bp, Homo sapiens
aagcgccttcccccgtaaatgatatc

SEQ ID NO: 33491 - DNA, 24 bp, Homo sapiens
gcgccttcccccgtaaatgatatc

SEQ ID NO: 33492 - DNA, 23 bp, Homo sapiens
cgccttcccccgtaaatgatatc

SEQ ID NO: 33493 - DNA, 22 bp, Homo sapiens
gccttcccccgtaaatgatatc

SEQ ID NO: 33494 - DNA, 21 bp, Homo sapiens
ccttcccccgtaaatgatatc

SEQ ID NO: 33495 - DNA, 20 bp, Homo sapiens
cttcccccgtaaatgatatc

SEQ ID NO: 33496 - DNA, 19 bp, Homo sapiens
ttcccccgtaaatgatatc

SEQ ID NO: 33497 - DNA, 18 bp, Homo sapiens
tcccccgtaaatgatatc

SEQ ID NO: 33498 - DNA, 17 bp, Homo sapiens
cccccgtaaatgatatc

SEQ ID NO: 33499 - DNA, 16 bp, Homo sapiens
ccccgtaaatgatatc

SEQ ID NO: 33500 - DNA, 18 bp, Homo sapiens
cgtaaatgatatcatctc

SEQ ID NO: 33501 - DNA, 21 bp, Homo sapiens
cgtaaatgatatcatctcaac

SEQ ID NO: 33502 - DNA, 22 bp, Homo sapiens
cgtaaatgatatcatctcaact

SEQ ID NO: 33503 - DNA, 17 bp, Homo sapiens
tatcatctcaacttagt

SEQ ID NO: 33504 - DNA, 16 bp, Homo sapiens
atcatctcaacttagt

SEQ ID NO: 33505 - DNA, 18 bp, Homo sapiens
cacacccacccaagaaca

SEQ ID NO: 33506 - DNA, 19 bp, Homo sapiens
cacacccacccaagaacag

SEQ ID NO: 33507 - DNA, 20 bp, Homo sapiens
cacacccacccaagaacagg

SEQ ID NO: 33508 - DNA, 17 bp, Homo sapiens
acacccacccaagaaca

SEQ ID NO: 33509 - DNA, 18 bp, Homo sapiens
acacccacccaagaacag

SEQ ID NO: 33510 - DNA, 19 bp, Homo sapiens
acacccacccaagaacagg

SEQ ID NO: 33511 - DNA, 16 bp, Homo sapiens
cacccacccaagaaca

SEQ ID NO: 33512 - DNA, 17 bp, Homo sapiens
cacccacccaagaacag

SEQ ID NO: 33513 - DNA, 18 bp, Homo sapiens
cacccacccaagaacagg

SEQ ID NO: 33514 - DNA, 26 bp, Homo sapiens
cacccacccaagaacagggtttgtta

SEQ ID NO: 33515 - DNA, 20 bp, Homo sapiens
cccacccaagaacagggttt

SEQ ID NO: 33516 - DNA, 24 bp, Homo sapiens
cccacccaagaacagggtttgtta

SEQ ID NO: 33517 - DNA, 22 bp, Homo sapiens
cacccaagaacagggtttgtta

SEQ ID NO: 33518 - DNA, 18 bp, Homo sapiens
acccaagaacagggtttg

SEQ ID NO: 33519 - DNA, 20 bp, Homo sapiens
acccaagaacagggtttgtt

SEQ ID NO: 33520 - DNA, 21 bp, Homo sapiens
acccaagaacagggtttgtta

SEQ ID NO: 33521 - DNA, 23 bp, Homo sapiens
acccaagaacagggtttgttaag

SEQ ID NO: 33522 - DNA, 19 bp, Homo sapiens
cccaagaacagggtttgtt

SEQ ID NO: 33523 - DNA, 20 bp, Homo sapiens
cccaagaacagggtttgtta

SEQ ID NO: 33524 - DNA, 18 bp, Homo sapiens
caagaacagggtttgtta

SEQ ID NO: 33525 - DNA, 17 bp, Homo sapiens
aagaacagggtttgtta

SEQ ID NO: 33526 - DNA, 18 bp, Homo sapiens
gaggctgaggcaggagaa

SEQ ID NO: 33527 - DNA, 17 bp, Homo sapiens
gaggctgaggcaggaga

SEQ ID NO: 33528 - DNA, 16 bp, Homo sapiens
gaggctgaggcaggag

SEQ ID NO: 33529 - DNA, 21 bp, Homo sapiens
ctgtagtcccagctactcggg

SEQ ID NO: 33530 - DNA, 16 bp, Homo sapiens
agtcccagctactcgg

SEQ ID NO: 33531 - DNA, 17 bp, Homo sapiens
tagtcccagctactcgg

SEQ ID NO: 33532 - DNA, 18 bp, Homo sapiens
gtagtcccagctactcgg

SEQ ID NO: 33533 - DNA, 19 bp, Homo sapiens
tgtagtcccagctactcgg

SEQ ID NO: 33534 - DNA, 18 bp, Homo sapiens
gaggctgaggcaggagaa

SEQ ID NO: 33535 - DNA, 17 bp, Homo sapiens
gaggctgaggcaggaga

SEQ ID NO: 33536 - DNA, 16 bp, Homo sapiens
gaggctgaggcaggag

SEQ ID NO: 33537 - DNA, 16 bp, Homo sapiens
gcactccagcctgggc

SEQ ID NO: 33538 - DNA, 18 bp, Homo sapiens
ctgcactccagcctgggc

SEQ ID NO: 33539 - DNA, 22 bp, Homo sapiens
gaggctgaggcaggagaatggc

SEQ ID NO: 33540 - DNA, 18 bp, Homo sapiens
gaggctgaggcaggagaa

SEQ ID NO: 33541 - DNA, 17 bp, Homo sapiens
gaggctgaggcaggaga

SEQ ID NO: 33542 - DNA, 16 bp, Homo sapiens
gaggctgaggcaggag

SEQ ID NO: 33543 - DNA, 20 bp, Homo sapiens
aggagaatcgcttgaacctg

SEQ ID NO: 33544 - DNA, 20 bp, Homo sapiens
gaggttgcagtgagccgaga

SEQ ID NO: 33545 - DNA, 22 bp, Homo sapiens
tcccgagtagctgggattacag

SEQ ID NO: 33546 - DNA, 20 bp, Homo sapiens
aggagaatcgcttgaacctg

SEQ ID NO: 33547 - DNA, 20 bp, Homo sapiens
gaggttgcagtgagccgaga

SEQ ID NO: 33548 - DNA, 21 bp, Homo sapiens
gcgcgatctcggctcactgca

SEQ ID NO: 33549 - DNA, 20 bp, Homo sapiens
gcgcgatctcggctcactgc

SEQ ID NO: 33550 - DNA, 20 bp, Homo sapiens
aggagaatcgcttgaacctg

SEQ ID NO: 33551 - DNA, 18 bp, Homo sapiens
gaggctgaggcaggagaa

SEQ ID NO: 33552 - DNA, 17 bp, Homo sapiens
gaggctgaggcaggaga

SEQ ID NO: 33553 - DNA, 16 bp, Homo sapiens
gaggctgaggcaggag

SEQ ID NO: 33554 - DNA, 18 bp, Homo sapiens
gaggctgaggcaggagaa

SEQ ID NO: 33555 - DNA, 17 bp, Homo sapiens
gaggctgaggcaggaga

SEQ ID NO: 33556 - DNA, 16 bp, Homo sapiens
gaggctgaggcaggag

SEQ ID NO: 33557 - DNA, 16 bp, Homo sapiens
gtgggggagaggctgt

SEQ ID NO: 33558 - DNA, 17 bp, Homo sapiens
gtgggggagaggctgtc

SEQ ID NO: 33559 - DNA, 18 bp, Homo sapiens
gtgggggagaggctgtcg

SEQ ID NO: 33560 - DNA, 19 bp, Homo sapiens
gtgggggagaggctgtcgc

SEQ ID NO: 33561 - DNA, 21 bp, Homo sapiens
gtgggggagaggctgtcgctg

SEQ ID NO: 33562 - DNA, 22 bp, Homo sapiens
gtgggggagaggctgtcgctgc

SEQ ID NO: 33563 - DNA, 21 bp, Homo sapiens
ctgggcccgcggcgggcgtgg

SEQ ID NO: 33564 - DNA, 22 bp, Homo sapiens
ctgggcccgcggcgggcgtggg

SEQ ID NO: 33565 - DNA, 20 bp, Homo sapiens
gctgacacgctgtcctctgg

SEQ ID NO: 33566 - DNA, 23 bp, Homo sapiens
gctgacacgctgtcctctggcga

SEQ ID NO: 33567 - DNA, 25 bp, Homo sapiens
gctgacacgctgtcctctggcgacc

SEQ ID NO: 33568 - DNA, 26 bp, Homo sapiens
gctgacacgctgtcctctggcgacct

SEQ ID NO: 33569 - DNA, 27 bp, Homo sapiens
ttccccggagtggggggttggccggag

SEQ ID NO: 33570 - DNA, 24 bp, Homo sapiens
tccccggagtggggggttggccgg

SEQ ID NO: 33571 - DNA, 25 bp, Homo sapiens
tccccggagtggggggttggccgga

SEQ ID NO: 33572 - DNA, 26 bp, Homo sapiens
tccccggagtggggggttggccggag

SEQ ID NO: 33573 - DNA, 27 bp, Homo sapiens
tccccggagtggggggttggccggagc

SEQ ID NO: 33574 - DNA, 23 bp, Homo sapiens
ccccggagtggggggttggccgg

SEQ ID NO: 33575 - DNA, 25 bp, Homo sapiens
ccccggagtggggggttggccggag

SEQ ID NO: 33576 - DNA, 26 bp, Homo sapiens
ccccggagtggggggttggccggagc

SEQ ID NO: 33577 - DNA, 22 bp, Homo sapiens
tcttcgtgatcgatgtggtgac

SEQ ID NO: 33578 - DNA, 23 bp, Homo sapiens
tcttcgtgatcgatgtggtgacg

SEQ ID NO: 33579 - DNA, 24 bp, Homo sapiens
tcttcgtgatcgatgtggtgacgt

SEQ ID NO: 33580 - DNA, 17 bp, Homo sapiens
cttcgtgatcgatgtgg

SEQ ID NO: 33581 - DNA, 19 bp, Homo sapiens
cttcgtgatcgatgtggtg

SEQ ID NO: 33582 - DNA, 20 bp, Homo sapiens
cttcgtgatcgatgtggtga

SEQ ID NO: 33583 - DNA, 21 bp, Homo sapiens
cttcgtgatcgatgtggtgac

SEQ ID NO: 33584 - DNA, 22 bp, Homo sapiens
cttcgtgatcgatgtggtgacg

SEQ ID NO: 33585 - DNA, 23 bp, Homo sapiens
cttcgtgatcgatgtggtgacgt

SEQ ID NO: 33586 - DNA, 24 bp, Homo sapiens
cttcgtgatcgatgtggtgacgtc

SEQ ID NO: 33587 - DNA, 25 bp, Homo sapiens
cttcgtgatcgatgtggtgacgtcg

SEQ ID NO: 33588 - DNA, 26 bp, Homo sapiens
cttcgtgatcgatgtggtgacgtcgt

SEQ ID NO: 33589 - DNA, 27 bp, Homo sapiens
cttcgtgatcgatgtggtgacgtcgtg

SEQ ID NO: 33590 - DNA, 28 bp, Homo sapiens
cttcgtgatcgatgtggtgacgtcgtgc

SEQ ID NO: 33591 - DNA, 29 bp, Homo sapiens
cttcgtgatcgatgtggtgacgtcgtgct

SEQ ID NO: 33592 - DNA, 30 bp, Homo sapiens; identical to SEQ ID NO: 1878

SEQ ID NO: 33593 - DNA, 16 bp, Homo sapiens
ttcgtgatcgatgtgg

SEQ ID NO: 33594 - DNA, 17 bp, Homo sapiens
ttcgtgatcgatgtggt

SEQ ID NO: 33595 - DNA, 18 bp, Homo sapiens
ttcgtgatcgatgtggtg

SEQ ID NO: 33596 - DNA, 19 bp, Homo sapiens
ttcgtgatcgatgtggtga

SEQ ID NO: 33597 - DNA, 20 bp, Homo sapiens
ttcgtgatcgatgtggtgac

SEQ ID NO: 33598 - DNA, 21 bp, Homo sapiens
ttcgtgatcgatgtggtgacg

SEQ ID NO: 33599 - DNA, 22 bp, Homo sapiens
ttcgtgatcgatgtggtgacgt

SEQ ID NO: 33600 - DNA, 23 bp, Homo sapiens
ttcgtgatcgatgtggtgacgtc

SEQ ID NO: 33601 - DNA, 24 bp, Homo sapiens
ttcgtgatcgatgtggtgacgtcg

SEQ ID NO: 33602 - DNA, 25 bp, Homo sapiens
ttcgtgatcgatgtggtgacgtcgt

SEQ ID NO: 33603 - DNA, 26 bp, Homo sapiens
ttcgtgatcgatgtggtgacgtcgtg

SEQ ID NO: 33604 - DNA, 27 bp, Homo sapiens
ttcgtgatcgatgtggtgacgtcgtgc

SEQ ID NO: 33605 - DNA, 28 bp, Homo sapiens
ttcgtgatcgatgtggtgacgtcgtgct

SEQ ID NO: 33606 - DNA, 29 bp, Homo sapiens
ttcgtgatcgatgtggtgacgtcgtgctc

SEQ ID NO: 33607 - DNA, 30 bp, Homo sapiens; identical to SEQ ID NO: 1888

SEQ ID NO: 33608 - DNA, 20 bp, Homo sapiens
tcgtgatcgatgtggtgacg

SEQ ID NO: 33609 - DNA, 22 bp, Homo sapiens
tcgtgatcgatgtggtgacgtc

SEQ ID NO: 33610 - DNA, 25 bp, Homo sapiens
tcgtgatcgatgtggtgacgtcgtg

SEQ ID NO: 33611 - DNA, 16 bp, Homo sapiens
gatcgatgtggtgacg

SEQ ID NO: 33612 - DNA, 17 bp, Homo sapiens
gatcgatgtggtgacgt

SEQ ID NO: 33613 - DNA, 18 bp, Homo sapiens
gatcgatgtggtgacgtc

SEQ ID NO: 33614 - DNA, 20 bp, Homo sapiens
gatcgatgtggtgacgtcgt

SEQ ID NO: 33615 - DNA, 21 bp, Homo sapiens
gatcgatgtggtgacgtcgtg

SEQ ID NO: 33616 - DNA, 22 bp, Homo sapiens
gatcgatgtggtgacgtcgtgc

SEQ ID NO: 33617 - DNA, 24 bp, Homo sapiens
gatcgatgtggtgacgtcgtgctc

SEQ ID NO: 33618 - DNA, 25 bp, Homo sapiens
gatcgatgtggtgacgtcgtgctct

SEQ ID NO: 33619 - DNA, 26 bp, Homo sapiens
gatcgatgtggtgacgtcgtgctctc

SEQ ID NO: 33620 - DNA, 30 bp, Homo sapiens; identical to SEQ ID NO: 1894

SEQ ID NO: 33621 - DNA, 20 bp, Homo sapiens
atcgatgtggtgacgtcgtg

SEQ ID NO: 33622 - DNA, 24 bp, Homo sapiens
atcgatgtggtgacgtcgtgctct

SEQ ID NO: 33623 - DNA, 29 bp, Homo sapiens
atcgatgtggtgacgtcgtgctctcccgg

SEQ ID NO: 33624 - DNA, 30 bp, Homo sapiens; identical to SEQ ID NO: 1904

SEQ ID NO: 33625 - DNA, 19 bp, Homo sapiens
tcgatgtggtgacgtcgtg

SEQ ID NO: 33626 - DNA, 30 bp, Homo sapiens
tcgatgtggtgacgtcgtgctctcccgggc

SEQ ID NO: 33627 - DNA, 18 bp, Homo sapiens
tcccgggccgggtccgag

SEQ ID NO: 33628 - DNA, 22 bp, Homo sapiens
ggtccgagccgcgacgggcgag

SEQ ID NO: 33629 - DNA, 24 bp, Homo sapiens
cgggcgaggggcggacgttcgtgg

SEQ ID NO: 33630 - DNA, 23 bp, Homo sapiens
gggcgaggggcggacgttcgtgg

SEQ ID NO: 33631 - DNA, 22 bp, Homo sapiens
ggcgaggggcggacgttcgtgg

SEQ ID NO: 33632 - DNA, 21 bp, Homo sapiens
gcgaggggcggacgttcgtgg

SEQ ID NO: 33633 - DNA, 19 bp, Homo sapiens
cgaggggcggacgttcgtg

SEQ ID NO: 33634 - DNA, 20 bp, Homo sapiens
cgaggggcggacgttcgtgg

SEQ ID NO: 33635 - DNA, 21 bp, Homo sapiens
cgaggggcggacgttcgtggc

SEQ ID NO: 33636 - DNA, 19 bp, Homo sapiens
gaggggcggacgttcgtgg

SEQ ID NO: 33637 - DNA, 23 bp, Homo sapiens
cccggcccgacctcgccgtcccg

SEQ ID NO: 33638 - DNA, 24 bp, Homo sapiens
cccggcccgacctcgccgtcccgc

SEQ ID NO: 33639 - DNA, 21 bp, Homo sapiens
cggcccgacctcgccgtcccg

SEQ ID NO: 33640 - DNA, 21 bp, Homo sapiens
cgacctcgccgtcccgcccgc

SEQ ID NO: 33641 - DNA, 22 bp, Homo sapiens
cgacctcgccgtcccgcccgcc

SEQ ID NO: 33642 - DNA, 18 bp, Homo sapiens
gacctcgccgtcccgccc

SEQ ID NO: 33643 - DNA, 19 bp, Homo sapiens
gacctcgccgtcccgcccg

SEQ ID NO: 33644 - DNA, 20 bp, Homo sapiens
gacctcgccgtcccgcccgc

SEQ ID NO: 33645 - DNA, 21 bp, Homo sapiens
gacctcgccgtcccgcccgcc

SEQ ID NO: 33646 - DNA, 22 bp, Homo sapiens
gacctcgccgtcccgcccgccg

SEQ ID NO: 33647 - DNA, 23 bp, Homo sapiens
gacctcgccgtcccgcccgccgc

SEQ ID NO: 33648 - DNA, 29 bp, Homo sapiens
ctctgacgcggcagacagccctcgctgtc

SEQ ID NO: 33649 - DNA, 30 bp, Homo sapiens
ctctgacgcggcagacagccctcgctgtcg

SEQ ID NO: 33650 - DNA, 20 bp, Homo sapiens
cagtggttgtcgacttgcgg

SEQ ID NO: 33651 - DNA, 21 bp, Homo sapiens
ctgagggagctcgtcggtgtg

SEQ ID NO: 33652 - DNA, 22 bp, Homo sapiens
ctgagggagctcgtcggtgtgg

SEQ ID NO: 33653 - DNA, 23 bp, Homo sapiens
ctgagggagctcgtcggtgtggg

SEQ ID NO: 33654 - DNA, 20 bp, Homo sapiens
tgagggagctcgtcggtgtg

SEQ ID NO: 33655 - DNA, 21 bp, Homo sapiens
tgagggagctcgtcggtgtgg

SEQ ID NO: 33656 - DNA, 22 bp, Homo sapiens
tgagggagctcgtcggtgtggg

SEQ ID NO: 33657 - DNA, 23 bp, Homo sapiens
tgagggagctcgtcggtgtgggg

SEQ ID NO: 33658 - DNA, 17 bp, Homo sapiens
gagggagctcgtcggtg

SEQ ID NO: 33659 - DNA, 18 bp, Homo sapiens
gagggagctcgtcggtgt

SEQ ID NO: 33660 - DNA, 19 bp, Homo sapiens
gagggagctcgtcggtgtg

SEQ ID NO: 33661 - DNA, 20 bp, Homo sapiens
gagggagctcgtcggtgtgg

SEQ ID NO: 33662 - DNA, 21 bp, Homo sapiens
gagggagctcgtcggtgtggg

SEQ ID NO: 33663 - DNA, 24 bp, Homo sapiens
gagggagctcgtcggtgtggggtt

SEQ ID NO: 33664 - DNA, 18 bp, Homo sapiens
agggagctcgtcggtgtg

SEQ ID NO: 33665 - DNA, 19 bp, Homo sapiens
agggagctcgtcggtgtgg

SEQ ID NO: 33666 - DNA, 20 bp, Homo sapiens
agggagctcgtcggtgtggg

SEQ ID NO: 33667 - DNA, 18 bp, Homo sapiens
gggagctcgtcggtgtgg

SEQ ID NO: 33668 - DNA, 19 bp, Homo sapiens
gggagctcgtcggtgtggg

SEQ ID NO: 33669 - DNA, 17 bp, Homo sapiens
ggagctcgtcggtgtgg

SEQ ID NO: 33670 - DNA, 18 bp, Homo sapiens
ggagctcgtcggtgtggg

SEQ ID NO: 33671 - DNA, 19 bp, Homo sapiens
ggagctcgtcggtgtgggg

SEQ ID NO: 33672 - DNA, 26 bp, Homo sapiens
ggagctcgtcggtgtggggttcgagg

SEQ ID NO: 33673 - DNA, 27 bp, Homo sapiens
ggagctcgtcggtgtggggttcgaggc

SEQ ID NO: 33674 - DNA, 16 bp, Homo sapiens
gagctcgtcggtgtgg

SEQ ID NO: 33675 - DNA, 17 bp, Homo sapiens
gagctcgtcggtgtggg

SEQ ID NO: 33676 - DNA, 18 bp, Homo sapiens
gagctcgtcggtgtgggg

SEQ ID NO: 33677 - DNA, 19 bp, Homo sapiens
gagctcgtcggtgtggggt

SEQ ID NO: 33678 - DNA, 20 bp, Homo sapiens
gagctcgtcggtgtggggtt

SEQ ID NO: 33679 - DNA, 22 bp, Homo sapiens
gagctcgtcggtgtggggttcg

SEQ ID NO: 33680 - DNA, 25 bp, Homo sapiens
gagctcgtcggtgtggggttcgagg

SEQ ID NO: 33681 - DNA, 26 bp, Homo sapiens
gagctcgtcggtgtggggttcgaggc

SEQ ID NO: 33682 - DNA, 27 bp, Homo sapiens
gagctcgtcggtgtggggttcgaggcg

SEQ ID NO: 33683 - DNA, 30 bp, Homo sapiens
gagctcgtcggtgtggggttcgaggcggtt

SEQ ID NO: 33684 - DNA, 16 bp, Homo sapiens
agctcgtcggtgtggg

SEQ ID NO: 33685 - DNA, 17 bp, Homo sapiens
agctcgtcggtgtgggg

SEQ ID NO: 33686 - DNA, 18 bp, Homo sapiens
agctcgtcggtgtggggt

SEQ ID NO: 33687 - DNA, 19 bp, Homo sapiens
agctcgtcggtgtggggtt

SEQ ID NO: 33688 - DNA, 21 bp, Homo sapiens
agctcgtcggtgtggggttcg

SEQ ID NO: 33689 - DNA, 24 bp, Homo sapiens
agctcgtcggtgtggggttcgagg

SEQ ID NO: 33690 - DNA, 25 bp, Homo sapiens
agctcgtcggtgtggggttcgaggc

SEQ ID NO: 33691 - DNA, 26 bp, Homo sapiens
agctcgtcggtgtggggttcgaggcg

SEQ ID NO: 33692 - DNA, 27 bp, Homo sapiens
agctcgtcggtgtggggttcgaggcgg

SEQ ID NO: 33693 - DNA, 24 bp, Homo sapiens
gctcgtcggtgtggggttcgaggc

SEQ ID NO: 33694 - DNA, 23 bp, Homo sapiens
ctcgtcggtgtggggttcgaggc

SEQ ID NO: 33695 - DNA, 22 bp, Homo sapiens
tcgtcggtgtggggttcgaggc

SEQ ID NO: 33696 - DNA, 21 bp, Homo sapiens
ctctggcgggtgcgcgcgggc

SEQ ID NO: 33697 - DNA, 22 bp, Homo sapiens
gcgggtgcgcgcgggccgtgtg

SEQ ID NO: 33698 - DNA, 23 bp, Homo sapiens
gcgggtgcgcgcgggccgtgtga

SEQ ID NO: 33699 - DNA, 19 bp, Homo sapiens
cgggtgcgcgcgggccgtg

SEQ ID NO: 33700 - DNA, 21 bp, Homo sapiens
cgggtgcgcgcgggccgtgtg

SEQ ID NO: 33701 - DNA, 22 bp, Homo sapiens
cgggtgcgcgcgggccgtgtga

SEQ ID NO: 33702 - DNA, 23 bp, Homo sapiens
cgggtgcgcgcgggccgtgtgag

SEQ ID NO: 33703 - DNA, 22 bp, Homo sapiens
ggctgccgttctgcctccgacc

SEQ ID NO: 33704 - DNA, 23 bp, Homo sapiens
ggctgccgttctgcctccgaccg

SEQ ID NO: 33705 - DNA, 24 bp, Homo sapiens
ggctgccgttctgcctccgaccgg

SEQ ID NO: 33706 - DNA, 25 bp, Homo sapiens
ggctgccgttctgcctccgaccggt

SEQ ID NO: 33707 - DNA, 26 bp, Homo sapiens
ggctgccgttctgcctccgaccggtc

SEQ ID NO: 33708 - DNA, 20 bp, Homo sapiens
gccgttctgcctccgaccgg

SEQ ID NO: 33709 - DNA, 27 bp, Homo sapiens
gttctgcctccgaccggtcgtgtgtgg

SEQ ID NO: 33710 - DNA, 21 bp, Homo sapiens
ctgcctccgaccggtcgtgtg

SEQ ID NO: 33711 - DNA, 24 bp, Homo sapiens
ctgcctccgaccggtcgtgtgtgg

SEQ ID NO: 33712 - DNA, 18 bp, Homo sapiens
tgcctccgaccggtcgtg

SEQ ID NO: 33713 - DNA, 19 bp, Homo sapiens
tgcctccgaccggtcgtgt

SEQ ID NO: 33714 - DNA, 20 bp, Homo sapiens
tgcctccgaccggtcgtgtg

SEQ ID NO: 33715 - DNA, 21 bp, Homo sapiens
tgcctccgaccggtcgtgtgt

SEQ ID NO: 33716 - DNA, 22 bp, Homo sapiens
tgcctccgaccggtcgtgtgtg

SEQ ID NO: 33717 - DNA, 23 bp, Homo sapiens
tgcctccgaccggtcgtgtgtgg

SEQ ID NO: 33718 - DNA, 24 bp, Homo sapiens
tgcctccgaccggtcgtgtgtggg

SEQ ID NO: 33719 - DNA, 19 bp, Homo sapiens
gcctccgaccggtcgtgtg

SEQ ID NO: 33720 - DNA, 22 bp, Homo sapiens
gcctccgaccggtcgtgtgtgg

SEQ ID NO: 33721 - DNA, 23 bp, Homo sapiens
gcctccgaccggtcgtgtgtggg

SEQ ID NO: 33722 - DNA, 21 bp, Homo sapiens
cctccgaccggtcgtgtgtgg

SEQ ID NO: 33723 - DNA, 21 bp, Homo sapiens
ctccgaccggtcgtgtgtggg

SEQ ID NO: 33724 - DNA, 22 bp, Homo sapiens
ggtcgtgtgtgggttgacttcg

SEQ ID NO: 33725 - DNA, 22 bp, Homo sapiens
gtgtgtgggttgacttcggagg

SEQ ID NO: 33726 - DNA, 22 bp, Homo sapiens
ggttgacttcggaggcgctctg

SEQ ID NO: 33727 - DNA, 21 bp, Homo sapiens
gttgacttcggaggcgctctg

SEQ ID NO: 33728 - DNA, 20 bp, Homo sapiens
gctctgcctcggaaggaagg

SEQ ID NO: 33729 - DNA, 21 bp, Homo sapiens
gctctgcctcggaaggaagga

SEQ ID NO: 33730 - DNA, 23 bp, Homo sapiens
gctctgcctcggaaggaaggagg

SEQ ID NO: 33731 - DNA, 19 bp, Homo sapiens
ctctgcctcggaaggaagg

SEQ ID NO: 33732 - DNA, 20 bp, Homo sapiens
ctctgcctcggaaggaagga

SEQ ID NO: 33733 - DNA, 22 bp, Homo sapiens
ctctgcctcggaaggaaggagg

SEQ ID NO: 33734 - DNA, 23 bp, Homo sapiens
ctctgcctcggaaggaaggaggt

SEQ ID NO: 33735 - DNA, 24 bp, Homo sapiens
ctctgcctcggaaggaaggaggtg

SEQ ID NO: 33736 - DNA, 23 bp, Homo sapiens
gcgcgcacgcgcgcaccggccgg

SEQ ID NO: 33737 - DNA, 22 bp, Homo sapiens
cgcgcacgcgcgcaccggccgg

SEQ ID NO: 33738 - DNA, 21 bp, Homo sapiens
gcgcacgcgcgcaccggccgg

SEQ ID NO: 33739 - DNA, 22 bp, Homo sapiens
cgcgcgcaccggccgggccccc

SEQ ID NO: 33740 - DNA, 22 bp, Homo sapiens
ccctgaacgcgaacgctcgagg

SEQ ID NO: 33741 - DNA, 21 bp, Homo sapiens
cctgaacgcgaacgctcgagg

SEQ ID NO: 33742 - DNA, 20 bp, Homo sapiens
ggccgcgcgcaggtgtttcc

SEQ ID NO: 33743 - DNA, 23 bp, Homo sapiens
ggccgcgcgcaggtgtttcctcg

SEQ ID NO: 33744 - DNA, 20 bp, Homo sapiens
cttccccaggcgtccctcgg

SEQ ID NO: 33745 - DNA, 21 bp, Homo sapiens
cttccccaggcgtccctcggc

SEQ ID NO: 33746 - DNA, 19 bp, Homo sapiens
ttccccaggcgtccctcgg

SEQ ID NO: 33747 - DNA, 20 bp, Homo sapiens
ttccccaggcgtccctcggc

SEQ ID NO: 33748 - DNA, 21 bp, Homo sapiens
ttccccaggcgtccctcggcg

SEQ ID NO: 33749 - DNA, 18 bp, Homo sapiens
tccccaggcgtccctcgg

SEQ ID NO: 33750 - DNA, 19 bp, Homo sapiens
tccccaggcgtccctcggc

SEQ ID NO: 33751 - DNA, 23 bp, Homo sapiens
gatcccccgggccgccgcctctg

SEQ ID NO: 33752 - DNA, 21 bp, Homo sapiens
gcgctgccgtagcgacccgct

SEQ ID NO: 33753 - DNA, 22 bp, Homo sapiens
cagaggaccctcctccgcttcc

SEQ ID NO: 33754 - DNA, 25 bp, Homo sapiens
gagtgcggctcgtcgcctactgtgg

SEQ ID NO: 33755 - DNA, 24 bp, Homo sapiens
agtgcggctcgtcgcctactgtgg

SEQ ID NO: 33756 - DNA, 22 bp, Homo sapiens
tgcggctcgtcgcctactgtgg

SEQ ID NO: 33757 - DNA, 21 bp, Homo sapiens
gcggctcgtcgcctactgtgg

SEQ ID NO: 33758 - DNA, 22 bp, Homo sapiens
gcggctcgtcgcctactgtggc

SEQ ID NO: 33759 - DNA, 20 bp, Homo sapiens
cggctcgtcgcctactgtgg

SEQ ID NO: 33760 - DNA, 19 bp, Homo sapiens
ggctcgtcgcctactgtgg

SEQ ID NO: 33761 - DNA, 21 bp, Homo sapiens
gtgggtgtgcgcgcccggcgc

SEQ ID NO: 33762 - DNA, 22 bp, Homo sapiens
gcgctctgtccggcgcgtgacc

SEQ ID NO: 33763 - DNA, 25 bp, Homo sapiens
cgctcccgtgccgagtcgtgaccgg

SEQ ID NO: 33764 - DNA, 22 bp, Homo sapiens
gctcccgtgccgagtcgtgacc

SEQ ID NO: 33765 - DNA, 24 bp, Homo sapiens
gctcccgtgccgagtcgtgaccgg

SEQ ID NO: 33766 - DNA, 22 bp, Homo sapiens
ctcccgtgccgagtcgtgaccg

SEQ ID NO: 33767 - DNA, 19 bp, Homo sapiens
cgtgccgagtcgtgaccgg

SEQ ID NO: 33768 - DNA, 21 bp, Homo sapiens
cgtgccgagtcgtgaccggtg

SEQ ID NO: 33769 - DNA, 18 bp, Homo sapiens
gtgccgagtcgtgaccgg

SEQ ID NO: 33770 - DNA, 20 bp, Homo sapiens
gtgccgagtcgtgaccggtg

SEQ ID NO: 33771 - DNA, 24 bp, Homo sapiens
cgcgtttgcgtggcacggggtcgg

SEQ ID NO: 33772 - DNA, 23 bp, Homo sapiens
gcgtttgcgtggcacggggtcgg

SEQ ID NO: 33773 - DNA, 21 bp, Homo sapiens
gtttgcgtggcacggggtcgg

SEQ ID NO: 33774 - DNA, 20 bp, Homo sapiens
tttgcgtggcacggggtcgg

SEQ ID NO: 33775 - DNA, 17 bp, Homo sapiens
ctggccctgggaaagcg

SEQ ID NO: 33776 - DNA, 18 bp, Homo sapiens
ctggccctgggaaagcgt

SEQ ID NO: 33777 - DNA, 16 bp, Homo sapiens
tggccctgggaaagcg

SEQ ID NO: 33778 - DNA, 16 bp, Homo sapiens
ggccctgggaaagcgt

SEQ ID NO: 33779 - DNA, 17 bp, Homo sapiens
ggccctgggaaagcgtc

SEQ ID NO: 33780 - DNA, 27 bp, Homo sapiens
tctcccggagcgggaccgggtcggagg

SEQ ID NO: 33781 - DNA, 28 bp, Homo sapiens
tctcccggagcgggaccgggtcggagga

SEQ ID NO: 33782 - DNA, 26 bp, Homo sapiens
ctcccggagcgggaccgggtcggagg

SEQ ID NO: 33783 - DNA, 27 bp, Homo sapiens
ctcccggagcgggaccgggtcggagga

SEQ ID NO: 33784 - DNA, 26 bp, Homo sapiens
tcccggagcgggaccgggtcggagga

SEQ ID NO: 33785 - DNA, 21 bp, Homo sapiens
cccggagcgggaccgggtcgg

SEQ ID NO: 33786 - DNA, 24 bp, Homo sapiens
cccggagcgggaccgggtcggagg

SEQ ID NO: 33787 - DNA, 25 bp, Homo sapiens
cccggagcgggaccgggtcggagga

SEQ ID NO: 33788 - DNA, 27 bp, Homo sapiens
cccggagcgggaccgggtcggaggatg

SEQ ID NO: 33789 - DNA, 30 bp, Homo sapiens
cccggagcgggaccgggtcggaggatggac

SEQ ID NO: 33790 - DNA, 23 bp, Homo sapiens
ccggagcgggaccgggtcggagg

SEQ ID NO: 33791 - DNA, 24 bp, Homo sapiens
ccggagcgggaccgggtcggagga

SEQ ID NO: 33792 - DNA, 26 bp, Homo sapiens
ccggagcgggaccgggtcggaggatg

SEQ ID NO: 33793 - DNA, 19 bp, Homo sapiens
cggagcgggaccgggtcgg

SEQ ID NO: 33794 - DNA, 21 bp, Homo sapiens
cggagcgggaccgggtcggag

SEQ ID NO: 33795 - DNA, 22 bp, Homo sapiens
cggagcgggaccgggtcggagg

SEQ ID NO: 33796 - DNA, 23 bp, Homo sapiens
cggagcgggaccgggtcggagga

SEQ ID NO: 33797 - DNA, 24 bp, Homo sapiens
cggagcgggaccgggtcggaggat

SEQ ID NO: 33798 - DNA, 25 bp, Homo sapiens
cggagcgggaccgggtcggaggatg

SEQ ID NO: 33799 - DNA, 18 bp, Homo sapiens
ggagcgggaccgggtcgg

SEQ ID NO: 33800 - DNA, 20 bp, Homo sapiens
ggagcgggaccgggtcggag

SEQ ID NO: 33801 - DNA, 21 bp, Homo sapiens
ggagcgggaccgggtcggagg

SEQ ID NO: 33802 - DNA, 22 bp, Homo sapiens
ggagcgggaccgggtcggagga

SEQ ID NO: 33803 - DNA, 23 bp, Homo sapiens
ggagcgggaccgggtcggaggat

SEQ ID NO: 33804 - DNA, 24 bp, Homo sapiens
ggagcgggaccgggtcggaggatg

SEQ ID NO: 33805 - DNA, 25 bp, Homo sapiens
ggagcgggaccgggtcggaggatgg

SEQ ID NO: 33806 - DNA, 17 bp, Homo sapiens
gagcgggaccgggtcgg

SEQ ID NO: 33807 - DNA, 19 bp, Homo sapiens
gagcgggaccgggtcggag

SEQ ID NO: 33808 - DNA, 20 bp, Homo sapiens
gagcgggaccgggtcggagg

SEQ ID NO: 33809 - DNA, 21 bp, Homo sapiens
gagcgggaccgggtcggagga

SEQ ID NO: 33810 - DNA, 22 bp, Homo sapiens
gagcgggaccgggtcggaggat

SEQ ID NO: 33811 - DNA, 23 bp, Homo sapiens
gagcgggaccgggtcggaggatg

SEQ ID NO: 33812 - DNA, 24 bp, Homo sapiens
gagcgggaccgggtcggaggatgg

SEQ ID NO: 33813 - DNA, 29 bp, Homo sapiens
gagcgggaccgggtcggaggatggacgag

SEQ ID NO: 33814 - DNA, 19 bp, Homo sapiens
agcgggaccgggtcggagg

SEQ ID NO: 33815 - DNA, 20 bp, Homo sapiens
agcgggaccgggtcggagga

SEQ ID NO: 33816 - DNA, 22 bp, Homo sapiens
agcgggaccgggtcggaggatg

SEQ ID NO: 33817 - DNA, 18 bp, Homo sapiens
gcgggaccgggtcggagg

SEQ ID NO: 33818 - DNA, 19 bp, Homo sapiens
gcgggaccgggtcggagga

SEQ ID NO: 33819 - DNA, 19 bp, Homo sapiens
ccgggtcggaggatggacg

SEQ ID NO: 33820 - DNA, 20 bp, Homo sapiens
ccgggtcggaggatggacga

SEQ ID NO: 33821 - DNA, 18 bp, Homo sapiens
cgggtcggaggatggacg

SEQ ID NO: 33822 - DNA, 19 bp, Homo sapiens
cgggtcggaggatggacga

SEQ ID NO: 33823 - DNA, 20 bp, Homo sapiens
cgggtcggaggatggacgag

SEQ ID NO: 33824 - DNA, 21 bp, Homo sapiens
cgggtcggaggatggacgaga

SEQ ID NO: 33825 - DNA, 30 bp, Homo sapiens
cgggtcggaggatggacgagaatcacgagc

SEQ ID NO: 33826 - DNA, 18 bp, Homo sapiens
gggtcggaggatggacga

SEQ ID NO: 33827 - DNA, 20 bp, Homo sapiens
gatggacgagaatcacgagc

SEQ ID NO: 33828 - DNA, 23 bp, Homo sapiens
gatggacgagaatcacgagcgac

SEQ ID NO: 33829 - DNA, 24 bp, Homo sapiens
gatggacgagaatcacgagcgacg

SEQ ID NO: 33830 - DNA, 25 bp, Homo sapiens
gatggacgagaatcacgagcgacgg

SEQ ID NO: 33831 - DNA, 26 bp, Homo sapiens
gatggacgagaatcacgagcgacggt

SEQ ID NO: 33832 - DNA, 19 bp, Homo sapiens
atggacgagaatcacgagc

SEQ ID NO: 33833 - DNA, 22 bp, Homo sapiens
atggacgagaatcacgagcgac

SEQ ID NO: 33834 - DNA, 23 bp, Homo sapiens
atggacgagaatcacgagcgacg

SEQ ID NO: 33835 - DNA, 24 bp, Homo sapiens
atggacgagaatcacgagcgacgg

SEQ ID NO: 33836 - DNA, 25 bp, Homo sapiens
atggacgagaatcacgagcgacggt

SEQ ID NO: 33837 - DNA, 26 bp, Homo sapiens
atggacgagaatcacgagcgacggtg

SEQ ID NO: 33838 - DNA, 27 bp, Homo sapiens
atggacgagaatcacgagcgacggtgg

SEQ ID NO: 33839 - DNA, 23 bp, Homo sapiens
tggacgagaatcacgagcgacgg

SEQ ID NO: 33840 - DNA, 20 bp, Homo sapiens
ggacgagaatcacgagcgac

SEQ ID NO: 33841 - DNA, 22 bp, Homo sapiens
ggacgagaatcacgagcgacgg

SEQ ID NO: 33842 - DNA, 23 bp, Homo sapiens
ggacgagaatcacgagcgacggt

SEQ ID NO: 33843 - DNA, 22 bp, Homo sapiens
cgtgtcgggttcgtggctgcgg

SEQ ID NO: 33844 - DNA, 21 bp, Homo sapiens
gtgtcgggttcgtggctgcgg

SEQ ID NO: 33845 - DNA, 20 bp, Homo sapiens
tgtcgggttcgtggctgcgg

SEQ ID NO: 33846 - DNA, 20 bp, Homo sapiens
ggtcgctccggggcccccgg

SEQ ID NO: 33847 - DNA, 19 bp, Homo sapiens
cccggggctcgcgaggcgg

SEQ ID NO: 33848 - DNA, 20 bp, Homo sapiens
cccggggctcgcgaggcggt

SEQ ID NO: 33849 - DNA, 18 bp, Homo sapiens
ccggggctcgcgaggcgg

SEQ ID NO: 33850 - DNA, 19 bp, Homo sapiens
ccggggctcgcgaggcggt

SEQ ID NO: 33851 - DNA, 20 bp, Homo sapiens
ccggggctcgcgaggcggtt

SEQ ID NO: 33852 - DNA, 19 bp, Homo sapiens
cggggctcgcgaggcggtt

SEQ ID NO: 33853 - DNA, 26 bp, Homo sapiens
ctcggtgggggccgagggccgtccgg

SEQ ID NO: 33854 - DNA, 19 bp, Homo sapiens
gcggggcgccgcgggaccg

SEQ ID NO: 33855 - DNA, 22 bp, Homo sapiens
ggtggcccggccgtgcctgagg

SEQ ID NO: 33856 - DNA, 21 bp, Homo sapiens
gccgcctctgcgggctcccgg

SEQ ID NO: 33857 - DNA, 18 bp, Homo sapiens
gcctctgcgggctcccgg

SEQ ID NO: 33858 - DNA, 22 bp, Homo sapiens
gggctcccgggtgcccttgccc

SEQ ID NO: 33859 - DNA, 23 bp, Homo sapiens
gggctcccgggtgcccttgccct

SEQ ID NO: 33860 - DNA, 21 bp, Homo sapiens
ccttgccctcgcggtccccgg

SEQ ID NO: 33861 - DNA, 22 bp, Homo sapiens
ccttgccctcgcggtccccggc

SEQ ID NO: 33862 - DNA, 20 bp, Homo sapiens
ccccccgagcggctcaccgg

SEQ ID NO: 33863 - DNA, 21 bp, Homo sapiens
ccccccgagcggctcaccggc

SEQ ID NO: 33864 - DNA, 29 bp, Homo sapiens
gcttcacgtccgttggtggccccgcctgg

SEQ ID NO: 33865 - DNA, 23 bp, Homo sapiens
gcctcgtggggcgccgccgccgg

SEQ ID NO: 33866 - DNA, 21 bp, Homo sapiens
tcgtggggcgccgccgccggc

SEQ ID NO: 33867 - DNA, 20 bp, Homo sapiens
cgtggggcgccgccgccggc

SEQ ID NO: 33868 - DNA, 17 bp, Homo sapiens
ggggcgccgccgccggc

SEQ ID NO: 33869 - DNA, 19 bp, Homo sapiens
gccttggggaccgggtcgg

SEQ ID NO: 33870 - DNA, 23 bp, Homo sapiens
ccttggggaccgggtcggtggcg

SEQ ID NO: 33871 - DNA, 19 bp, Homo sapiens
ttggggaccgggtcggtgg

SEQ ID NO: 33872 - DNA, 21 bp, Homo sapiens
ttggggaccgggtcggtggcg

SEQ ID NO: 33873 - DNA, 20 bp, Homo sapiens
ggggaccgggtcggtggcgc

SEQ ID NO: 33874 - DNA, 19 bp, Homo sapiens
ggcccggtgggcttcccgg

SEQ ID NO: 33875 - DNA, 21 bp, Homo sapiens
gcccggtgggcttcccggagg

SEQ ID NO: 33876 - DNA, 22 bp, Homo sapiens
gcccggtgggcttcccggaggg

SEQ ID NO: 33877 - DNA, 24 bp, Homo sapiens
gagggttccgggggtcggcctgcg

SEQ ID NO: 33878 - DNA, 21 bp, Homo sapiens
ggttccgggggtcggcctgcg

SEQ ID NO: 33879 - DNA, 22 bp, Homo sapiens
ggttccgggggtcggcctgcgg

SEQ ID NO: 33880 - DNA, 20 bp, Homo sapiens
gttccgggggtcggcctgcg

SEQ ID NO: 33881 - DNA, 21 bp, Homo sapiens
gttccgggggtcggcctgcgg

SEQ ID NO: 33882 - DNA, 20 bp, Homo sapiens
ccgggggtcggcctgcggcg

SEQ ID NO: 33883 - DNA, 21 bp, Homo sapiens
ccgggggtcggcctgcggcgc

SEQ ID NO: 33884 - DNA, 22 bp, Homo sapiens
ccgggggtcggcctgcggcgcg

SEQ ID NO: 33885 - DNA, 17 bp, Homo sapiens
cgggggtcggcctgcgg

SEQ ID NO: 33886 - DNA, 18 bp, Homo sapiens
cgggggtcggcctgcggc

SEQ ID NO: 33887 - DNA, 19 bp, Homo sapiens
cgggggtcggcctgcggcg

SEQ ID NO: 33888 - DNA, 20 bp, Homo sapiens
cgggggtcggcctgcggcgc

SEQ ID NO: 33889 - DNA, 16 bp, Homo sapiens
gggggtcggcctgcgg

SEQ ID NO: 33890 - DNA, 19 bp, Homo sapiens
gggggtcggcctgcggcgc

SEQ ID NO: 33891 - DNA, 22 bp, Homo sapiens
ggggtcggcctgcggcgcgtgc

SEQ ID NO: 33892 - DNA, 22 bp, Homo sapiens
gcggcgcgtgcgggggaggaga

SEQ ID NO: 33893 - DNA, 17 bp, Homo sapiens
cggtcggccgccccggg

SEQ ID NO: 33894 - DNA, 21 bp, Homo sapiens
ccgggtgccgcgcggtgccgc

SEQ ID NO: 33895 - DNA, 23 bp, Homo sapiens
gtcggccgcgctcgaggggtccc

SEQ ID NO: 33896 - DNA, 24 bp, Homo sapiens
gtcggccgcgctcgaggggtcccc

SEQ ID NO: 33897 - DNA, 22 bp, Homo sapiens
tggcgtccccttccccgccggc

SEQ ID NO: 33898 - DNA, 20 bp, Homo sapiens
gcgtccccttccccgccggc

SEQ ID NO: 33899 - DNA, 21 bp, Homo sapiens
gcgtccccttccccgccggcc

SEQ ID NO: 33900 - DNA, 20 bp, Homo sapiens
ctcgtcttctcccggcccgc

SEQ ID NO: 33901 - DNA, 21 bp, Homo sapiens
ctcgtcttctcccggcccgct

SEQ ID NO: 33902 - DNA, 23 bp, Homo sapiens
ctcgtcttctcccggcccgctct

SEQ ID NO: 33903 - DNA, 18 bp, Homo sapiens
cgtcttctcccggcccgc

SEQ ID NO: 33904 - DNA, 19 bp, Homo sapiens
cgtcttctcccggcccgct

SEQ ID NO: 33905 - DNA, 21 bp, Homo sapiens
cgtcttctcccggcccgctct

SEQ ID NO: 33906 - DNA, 21 bp, Homo sapiens
cttccgaaccgggtcggcgcg

SEQ ID NO: 33907 - DNA, 23 bp, Homo sapiens
cttccgaaccgggtcggcgcgtc

SEQ ID NO: 33908 - DNA, 22 bp, Homo sapiens
ttccgaaccgggtcggcgcgtc

SEQ ID NO: 33909 - DNA, 19 bp, Homo sapiens
tccgaaccgggtcggcgcg

SEQ ID NO: 33910 - DNA, 21 bp, Homo sapiens
tccgaaccgggtcggcgcgtc

SEQ ID NO: 33911 - DNA, 22 bp, Homo sapiens
tccgaaccgggtcggcgcgtcc

SEQ ID NO: 33912 - DNA, 23 bp, Homo sapiens
tccgaaccgggtcggcgcgtccc

SEQ ID NO: 33913 - DNA, 24 bp, Homo sapiens
tccgaaccgggtcggcgcgtcccc

SEQ ID NO: 33914 - DNA, 25 bp, Homo sapiens
tccgaaccgggtcggcgcgtccccc

SEQ ID NO: 33915 - DNA, 26 bp, Homo sapiens
tccgaaccgggtcggcgcgtcccccg

SEQ ID NO: 33916 - DNA, 18 bp, Homo sapiens
ccgaaccgggtcggcgcg

SEQ ID NO: 33917 - DNA, 20 bp, Homo sapiens
ccgaaccgggtcggcgcgtc

SEQ ID NO: 33918 - DNA, 21 bp, Homo sapiens
ccgaaccgggtcggcgcgtcc

SEQ ID NO: 33919 - DNA, 22 bp, Homo sapiens
ccgaaccgggtcggcgcgtccc

SEQ ID NO: 33920 - DNA, 17 bp, Homo sapiens
cgaaccgggtcggcgcg

SEQ ID NO: 33921 - DNA, 19 bp, Homo sapiens
cgaaccgggtcggcgcgtc

SEQ ID NO: 33922 - DNA, 21 bp, Homo sapiens
cgaaccgggtcggcgcgtccc

SEQ ID NO: 33923 - DNA, 22 bp, Homo sapiens
cgaaccgggtcggcgcgtcccc

SEQ ID NO: 33924 - DNA, 18 bp, Homo sapiens
gaaccgggtcggcgcgtc

SEQ ID NO: 33925 - DNA, 22 bp, Homo sapiens
tccgtcccgggcgtcggcgtcg

SEQ ID NO: 33926 - DNA, 23 bp, Homo sapiens
tccgtcccgggcgtcggcgtcgg

SEQ ID NO: 33927 - DNA, 17 bp, Homo sapiens
cgtcccgggcgtcggcg

SEQ ID NO: 33928 - DNA, 18 bp, Homo sapiens
cgtcccgggcgtcggcgt

SEQ ID NO: 33929 - DNA, 19 bp, Homo sapiens
cgtcccgggcgtcggcgtc

SEQ ID NO: 33930 - DNA, 20 bp, Homo sapiens
cgtcccgggcgtcggcgtcg

SEQ ID NO: 33931 - DNA, 21 bp, Homo sapiens
cgtcccgggcgtcggcgtcgg

SEQ ID NO: 33932 - DNA, 22 bp, Homo sapiens
cgtcccgggcgtcggcgtcggg

SEQ ID NO: 33933 - DNA, 17 bp, Homo sapiens
gtcccgggcgtcggcgt

SEQ ID NO: 33934 - DNA, 18 bp, Homo sapiens
gtcccgggcgtcggcgtc

SEQ ID NO: 33935 - DNA, 19 bp, Homo sapiens
gtcccgggcgtcggcgtcg

SEQ ID NO: 33936 - DNA, 20 bp, Homo sapiens
gtcccgggcgtcggcgtcgg

SEQ ID NO: 33937 - DNA, 21 bp, Homo sapiens
gtcccgggcgtcggcgtcggg

SEQ ID NO: 33938 - DNA, 18 bp, Homo sapiens
tcccgggcgtcggcgtcg

SEQ ID NO: 33939 - DNA, 19 bp, Homo sapiens
tcccgggcgtcggcgtcgg

SEQ ID NO: 33940 - DNA, 20 bp, Homo sapiens
tcccgggcgtcggcgtcggg

SEQ ID NO: 33941 - DNA, 18 bp, Homo sapiens
cccgggcgtcggcgtcgg

SEQ ID NO: 33942 - DNA, 19 bp, Homo sapiens
cccgggcgtcggcgtcggg

SEQ ID NO: 33943 - DNA, 17 bp, Homo sapiens
ccgggcgtcggcgtcgg

SEQ ID NO: 33944 - DNA, 18 bp, Homo sapiens
ccgggcgtcggcgtcggg

SEQ ID NO: 33945 - DNA, 16 bp, Homo sapiens
cgggcgtcggcgtcgg

SEQ ID NO: 33946 - DNA, 17 bp, Homo sapiens
cgggcgtcggcgtcggg

SEQ ID NO: 33947 - DNA, 23 bp, Homo sapiens
cgggcgtcggcgtcggggagagc

SEQ ID NO: 33948 - DNA, 16 bp, Homo sapiens
gggcgtcggcgtcggg

SEQ ID NO: 33949 - DNA, 21 bp, Homo sapiens
gggcgtcggcgtcggggagag

SEQ ID NO: 33950 - DNA, 22 bp, Homo sapiens
gggcgtcggcgtcggggagagc

SEQ ID NO: 33951 - DNA, 18 bp, Homo sapiens
ccgtcctccccgcgtggc

SEQ ID NO: 33952 - DNA, 19 bp, Homo sapiens
ccgtcctccccgcgtggcg

SEQ ID NO: 33953 - DNA, 18 bp, Homo sapiens
cgtcctccccgcgtggcg

SEQ ID NO: 33954 - DNA, 19 bp, Homo sapiens
cggacaggcgttcgtgcga

SEQ ID NO: 33955 - DNA, 20 bp, Homo sapiens
cggacaggcgttcgtgcgac

SEQ ID NO: 33956 - DNA, 21 bp, Homo sapiens
cggacaggcgttcgtgcgacg

SEQ ID NO: 33957 - DNA, 22 bp, Homo sapiens
cggacaggcgttcgtgcgacgt

SEQ ID NO: 33958 - DNA, 21 bp, Homo sapiens
aggcgttcgtgcgacgtgtgg

SEQ ID NO: 33959 - DNA, 20 bp, Homo sapiens
ggcgttcgtgcgacgtgtgg

SEQ ID NO: 33960 - DNA, 19 bp, Homo sapiens
gcgttcgtgcgacgtgtgg

SEQ ID NO: 33961 - DNA, 19 bp, Homo sapiens
gtcgacctccgccttgccg

SEQ ID NO: 33962 - DNA, 19 bp, Homo sapiens
gcctcggccccggtcgcgg

SEQ ID NO: 33963 - DNA, 17 bp, Homo sapiens
ggtcgcggtcccccgtc

SEQ ID NO: 33964 - DNA, 18 bp, Homo sapiens
ggtcgcggtcccccgtcc

SEQ ID NO: 33965 - DNA, 16 bp, Homo sapiens
gtcgcggtcccccgtc

SEQ ID NO: 33966 - DNA, 18 bp, Homo sapiens
gtcgcggtcccccgtccc

SEQ ID NO: 33967 - DNA, 19 bp, Homo sapiens
gtcgcggtcccccgtcccg

SEQ ID NO: 33968 - DNA, 20 bp, Homo sapiens
gtcgcggtcccccgtcccgg

SEQ ID NO: 33969 - DNA, 21 bp, Homo sapiens
gtcgcggtcccccgtcccggg

SEQ ID NO: 33970 - DNA, 22 bp, Homo sapiens
gtcgcggtcccccgtcccgggc

SEQ ID NO: 33971 - DNA, 23 bp, Homo sapiens
gtcgcggtcccccgtcccgggcg

SEQ ID NO: 33972 - DNA, 26 bp, Homo sapiens
gtcgcggtcccccgtcccgggcgggg

SEQ ID NO: 33973 - DNA, 29 bp, Homo sapiens
gtcgcggtcccccgtcccgggcgggggcg

SEQ ID NO: 33974 - DNA, 20 bp, Homo sapiens
gccctcccttggccgtcgtg

SEQ ID NO: 33975 - DNA, 21 bp, Homo sapiens
gccctcccttggccgtcgtgt

SEQ ID NO: 33976 - DNA, 22 bp, Homo sapiens
gccctcccttggccgtcgtgtg

SEQ ID NO: 33977 - DNA, 23 bp, Homo sapiens
gccctcccttggccgtcgtgtgg

SEQ ID NO: 33978 - DNA, 20 bp, Homo sapiens
ctcccttggccgtcgtgtgg

SEQ ID NO: 33979 - DNA, 19 bp, Homo sapiens
tcccttggccgtcgtgtgg

SEQ ID NO: 33980 - DNA, 30 bp, Homo sapiens
gggcttcggccgggccccgggccctcgacc

SEQ ID NO: 33981 - DNA, 20 bp, Homo sapiens
ggcttcggccgggccccggg

SEQ ID NO: 33982 - DNA, 19 bp, Homo sapiens
gcttcggccgggccccggg

SEQ ID NO: 33983 - DNA, 18 bp, Homo sapiens
cttcggccgggccccggg

SEQ ID NO: 33984 - DNA, 24 bp, Homo sapiens
gccgggccccgggccctcgaccgg

SEQ ID NO: 33985 - DNA, 25 bp, Homo sapiens
gccgggccccgggccctcgaccgga

SEQ ID NO: 33986 - DNA, 23 bp, Homo sapiens
ccgggccccgggccctcgaccgg

SEQ ID NO: 33987 - DNA, 24 bp, Homo sapiens
ccgggccccgggccctcgaccgga

SEQ ID NO: 33988 - DNA, 22 bp, Homo sapiens
cgggccccgggccctcgaccgg

SEQ ID NO: 33989 - DNA, 19 bp, Homo sapiens
gggccccgggccctcgacc

SEQ ID NO: 33990 - DNA, 20 bp, Homo sapiens
gggccccgggccctcgaccg

SEQ ID NO: 33991 - DNA, 21 bp, Homo sapiens
gggccccgggccctcgaccgg

SEQ ID NO: 33992 - DNA, 22 bp, Homo sapiens
gggccccgggccctcgaccgga

SEQ ID NO: 33993 - DNA, 23 bp, Homo sapiens
gggccccgggccctcgaccggac

SEQ ID NO: 33994 - DNA, 24 bp, Homo sapiens
gggccccgggccctcgaccggacc

SEQ ID NO: 33995 - DNA, 18 bp, Homo sapiens
ggccccgggccctcgacc

SEQ ID NO: 33996 - DNA, 20 bp, Homo sapiens
ggccccgggccctcgaccgg

SEQ ID NO: 33997 - DNA, 21 bp, Homo sapiens
ggccccgggccctcgaccgga

SEQ ID NO: 33998 - DNA, 22 bp, Homo sapiens
ggccccgggccctcgaccggac

SEQ ID NO: 33999 - DNA, 23 bp, Homo sapiens
gggccctcgaccggaccggtgcg

SEQ ID NO: 34000 - DNA, 25 bp, Homo sapiens
gggccctcgaccggaccggtgcgcg

SEQ ID NO: 34001 - DNA, 26 bp, Homo sapiens
gggccctcgaccggaccggtgcgcgg

SEQ ID NO: 34002 - DNA, 22 bp, Homo sapiens
ggccctcgaccggaccggtgcg

SEQ ID NO: 34003 - DNA, 24 bp, Homo sapiens
ggccctcgaccggaccggtgcgcg

SEQ ID NO: 34004 - DNA, 25 bp, Homo sapiens
ggccctcgaccggaccggtgcgcgg

SEQ ID NO: 34005 - DNA, 20 bp, Homo sapiens
ccctcgaccggaccggtgcg

SEQ ID NO: 34006 - DNA, 22 bp, Homo sapiens
ccctcgaccggaccggtgcgcg

SEQ ID NO: 34007 - DNA, 23 bp, Homo sapiens
ccctcgaccggaccggtgcgcgg

SEQ ID NO: 34008 - DNA, 19 bp, Homo sapiens
cctcgaccggaccggtgcg

SEQ ID NO: 34009 - DNA, 21 bp, Homo sapiens
cctcgaccggaccggtgcgcg

SEQ ID NO: 34010 - DNA, 22 bp, Homo sapiens
cctcgaccggaccggtgcgcgg

SEQ ID NO: 34011 - DNA, 23 bp, Homo sapiens
cctcgaccggaccggtgcgcggg

SEQ ID NO: 34012 - DNA, 28 bp, Homo sapiens
cctcgaccggaccggtgcgcgggcgctg

SEQ ID NO: 34013 - DNA, 30 bp, Homo sapiens
cctcgaccggaccggtgcgcgggcgctgcg

SEQ ID NO: 34014 - DNA, 21 bp, Homo sapiens
ctcgaccggaccggtgcgcgg

SEQ ID NO: 34015 - DNA, 18 bp, Homo sapiens
cgctcgccgcccggacgt

SEQ ID NO: 34016 - DNA, 20 bp, Homo sapiens
cgctcgccgcccggacgtcg

SEQ ID NO: 34017 - DNA, 21 bp, Homo sapiens
cgctcgccgcccggacgtcgg

SEQ ID NO: 34018 - DNA, 19 bp, Homo sapiens
gctcgccgcccggacgtcg

SEQ ID NO: 34019 - DNA, 18 bp, Homo sapiens
ctcgccgcccggacgtcg

SEQ ID NO: 34020 - DNA, 19 bp, Homo sapiens
ctcgccgcccggacgtcgg

SEQ ID NO: 34021 - DNA, 16 bp, Homo sapiens
cgccgcccggacgtcg

SEQ ID NO: 34022 - DNA, 17 bp, Homo sapiens
cgccgcccggacgtcgg

SEQ ID NO: 34023 - DNA, 19 bp, Homo sapiens
gcgcgcgcgcgcgtggccg

SEQ ID NO: 34024 - DNA, 17 bp, Homo sapiens
gggcgcgacgaagaagc

SEQ ID NO: 34025 - DNA, 20 bp, Homo sapiens
gggcgcgacgaagaagcgtc

SEQ ID NO: 34026 - DNA, 16 bp, Homo sapiens
ggcgcgacgaagaagc

SEQ ID NO: 34027 - DNA, 23 bp, Homo sapiens
gaagaagcgtcgcgggtctgtgg

SEQ ID NO: 34028 - DNA, 22 bp, Homo sapiens
aagaagcgtcgcgggtctgtgg

SEQ ID NO: 34029 - DNA, 23 bp, Homo sapiens
aagaagcgtcgcgggtctgtggc

SEQ ID NO: 34030 - DNA, 21 bp, Homo sapiens
agaagcgtcgcgggtctgtgg

SEQ ID NO: 34031 - DNA, 20 bp, Homo sapiens
gaagcgtcgcgggtctgtgg

SEQ ID NO: 34032 - DNA, 21 bp, Homo sapiens
gaagcgtcgcgggtctgtggc

SEQ ID NO: 34033 - DNA, 22 bp, Homo sapiens
gaagcgtcgcgggtctgtggcg

SEQ ID NO: 34034 - DNA, 19 bp, Homo sapiens
aagcgtcgcgggtctgtgg

SEQ ID NO: 34035 - DNA, 20 bp, Homo sapiens
aagcgtcgcgggtctgtggc

SEQ ID NO: 34036 - DNA, 18 bp, Homo sapiens
agcgtcgcgggtctgtgg

SEQ ID NO: 34037 - DNA, 19 bp, Homo sapiens
agcgtcgcgggtctgtggc

SEQ ID NO: 34038 - DNA, 17 bp, Homo sapiens
gcgtcgcgggtctgtgg

SEQ ID NO: 34039 - DNA, 18 bp, Homo sapiens
gcgtcgcgggtctgtggc

SEQ ID NO: 34040 - DNA, 21 bp, Homo sapiens
cgcgggtctgtggcgcggggc

SEQ ID NO: 34041 - DNA, 19 bp, Homo sapiens
cggtggtcgtgtcgcgtgg

SEQ ID NO: 34042 - DNA, 20 bp, Homo sapiens
cggtggtcgtgtcgcgtggg

SEQ ID NO: 34043 - DNA, 18 bp, Homo sapiens
ggtggtcgtgtcgcgtgg

SEQ ID NO: 34044 - DNA, 19 bp, Homo sapiens
ggtggtcgtgtcgcgtggg

SEQ ID NO: 34045 - DNA, 17 bp, Homo sapiens
gtggtcgtgtcgcgtgg

SEQ ID NO: 34046 - DNA, 18 bp, Homo sapiens
gtggtcgtgtcgcgtggg

SEQ ID NO: 34047 - DNA, 18 bp, Homo sapiens
gtcgtgtcgcgtgggggg

SEQ ID NO: 34048 - DNA, 19 bp, Homo sapiens
gtcgtgtcgcgtggggggc

SEQ ID NO: 34049 - DNA, 20 bp, Homo sapiens
gtcgtgtcgcgtggggggcg

SEQ ID NO: 34050 - DNA, 16 bp, Homo sapiens
ccgctcgctccctccc

SEQ ID NO: 34051 - DNA, 21 bp, Homo sapiens
tcccgtccgcccgtccgcggc

SEQ ID NO: 34052 - DNA, 18 bp, Homo sapiens
cccgtccgtccgtccgtc

SEQ ID NO: 34053 - DNA, 16 bp, Homo sapiens
ccgtccgtccgtccgt

SEQ ID NO: 34054 - DNA, 17 bp, Homo sapiens
ccgtccgtccgtccgtc

SEQ ID NO: 34055 - DNA, 16 bp, Homo sapiens
cgtccgtccgtccgtc

SEQ ID NO: 34056 - DNA, 21 bp, Homo sapiens
tcgcgaggccccccggccggc

SEQ ID NO: 34057 - DNA, 19 bp, Homo sapiens
cgcgaggccccccggccgg

SEQ ID NO: 34058 - DNA, 20 bp, Homo sapiens
cgcgaggccccccggccggc

SEQ ID NO: 34059 - DNA, 19 bp, Homo sapiens
gcgaggccccccggccggc

SEQ ID NO: 34060 - DNA, 19 bp, Homo sapiens
ggccgtccggccgcgtcgg

SEQ ID NO: 34061 - DNA, 20 bp, Homo sapiens
ccgtccggccgcgtcggggc

SEQ ID NO: 34062 - DNA, 16 bp, Homo sapiens
cgtccggccgcgtcgg

SEQ ID NO: 34063 - DNA, 17 bp, Homo sapiens
cgtccggccgcgtcggg

SEQ ID NO: 34064 - DNA, 18 bp, Homo sapiens
cgtccggccgcgtcgggg

SEQ ID NO: 34065 - DNA, 20 bp, Homo sapiens
cgtccggccgcgtcggggcc

SEQ ID NO: 34066 - DNA, 23 bp, Homo sapiens
cgtccggccgcgtcggggcctcg

SEQ ID NO: 34067 - DNA, 21 bp, Homo sapiens
ggccgcgtcggggcctcgccg

SEQ ID NO: 34068 - DNA, 22 bp, Homo sapiens
ggccgcgtcggggcctcgccgc

SEQ ID NO: 34069 - DNA, 19 bp, Homo sapiens
cctacctggttgatcctgc

SEQ ID NO: 34070 - DNA, 20 bp, Homo sapiens
cctacctggttgatcctgcc

SEQ ID NO: 34071 - DNA, 22 bp, Homo sapiens
cctacctggttgatcctgccag

SEQ ID NO: 34072 - DNA, 23 bp, Homo sapiens
cctacctggttgatcctgccagt

SEQ ID NO: 34073 - DNA, 19 bp, Homo sapiens
ctacctggttgatcctgcc

SEQ ID NO: 34074 - DNA, 21 bp, Homo sapiens
ctacctggttgatcctgccag

SEQ ID NO: 34075 - DNA, 22 bp, Homo sapiens
ctacctggttgatcctgccagt

SEQ ID NO: 34076 - DNA, 16 bp, Homo sapiens
tacctggttgatcctg

SEQ ID NO: 34077 - DNA, 17 bp, Homo sapiens
tacctggttgatcctgc

SEQ ID NO: 34078 - DNA, 18 bp, Homo sapiens
tacctggttgatcctgcc

SEQ ID NO: 34079 - DNA, 19 bp, Homo sapiens
tacctggttgatcctgcca

SEQ ID NO: 34080 - DNA, 20 bp, Homo sapiens
tacctggttgatcctgccag

SEQ ID NO: 34081 - DNA, 21 bp, Homo sapiens
tacctggttgatcctgccagt

SEQ ID NO: 34082 - DNA, 22 bp, Homo sapiens
tacctggttgatcctgccagta

SEQ ID NO: 34083 - DNA, 23 bp, Homo sapiens
tacctggttgatcctgccagtag

SEQ ID NO: 34084 - DNA, 24 bp, Homo sapiens
tacctggttgatcctgccagtagc

SEQ ID NO: 34085 - DNA, 25 bp, Homo sapiens
tacctggttgatcctgccagtagca

SEQ ID NO: 34086 - DNA, 30 bp, Homo sapiens; identical to SEQ ID NO: 12067

SEQ ID NO: 34087 - DNA, 17 bp, Homo sapiens
acctggttgatcctgcc

SEQ ID NO: 34088 - DNA, 20 bp, Homo sapiens
acctggttgatcctgccagt

SEQ ID NO: 34089 - DNA, 30 bp, Homo sapiens
acctggttgatcctgccagtagcatatgct

SEQ ID NO: 34090 - DNA, 16 bp, Homo sapiens
cctggttgatcctgcc

SEQ ID NO: 34091 - DNA, 18 bp, Homo sapiens
cctggttgatcctgccag

SEQ ID NO: 34092 - DNA, 19 bp, Homo sapiens
cctggttgatcctgccagt

SEQ ID NO: 34093 - DNA, 20 bp, Homo sapiens
cctggttgatcctgccagta

SEQ ID NO: 34094 - DNA, 21 bp, Homo sapiens
cctggttgatcctgccagtag

SEQ ID NO: 34095 - DNA, 22 bp, Homo sapiens
cctggttgatcctgccagtagc

SEQ ID NO: 34096 - DNA, 30 bp, Homo sapiens
cctggttgatcctgccagtagcatatgctt

SEQ ID NO: 34097 - DNA, 16 bp, Homo sapiens
ctggttgatcctgcca

SEQ ID NO: 34098 - DNA, 20 bp, Homo sapiens
ctggttgatcctgccagtag

SEQ ID NO: 34099 - DNA, 21 bp, Homo sapiens
ctggttgatcctgccagtagc

SEQ ID NO: 34100 - DNA, 16 bp, Homo sapiens
tggttgatcctgccag

SEQ ID NO: 34101 - DNA, 17 bp, Homo sapiens
tggttgatcctgccagt

SEQ ID NO: 34102 - DNA, 19 bp, Homo sapiens
tggttgatcctgccagtag

SEQ ID NO: 34103 - DNA, 16 bp, Homo sapiens
ggttgatcctgccagt

SEQ ID NO: 34104 - DNA, 17 bp, Homo sapiens
ggttgatcctgccagta

SEQ ID NO: 34105 - DNA, 18 bp, Homo sapiens
ggttgatcctgccagtag

SEQ ID NO: 34106 - DNA, 19 bp, Homo sapiens
ggttgatcctgccagtagc

SEQ ID NO: 34107 - DNA, 21 bp, Homo sapiens
ggttgatcctgccagtagcat

SEQ ID NO: 34108 - DNA, 23 bp, Homo sapiens
ggttgatcctgccagtagcatat

SEQ ID NO: 34109 - DNA, 17 bp, Homo sapiens
gttgatcctgccagtag

SEQ ID NO: 34110 - DNA, 18 bp, Homo sapiens
gttgatcctgccagtagc

SEQ ID NO: 34111 - DNA, 20 bp, Homo sapiens
gttgatcctgccagtagcat

SEQ ID NO: 34112 - DNA, 22 bp, Homo sapiens
gttgatcctgccagtagcatat

SEQ ID NO: 34113 - DNA, 24 bp, Homo sapiens
gttgatcctgccagtagcatatgc

SEQ ID NO: 34114 - DNA, 16 bp, Homo sapiens
ttgatcctgccagtag

SEQ ID NO: 34115 - DNA, 17 bp, Homo sapiens
ttgatcctgccagtagc

SEQ ID NO: 34116 - DNA, 19 bp, Homo sapiens
ttgatcctgccagtagcat

SEQ ID NO: 34117 - DNA, 21 bp, Homo sapiens
ttgatcctgccagtagcatat

SEQ ID NO: 34118 - DNA, 22 bp, Homo sapiens
ttgatcctgccagtagcatatg

SEQ ID NO: 34119 - DNA, 23 bp, Homo sapiens
ttgatcctgccagtagcatatgc

SEQ ID NO: 34120 - DNA, 24 bp, Homo sapiens
ttgatcctgccagtagcatatgct

SEQ ID NO: 34121 - DNA, 16 bp, Homo sapiens
tgatcctgccagtagc

SEQ ID NO: 34122 - DNA, 18 bp, Homo sapiens
tgatcctgccagtagcat

SEQ ID NO: 34123 - DNA, 20 bp, Homo sapiens
tgatcctgccagtagcatat

SEQ ID NO: 34124 - DNA, 21 bp, Homo sapiens
tgatcctgccagtagcatatg

SEQ ID NO: 34125 - DNA, 17 bp, Homo sapiens
gatcctgccagtagcat

SEQ ID NO: 34126 - DNA, 19 bp, Homo sapiens
gatcctgccagtagcatat

SEQ ID NO: 34127 - DNA, 20 bp, Homo sapiens
gatcctgccagtagcatatg

SEQ ID NO: 34128 - DNA, 21 bp, Homo sapiens
gatcctgccagtagcatatgc

SEQ ID NO: 34129 - DNA, 18 bp, Homo sapiens
atcctgccagtagcatat

SEQ ID NO: 34130 - DNA, 19 bp, Homo sapiens
atcctgccagtagcatatg

SEQ ID NO: 34131 - DNA, 16 bp, Homo sapiens
cctgccagtagcatat

SEQ ID NO: 34132 - DNA, 17 bp, Homo sapiens
cctgccagtagcatatg

SEQ ID NO: 34133 - DNA, 19 bp, Homo sapiens
cctgccagtagcatatgct

SEQ ID NO: 34134 - DNA, 20 bp, Homo sapiens
cctgccagtagcatatgctt

SEQ ID NO: 34135 - DNA, 21 bp, Homo sapiens
cctgccagtagcatatgcttg

SEQ ID NO: 34136 - DNA, 17 bp, Homo sapiens
ctgccagtagcatatgc

SEQ ID NO: 34137 - DNA, 22 bp, Homo sapiens
ctgccagtagcatatgcttgtc

SEQ ID NO: 34138 - DNA, 18 bp, Homo sapiens
gccagtagcatatgcttg

SEQ ID NO: 34139 - DNA, 22 bp, Homo sapiens
gccagtagcatatgcttgtctc

SEQ ID NO: 34140 - DNA, 18 bp, Homo sapiens
gtagcatatgcttgtctc

SEQ ID NO: 34141 - DNA, 19 bp, Homo sapiens
gtagcatatgcttgtctca

SEQ ID NO: 34142 - DNA, 16 bp, Homo sapiens
gcatatgcttgtctca

SEQ ID NO: 34143 - DNA, 18 bp, Homo sapiens
gcatatgcttgtctcaaa

SEQ ID NO: 34144 - DNA, 19 bp, Homo sapiens
gcatatgcttgtctcaaag

SEQ ID NO: 34145 - DNA, 20 bp, Homo sapiens
gcatatgcttgtctcaaaga

SEQ ID NO: 34146 - DNA, 21 bp, Homo sapiens
gcatatgcttgtctcaaagat

SEQ ID NO: 34147 - DNA, 22 bp, Homo sapiens
gcatatgcttgtctcaaagatt

SEQ ID NO: 34148 - DNA, 23 bp, Homo sapiens
gcatatgcttgtctcaaagatta

SEQ ID NO: 34149 - DNA, 24 bp, Homo sapiens
gcatatgcttgtctcaaagattaa

SEQ ID NO: 34150 - DNA, 25 bp, Homo sapiens
gcatatgcttgtctcaaagattaag

SEQ ID NO: 34151 - DNA, 20 bp, Homo sapiens
catatgcttgtctcaaagat

SEQ ID NO: 34152 - DNA, 21 bp, Homo sapiens
catatgcttgtctcaaagatt

SEQ ID NO: 34153 - DNA, 18 bp, Homo sapiens
atatgcttgtctcaaaga

SEQ ID NO: 34154 - DNA, 20 bp, Homo sapiens
atatgcttgtctcaaagatt

SEQ ID NO: 34155 - DNA, 23 bp, Homo sapiens
atatgcttgtctcaaagattaag

SEQ ID NO: 34156 - DNA, 18 bp, Homo sapiens
atgcttgtctcaaagatt

SEQ ID NO: 34157 - DNA, 19 bp, Homo sapiens
cttgtctcaaagattaagc

SEQ ID NO: 34158 - DNA, 20 bp, Homo sapiens
gtctcaaagattaagccatg

SEQ ID NO: 34159 - DNA, 19 bp, Homo sapiens
tctcaaagattaagccatg

SEQ ID NO: 34160 - DNA, 21 bp, Homo sapiens
tctcaaagattaagccatgca

SEQ ID NO: 34161 - DNA, 22 bp, Homo sapiens
tctcaaagattaagccatgcat

SEQ ID NO: 34162 - DNA, 21 bp, Homo sapiens
aagattaagccatgcatgtct

SEQ ID NO: 34163 - DNA, 20 bp, Homo sapiens
agattaagccatgcatgtct

SEQ ID NO: 34164 - DNA, 19 bp, Homo sapiens
gattaagccatgcatgtct

SEQ ID NO: 34165 - DNA, 18 bp, Homo sapiens
attaagccatgcatgtct

SEQ ID NO: 34166 - DNA, 16 bp, Homo sapiens
taagccatgcatgtct

SEQ ID NO: 34167 - DNA, 18 bp, Homo sapiens
gtacgcacggccggtaca

SEQ ID NO: 34168 - DNA, 20 bp, Homo sapiens
tacgcacggccggtacagtg

SEQ ID NO: 34169 - DNA, 18 bp, Homo sapiens
acgcacggccggtacagt

SEQ ID NO: 34170 - DNA, 19 bp, Homo sapiens
acgcacggccggtacagtg

SEQ ID NO: 34171 - DNA, 20 bp, Homo sapiens
acgcacggccggtacagtga

SEQ ID NO: 34172 - DNA, 21 bp, Homo sapiens
cacggccggtacagtgaaact

SEQ ID NO: 34173 - DNA, 29 bp, Homo sapiens
acggccggtacagtgaaactgcgaatggc

SEQ ID NO: 34174 - DNA, 29 bp, Homo sapiens
ggtacagtgaaactgcgaatggctcatta

SEQ ID NO: 34175 - DNA, 21 bp, Homo sapiens
acagtgaaactgcgaatggct

SEQ ID NO: 34176 - DNA, 21 bp, Homo sapiens
cagtgaaactgcgaatggctc

SEQ ID NO: 34177 - DNA, 20 bp, Homo sapiens
agtgaaactgcgaatggctc

SEQ ID NO: 34178 - DNA, 23 bp, Homo sapiens
agtgaaactgcgaatggctcatt

SEQ ID NO: 34179 - DNA, 30 bp, Homo sapiens
agtgaaactgcgaatggctcattaaatcag

SEQ ID NO: 34180 - DNA, 22 bp, Homo sapiens
gtgaaactgcgaatggctcatt

SEQ ID NO: 34181 - DNA, 30 bp, Homo sapiens
gtgaaactgcgaatggctcattaaatcagt

SEQ ID NO: 34182 - DNA, 28 bp, Homo sapiens
tgaaactgcgaatggctcattaaatcag

SEQ ID NO: 34183 - DNA, 20 bp, Homo sapiens
gaaactgcgaatggctcatt

SEQ ID NO: 34184 - DNA, 19 bp, Homo sapiens
aaactgcgaatggctcatt

SEQ ID NO: 34185 - DNA, 18 bp, Homo sapiens
aactgcgaatggctcatt

SEQ ID NO: 34186 - DNA, 17 bp, Homo sapiens
actgcgaatggctcatt

SEQ ID NO: 34187 - DNA, 16 bp, Homo sapiens
ctgcgaatggctcatt

SEQ ID NO: 34188 - DNA, 21 bp, Homo sapiens
gcgaatggctcattaaatcag

SEQ ID NO: 34189 - DNA, 16 bp, Homo sapiens
tggctcattaaatcag

SEQ ID NO: 34190 - DNA, 20 bp, Homo sapiens
gctcattaaatcagttatgg

SEQ ID NO: 34191 - DNA, 21 bp, Homo sapiens
gctcattaaatcagttatggt

SEQ ID NO: 34192 - DNA, 23 bp, Homo sapiens
gctcattaaatcagttatggttc

SEQ ID NO: 34193 - DNA, 20 bp, Homo sapiens
ctcattaaatcagttatggt

SEQ ID NO: 34194 - DNA, 26 bp, Homo sapiens
aatcagttatggttcctttggtcgct

SEQ ID NO: 34195 - DNA, 28 bp, Homo sapiens
aatcagttatggttcctttggtcgctcg

SEQ ID NO: 34196 - DNA, 23 bp, Homo sapiens
atcagttatggttcctttggtcg

SEQ ID NO: 34197 - DNA, 25 bp, Homo sapiens
atcagttatggttcctttggtcgct

SEQ ID NO: 34198 - DNA, 27 bp, Homo sapiens
atcagttatggttcctttggtcgctcg

SEQ ID NO: 34199 - DNA, 30 bp, Homo sapiens; identical to SEQ ID NO: 12303

SEQ ID NO: 34200 - DNA, 19 bp, Homo sapiens
tcagttatggttcctttgg

SEQ ID NO: 34201 - DNA, 20 bp, Homo sapiens
tcagttatggttcctttggt

SEQ ID NO: 34202 - DNA, 21 bp, Homo sapiens
tcagttatggttcctttggtc

SEQ ID NO: 34203 - DNA, 22 bp, Homo sapiens
tcagttatggttcctttggtcg

SEQ ID NO: 34204 - DNA, 23 bp, Homo sapiens
tcagttatggttcctttggtcgc

SEQ ID NO: 34205 - DNA, 24 bp, Homo sapiens
tcagttatggttcctttggtcgct

SEQ ID NO: 34206 - DNA, 26 bp, Homo sapiens
tcagttatggttcctttggtcgctcg

SEQ ID NO: 34207 - DNA, 28 bp, Homo sapiens
tcagttatggttcctttggtcgctcgct

SEQ ID NO: 34208 - DNA, 21 bp, Homo sapiens
cagttatggttcctttggtcg

SEQ ID NO: 34209 - DNA, 23 bp, Homo sapiens
cagttatggttcctttggtcgct

SEQ ID NO: 34210 - DNA, 25 bp, Homo sapiens
cagttatggttcctttggtcgctcg

SEQ ID NO: 34211 - DNA, 18 bp, Homo sapiens
agttatggttcctttggt

SEQ ID NO: 34212 - DNA, 19 bp, Homo sapiens
agttatggttcctttggtc

SEQ ID NO: 34213 - DNA, 20 bp, Homo sapiens
agttatggttcctttggtcg

SEQ ID NO: 34214 - DNA, 21 bp, Homo sapiens
agttatggttcctttggtcgc

SEQ ID NO: 34215 - DNA, 22 bp, Homo sapiens
agttatggttcctttggtcgct

SEQ ID NO: 34216 - DNA, 23 bp, Homo sapiens
agttatggttcctttggtcgctc

SEQ ID NO: 34217 - DNA, 24 bp, Homo sapiens
agttatggttcctttggtcgctcg

SEQ ID NO: 34218 - DNA, 26 bp, Homo sapiens
agttatggttcctttggtcgctcgct

SEQ ID NO: 34219 - DNA, 27 bp, Homo sapiens
agttatggttcctttggtcgctcgctc

SEQ ID NO: 34220 - DNA, 30 bp, Homo sapiens; identical to SEQ ID NO: 12325

SEQ ID NO: 34221 - DNA, 16 bp, Homo sapiens
gttatggttcctttgg

SEQ ID NO: 34222 - DNA, 17 bp, Homo sapiens
gttatggttcctttggt

SEQ ID NO: 34223 - DNA, 18 bp, Homo sapiens
gttatggttcctttggtc

SEQ ID NO: 34224 - DNA, 19 bp, Homo sapiens
gttatggttcctttggtcg

SEQ ID NO: 34225 - DNA, 20 bp, Homo sapiens
gttatggttcctttggtcgc

SEQ ID NO: 34226 - DNA, 21 bp, Homo sapiens
gttatggttcctttggtcgct

SEQ ID NO: 34227 - DNA, 22 bp, Homo sapiens
gttatggttcctttggtcgctc

SEQ ID NO: 34228 - DNA, 23 bp, Homo sapiens
gttatggttcctttggtcgctcg

SEQ ID NO: 34229 - DNA, 24 bp, Homo sapiens
gttatggttcctttggtcgctcgc

SEQ ID NO: 34230 - DNA, 25 bp, Homo sapiens
gttatggttcctttggtcgctcgct

SEQ ID NO: 34231 - DNA, 26 bp, Homo sapiens
gttatggttcctttggtcgctcgctc

SEQ ID NO: 34232 - DNA, 27 bp, Homo sapiens
gttatggttcctttggtcgctcgctcc

SEQ ID NO: 34233 - DNA, 20 bp, Homo sapiens
ttatggttcctttggtcgct

SEQ ID NO: 34234 - DNA, 21 bp, Homo sapiens
ttatggttcctttggtcgctc

SEQ ID NO: 34235 - DNA, 22 bp, Homo sapiens
ttatggttcctttggtcgctcg

SEQ ID NO: 34236 - DNA, 23 bp, Homo sapiens
ttatggttcctttggtcgctcgc

SEQ ID NO: 34237 - DNA, 24 bp, Homo sapiens
ttatggttcctttggtcgctcgct

SEQ ID NO: 34238 - DNA, 21 bp, Homo sapiens
tatggttcctttggtcgctcg

SEQ ID NO: 34239 - DNA, 16 bp, Homo sapiens
atggttcctttggtcg

SEQ ID NO: 34240 - DNA, 17 bp, Homo sapiens
atggttcctttggtcgc

SEQ ID NO: 34241 - DNA, 18 bp, Homo sapiens
atggttcctttggtcgct

SEQ ID NO: 34242 - DNA, 19 bp, Homo sapiens
atggttcctttggtcgctc

SEQ ID NO: 34243 - DNA, 20 bp, Homo sapiens
atggttcctttggtcgctcg

SEQ ID NO: 34244 - DNA, 21 bp, Homo sapiens
atggttcctttggtcgctcgc

SEQ ID NO: 34245 - DNA, 22 bp, Homo sapiens
atggttcctttggtcgctcgct

SEQ ID NO: 34246 - DNA, 23 bp, Homo sapiens
atggttcctttggtcgctcgctc

SEQ ID NO: 34247 - DNA, 24 bp, Homo sapiens
atggttcctttggtcgctcgctcc

SEQ ID NO: 34248 - DNA, 17 bp, Homo sapiens
tggttcctttggtcgct

SEQ ID NO: 34249 - DNA, 19 bp, Homo sapiens
tggttcctttggtcgctcg

SEQ ID NO: 34250 - DNA, 20 bp, Homo sapiens
tggttcctttggtcgctcgc

SEQ ID NO: 34251 - DNA, 21 bp, Homo sapiens
tggttcctttggtcgctcgct

SEQ ID NO: 34252 - DNA, 23 bp, Homo sapiens
tggttcctttggtcgctcgctcc

SEQ ID NO: 34253 - DNA, 16 bp, Homo sapiens
ggttcctttggtcgct

SEQ ID NO: 34254 - DNA, 18 bp, Homo sapiens
ggttcctttggtcgctcg

SEQ ID NO: 34255 - DNA, 19 bp, Homo sapiens
ggttcctttggtcgctcgc

SEQ ID NO: 34256 - DNA, 20 bp, Homo sapiens
ggttcctttggtcgctcgct

SEQ ID NO: 34257 - DNA, 21 bp, Homo sapiens
ggttcctttggtcgctcgctc

SEQ ID NO: 34258 - DNA, 22 bp, Homo sapiens
ggttcctttggtcgctcgctcc

SEQ ID NO: 34259 - DNA, 23 bp, Homo sapiens
ggttcctttggtcgctcgctcct

SEQ ID NO: 34260 - DNA, 24 bp, Homo sapiens
ggttcctttggtcgctcgctcctc

SEQ ID NO: 34261 - DNA, 25 bp, Homo sapiens
ggttcctttggtcgctcgctcctct

SEQ ID NO: 34262 - DNA, 17 bp, Homo sapiens
gttcctttggtcgctcg

SEQ ID NO: 34263 - DNA, 18 bp, Homo sapiens
gttcctttggtcgctcgc

SEQ ID NO: 34264 - DNA, 19 bp, Homo sapiens
gttcctttggtcgctcgct

SEQ ID NO: 34265 - DNA, 20 bp, Homo sapiens
gttcctttggtcgctcgctc

SEQ ID NO: 34266 - DNA, 21 bp, Homo sapiens
gttcctttggtcgctcgctcc

SEQ ID NO: 34267 - DNA, 22 bp, Homo sapiens
gttcctttggtcgctcgctcct

SEQ ID NO: 34268 - DNA, 23 bp, Homo sapiens
gttcctttggtcgctcgctcctc

SEQ ID NO: 34269 - DNA, 24 bp, Homo sapiens
gttcctttggtcgctcgctcctct

SEQ ID NO: 34270 - DNA, 16 bp, Homo sapiens
ttcctttggtcgctcg

SEQ ID NO: 34271 - DNA, 18 bp, Homo sapiens
ttcctttggtcgctcgct

SEQ ID NO: 34272 - DNA, 20 bp, Homo sapiens
ttcctttggtcgctcgctcc

SEQ ID NO: 34273 - DNA, 21 bp, Homo sapiens
ttcctttggtcgctcgctcct

SEQ ID NO: 34274 - DNA, 22 bp, Homo sapiens
ttcctttggtcgctcgctcctc

SEQ ID NO: 34275 - DNA, 23 bp, Homo sapiens
ttcctttggtcgctcgctcctct

SEQ ID NO: 34276 - DNA, 26 bp, Homo sapiens
ttcctttggtcgctcgctcctctcct

SEQ ID NO: 34277 - DNA, 17 bp, Homo sapiens
tcctttggtcgctcgct

SEQ ID NO: 34278 - DNA, 19 bp, Homo sapiens
tcctttggtcgctcgctcc

SEQ ID NO: 34279 - DNA, 22 bp, Homo sapiens
tcctttggtcgctcgctcctct

SEQ ID NO: 34280 - DNA, 25 bp, Homo sapiens
tcctttggtcgctcgctcctctcct

SEQ ID NO: 34281 - DNA, 18 bp, Homo sapiens
ctttggtcgctcgctcct

SEQ ID NO: 34282 - DNA, 22 bp, Homo sapiens
ctttggtcgctcgctcctctcc

SEQ ID NO: 34283 - DNA, 23 bp, Homo sapiens
ctttggtcgctcgctcctctcct

SEQ ID NO: 34284 - DNA, 16 bp, Homo sapiens
tttggtcgctcgctcc

SEQ ID NO: 34285 - DNA, 19 bp, Homo sapiens
tttggtcgctcgctcctct

SEQ ID NO: 34286 - DNA, 20 bp, Homo sapiens
tttggtcgctcgctcctctc

SEQ ID NO: 34287 - DNA, 21 bp, Homo sapiens
tttggtcgctcgctcctctcc

SEQ ID NO: 34288 - DNA, 22 bp, Homo sapiens
tttggtcgctcgctcctctcct

SEQ ID NO: 34289 - DNA, 23 bp, Homo sapiens
tttggtcgctcgctcctctccta

SEQ ID NO: 34290 - DNA, 24 bp, Homo sapiens
tttggtcgctcgctcctctcctac

SEQ ID NO: 34291 - DNA, 25 bp, Homo sapiens
tttggtcgctcgctcctctcctact

SEQ ID NO: 34292 - DNA, 20 bp, Homo sapiens
ttggtcgctcgctcctctcc

SEQ ID NO: 34293 - DNA, 21 bp, Homo sapiens
ttggtcgctcgctcctctcct

SEQ ID NO: 34294 - DNA, 17 bp, Homo sapiens
tggtcgctcgctcctct

SEQ ID NO: 34295 - DNA, 19 bp, Homo sapiens
tggtcgctcgctcctctcc

SEQ ID NO: 34296 - DNA, 20 bp, Homo sapiens
tggtcgctcgctcctctcct

SEQ ID NO: 34297 - DNA, 21 bp, Homo sapiens
tggtcgctcgctcctctccta

SEQ ID NO: 34298 - DNA, 22 bp, Homo sapiens
tggtcgctcgctcctctcctac

SEQ ID NO: 34299 - DNA, 23 bp, Homo sapiens
tggtcgctcgctcctctcctact

SEQ ID NO: 34300 - DNA, 24 bp, Homo sapiens
tggtcgctcgctcctctcctactt

SEQ ID NO: 34301 - DNA, 26 bp, Homo sapiens
tggtcgctcgctcctctcctacttgg

SEQ ID NO: 34302 - DNA, 18 bp, Homo sapiens
ggtcgctcgctcctctcc

SEQ ID NO: 34303 - DNA, 19 bp, Homo sapiens
ggtcgctcgctcctctcct

SEQ ID NO: 34304 - DNA, 20 bp, Homo sapiens
ggtcgctcgctcctctccta

SEQ ID NO: 34305 - DNA, 18 bp, Homo sapiens
gtcgctcgctcctctcct

SEQ ID NO: 34306 - DNA, 21 bp, Homo sapiens
gtcgctcgctcctctcctact

SEQ ID NO: 34307 - DNA, 22 bp, Homo sapiens
gtcgctcgctcctctcctactt

SEQ ID NO: 34308 - DNA, 23 bp, Homo sapiens
gtcgctcgctcctctcctacttg

SEQ ID NO: 34309 - DNA, 24 bp, Homo sapiens
gtcgctcgctcctctcctacttgg

SEQ ID NO: 34310 - DNA, 19 bp, Homo sapiens
cgctcgctcctctcctact

SEQ ID NO: 34311 - DNA, 20 bp, Homo sapiens
cgctcgctcctctcctactt

SEQ ID NO: 34312 - DNA, 21 bp, Homo sapiens
cgctcgctcctctcctacttg

SEQ ID NO: 34313 - DNA, 22 bp, Homo sapiens
cgctcgctcctctcctacttgg

SEQ ID NO: 34314 - DNA, 24 bp, Homo sapiens
cgctcgctcctctcctacttggat

SEQ ID NO: 34315 - DNA, 19 bp, Homo sapiens
ctcgctcctctcctacttg

SEQ ID NO: 34316 - DNA, 20 bp, Homo sapiens
ctcgctcctctcctacttgg

SEQ ID NO: 34317 - DNA, 22 bp, Homo sapiens
ctcgctcctctcctacttggat

SEQ ID NO: 34318 - DNA, 17 bp, Homo sapiens
cgctcctctcctacttg

SEQ ID NO: 34319 - DNA, 18 bp, Homo sapiens
cgctcctctcctacttgg

SEQ ID NO: 34320 - DNA, 20 bp, Homo sapiens
cgctcctctcctacttggat

SEQ ID NO: 34321 - DNA, 21 bp, Homo sapiens
cgctcctctcctacttggata

SEQ ID NO: 34322 - DNA, 28 bp, Homo sapiens
cgctcctctcctacttggataactgtgg

SEQ ID NO: 34323 - DNA, 26 bp, Homo sapiens
ctcctctcctacttggataactgtgg

SEQ ID NO: 34324 - DNA, 25 bp, Homo sapiens
tcctctcctacttggataactgtgg

SEQ ID NO: 34325 - DNA, 24 bp, Homo sapiens
cctctcctacttggataactgtgg

SEQ ID NO: 34326 - DNA, 25 bp, Homo sapiens
cctctcctacttggataactgtggt

SEQ ID NO: 34327 - DNA, 23 bp, Homo sapiens
ctctcctacttggataactgtgg

SEQ ID NO: 34328 - DNA, 24 bp, Homo sapiens
ctctcctacttggataactgtggt

SEQ ID NO: 34329 - DNA, 30 bp, Homo sapiens; identical to SEQ ID NO: 12459

SEQ ID NO: 34330 - DNA, 22 bp, Homo sapiens
tctcctacttggataactgtgg

SEQ ID NO: 34331 - DNA, 23 bp, Homo sapiens
tctcctacttggataactgtggt

SEQ ID NO: 34332 - DNA, 24 bp, Homo sapiens
tctcctacttggataactgtggta

SEQ ID NO: 34333 - DNA, 29 bp, Homo sapiens
tctcctacttggataactgtggtaattct

SEQ ID NO: 34334 - DNA, 30 bp, Homo sapiens; identical to SEQ ID NO: 12462

SEQ ID NO: 34335 - DNA, 20 bp, Homo sapiens
ctcctacttggataactgtg

SEQ ID NO: 34336 - DNA, 21 bp, Homo sapiens
ctcctacttggataactgtgg

SEQ ID NO: 34337 - DNA, 22 bp, Homo sapiens
ctcctacttggataactgtggt

SEQ ID NO: 34338 - DNA, 23 bp, Homo sapiens
ctcctacttggataactgtggta

SEQ ID NO: 34339 - DNA, 25 bp, Homo sapiens
ctcctacttggataactgtggtaat

SEQ ID NO: 34340 - DNA, 28 bp, Homo sapiens
ctcctacttggataactgtggtaattct

SEQ ID NO: 34341 - DNA, 29 bp, Homo sapiens
ctcctacttggataactgtggtaattcta

SEQ ID NO: 34342 - DNA, 30 bp, Homo sapiens; identical to SEQ ID NO: 2071

SEQ ID NO: 34343 - DNA, 19 bp, Homo sapiens
tcctacttggataactgtg

SEQ ID NO: 34344 - DNA, 20 bp, Homo sapiens
tcctacttggataactgtgg

SEQ ID NO: 34345 - DNA, 21 bp, Homo sapiens
tcctacttggataactgtggt

SEQ ID NO: 34346 - DNA, 22 bp, Homo sapiens
tcctacttggataactgtggta

SEQ ID NO: 34347 - DNA, 24 bp, Homo sapiens
tcctacttggataactgtggtaat

SEQ ID NO: 34348 - DNA, 27 bp, Homo sapiens
tcctacttggataactgtggtaattct

SEQ ID NO: 34349 - DNA, 29 bp, Homo sapiens
tcctacttggataactgtggtaattctag

SEQ ID NO: 34350 - DNA, 30 bp, Homo sapiens
tcctacttggataactgtggtaattctaga

SEQ ID NO: 34351 - DNA, 18 bp, Homo sapiens
cctacttggataactgtg

SEQ ID NO: 34352 - DNA, 19 bp, Homo sapiens
cctacttggataactgtgg

SEQ ID NO: 34353 - DNA, 20 bp, Homo sapiens
cctacttggataactgtggt

SEQ ID NO: 34354 - DNA, 21 bp, Homo sapiens
cctacttggataactgtggta

SEQ ID NO: 34355 - DNA, 23 bp, Homo sapiens
cctacttggataactgtggtaat

SEQ ID NO: 34356 - DNA, 26 bp, Homo sapiens
cctacttggataactgtggtaattct

SEQ ID NO: 34357 - DNA, 28 bp, Homo sapiens
cctacttggataactgtggtaattctag

SEQ ID NO: 34358 - DNA, 30 bp, Homo sapiens; identical to SEQ ID NO: 2081

SEQ ID NO: 34359 - DNA, 17 bp, Homo sapiens
ctacttggataactgtg

SEQ ID NO: 34360 - DNA, 18 bp, Homo sapiens
ctacttggataactgtgg

SEQ ID NO: 34361 - DNA, 19 bp, Homo sapiens
ctacttggataactgtggt

SEQ ID NO: 34362 - DNA, 20 bp, Homo sapiens
ctacttggataactgtggta

SEQ ID NO: 34363 - DNA, 22 bp, Homo sapiens
ctacttggataactgtggtaat

SEQ ID NO: 34364 - DNA, 29 bp, Homo sapiens
ctacttggataactgtggtaattctagag

SEQ ID NO: 34365 - DNA, 30 bp, Homo sapiens; identical to SEQ ID NO: 2087

SEQ ID NO: 34366 - DNA, 17 bp, Homo sapiens
tacttggataactgtgg

SEQ ID NO: 34367 - DNA, 18 bp, Homo sapiens
tacttggataactgtggt

SEQ ID NO: 34368 - DNA, 19 bp, Homo sapiens
tacttggataactgtggta

SEQ ID NO: 34369 - DNA, 21 bp, Homo sapiens
tacttggataactgtggtaat

SEQ ID NO: 34370 - DNA, 23 bp, Homo sapiens
tacttggataactgtggtaattc

SEQ ID NO: 34371 - DNA, 24 bp, Homo sapiens
tacttggataactgtggtaattct

SEQ ID NO: 34372 - DNA, 25 bp, Homo sapiens
tacttggataactgtggtaattcta

SEQ ID NO: 34373 - DNA, 29 bp, Homo sapiens
tacttggataactgtggtaattctagagc

SEQ ID NO: 34374 - DNA, 30 bp, Homo sapiens; identical to SEQ ID NO: 2094

SEQ ID NO: 34375 - DNA, 16 bp, Homo sapiens
acttggataactgtgg

SEQ ID NO: 34376 - DNA, 17 bp, Homo sapiens
acttggataactgtggt

SEQ ID NO: 34377 - DNA, 18 bp, Homo sapiens
acttggataactgtggta

SEQ ID NO: 34378 - DNA, 20 bp, Homo sapiens
acttggataactgtggtaat

SEQ ID NO: 34379 - DNA, 22 bp, Homo sapiens
acttggataactgtggtaattc

SEQ ID NO: 34380 - DNA, 23 bp, Homo sapiens
acttggataactgtggtaattct

SEQ ID NO: 34381 - DNA, 24 bp, Homo sapiens
acttggataactgtggtaattcta

SEQ ID NO: 34382 - DNA, 25 bp, Homo sapiens
acttggataactgtggtaattctag

SEQ ID NO: 34383 - DNA, 27 bp, Homo sapiens
acttggataactgtggtaattctagag

SEQ ID NO: 34384 - DNA, 28 bp, Homo sapiens
acttggataactgtggtaattctagagc

SEQ ID NO: 34385 - DNA, 29 bp, Homo sapiens
acttggataactgtggtaattctagagct

SEQ ID NO: 34386 - DNA, 16 bp, Homo sapiens
cttggataactgtggt

SEQ ID NO: 34387 - DNA, 17 bp, Homo sapiens
cttggataactgtggta

SEQ ID NO: 34388 - DNA, 19 bp, Homo sapiens
cttggataactgtggtaat

SEQ ID NO: 34389 - DNA, 20 bp, Homo sapiens
cttggataactgtggtaatt

SEQ ID NO: 34390 - DNA, 21 bp, Homo sapiens
cttggataactgtggtaattc

SEQ ID NO: 34391 - DNA, 22 bp, Homo sapiens
cttggataactgtggtaattct

SEQ ID NO: 34392 - DNA, 23 bp, Homo sapiens
cttggataactgtggtaattcta

SEQ ID NO: 34393 - DNA, 24 bp, Homo sapiens
cttggataactgtggtaattctag

SEQ ID NO: 34394 - DNA, 26 bp, Homo sapiens
cttggataactgtggtaattctagag

SEQ ID NO: 34395 - DNA, 27 bp, Homo sapiens
cttggataactgtggtaattctagagc

SEQ ID NO: 34396 - DNA, 28 bp, Homo sapiens
cttggataactgtggtaattctagagct

SEQ ID NO: 34397 - DNA, 29 bp, Homo sapiens
cttggataactgtggtaattctagagcta

SEQ ID NO: 34398 - DNA, 16 bp, Homo sapiens
ttggataactgtggta

SEQ ID NO: 34399 - DNA, 18 bp, Homo sapiens
ttggataactgtggtaat

SEQ ID NO: 34400 - DNA, 19 bp, Homo sapiens
ttggataactgtggtaatt

SEQ ID NO: 34401 - DNA, 20 bp, Homo sapiens
ttggataactgtggtaattc

SEQ ID NO: 34402 - DNA, 21 bp, Homo sapiens
ttggataactgtggtaattct

SEQ ID NO: 34403 - DNA, 22 bp, Homo sapiens
ttggataactgtggtaattcta

SEQ ID NO: 34404 - DNA, 23 bp, Homo sapiens
ttggataactgtggtaattctag

SEQ ID NO: 34405 - DNA, 25 bp, Homo sapiens
ttggataactgtggtaattctagag

SEQ ID NO: 34406 - DNA, 26 bp, Homo sapiens
ttggataactgtggtaattctagagc

SEQ ID NO: 34407 - DNA, 27 bp, Homo sapiens
ttggataactgtggtaattctagagct

SEQ ID NO: 34408 - DNA, 28 bp, Homo sapiens
ttggataactgtggtaattctagagcta

SEQ ID NO: 34409 - DNA, 29 bp, Homo sapiens
ttggataactgtggtaattctagagctaa

SEQ ID NO: 34410 - DNA, 16 bp, Homo sapiens
tggataactgtggtaa

SEQ ID NO: 34411 - DNA, 17 bp, Homo sapiens
tggataactgtggtaat

SEQ ID NO: 34412 - DNA, 18 bp, Homo sapiens
tggataactgtggtaatt

SEQ ID NO: 34413 - DNA, 19 bp, Homo sapiens
tggataactgtggtaattc

SEQ ID NO: 34414 - DNA, 20 bp, Homo sapiens
tggataactgtggtaattct

SEQ ID NO: 34415 - DNA, 21 bp, Homo sapiens
tggataactgtggtaattcta

SEQ ID NO: 34416 - DNA, 22 bp, Homo sapiens
tggataactgtggtaattctag

SEQ ID NO: 34417 - DNA, 23 bp, Homo sapiens
tggataactgtggtaattctaga

SEQ ID NO: 34418 - DNA, 24 bp, Homo sapiens
tggataactgtggtaattctagag

SEQ ID NO: 34419 - DNA, 25 bp, Homo sapiens
tggataactgtggtaattctagagc

SEQ ID NO: 34420 - DNA, 26 bp, Homo sapiens
tggataactgtggtaattctagagct

SEQ ID NO: 34421 - DNA, 27 bp, Homo sapiens
tggataactgtggtaattctagagcta

SEQ ID NO: 34422 - DNA, 28 bp, Homo sapiens
tggataactgtggtaattctagagctaa

SEQ ID NO: 34423 - DNA, 29 bp, Homo sapiens
tggataactgtggtaattctagagctaat

SEQ ID NO: 34424 - DNA, 30 bp, Homo sapiens
tggataactgtggtaattctagagctaata

SEQ ID NO: 34425 - DNA, 18 bp, Homo sapiens
ggataactgtggtaattc

SEQ ID NO: 34426 - DNA, 19 bp, Homo sapiens
ggataactgtggtaattct

SEQ ID NO: 34427 - DNA, 20 bp, Homo sapiens
ggataactgtggtaattcta

SEQ ID NO: 34428 - DNA, 21 bp, Homo sapiens
ggataactgtggtaattctag

SEQ ID NO: 34429 - DNA, 22 bp, Homo sapiens
ggataactgtggtaattctaga

SEQ ID NO: 34430 - DNA, 23 bp, Homo sapiens
ggataactgtggtaattctagag

SEQ ID NO: 34431 - DNA, 24 bp, Homo sapiens
ggataactgtggtaattctagagc

SEQ ID NO: 34432 - DNA, 25 bp, Homo sapiens
ggataactgtggtaattctagagct

SEQ ID NO: 34433 - DNA, 26 bp, Homo sapiens
ggataactgtggtaattctagagcta

SEQ ID NO: 34434 - DNA, 27 bp, Homo sapiens
ggataactgtggtaattctagagctaa

SEQ ID NO: 34435 - DNA, 29 bp, Homo sapiens
ggataactgtggtaattctagagctaata

SEQ ID NO: 34436 - DNA, 30 bp, Homo sapiens
ggataactgtggtaattctagagctaatac

SEQ ID NO: 34437 - DNA, 17 bp, Homo sapiens
gataactgtggtaattc

SEQ ID NO: 34438 - DNA, 18 bp, Homo sapiens
gataactgtggtaattct

SEQ ID NO: 34439 - DNA, 19 bp, Homo sapiens
gataactgtggtaattcta

SEQ ID NO: 34440 - DNA, 20 bp, Homo sapiens
gataactgtggtaattctag

SEQ ID NO: 34441 - DNA, 21 bp, Homo sapiens
gataactgtggtaattctaga

SEQ ID NO: 34442 - DNA, 22 bp, Homo sapiens
gataactgtggtaattctagag

SEQ ID NO: 34443 - DNA, 23 bp, Homo sapiens
gataactgtggtaattctagagc

SEQ ID NO: 34444 - DNA, 24 bp, Homo sapiens
gataactgtggtaattctagagct

SEQ ID NO: 34445 - DNA, 25 bp, Homo sapiens
gataactgtggtaattctagagcta

SEQ ID NO: 34446 - DNA, 26 bp, Homo sapiens
gataactgtggtaattctagagctaa

SEQ ID NO: 34447 - DNA, 28 bp, Homo sapiens
gataactgtggtaattctagagctaata

SEQ ID NO: 34448 - DNA, 29 bp, Homo sapiens
gataactgtggtaattctagagctaatac

SEQ ID NO: 34449 - DNA, 17 bp, Homo sapiens
ataactgtggtaattct

SEQ ID NO: 34450 - DNA, 18 bp, Homo sapiens
ataactgtggtaattcta

SEQ ID NO: 34451 - DNA, 19 bp, Homo sapiens
ataactgtggtaattctag

SEQ ID NO: 34452 - DNA, 20 bp, Homo sapiens
ataactgtggtaattctaga

SEQ ID NO: 34453 - DNA, 21 bp, Homo sapiens
ataactgtggtaattctagag

SEQ ID NO: 34454 - DNA, 22 bp, Homo sapiens
ataactgtggtaattctagagc

SEQ ID NO: 34455 - DNA, 23 bp, Homo sapiens
ataactgtggtaattctagagct

SEQ ID NO: 34456 - DNA, 24 bp, Homo sapiens
ataactgtggtaattctagagcta

SEQ ID NO: 34457 - DNA, 25 bp, Homo sapiens
ataactgtggtaattctagagctaa

SEQ ID NO: 34458 - DNA, 27 bp, Homo sapiens
ataactgtggtaattctagagctaata

SEQ ID NO: 34459 - DNA, 28 bp, Homo sapiens
ataactgtggtaattctagagctaatac

SEQ ID NO: 34460 - DNA, 29 bp, Homo sapiens
ataactgtggtaattctagagctaataca

SEQ ID NO: 34461 - DNA, 30 bp, Homo sapiens
ataactgtggtaattctagagctaatacat

SEQ ID NO: 34462 - DNA, 16 bp, Homo sapiens
taactgtggtaattct

SEQ ID NO: 34463 - DNA, 17 bp, Homo sapiens
taactgtggtaattcta

SEQ ID NO: 34464 - DNA, 18 bp, Homo sapiens
taactgtggtaattctag

SEQ ID NO: 34465 - DNA, 19 bp, Homo sapiens
taactgtggtaattctaga

SEQ ID NO: 34466 - DNA, 20 bp, Homo sapiens
taactgtggtaattctagag

SEQ ID NO: 34467 - DNA, 21 bp, Homo sapiens
taactgtggtaattctagagc

SEQ ID NO: 34468 - DNA, 22 bp, Homo sapiens
taactgtggtaattctagagct

SEQ ID NO: 34469 - DNA, 23 bp, Homo sapiens
taactgtggtaattctagagcta

SEQ ID NO: 34470 - DNA, 24 bp, Homo sapiens
taactgtggtaattctagagctaa

SEQ ID NO: 34471 - DNA, 26 bp, Homo sapiens
taactgtggtaattctagagctaata

SEQ ID NO: 34472 - DNA, 28 bp, Homo sapiens
taactgtggtaattctagagctaataca

SEQ ID NO: 34473 - DNA, 30 bp, Homo sapiens
taactgtggtaattctagagctaatacatg

SEQ ID NO: 34474 - DNA, 16 bp, Homo sapiens
aactgtggtaattcta

SEQ ID NO: 34475 - DNA, 17 bp, Homo sapiens
aactgtggtaattctag

SEQ ID NO: 34476 - DNA, 18 bp, Homo sapiens
aactgtggtaattctaga

SEQ ID NO: 34477 - DNA, 19 bp, Homo sapiens
aactgtggtaattctagag

SEQ ID NO: 34478 - DNA, 20 bp, Homo sapiens
aactgtggtaattctagagc

SEQ ID NO: 34479 - DNA, 21 bp, Homo sapiens
aactgtggtaattctagagct

SEQ ID NO: 34480 - DNA, 22 bp, Homo sapiens
aactgtggtaattctagagcta

SEQ ID NO: 34481 - DNA, 23 bp, Homo sapiens
aactgtggtaattctagagctaa

SEQ ID NO: 34482 - DNA, 25 bp, Homo sapiens
aactgtggtaattctagagctaata

SEQ ID NO: 34483 - DNA, 27 bp, Homo sapiens
aactgtggtaattctagagctaataca

SEQ ID NO: 34484 - DNA, 28 bp, Homo sapiens
aactgtggtaattctagagctaatacat

SEQ ID NO: 34485 - DNA, 29 bp, Homo sapiens
aactgtggtaattctagagctaatacatg

SEQ ID NO: 34486 - DNA, 30 bp, Homo sapiens; identical to SEQ ID NO: 2119

SEQ ID NO: 34487 - DNA, 16 bp, Homo sapiens
actgtggtaattctag

SEQ ID NO: 34488 - DNA, 17 bp, Homo sapiens
actgtggtaattctaga

SEQ ID NO: 34489 - DNA, 18 bp, Homo sapiens
actgtggtaattctagag

SEQ ID NO: 34490 - DNA, 19 bp, Homo sapiens
actgtggtaattctagagc

SEQ ID NO: 34491 - DNA, 20 bp, Homo sapiens
actgtggtaattctagagct

SEQ ID NO: 34492 - DNA, 21 bp, Homo sapiens
actgtggtaattctagagcta

SEQ ID NO: 34493 - DNA, 22 bp, Homo sapiens
actgtggtaattctagagctaa

SEQ ID NO: 34494 - DNA, 23 bp, Homo sapiens
actgtggtaattctagagctaat

SEQ ID NO: 34495 - DNA, 24 bp, Homo sapiens
actgtggtaattctagagctaata

SEQ ID NO: 34496 - DNA, 25 bp, Homo sapiens
actgtggtaattctagagctaatac

SEQ ID NO: 34497 - DNA, 26 bp, Homo sapiens
actgtggtaattctagagctaataca

SEQ ID NO: 34498 - DNA, 28 bp, Homo sapiens
actgtggtaattctagagctaatacatg

SEQ ID NO: 34499 - DNA, 29 bp, Homo sapiens
actgtggtaattctagagctaatacatgc

SEQ ID NO: 34500 - DNA, 30 bp, Homo sapiens; identical to SEQ ID NO: 2123

SEQ ID NO: 34501 - DNA, 17 bp, Homo sapiens
ctgtggtaattctagag

SEQ ID NO: 34502 - DNA, 18 bp, Homo sapiens
ctgtggtaattctagagc

SEQ ID NO: 34503 - DNA, 19 bp, Homo sapiens
ctgtggtaattctagagct

SEQ ID NO: 34504 - DNA, 20 bp, Homo sapiens
ctgtggtaattctagagcta

SEQ ID NO: 34505 - DNA, 21 bp, Homo sapiens
ctgtggtaattctagagctaa

SEQ ID NO: 34506 - DNA, 22 bp, Homo sapiens
ctgtggtaattctagagctaat

SEQ ID NO: 34507 - DNA, 23 bp, Homo sapiens
ctgtggtaattctagagctaata

SEQ ID NO: 34508 - DNA, 24 bp, Homo sapiens
ctgtggtaattctagagctaatac

SEQ ID NO: 34509 - DNA, 25 bp, Homo sapiens
ctgtggtaattctagagctaataca

SEQ ID NO: 34510 - DNA, 26 bp, Homo sapiens
ctgtggtaattctagagctaatacat

SEQ ID NO: 34511 - DNA, 27 bp, Homo sapiens
ctgtggtaattctagagctaatacatg

SEQ ID NO: 34512 - DNA, 28 bp, Homo sapiens
ctgtggtaattctagagctaatacatgc

SEQ ID NO: 34513 - DNA, 29 bp, Homo sapiens
ctgtggtaattctagagctaatacatgcc

SEQ ID NO: 34514 - DNA, 30 bp, Homo sapiens
ctgtggtaattctagagctaatacatgccg

SEQ ID NO: 34515 - DNA, 18 bp, Homo sapiens
tgtggtaattctagagct

SEQ ID NO: 34516 - DNA, 21 bp, Homo sapiens
tgtggtaattctagagctaat

SEQ ID NO: 34517 - DNA, 22 bp, Homo sapiens
tgtggtaattctagagctaata

SEQ ID NO: 34518 - DNA, 23 bp, Homo sapiens
tgtggtaattctagagctaatac

SEQ ID NO: 34519 - DNA, 24 bp, Homo sapiens
tgtggtaattctagagctaataca

SEQ ID NO: 34520 - DNA, 29 bp, Homo sapiens
tgtggtaattctagagctaatacatgccg

SEQ ID NO: 34521 - DNA, 17 bp, Homo sapiens
gtggtaattctagagct

SEQ ID NO: 34522 - DNA, 20 bp, Homo sapiens
gtggtaattctagagctaat

SEQ ID NO: 34523 - DNA, 21 bp, Homo sapiens
gtggtaattctagagctaata

SEQ ID NO: 34524 - DNA, 22 bp, Homo sapiens
gtggtaattctagagctaatac

SEQ ID NO: 34525 - DNA, 23 bp, Homo sapiens
gtggtaattctagagctaataca

SEQ ID NO: 34526 - DNA, 24 bp, Homo sapiens
gtggtaattctagagctaatacat

SEQ ID NO: 34527 - DNA, 25 bp, Homo sapiens
gtggtaattctagagctaatacatg

SEQ ID NO: 34528 - DNA, 30 bp, Homo sapiens
gtggtaattctagagctaatacatgccgac

SEQ ID NO: 34529 - DNA, 21 bp, Homo sapiens
ggtaattctagagctaataca

SEQ ID NO: 34530 - DNA, 16 bp, Homo sapiens
aattctagagctaata

SEQ ID NO: 34531 - DNA, 18 bp, Homo sapiens
aattctagagctaataca

SEQ ID NO: 34532 - DNA, 19 bp, Homo sapiens
aattctagagctaatacat

SEQ ID NO: 34533 - DNA, 20 bp, Homo sapiens
aattctagagctaatacatg

SEQ ID NO: 34534 - DNA, 22 bp, Homo sapiens
aattctagagctaatacatgcc

SEQ ID NO: 34535 - DNA, 23 bp, Homo sapiens
aattctagagctaatacatgccg

SEQ ID NO: 34536 - DNA, 24 bp, Homo sapiens
aattctagagctaatacatgccga

SEQ ID NO: 34537 - DNA, 26 bp, Homo sapiens
aattctagagctaatacatgccgacg

SEQ ID NO: 34538 - DNA, 27 bp, Homo sapiens
aattctagagctaatacatgccgacgg

SEQ ID NO: 34539 - DNA, 24 bp, Homo sapiens
attctagagctaatacatgccgac

SEQ ID NO: 34540 - DNA, 22 bp, Homo sapiens
ctagagctaatacatgccgacg

SEQ ID NO: 34541 - DNA, 23 bp, Homo sapiens
ctagagctaatacatgccgacgg

SEQ ID NO: 34542 - DNA, 24 bp, Homo sapiens
ctagagctaatacatgccgacggg

SEQ ID NO: 34543 - DNA, 25 bp, Homo sapiens
ctagagctaatacatgccgacgggc

SEQ ID NO: 34544 - DNA, 24 bp, Homo sapiens
tagagctaatacatgccgacgggc

SEQ ID NO: 34545 - DNA, 22 bp, Homo sapiens
agagctaatacatgccgacggg

SEQ ID NO: 34546 - DNA, 23 bp, Homo sapiens
agagctaatacatgccgacgggc

SEQ ID NO: 34547 - DNA, 21 bp, Homo sapiens
gagctaatacatgccgacggg

SEQ ID NO: 34548 - DNA, 22 bp, Homo sapiens
gagctaatacatgccgacgggc

SEQ ID NO: 34549 - DNA, 23 bp, Homo sapiens
gagctaatacatgccgacgggcg

SEQ ID NO: 34550 - DNA, 24 bp, Homo sapiens
gagctaatacatgccgacgggcgc

SEQ ID NO: 34551 - DNA, 21 bp, Homo sapiens
aatacatgccgacgggcgctg

SEQ ID NO: 34552 - DNA, 22 bp, Homo sapiens
aatacatgccgacgggcgctga

SEQ ID NO: 34553 - DNA, 23 bp, Homo sapiens
aatacatgccgacgggcgctgac

SEQ ID NO: 34554 - DNA, 24 bp, Homo sapiens
aatacatgccgacgggcgctgacc

SEQ ID NO: 34555 - DNA, 21 bp, Homo sapiens
atacatgccgacgggcgctga

SEQ ID NO: 34556 - DNA, 23 bp, Homo sapiens
atacatgccgacgggcgctgacc

SEQ ID NO: 34557 - DNA, 24 bp, Homo sapiens
tacatgccgacgggcgctgacccc

SEQ ID NO: 34558 - DNA, 19 bp, Homo sapiens
catgccgacgggcgctgac

SEQ ID NO: 34559 - DNA, 20 bp, Homo sapiens
catgccgacgggcgctgacc

SEQ ID NO: 34560 - DNA, 22 bp, Homo sapiens
catgccgacgggcgctgacccc

SEQ ID NO: 34561 - DNA, 23 bp, Homo sapiens
catgccgacgggcgctgaccccc

SEQ ID NO: 34562 - DNA, 24 bp, Homo sapiens
catgccgacgggcgctgaccccct

SEQ ID NO: 34563 - DNA, 25 bp, Homo sapiens
catgccgacgggcgctgaccccctt

SEQ ID NO: 34564 - DNA, 26 bp, Homo sapiens
catgccgacgggcgctgacccccttc

SEQ ID NO: 34565 - DNA, 17 bp, Homo sapiens
tgccgacgggcgctgac

SEQ ID NO: 34566 - DNA, 18 bp, Homo sapiens
tgccgacgggcgctgacc

SEQ ID NO: 34567 - DNA, 19 bp, Homo sapiens
tgccgacgggcgctgaccc

SEQ ID NO: 34568 - DNA, 20 bp, Homo sapiens
tgccgacgggcgctgacccc

SEQ ID NO: 34569 - DNA, 22 bp, Homo sapiens
tgccgacgggcgctgaccccct

SEQ ID NO: 34570 - DNA, 23 bp, Homo sapiens
tgccgacgggcgctgaccccctt

SEQ ID NO: 34571 - DNA, 24 bp, Homo sapiens
tgccgacgggcgctgacccccttc

SEQ ID NO: 34572 - DNA, 25 bp, Homo sapiens
tgccgacgggcgctgacccccttcg

SEQ ID NO: 34573 - DNA, 28 bp, Homo sapiens
tgccgacgggcgctgacccccttcgcgg

SEQ ID NO: 34574 - DNA, 30 bp, Homo sapiens; identical to SEQ ID NO: 12643

SEQ ID NO: 34575 - DNA, 17 bp, Homo sapiens
gccgacgggcgctgacc

SEQ ID NO: 34576 - DNA, 18 bp, Homo sapiens
gccgacgggcgctgaccc

SEQ ID NO: 34577 - DNA, 21 bp, Homo sapiens
gccgacgggcgctgaccccct

SEQ ID NO: 34578 - DNA, 22 bp, Homo sapiens
gccgacgggcgctgaccccctt

SEQ ID NO: 34579 - DNA, 23 bp, Homo sapiens
gccgacgggcgctgacccccttc

SEQ ID NO: 34580 - DNA, 24 bp, Homo sapiens
gccgacgggcgctgacccccttcg

SEQ ID NO: 34581 - DNA, 26 bp, Homo sapiens
gccgacgggcgctgacccccttcgcg

SEQ ID NO: 34582 - DNA, 27 bp, Homo sapiens
gccgacgggcgctgacccccttcgcgg

SEQ ID NO: 34583 - DNA, 30 bp, Homo sapiens
gccgacgggcgctgacccccttcgcggggg

SEQ ID NO: 34584 - DNA, 23 bp, Homo sapiens
ccgacgggcgctgacccccttcg

SEQ ID NO: 34585 - DNA, 17 bp, Homo sapiens
gacgggcgctgaccccc

SEQ ID NO: 34586 - DNA, 19 bp, Homo sapiens
gacgggcgctgaccccctt

SEQ ID NO: 34587 - DNA, 20 bp, Homo sapiens
gacgggcgctgacccccttc

SEQ ID NO: 34588 - DNA, 30 bp, Homo sapiens
cgggcgctgacccccttcgcgggggggatg

SEQ ID NO: 34589 - DNA, 30 bp, Homo sapiens
gggcgctgacccccttcgcgggggggatgc

SEQ ID NO: 34590 - DNA, 16 bp, Homo sapiens
ggcgctgacccccttc

SEQ ID NO: 34591 - DNA, 17 bp, Homo sapiens
ggcgctgacccccttcg

SEQ ID NO: 34592 - DNA, 19 bp, Homo sapiens
ggcgctgacccccttcgcg

SEQ ID NO: 34593 - DNA, 26 bp, Homo sapiens
ggcgctgacccccttcgcggggggga

SEQ ID NO: 34594 - DNA, 19 bp, Homo sapiens
gcgctgacccccttcgcgg

SEQ ID NO: 34595 - DNA, 17 bp, Homo sapiens
cgctgacccccttcgcg

SEQ ID NO: 34596 - DNA, 18 bp, Homo sapiens
cgctgacccccttcgcgg

SEQ ID NO: 34597 - DNA, 19 bp, Homo sapiens
cgctgacccccttcgcggg

SEQ ID NO: 34598 - DNA, 17 bp, Homo sapiens
ccttcgcgggggggatg

SEQ ID NO: 34599 - DNA, 20 bp, Homo sapiens
ttcgcgggggggatgcgtgc

SEQ ID NO: 34600 - DNA, 29 bp, Homo sapiens
ttcgcgggggggatgcgtgcatttatcag

SEQ ID NO: 34601 - DNA, 19 bp, Homo sapiens
tcgcgggggggatgcgtgc

SEQ ID NO: 34602 - DNA, 28 bp, Homo sapiens
tcgcgggggggatgcgtgcatttatcag

SEQ ID NO: 34603 - DNA, 17 bp, Homo sapiens
gcgggggggatgcgtgc

SEQ ID NO: 34604 - DNA, 19 bp, Homo sapiens
cgggggggatgcgtgcatt

SEQ ID NO: 34605 - DNA, 20 bp, Homo sapiens
cgggggggatgcgtgcattt

SEQ ID NO: 34606 - DNA, 21 bp, Homo sapiens
ggatgcgtgcatttatcagat

SEQ ID NO: 34607 - DNA, 22 bp, Homo sapiens
ggatgcgtgcatttatcagatc

SEQ ID NO: 34608 - DNA, 23 bp, Homo sapiens
ggatgcgtgcatttatcagatca

SEQ ID NO: 34609 - DNA, 29 bp, Homo sapiens
ggatgcgtgcatttatcagatcaaaacca

SEQ ID NO: 34610 - DNA, 18 bp, Homo sapiens
gatgcgtgcatttatcag

SEQ ID NO: 34611 - DNA, 20 bp, Homo sapiens
gatgcgtgcatttatcagat

SEQ ID NO: 34612 - DNA, 21 bp, Homo sapiens
gatgcgtgcatttatcagatc

SEQ ID NO: 34613 - DNA, 22 bp, Homo sapiens
gatgcgtgcatttatcagatca

SEQ ID NO: 34614 - DNA, 23 bp, Homo sapiens
gatgcgtgcatttatcagatcaa

SEQ ID NO: 34615 - DNA, 24 bp, Homo sapiens
gatgcgtgcatttatcagatcaaa

SEQ ID NO: 34616 - DNA, 27 bp, Homo sapiens
gatgcgtgcatttatcagatcaaaacc

SEQ ID NO: 34617 - DNA, 30 bp, Homo sapiens
gatgcgtgcatttatcagatcaaaaccaac

SEQ ID NO: 34618 - DNA, 17 bp, Homo sapiens
atgcgtgcatttatcag

SEQ ID NO: 34619 - DNA, 18 bp, Homo sapiens
atgcgtgcatttatcaga

SEQ ID NO: 34620 - DNA, 19 bp, Homo sapiens
atgcgtgcatttatcagat

SEQ ID NO: 34621 - DNA, 20 bp, Homo sapiens
atgcgtgcatttatcagatc

SEQ ID NO: 34622 - DNA, 21 bp, Homo sapiens
atgcgtgcatttatcagatca

SEQ ID NO: 34623 - DNA, 22 bp, Homo sapiens
atgcgtgcatttatcagatcaa

SEQ ID NO: 34624 - DNA, 23 bp, Homo sapiens
atgcgtgcatttatcagatcaaa

SEQ ID NO: 34625 - DNA, 24 bp, Homo sapiens
atgcgtgcatttatcagatcaaaa

SEQ ID NO: 34626 - DNA, 25 bp, Homo sapiens
atgcgtgcatttatcagatcaaaac

SEQ ID NO: 34627 - DNA, 26 bp, Homo sapiens
atgcgtgcatttatcagatcaaaacc

SEQ ID NO: 34628 - DNA, 27 bp, Homo sapiens
atgcgtgcatttatcagatcaaaacca

SEQ ID NO: 34629 - DNA, 28 bp, Homo sapiens
atgcgtgcatttatcagatcaaaaccaa

SEQ ID NO: 34630 - DNA, 29 bp, Homo sapiens
atgcgtgcatttatcagatcaaaaccaac

SEQ ID NO: 34631 - DNA, 30 bp, Homo sapiens
atgcgtgcatttatcagatcaaaaccaacc

SEQ ID NO: 34632 - DNA, 16 bp, Homo sapiens
tgcgtgcatttatcag

SEQ ID NO: 34633 - DNA, 17 bp, Homo sapiens
tgcgtgcatttatcaga

SEQ ID NO: 34634 - DNA, 18 bp, Homo sapiens
tgcgtgcatttatcagat

SEQ ID NO: 34635 - DNA, 19 bp, Homo sapiens
tgcgtgcatttatcagatc

SEQ ID NO: 34636 - DNA, 20 bp, Homo sapiens
tgcgtgcatttatcagatca

SEQ ID NO: 34637 - DNA, 21 bp, Homo sapiens
tgcgtgcatttatcagatcaa

SEQ ID NO: 34638 - DNA, 22 bp, Homo sapiens
tgcgtgcatttatcagatcaaa

SEQ ID NO: 34639 - DNA, 23 bp, Homo sapiens
tgcgtgcatttatcagatcaaaa

SEQ ID NO: 34640 - DNA, 24 bp, Homo sapiens
tgcgtgcatttatcagatcaaaac

SEQ ID NO: 34641 - DNA, 25 bp, Homo sapiens
tgcgtgcatttatcagatcaaaacc

SEQ ID NO: 34642 - DNA, 26 bp, Homo sapiens
tgcgtgcatttatcagatcaaaacca

SEQ ID NO: 34643 - DNA, 27 bp, Homo sapiens
tgcgtgcatttatcagatcaaaaccaa

SEQ ID NO: 34644 - DNA, 28 bp, Homo sapiens
tgcgtgcatttatcagatcaaaaccaac

SEQ ID NO: 34645 - DNA, 29 bp, Homo sapiens
tgcgtgcatttatcagatcaaaaccaacc

SEQ ID NO: 34646 - DNA, 30 bp, Homo sapiens
tgcgtgcatttatcagatcaaaaccaaccc

SEQ ID NO: 34647 - DNA, 16 bp, Homo sapiens
gcgtgcatttatcaga

SEQ ID NO: 34648 - DNA, 17 bp, Homo sapiens
gcgtgcatttatcagat

SEQ ID NO: 34649 - DNA, 18 bp, Homo sapiens
gcgtgcatttatcagatc

SEQ ID NO: 34650 - DNA, 19 bp, Homo sapiens
gcgtgcatttatcagatca

SEQ ID NO: 34651 - DNA, 20 bp, Homo sapiens
gcgtgcatttatcagatcaa

SEQ ID NO: 34652 - DNA, 21 bp, Homo sapiens
gcgtgcatttatcagatcaaa

SEQ ID NO: 34653 - DNA, 22 bp, Homo sapiens
gcgtgcatttatcagatcaaaa

SEQ ID NO: 34654 - DNA, 23 bp, Homo sapiens
gcgtgcatttatcagatcaaaac

SEQ ID NO: 34655 - DNA, 24 bp, Homo sapiens
gcgtgcatttatcagatcaaaacc

SEQ ID NO: 34656 - DNA, 25 bp, Homo sapiens
gcgtgcatttatcagatcaaaacca

SEQ ID NO: 34657 - DNA, 26 bp, Homo sapiens
gcgtgcatttatcagatcaaaaccaa

SEQ ID NO: 34658 - DNA, 27 bp, Homo sapiens
gcgtgcatttatcagatcaaaaccaac

SEQ ID NO: 34659 - DNA, 28 bp, Homo sapiens
gcgtgcatttatcagatcaaaaccaacc

SEQ ID NO: 34660 - DNA, 29 bp, Homo sapiens
gcgtgcatttatcagatcaaaaccaaccc

SEQ ID NO: 34661 - DNA, 30 bp, Homo sapiens
gcgtgcatttatcagatcaaaaccaacccg

SEQ ID NO: 34662 - DNA, 16 bp, Homo sapiens
cgtgcatttatcagat

SEQ ID NO: 34663 - DNA, 17 bp, Homo sapiens
cgtgcatttatcagatc

SEQ ID NO: 34664 - DNA, 18 bp, Homo sapiens
cgtgcatttatcagatca

SEQ ID NO: 34665 - DNA, 19 bp, Homo sapiens
cgtgcatttatcagatcaa

SEQ ID NO: 34666 - DNA, 20 bp, Homo sapiens
cgtgcatttatcagatcaaa

SEQ ID NO: 34667 - DNA, 22 bp, Homo sapiens
cgtgcatttatcagatcaaaac

SEQ ID NO: 34668 - DNA, 23 bp, Homo sapiens
cgtgcatttatcagatcaaaacc

SEQ ID NO: 34669 - DNA, 24 bp, Homo sapiens
cgtgcatttatcagatcaaaacca

SEQ ID NO: 34670 - DNA, 25 bp, Homo sapiens
cgtgcatttatcagatcaaaaccaa

SEQ ID NO: 34671 - DNA, 26 bp, Homo sapiens
cgtgcatttatcagatcaaaaccaac

SEQ ID NO: 34672 - DNA, 27 bp, Homo sapiens
cgtgcatttatcagatcaaaaccaacc

SEQ ID NO: 34673 - DNA, 30 bp, Homo sapiens
cgtgcatttatcagatcaaaaccaacccgg

SEQ ID NO: 34674 - DNA, 16 bp, Homo sapiens
gtgcatttatcagatc

SEQ ID NO: 34675 - DNA, 17 bp, Homo sapiens
gtgcatttatcagatca

SEQ ID NO: 34676 - DNA, 21 bp, Homo sapiens
gtgcatttatcagatcaaaac

SEQ ID NO: 34677 - DNA, 22 bp, Homo sapiens
gtgcatttatcagatcaaaacc

SEQ ID NO: 34678 - DNA, 23 bp, Homo sapiens
gtgcatttatcagatcaaaacca

SEQ ID NO: 34679 - DNA, 24 bp, Homo sapiens
gtgcatttatcagatcaaaaccaa

SEQ ID NO: 34680 - DNA, 29 bp, Homo sapiens
gtgcatttatcagatcaaaaccaacccgg

SEQ ID NO: 34681 - DNA, 30 bp, Homo sapiens
gtgcatttatcagatcaaaaccaacccggt

SEQ ID NO: 34682 - DNA, 21 bp, Homo sapiens
tgcatttatcagatcaaaacc

SEQ ID NO: 34683 - DNA, 28 bp, Homo sapiens
tgcatttatcagatcaaaaccaacccgg

SEQ ID NO: 34684 - DNA, 27 bp, Homo sapiens
gcatttatcagatcaaaaccaacccgg

SEQ ID NO: 34685 - DNA, 16 bp, Homo sapiens
catttatcagatcaaa

SEQ ID NO: 34686 - DNA, 17 bp, Homo sapiens
catttatcagatcaaaa

SEQ ID NO: 34687 - DNA, 19 bp, Homo sapiens
catttatcagatcaaaacc

SEQ ID NO: 34688 - DNA, 20 bp, Homo sapiens
catttatcagatcaaaacca

SEQ ID NO: 34689 - DNA, 21 bp, Homo sapiens
catttatcagatcaaaaccaa

SEQ ID NO: 34690 - DNA, 23 bp, Homo sapiens
catttatcagatcaaaaccaacc

SEQ ID NO: 34691 - DNA, 26 bp, Homo sapiens
catttatcagatcaaaaccaacccgg

SEQ ID NO: 34692 - DNA, 27 bp, Homo sapiens
catttatcagatcaaaaccaacccggt

SEQ ID NO: 34693 - DNA, 28 bp, Homo sapiens
catttatcagatcaaaaccaacccggtc

SEQ ID NO: 34694 - DNA, 18 bp, Homo sapiens
atttatcagatcaaaacc

SEQ ID NO: 34695 - DNA, 20 bp, Homo sapiens
atttatcagatcaaaaccaa

SEQ ID NO: 34696 - DNA, 21 bp, Homo sapiens
atttatcagatcaaaaccaac

SEQ ID NO: 34697 - DNA, 22 bp, Homo sapiens
atttatcagatcaaaaccaacc

SEQ ID NO: 34698 - DNA, 25 bp, Homo sapiens
atttatcagatcaaaaccaacccgg

SEQ ID NO: 34699 - DNA, 27 bp, Homo sapiens
atttatcagatcaaaaccaacccggtc

SEQ ID NO: 34700 - DNA, 17 bp, Homo sapiens
tttatcagatcaaaacc

SEQ ID NO: 34701 - DNA, 18 bp, Homo sapiens
tttatcagatcaaaacca

SEQ ID NO: 34702 - DNA, 19 bp, Homo sapiens
tttatcagatcaaaaccaa

SEQ ID NO: 34703 - DNA, 20 bp, Homo sapiens
tttatcagatcaaaaccaac

SEQ ID NO: 34704 - DNA, 21 bp, Homo sapiens
tttatcagatcaaaaccaacc

SEQ ID NO: 34705 - DNA, 22 bp, Homo sapiens
tttatcagatcaaaaccaaccc

SEQ ID NO: 34706 - DNA, 23 bp, Homo sapiens
tttatcagatcaaaaccaacccg

SEQ ID NO: 34707 - DNA, 24 bp, Homo sapiens
tttatcagatcaaaaccaacccgg

SEQ ID NO: 34708 - DNA, 25 bp, Homo sapiens
tttatcagatcaaaaccaacccggt

SEQ ID NO: 34709 - DNA, 26 bp, Homo sapiens
tttatcagatcaaaaccaacccggtc

SEQ ID NO: 34710 - DNA, 20 bp, Homo sapiens
ttatcagatcaaaaccaacc

SEQ ID NO: 34711 - DNA, 23 bp, Homo sapiens
ttatcagatcaaaaccaacccgg

SEQ ID NO: 34712 - DNA, 24 bp, Homo sapiens
ttatcagatcaaaaccaacccggt

SEQ ID NO: 34713 - DNA, 25 bp, Homo sapiens
ttatcagatcaaaaccaacccggtc

SEQ ID NO: 34714 - DNA, 20 bp, Homo sapiens
tatcagatcaaaaccaaccc

SEQ ID NO: 34715 - DNA, 22 bp, Homo sapiens
tatcagatcaaaaccaacccgg

SEQ ID NO: 34716 - DNA, 23 bp, Homo sapiens
tatcagatcaaaaccaacccggt

SEQ ID NO: 34717 - DNA, 24 bp, Homo sapiens
tatcagatcaaaaccaacccggtc

SEQ ID NO: 34718 - DNA, 19 bp, Homo sapiens
atcagatcaaaaccaaccc

SEQ ID NO: 34719 - DNA, 20 bp, Homo sapiens
atcagatcaaaaccaacccg

SEQ ID NO: 34720 - DNA, 21 bp, Homo sapiens
atcagatcaaaaccaacccgg

SEQ ID NO: 34721 - DNA, 22 bp, Homo sapiens
atcagatcaaaaccaacccggt

SEQ ID NO: 34722 - DNA, 23 bp, Homo sapiens
atcagatcaaaaccaacccggtc

SEQ ID NO: 34723 - DNA, 30 bp, Homo sapiens
atcagatcaaaaccaacccggtcagcccct

SEQ ID NO: 34724 - DNA, 20 bp, Homo sapiens
tcagatcaaaaccaacccgg

SEQ ID NO: 34725 - DNA, 21 bp, Homo sapiens
tcagatcaaaaccaacccggt

SEQ ID NO: 34726 - DNA, 22 bp, Homo sapiens
tcagatcaaaaccaacccggtc

SEQ ID NO: 34727 - DNA, 30 bp, Homo sapiens
tcagatcaaaaccaacccggtcagcccctc

SEQ ID NO: 34728 - DNA, 19 bp, Homo sapiens
cagatcaaaaccaacccgg

SEQ ID NO: 34729 - DNA, 20 bp, Homo sapiens
cagatcaaaaccaacccggt

SEQ ID NO: 34730 - DNA, 21 bp, Homo sapiens
cagatcaaaaccaacccggtc

SEQ ID NO: 34731 - DNA, 20 bp, Homo sapiens
agatcaaaaccaacccggtc

SEQ ID NO: 34732 - DNA, 16 bp, Homo sapiens
gatcaaaaccaacccg

SEQ ID NO: 34733 - DNA, 17 bp, Homo sapiens
gatcaaaaccaacccgg

SEQ ID NO: 34734 - DNA, 19 bp, Homo sapiens
gatcaaaaccaacccggtc

SEQ ID NO: 34735 - DNA, 21 bp, Homo sapiens
gatcaaaaccaacccggtcag

SEQ ID NO: 34736 - DNA, 22 bp, Homo sapiens
gatcaaaaccaacccggtcagc

SEQ ID NO: 34737 - DNA, 16 bp, Homo sapiens
atcaaaaccaacccgg

SEQ ID NO: 34738 - DNA, 18 bp, Homo sapiens
atcaaaaccaacccggtc

SEQ ID NO: 34739 - DNA, 29 bp, Homo sapiens
atcaaaaccaacccggtcagcccctctcc

SEQ ID NO: 34740 - DNA, 30 bp, Homo sapiens; identical to SEQ ID NO: 12703

SEQ ID NO: 34741 - DNA, 28 bp, Homo sapiens
tcaaaaccaacccggtcagcccctctcc

SEQ ID NO: 34742 - DNA, 30 bp, Homo sapiens
tcaaaaccaacccggtcagcccctctccgg

SEQ ID NO: 34743 - DNA, 18 bp, Homo sapiens
caaaaccaacccggtcag

SEQ ID NO: 34744 - DNA, 27 bp, Homo sapiens
caaaaccaacccggtcagcccctctcc

SEQ ID NO: 34745 - DNA, 30 bp, Homo sapiens
caaaaccaacccggtcagcccctctccggc

SEQ ID NO: 34746 - DNA, 26 bp, Homo sapiens
aaaaccaacccggtcagcccctctcc

SEQ ID NO: 34747 - DNA, 23 bp, Homo sapiens
aaaccaacccggtcagcccctct

SEQ ID NO: 34748 - DNA, 25 bp, Homo sapiens
aaaccaacccggtcagcccctctcc

SEQ ID NO: 34749 - DNA, 24 bp, Homo sapiens
aaccaacccggtcagcccctctcc

SEQ ID NO: 34750 - DNA, 23 bp, Homo sapiens
accaacccggtcagcccctctcc

SEQ ID NO: 34751 - DNA, 22 bp, Homo sapiens
ccaacccggtcagcccctctcc

SEQ ID NO: 34752 - DNA, 20 bp, Homo sapiens
caacccggtcagcccctctc

SEQ ID NO: 34753 - DNA, 21 bp, Homo sapiens
caacccggtcagcccctctcc

SEQ ID NO: 34754 - DNA, 22 bp, Homo sapiens
caacccggtcagcccctctccg

SEQ ID NO: 34755 - DNA, 18 bp, Homo sapiens
aacccggtcagcccctct

SEQ ID NO: 34756 - DNA, 19 bp, Homo sapiens
aacccggtcagcccctctc

SEQ ID NO: 34757 - DNA, 20 bp, Homo sapiens
aacccggtcagcccctctcc

SEQ ID NO: 34758 - DNA, 21 bp, Homo sapiens
aacccggtcagcccctctccg

SEQ ID NO: 34759 - DNA, 18 bp, Homo sapiens
acccggtcagcccctctc

SEQ ID NO: 34760 - DNA, 19 bp, Homo sapiens
acccggtcagcccctctcc

SEQ ID NO: 34761 - DNA, 20 bp, Homo sapiens
acccggtcagcccctctccg

SEQ ID NO: 34762 - DNA, 17 bp, Homo sapiens
cccggtcagcccctctc

SEQ ID NO: 34763 - DNA, 18 bp, Homo sapiens
cccggtcagcccctctcc

SEQ ID NO: 34764 - DNA, 19 bp, Homo sapiens
cccggtcagcccctctccg

SEQ ID NO: 34765 - DNA, 20 bp, Homo sapiens
cccggtcagcccctctccgg

SEQ ID NO: 34766 - DNA, 21 bp, Homo sapiens
cccggtcagcccctctccggc

SEQ ID NO: 34767 - DNA, 22 bp, Homo sapiens
cccggtcagcccctctccggcc

SEQ ID NO: 34768 - DNA, 23 bp, Homo sapiens
cccggtcagcccctctccggccc

SEQ ID NO: 34769 - DNA, 24 bp, Homo sapiens
cccggtcagcccctctccggcccc

SEQ ID NO: 34770 - DNA, 25 bp, Homo sapiens
cccggtcagcccctctccggccccg

SEQ ID NO: 34771 - DNA, 17 bp, Homo sapiens
ccggtcagcccctctcc

SEQ ID NO: 34772 - DNA, 18 bp, Homo sapiens
ccggtcagcccctctccg

SEQ ID NO: 34773 - DNA, 19 bp, Homo sapiens
ccggtcagcccctctccgg

SEQ ID NO: 34774 - DNA, 20 bp, Homo sapiens
ccggtcagcccctctccggc

SEQ ID NO: 34775 - DNA, 21 bp, Homo sapiens
ccggtcagcccctctccggcc

SEQ ID NO: 34776 - DNA, 22 bp, Homo sapiens
ccggtcagcccctctccggccc

SEQ ID NO: 34777 - DNA, 23 bp, Homo sapiens
ccggtcagcccctctccggcccc

SEQ ID NO: 34778 - DNA, 24 bp, Homo sapiens
ccggtcagcccctctccggccccg

SEQ ID NO: 34779 - DNA, 16 bp, Homo sapiens
cggtcagcccctctcc

SEQ ID NO: 34780 - DNA, 17 bp, Homo sapiens
cggtcagcccctctccg

SEQ ID NO: 34781 - DNA, 18 bp, Homo sapiens
cggtcagcccctctccgg

SEQ ID NO: 34782 - DNA, 19 bp, Homo sapiens
cggtcagcccctctccggc

SEQ ID NO: 34783 - DNA, 20 bp, Homo sapiens
cggtcagcccctctccggcc

SEQ ID NO: 34784 - DNA, 21 bp, Homo sapiens
cggtcagcccctctccggccc

SEQ ID NO: 34785 - DNA, 16 bp, Homo sapiens
ggtcagcccctctccg

SEQ ID NO: 34786 - DNA, 18 bp, Homo sapiens
ggtcagcccctctccggc

SEQ ID NO: 34787 - DNA, 19 bp, Homo sapiens
ggtcagcccctctccggcc

SEQ ID NO: 34788 - DNA, 20 bp, Homo sapiens
ggtcagcccctctccggccc

SEQ ID NO: 34789 - DNA, 22 bp, Homo sapiens
ggtcagcccctctccggccccg

SEQ ID NO: 34790 - DNA, 17 bp, Homo sapiens
gcccctctccggccccg

SEQ ID NO: 34791 - DNA, 18 bp, Homo sapiens
gcccctctccggccccgg

SEQ ID NO: 34792 - DNA, 21 bp, Homo sapiens
ccggccccggccggggggcgg

SEQ ID NO: 34793 - DNA, 16 bp, Homo sapiens
ggccccggccgggggg

SEQ ID NO: 34794 - DNA, 17 bp, Homo sapiens
ggccccggccggggggc

SEQ ID NO: 34795 - DNA, 18 bp, Homo sapiens
ggccccggccggggggcg

SEQ ID NO: 34796 - DNA, 19 bp, Homo sapiens
ggccccggccggggggcgg

SEQ ID NO: 34797 - DNA, 20 bp, Homo sapiens
ggccccggccggggggcggg

SEQ ID NO: 34798 - DNA, 21 bp, Homo sapiens
ggccccggccggggggcgggc

SEQ ID NO: 34799 - DNA, 22 bp, Homo sapiens
ggccccggccggggggcgggcg

SEQ ID NO: 34800 - DNA, 23 bp, Homo sapiens
ggccccggccggggggcgggcgc

SEQ ID NO: 34801 - DNA, 24 bp, Homo sapiens
ggccccggccggggggcgggcgcc

SEQ ID NO: 34802 - DNA, 27 bp, Homo sapiens
ggccccggccggggggcgggcgccggc

SEQ ID NO: 34803 - DNA, 28 bp, Homo sapiens
ggccccggccggggggcgggcgccggcg

SEQ ID NO: 34804 - DNA, 30 bp, Homo sapiens
ggccccggccggggggcgggcgccggcggc

SEQ ID NO: 34805 - DNA, 16 bp, Homo sapiens
gccccggccggggggc

SEQ ID NO: 34806 - DNA, 17 bp, Homo sapiens
gccccggccggggggcg

SEQ ID NO: 34807 - DNA, 18 bp, Homo sapiens
gccccggccggggggcgg

SEQ ID NO: 34808 - DNA, 19 bp, Homo sapiens
gccccggccggggggcggg

SEQ ID NO: 34809 - DNA, 20 bp, Homo sapiens
gccccggccggggggcgggc

SEQ ID NO: 34810 - DNA, 21 bp, Homo sapiens
gccccggccggggggcgggcg

SEQ ID NO: 34811 - DNA, 22 bp, Homo sapiens
gccccggccggggggcgggcgc

SEQ ID NO: 34812 - DNA, 23 bp, Homo sapiens
gccccggccggggggcgggcgcc

SEQ ID NO: 34813 - DNA, 25 bp, Homo sapiens
gccccggccggggggcgggcgccgg

SEQ ID NO: 34814 - DNA, 26 bp, Homo sapiens
gccccggccggggggcgggcgccggc

SEQ ID NO: 34815 - DNA, 27 bp, Homo sapiens
gccccggccggggggcgggcgccggcg

SEQ ID NO: 34816 - DNA, 28 bp, Homo sapiens
gccccggccggggggcgggcgccggcgg

SEQ ID NO: 34817 - DNA, 29 bp, Homo sapiens
gccccggccggggggcgggcgccggcggc

SEQ ID NO: 34818 - DNA, 30 bp, Homo sapiens; identical to SEQ ID NO: 12722

SEQ ID NO: 34819 - DNA, 17 bp, Homo sapiens
ccccggccggggggcgg

SEQ ID NO: 34820 - DNA, 18 bp, Homo sapiens
ccccggccggggggcggg

SEQ ID NO: 34821 - DNA, 19 bp, Homo sapiens
ccccggccggggggcgggc

SEQ ID NO: 34822 - DNA, 21 bp, Homo sapiens
ccccggccggggggcgggcgc

SEQ ID NO: 34823 - DNA, 24 bp, Homo sapiens
ccccggccggggggcgggcgccgg

SEQ ID NO: 34824 - DNA, 28 bp, Homo sapiens
ccccggccggggggcgggcgccggcggc

SEQ ID NO: 34825 - DNA, 17 bp, Homo sapiens
cggccggggggcgggcg

SEQ ID NO: 34826 - DNA, 18 bp, Homo sapiens
cggccggggggcgggcgc

SEQ ID NO: 34827 - DNA, 21 bp, Homo sapiens
cggccggggggcgggcgccgg

SEQ ID NO: 34828 - DNA, 22 bp, Homo sapiens
cggccggggggcgggcgccggc

SEQ ID NO: 34829 - DNA, 23 bp, Homo sapiens
cggccggggggcgggcgccggcg

SEQ ID NO: 34830 - DNA, 24 bp, Homo sapiens
cggccggggggcgggcgccggcgg

SEQ ID NO: 34831 - DNA, 25 bp, Homo sapiens
cggccggggggcgggcgccggcggc

SEQ ID NO: 34832 - DNA, 16 bp, Homo sapiens
ggccggggggcgggcg

SEQ ID NO: 34833 - DNA, 17 bp, Homo sapiens
ggccggggggcgggcgc

SEQ ID NO: 34834 - DNA, 20 bp, Homo sapiens
ggccggggggcgggcgccgg

SEQ ID NO: 34835 - DNA, 21 bp, Homo sapiens
ggccggggggcgggcgccggc

SEQ ID NO: 34836 - DNA, 22 bp, Homo sapiens
ggccggggggcgggcgccggcg

SEQ ID NO: 34837 - DNA, 23 bp, Homo sapiens
ggccggggggcgggcgccggcgg

SEQ ID NO: 34838 - DNA, 24 bp, Homo sapiens
ggccggggggcgggcgccggcggc

SEQ ID NO: 34839 - DNA, 16 bp, Homo sapiens
gccggggggcgggcgc

SEQ ID NO: 34840 - DNA, 17 bp, Homo sapiens
gccggggggcgggcgcc

SEQ ID NO: 34841 - DNA, 18 bp, Homo sapiens
gccggggggcgggcgccg

SEQ ID NO: 34842 - DNA, 19 bp, Homo sapiens
gccggggggcgggcgccgg

SEQ ID NO: 34843 - DNA, 20 bp, Homo sapiens
gccggggggcgggcgccggc

SEQ ID NO: 34844 - DNA, 21 bp, Homo sapiens
gccggggggcgggcgccggcg

SEQ ID NO: 34845 - DNA, 22 bp, Homo sapiens
gccggggggcgggcgccggcgg

SEQ ID NO: 34846 - DNA, 23 bp, Homo sapiens
gccggggggcgggcgccggcggc

SEQ ID NO: 34847 - DNA, 19 bp, Homo sapiens
ccggggggcgggcgccggc

SEQ ID NO: 34848 - DNA, 20 bp, Homo sapiens
ccggggggcgggcgccggcg

SEQ ID NO: 34849 - DNA, 21 bp, Homo sapiens
ccggggggcgggcgccggcgg

SEQ ID NO: 34850 - DNA, 22 bp, Homo sapiens
ccggggggcgggcgccggcggc

SEQ ID NO: 34851 - DNA, 17 bp, Homo sapiens
cggggggcgggcgccgg

SEQ ID NO: 34852 - DNA, 18 bp, Homo sapiens
cggggggcgggcgccggc

SEQ ID NO: 34853 - DNA, 19 bp, Homo sapiens
cggggggcgggcgccggcg

SEQ ID NO: 34854 - DNA, 20 bp, Homo sapiens
cggggggcgggcgccggcgg

SEQ ID NO: 34855 - DNA, 21 bp, Homo sapiens
cggggggcgggcgccggcggc

SEQ ID NO: 34856 - DNA, 22 bp, Homo sapiens
cggggggcgggcgccggcggct

SEQ ID NO: 34857 - DNA, 23 bp, Homo sapiens
cggggggcgggcgccggcggctt

SEQ ID NO: 34858 - DNA, 17 bp, Homo sapiens
ggggggcgggcgccggc

SEQ ID NO: 34859 - DNA, 18 bp, Homo sapiens
ggggggcgggcgccggcg

SEQ ID NO: 34860 - DNA, 19 bp, Homo sapiens
ggggggcgggcgccggcgg

SEQ ID NO: 34861 - DNA, 20 bp, Homo sapiens
ggggggcgggcgccggcggc

SEQ ID NO: 34862 - DNA, 21 bp, Homo sapiens
ggggggcgggcgccggcggct

SEQ ID NO: 34863 - DNA, 22 bp, Homo sapiens
ggggggcgggcgccggcggctt

SEQ ID NO: 34864 - DNA, 17 bp, Homo sapiens
gggggcgggcgccggcg

SEQ ID NO: 34865 - DNA, 19 bp, Homo sapiens
gggggcgggcgccggcggc

SEQ ID NO: 34866 - DNA, 20 bp, Homo sapiens
gggggcgggcgccggcggct

SEQ ID NO: 34867 - DNA, 16 bp, Homo sapiens
ggggcgggcgccggcg

SEQ ID NO: 34868 - DNA, 18 bp, Homo sapiens
ggggcgggcgccggcggc

SEQ ID NO: 34869 - DNA, 19 bp, Homo sapiens
ggggcgggcgccggcggct

SEQ ID NO: 34870 - DNA, 20 bp, Homo sapiens
ggggcgggcgccggcggctt

SEQ ID NO: 34871 - DNA, 20 bp, Homo sapiens
gcgggcgccggcggctttgg

SEQ ID NO: 34872 - DNA, 27 bp, Homo sapiens
gcgggcgccggcggctttggtgactct

SEQ ID NO: 34873 - DNA, 19 bp, Homo sapiens
cgggcgccggcggctttgg

SEQ ID NO: 34874 - DNA, 24 bp, Homo sapiens
ggcgccggcggctttggtgactct

SEQ ID NO: 34875 - DNA, 27 bp, Homo sapiens
ggcgccggcggctttggtgactctaga

SEQ ID NO: 34876 - DNA, 29 bp, Homo sapiens
ggcgccggcggctttggtgactctagata

SEQ ID NO: 34877 - DNA, 23 bp, Homo sapiens
gcgccggcggctttggtgactct

SEQ ID NO: 34878 - DNA, 24 bp, Homo sapiens
gcgccggcggctttggtgactcta

SEQ ID NO: 34879 - DNA, 25 bp, Homo sapiens
gcgccggcggctttggtgactctag

SEQ ID NO: 34880 - DNA, 26 bp, Homo sapiens
gcgccggcggctttggtgactctaga

SEQ ID NO: 34881 - DNA, 27 bp, Homo sapiens
gcgccggcggctttggtgactctagat

SEQ ID NO: 34882 - DNA, 28 bp, Homo sapiens
gcgccggcggctttggtgactctagata

SEQ ID NO: 34883 - DNA, 22 bp, Homo sapiens
cgccggcggctttggtgactct

SEQ ID NO: 34884 - DNA, 23 bp, Homo sapiens
cgccggcggctttggtgactcta

SEQ ID NO: 34885 - DNA, 24 bp, Homo sapiens
cgccggcggctttggtgactctag

SEQ ID NO: 34886 - DNA, 25 bp, Homo sapiens
cgccggcggctttggtgactctaga

SEQ ID NO: 34887 - DNA, 26 bp, Homo sapiens
cgccggcggctttggtgactctagat

SEQ ID NO: 34888 - DNA, 19 bp, Homo sapiens
gccggcggctttggtgact

SEQ ID NO: 34889 - DNA, 21 bp, Homo sapiens
gccggcggctttggtgactct

SEQ ID NO: 34890 - DNA, 23 bp, Homo sapiens
gccggcggctttggtgactctag

SEQ ID NO: 34891 - DNA, 24 bp, Homo sapiens
gccggcggctttggtgactctaga

SEQ ID NO: 34892 - DNA, 25 bp, Homo sapiens
gccggcggctttggtgactctagat

SEQ ID NO: 34893 - DNA, 20 bp, Homo sapiens
ccggcggctttggtgactct

SEQ ID NO: 34894 - DNA, 21 bp, Homo sapiens
ccggcggctttggtgactcta

SEQ ID NO: 34895 - DNA, 22 bp, Homo sapiens
ccggcggctttggtgactctag

SEQ ID NO: 34896 - DNA, 23 bp, Homo sapiens
ccggcggctttggtgactctaga

SEQ ID NO: 34897 - DNA, 24 bp, Homo sapiens
ccggcggctttggtgactctagat

SEQ ID NO: 34898 - DNA, 25 bp, Homo sapiens
ccggcggctttggtgactctagata

SEQ ID NO: 34899 - DNA, 22 bp, Homo sapiens
cggcggctttggtgactctaga

SEQ ID NO: 34900 - DNA, 18 bp, Homo sapiens
ggcggctttggtgactct

SEQ ID NO: 34901 - DNA, 21 bp, Homo sapiens
ggcggctttggtgactctaga

SEQ ID NO: 34902 - DNA, 22 bp, Homo sapiens
ggcggctttggtgactctagat

SEQ ID NO: 34903 - DNA, 23 bp, Homo sapiens
ggcggctttggtgactctagata

SEQ ID NO: 34904 - DNA, 17 bp, Homo sapiens
gcggctttggtgactct

SEQ ID NO: 34905 - DNA, 19 bp, Homo sapiens
gcggctttggtgactctag

SEQ ID NO: 34906 - DNA, 20 bp, Homo sapiens
gcggctttggtgactctaga

SEQ ID NO: 34907 - DNA, 21 bp, Homo sapiens
gcggctttggtgactctagat

SEQ ID NO: 34908 - DNA, 22 bp, Homo sapiens
gcggctttggtgactctagata

SEQ ID NO: 34909 - DNA, 16 bp, Homo sapiens
cggctttggtgactct

SEQ ID NO: 34910 - DNA, 18 bp, Homo sapiens
cggctttggtgactctag

SEQ ID NO: 34911 - DNA, 19 bp, Homo sapiens
cggctttggtgactctaga

SEQ ID NO: 34912 - DNA, 20 bp, Homo sapiens
cggctttggtgactctagat

SEQ ID NO: 34913 - DNA, 21 bp, Homo sapiens
cggctttggtgactctagata

SEQ ID NO: 34914 - DNA, 22 bp, Homo sapiens
cggctttggtgactctagataa

SEQ ID NO: 34915 - DNA, 17 bp, Homo sapiens
ggctttggtgactctag

SEQ ID NO: 34916 - DNA, 18 bp, Homo sapiens
ggctttggtgactctaga

SEQ ID NO: 34917 - DNA, 19 bp, Homo sapiens
ggctttggtgactctagat

SEQ ID NO: 34918 - DNA, 20 bp, Homo sapiens
ggctttggtgactctagata

SEQ ID NO: 34919 - DNA, 27 bp, Homo sapiens
ggctttggtgactctagataacctcgg

SEQ ID NO: 34920 - DNA, 30 bp, Homo sapiens
ggctttggtgactctagataacctcgggcc

SEQ ID NO: 34921 - DNA, 16 bp, Homo sapiens
gctttggtgactctag

SEQ ID NO: 34922 - DNA, 17 bp, Homo sapiens
gctttggtgactctaga

SEQ ID NO: 34923 - DNA, 18 bp, Homo sapiens
gctttggtgactctagat

SEQ ID NO: 34924 - DNA, 19 bp, Homo sapiens
gctttggtgactctagata

SEQ ID NO: 34925 - DNA, 20 bp, Homo sapiens
gctttggtgactctagataa

SEQ ID NO: 34926 - DNA, 21 bp, Homo sapiens
gctttggtgactctagataac

SEQ ID NO: 34927 - DNA, 26 bp, Homo sapiens
gctttggtgactctagataacctcgg

SEQ ID NO: 34928 - DNA, 30 bp, Homo sapiens; identical to SEQ ID NO: 12757

SEQ ID NO: 34929 - DNA, 16 bp, Homo sapiens
ctttggtgactctaga

SEQ ID NO: 34930 - DNA, 17 bp, Homo sapiens
ctttggtgactctagat

SEQ ID NO: 34931 - DNA, 18 bp, Homo sapiens
ctttggtgactctagata

SEQ ID NO: 34932 - DNA, 19 bp, Homo sapiens
ctttggtgactctagataa

SEQ ID NO: 34933 - DNA, 20 bp, Homo sapiens
ctttggtgactctagataac

SEQ ID NO: 34934 - DNA, 21 bp, Homo sapiens
ctttggtgactctagataacc

SEQ ID NO: 34935 - DNA, 22 bp, Homo sapiens
ctttggtgactctagataacct

SEQ ID NO: 34936 - DNA, 23 bp, Homo sapiens
ctttggtgactctagataacctc

SEQ ID NO: 34937 - DNA, 24 bp, Homo sapiens
ctttggtgactctagataacctcg

SEQ ID NO: 34938 - DNA, 25 bp, Homo sapiens
ctttggtgactctagataacctcgg

SEQ ID NO: 34939 - DNA, 26 bp, Homo sapiens
ctttggtgactctagataacctcggg

SEQ ID NO: 34940 - DNA, 29 bp, Homo sapiens
ctttggtgactctagataacctcgggccg

SEQ ID NO: 34941 - DNA, 16 bp, Homo sapiens
tttggtgactctagat

SEQ ID NO: 34942 - DNA, 17 bp, Homo sapiens
tttggtgactctagata

SEQ ID NO: 34943 - DNA, 19 bp, Homo sapiens
tttggtgactctagataac

SEQ ID NO: 34944 - DNA, 20 bp, Homo sapiens
tttggtgactctagataacc

SEQ ID NO: 34945 - DNA, 23 bp, Homo sapiens
tttggtgactctagataacctcg

SEQ ID NO: 34946 - DNA, 24 bp, Homo sapiens
tttggtgactctagataacctcgg

SEQ ID NO: 34947 - DNA, 25 bp, Homo sapiens
tttggtgactctagataacctcggg

SEQ ID NO: 34948 - DNA, 26 bp, Homo sapiens
tttggtgactctagataacctcgggc

SEQ ID NO: 34949 - DNA, 27 bp, Homo sapiens
tttggtgactctagataacctcgggcc

SEQ ID NO: 34950 - DNA, 28 bp, Homo sapiens
tttggtgactctagataacctcgggccg

SEQ ID NO: 34951 - DNA, 16 bp, Homo sapiens
ttggtgactctagata

SEQ ID NO: 34952 - DNA, 18 bp, Homo sapiens
ttggtgactctagataac

SEQ ID NO: 34953 - DNA, 19 bp, Homo sapiens
ttggtgactctagataacc

SEQ ID NO: 34954 - DNA, 22 bp, Homo sapiens
ttggtgactctagataacctcg

SEQ ID NO: 34955 - DNA, 23 bp, Homo sapiens
ttggtgactctagataacctcgg

SEQ ID NO: 34956 - DNA, 24 bp, Homo sapiens
ttggtgactctagataacctcggg

SEQ ID NO: 34957 - DNA, 25 bp, Homo sapiens
ttggtgactctagataacctcgggc

SEQ ID NO: 34958 - DNA, 26 bp, Homo sapiens
ttggtgactctagataacctcgggcc

SEQ ID NO: 34959 - DNA, 27 bp, Homo sapiens
ttggtgactctagataacctcgggccg

SEQ ID NO: 34960 - DNA, 28 bp, Homo sapiens
ttggtgactctagataacctcgggccga

SEQ ID NO: 34961 - DNA, 22 bp, Homo sapiens
tggtgactctagataacctcgg

SEQ ID NO: 34962 - DNA, 29 bp, Homo sapiens
tggtgactctagataacctcgggccgatc

SEQ ID NO: 34963 - DNA, 30 bp, Homo sapiens
tggtgactctagataacctcgggccgatcg

SEQ ID NO: 34964 - DNA, 21 bp, Homo sapiens
ggtgactctagataacctcgg

SEQ ID NO: 34965 - DNA, 25 bp, Homo sapiens
ggtgactctagataacctcgggccg

SEQ ID NO: 34966 - DNA, 28 bp, Homo sapiens
ggtgactctagataacctcgggccgatc

SEQ ID NO: 34967 - DNA, 29 bp, Homo sapiens
ggtgactctagataacctcgggccgatcg

SEQ ID NO: 34968 - DNA, 30 bp, Homo sapiens; identical to SEQ ID NO: 12804

SEQ ID NO: 34969 - DNA, 17 bp, Homo sapiens
gtgactctagataacct

SEQ ID NO: 34970 - DNA, 18 bp, Homo sapiens
gtgactctagataacctc

SEQ ID NO: 34971 - DNA, 19 bp, Homo sapiens
gtgactctagataacctcg

SEQ ID NO: 34972 - DNA, 20 bp, Homo sapiens
gtgactctagataacctcgg

SEQ ID NO: 34973 - DNA, 21 bp, Homo sapiens
gtgactctagataacctcggg

SEQ ID NO: 34974 - DNA, 22 bp, Homo sapiens
gtgactctagataacctcgggc

SEQ ID NO: 34975 - DNA, 23 bp, Homo sapiens
gtgactctagataacctcgggcc

SEQ ID NO: 34976 - DNA, 24 bp, Homo sapiens
gtgactctagataacctcgggccg

SEQ ID NO: 34977 - DNA, 27 bp, Homo sapiens
gtgactctagataacctcgggccgatc

SEQ ID NO: 34978 - DNA, 29 bp, Homo sapiens
gtgactctagataacctcgggccgatcgc

SEQ ID NO: 34979 - DNA, 18 bp, Homo sapiens
tgactctagataacctcg

SEQ ID NO: 34980 - DNA, 19 bp, Homo sapiens
tgactctagataacctcgg

SEQ ID NO: 34981 - DNA, 20 bp, Homo sapiens
tgactctagataacctcggg

SEQ ID NO: 34982 - DNA, 21 bp, Homo sapiens
tgactctagataacctcgggc

SEQ ID NO: 34983 - DNA, 22 bp, Homo sapiens
tgactctagataacctcgggcc

SEQ ID NO: 34984 - DNA, 23 bp, Homo sapiens
tgactctagataacctcgggccg

SEQ ID NO: 34985 - DNA, 26 bp, Homo sapiens
tgactctagataacctcgggccgatc

SEQ ID NO: 34986 - DNA, 30 bp, Homo sapiens; identical to SEQ ID NO: 2179

SEQ ID NO: 34987 - DNA, 17 bp, Homo sapiens
gactctagataacctcg

SEQ ID NO: 34988 - DNA, 18 bp, Homo sapiens
gactctagataacctcgg

SEQ ID NO: 34989 - DNA, 19 bp, Homo sapiens
gactctagataacctcggg

SEQ ID NO: 34990 - DNA, 21 bp, Homo sapiens
gactctagataacctcgggcc

SEQ ID NO: 34991 - DNA, 22 bp, Homo sapiens
gactctagataacctcgggccg

SEQ ID NO: 34992 - DNA, 25 bp, Homo sapiens
gactctagataacctcgggccgatc

SEQ ID NO: 34993 - DNA, 29 bp, Homo sapiens
gactctagataacctcgggccgatcgcac

SEQ ID NO: 34994 - DNA, 30 bp, Homo sapiens; identical to SEQ ID NO: 12835

SEQ ID NO: 34995 - DNA, 17 bp, Homo sapiens
actctagataacctcgg

SEQ ID NO: 34996 - DNA, 18 bp, Homo sapiens
actctagataacctcggg

SEQ ID NO: 34997 - DNA, 19 bp, Homo sapiens
actctagataacctcgggc

SEQ ID NO: 34998 - DNA, 20 bp, Homo sapiens
actctagataacctcgggcc

SEQ ID NO: 34999 - DNA, 21 bp, Homo sapiens
actctagataacctcgggccg

SEQ ID NO: 35000 - DNA, 22 bp, Homo sapiens
actctagataacctcgggccga

SEQ ID NO: 35001 - DNA, 23 bp, Homo sapiens
actctagataacctcgggccgat

SEQ ID NO: 35002 - DNA, 24 bp, Homo sapiens
actctagataacctcgggccgatc

SEQ ID NO: 35003 - DNA, 25 bp, Homo sapiens
actctagataacctcgggccgatcg

SEQ ID NO: 35004 - DNA, 26 bp, Homo sapiens
actctagataacctcgggccgatcgc

SEQ ID NO: 35005 - DNA, 27 bp, Homo sapiens
actctagataacctcgggccgatcgca

SEQ ID NO: 35006 - DNA, 28 bp, Homo sapiens
actctagataacctcgggccgatcgcac

SEQ ID NO: 35007 - DNA, 30 bp, Homo sapiens
actctagataacctcgggccgatcgcacgc

SEQ ID NO: 35008 - DNA, 16 bp, Homo sapiens
ctctagataacctcgg

SEQ ID NO: 35009 - DNA, 17 bp, Homo sapiens
ctctagataacctcggg

SEQ ID NO: 35010 - DNA, 18 bp, Homo sapiens
ctctagataacctcgggc

SEQ ID NO: 35011 - DNA, 19 bp, Homo sapiens
ctctagataacctcgggcc

SEQ ID NO: 35012 - DNA, 20 bp, Homo sapiens
ctctagataacctcgggccg

SEQ ID NO: 35013 - DNA, 21 bp, Homo sapiens
ctctagataacctcgggccga

SEQ ID NO: 35014 - DNA, 22 bp, Homo sapiens
ctctagataacctcgggccgat

SEQ ID NO: 35015 - DNA, 23 bp, Homo sapiens
ctctagataacctcgggccgatc

SEQ ID NO: 35016 - DNA, 24 bp, Homo sapiens
ctctagataacctcgggccgatcg

SEQ ID NO: 35017 - DNA, 25 bp, Homo sapiens
ctctagataacctcgggccgatcgc

SEQ ID NO: 35018 - DNA, 26 bp, Homo sapiens
ctctagataacctcgggccgatcgca

SEQ ID NO: 35019 - DNA, 27 bp, Homo sapiens
ctctagataacctcgggccgatcgcac

SEQ ID NO: 35020 - DNA, 28 bp, Homo sapiens
ctctagataacctcgggccgatcgcacg

SEQ ID NO: 35021 - DNA, 29 bp, Homo sapiens
ctctagataacctcgggccgatcgcacgc

SEQ ID NO: 35022 - DNA, 19 bp, Homo sapiens
tctagataacctcgggccg

SEQ ID NO: 35023 - DNA, 20 bp, Homo sapiens
tctagataacctcgggccga

SEQ ID NO: 35024 - DNA, 21 bp, Homo sapiens
tctagataacctcgggccgat

SEQ ID NO: 35025 - DNA, 22 bp, Homo sapiens
tctagataacctcgggccgatc

SEQ ID NO: 35026 - DNA, 23 bp, Homo sapiens
tctagataacctcgggccgatcg

SEQ ID NO: 35027 - DNA, 25 bp, Homo sapiens
tctagataacctcgggccgatcgca

SEQ ID NO: 35028 - DNA, 26 bp, Homo sapiens
tctagataacctcgggccgatcgcac

SEQ ID NO: 35029 - DNA, 28 bp, Homo sapiens
tctagataacctcgggccgatcgcacgc

SEQ ID NO: 35030 - DNA, 17 bp, Homo sapiens
ctagataacctcgggcc

SEQ ID NO: 35031 - DNA, 18 bp, Homo sapiens
ctagataacctcgggccg

SEQ ID NO: 35032 - DNA, 19 bp, Homo sapiens
ctagataacctcgggccga

SEQ ID NO: 35033 - DNA, 20 bp, Homo sapiens
ctagataacctcgggccgat

SEQ ID NO: 35034 - DNA, 21 bp, Homo sapiens
ctagataacctcgggccgatc

SEQ ID NO: 35035 - DNA, 22 bp, Homo sapiens
ctagataacctcgggccgatcg

SEQ ID NO: 35036 - DNA, 23 bp, Homo sapiens
ctagataacctcgggccgatcgc

SEQ ID NO: 35037 - DNA, 24 bp, Homo sapiens
ctagataacctcgggccgatcgca

SEQ ID NO: 35038 - DNA, 25 bp, Homo sapiens
ctagataacctcgggccgatcgcac

SEQ ID NO: 35039 - DNA, 26 bp, Homo sapiens
ctagataacctcgggccgatcgcacg

SEQ ID NO: 35040 - DNA, 27 bp, Homo sapiens
ctagataacctcgggccgatcgcacgc

SEQ ID NO: 35041 - DNA, 18 bp, Homo sapiens
tagataacctcgggccga

SEQ ID NO: 35042 - DNA, 19 bp, Homo sapiens
tagataacctcgggccgat

SEQ ID NO: 35043 - DNA, 20 bp, Homo sapiens
tagataacctcgggccgatc

SEQ ID NO: 35044 - DNA, 21 bp, Homo sapiens
tagataacctcgggccgatcg

SEQ ID NO: 35045 - DNA, 22 bp, Homo sapiens
tagataacctcgggccgatcgc

SEQ ID NO: 35046 - DNA, 23 bp, Homo sapiens
tagataacctcgggccgatcgca

SEQ ID NO: 35047 - DNA, 24 bp, Homo sapiens
tagataacctcgggccgatcgcac

SEQ ID NO: 35048 - DNA, 25 bp, Homo sapiens
tagataacctcgggccgatcgcacg

SEQ ID NO: 35049 - DNA, 26 bp, Homo sapiens
tagataacctcgggccgatcgcacgc

SEQ ID NO: 35050 - DNA, 18 bp, Homo sapiens
agataacctcgggccgat

SEQ ID NO: 35051 - DNA, 19 bp, Homo sapiens
agataacctcgggccgatc

SEQ ID NO: 35052 - DNA, 20 bp, Homo sapiens
agataacctcgggccgatcg

SEQ ID NO: 35053 - DNA, 21 bp, Homo sapiens
agataacctcgggccgatcgc

SEQ ID NO: 35054 - DNA, 22 bp, Homo sapiens
agataacctcgggccgatcgca

SEQ ID NO: 35055 - DNA, 23 bp, Homo sapiens
agataacctcgggccgatcgcac

SEQ ID NO: 35056 - DNA, 25 bp, Homo sapiens
agataacctcgggccgatcgcacgc

SEQ ID NO: 35057 - DNA, 19 bp, Homo sapiens
gataacctcgggccgatcg

SEQ ID NO: 35058 - DNA, 20 bp, Homo sapiens
gataacctcgggccgatcgc

SEQ ID NO: 35059 - DNA, 21 bp, Homo sapiens
gataacctcgggccgatcgca

SEQ ID NO: 35060 - DNA, 22 bp, Homo sapiens
gataacctcgggccgatcgcac

SEQ ID NO: 35061 - DNA, 23 bp, Homo sapiens
gataacctcgggccgatcgcacg

SEQ ID NO: 35062 - DNA, 24 bp, Homo sapiens
gataacctcgggccgatcgcacgc

SEQ ID NO: 35063 - DNA, 18 bp, Homo sapiens
ataacctcgggccgatcg

SEQ ID NO: 35064 - DNA, 19 bp, Homo sapiens
ataacctcgggccgatcgc

SEQ ID NO: 35065 - DNA, 20 bp, Homo sapiens
ataacctcgggccgatcgca

SEQ ID NO: 35066 - DNA, 21 bp, Homo sapiens
ataacctcgggccgatcgcac

SEQ ID NO: 35067 - DNA, 22 bp, Homo sapiens
ataacctcgggccgatcgcacg

SEQ ID NO: 35068 - DNA, 23 bp, Homo sapiens
ataacctcgggccgatcgcacgc

SEQ ID NO: 35069 - DNA, 17 bp, Homo sapiens
taacctcgggccgatcg

SEQ ID NO: 35070 - DNA, 19 bp, Homo sapiens
taacctcgggccgatcgca

SEQ ID NO: 35071 - DNA, 20 bp, Homo sapiens
taacctcgggccgatcgcac

SEQ ID NO: 35072 - DNA, 21 bp, Homo sapiens
taacctcgggccgatcgcacg

SEQ ID NO: 35073 - DNA, 22 bp, Homo sapiens
taacctcgggccgatcgcacgc

SEQ ID NO: 35074 - DNA, 23 bp, Homo sapiens
taacctcgggccgatcgcacgcc

SEQ ID NO: 35075 - DNA, 16 bp, Homo sapiens
aacctcgggccgatcg

SEQ ID NO: 35076 - DNA, 17 bp, Homo sapiens
aacctcgggccgatcgc

SEQ ID NO: 35077 - DNA, 18 bp, Homo sapiens
aacctcgggccgatcgca

SEQ ID NO: 35078 - DNA, 19 bp, Homo sapiens
aacctcgggccgatcgcac

SEQ ID NO: 35079 - DNA, 20 bp, Homo sapiens
aacctcgggccgatcgcacg

SEQ ID NO: 35080 - DNA, 21 bp, Homo sapiens
aacctcgggccgatcgcacgc

SEQ ID NO: 35081 - DNA, 17 bp, Homo sapiens
acctcgggccgatcgca

SEQ ID NO: 35082 - DNA, 18 bp, Homo sapiens
acctcgggccgatcgcac

SEQ ID NO: 35083 - DNA, 19 bp, Homo sapiens
acctcgggccgatcgcacg

SEQ ID NO: 35084 - DNA, 20 bp, Homo sapiens
acctcgggccgatcgcacgc

SEQ ID NO: 35085 - DNA, 21 bp, Homo sapiens
acctcgggccgatcgcacgcc

SEQ ID NO: 35086 - DNA, 22 bp, Homo sapiens
acctcgggccgatcgcacgccc

SEQ ID NO: 35087 - DNA, 23 bp, Homo sapiens
acctcgggccgatcgcacgcccc

SEQ ID NO: 35088 - DNA, 16 bp, Homo sapiens
cctcgggccgatcgca

SEQ ID NO: 35089 - DNA, 17 bp, Homo sapiens
cctcgggccgatcgcac

SEQ ID NO: 35090 - DNA, 18 bp, Homo sapiens
cctcgggccgatcgcacg

SEQ ID NO: 35091 - DNA, 19 bp, Homo sapiens
cctcgggccgatcgcacgc

SEQ ID NO: 35092 - DNA, 20 bp, Homo sapiens
cctcgggccgatcgcacgcc

SEQ ID NO: 35093 - DNA, 16 bp, Homo sapiens
ctcgggccgatcgcac

SEQ ID NO: 35094 - DNA, 17 bp, Homo sapiens
ctcgggccgatcgcacg

SEQ ID NO: 35095 - DNA, 18 bp, Homo sapiens
ctcgggccgatcgcacgc

SEQ ID NO: 35096 - DNA, 19 bp, Homo sapiens
ctcgggccgatcgcacgcc

SEQ ID NO: 35097 - DNA, 21 bp, Homo sapiens
ctcgggccgatcgcacgcccc

SEQ ID NO: 35098 - DNA, 16 bp, Homo sapiens
cgggccgatcgcacgc

SEQ ID NO: 35099 - DNA, 17 bp, Homo sapiens
cgggccgatcgcacgcc

SEQ ID NO: 35100 - DNA, 21 bp, Homo sapiens
gccgatcgcacgccccccgtg

SEQ ID NO: 35101 - DNA, 19 bp, Homo sapiens
ccgatcgcacgccccccgt

SEQ ID NO: 35102 - DNA, 20 bp, Homo sapiens
ccgatcgcacgccccccgtg

SEQ ID NO: 35103 - DNA, 21 bp, Homo sapiens
ccgatcgcacgccccccgtgg

SEQ ID NO: 35104 - DNA, 20 bp, Homo sapiens
atcgcacgccccccgtggcg

SEQ ID NO: 35105 - DNA, 19 bp, Homo sapiens
gccccccgtggcggcgacg

SEQ ID NO: 35106 - DNA, 20 bp, Homo sapiens
gccccccgtggcggcgacga

SEQ ID NO: 35107 - DNA, 24 bp, Homo sapiens
gccccccgtggcggcgacgaccca

SEQ ID NO: 35108 - DNA, 26 bp, Homo sapiens
gccccccgtggcggcgacgacccatt

SEQ ID NO: 35109 - DNA, 28 bp, Homo sapiens
gccccccgtggcggcgacgacccattcg

SEQ ID NO: 35110 - DNA, 29 bp, Homo sapiens
gccccccgtggcggcgacgacccattcga

SEQ ID NO: 35111 - DNA, 21 bp, Homo sapiens
ccccccgtggcggcgacgacc

SEQ ID NO: 35112 - DNA, 17 bp, Homo sapiens
cgtggcggcgacgaccc

SEQ ID NO: 35113 - DNA, 20 bp, Homo sapiens
acgacccattcgaacgtctg

SEQ ID NO: 35114 - DNA, 19 bp, Homo sapiens
cgacccattcgaacgtctg

SEQ ID NO: 35115 - DNA, 20 bp, Homo sapiens
gacccattcgaacgtctgcc

SEQ ID NO: 35116 - DNA, 17 bp, Homo sapiens
acccattcgaacgtctg

SEQ ID NO: 35117 - DNA, 19 bp, Homo sapiens
acccattcgaacgtctgcc

SEQ ID NO: 35118 - DNA, 21 bp, Homo sapiens
acccattcgaacgtctgccct

SEQ ID NO: 35119 - DNA, 24 bp, Homo sapiens
acccattcgaacgtctgccctatc

SEQ ID NO: 35120 - DNA, 16 bp, Homo sapiens
cccattcgaacgtctg

SEQ ID NO: 35121 - DNA, 17 bp, Homo sapiens
cccattcgaacgtctgc

SEQ ID NO: 35122 - DNA, 18 bp, Homo sapiens
cccattcgaacgtctgcc

SEQ ID NO: 35123 - DNA, 17 bp, Homo sapiens
ccattcgaacgtctgcc

SEQ ID NO: 35124 - DNA, 18 bp, Homo sapiens
ccattcgaacgtctgccc

SEQ ID NO: 35125 - DNA, 22 bp, Homo sapiens
ccattcgaacgtctgccctatc

SEQ ID NO: 35126 - DNA, 16 bp, Homo sapiens
cattcgaacgtctgcc

SEQ ID NO: 35127 - DNA, 17 bp, Homo sapiens
cattcgaacgtctgccc

SEQ ID NO: 35128 - DNA, 18 bp, Homo sapiens
cattcgaacgtctgccct

SEQ ID NO: 35129 - DNA, 21 bp, Homo sapiens
cattcgaacgtctgccctatc

SEQ ID NO: 35130 - DNA, 22 bp, Homo sapiens
cattcgaacgtctgccctatca

SEQ ID NO: 35131 - DNA, 17 bp, Homo sapiens
attcgaacgtctgccct

SEQ ID NO: 35132 - DNA, 20 bp, Homo sapiens
attcgaacgtctgccctatc

SEQ ID NO: 35133 - DNA, 19 bp, Homo sapiens
ttcgaacgtctgccctatc

SEQ ID NO: 35134 - DNA, 20 bp, Homo sapiens
ttcgaacgtctgccctatca

SEQ ID NO: 35135 - DNA, 22 bp, Homo sapiens
ttcgaacgtctgccctatcaac

SEQ ID NO: 35136 - DNA, 23 bp, Homo sapiens
ttcgaacgtctgccctatcaact

SEQ ID NO: 35137 - DNA, 18 bp, Homo sapiens
tcgaacgtctgccctatc

SEQ ID NO: 35138 - DNA, 19 bp, Homo sapiens
tcgaacgtctgccctatca

SEQ ID NO: 35139 - DNA, 21 bp, Homo sapiens
tcgaacgtctgccctatcaac

SEQ ID NO: 35140 - DNA, 22 bp, Homo sapiens
tcgaacgtctgccctatcaact

SEQ ID NO: 35141 - DNA, 23 bp, Homo sapiens
tcgaacgtctgccctatcaactt

SEQ ID NO: 35142 - DNA, 25 bp, Homo sapiens
tcgaacgtctgccctatcaactttc

SEQ ID NO: 35143 - DNA, 16 bp, Homo sapiens
cgaacgtctgccctat

SEQ ID NO: 35144 - DNA, 17 bp, Homo sapiens
cgaacgtctgccctatc

SEQ ID NO: 35145 - DNA, 18 bp, Homo sapiens
cgaacgtctgccctatca

SEQ ID NO: 35146 - DNA, 19 bp, Homo sapiens
cgaacgtctgccctatcaa

SEQ ID NO: 35147 - DNA, 20 bp, Homo sapiens
cgaacgtctgccctatcaac

SEQ ID NO: 35148 - DNA, 21 bp, Homo sapiens
cgaacgtctgccctatcaact

SEQ ID NO: 35149 - DNA, 22 bp, Homo sapiens
cgaacgtctgccctatcaactt

SEQ ID NO: 35150 - DNA, 23 bp, Homo sapiens
cgaacgtctgccctatcaacttt

SEQ ID NO: 35151 - DNA, 24 bp, Homo sapiens
cgaacgtctgccctatcaactttc

SEQ ID NO: 35152 - DNA, 16 bp, Homo sapiens
gaacgtctgccctatc

SEQ ID NO: 35153 - DNA, 17 bp, Homo sapiens
gaacgtctgccctatca

SEQ ID NO: 35154 - DNA, 19 bp, Homo sapiens
gaacgtctgccctatcaac

SEQ ID NO: 35155 - DNA, 20 bp, Homo sapiens
gaacgtctgccctatcaact

SEQ ID NO: 35156 - DNA, 21 bp, Homo sapiens
gaacgtctgccctatcaactt

SEQ ID NO: 35157 - DNA, 23 bp, Homo sapiens
gaacgtctgccctatcaactttc

SEQ ID NO: 35158 - DNA, 24 bp, Homo sapiens
gaacgtctgccctatcaactttcg

SEQ ID NO: 35159 - DNA, 19 bp, Homo sapiens
aacgtctgccctatcaact

SEQ ID NO: 35160 - DNA, 20 bp, Homo sapiens
aacgtctgccctatcaactt

SEQ ID NO: 35161 - DNA, 21 bp, Homo sapiens
aacgtctgccctatcaacttt

SEQ ID NO: 35162 - DNA, 21 bp, Homo sapiens
acgtctgccctatcaactttc

SEQ ID NO: 35163 - DNA, 17 bp, Homo sapiens
cgtctgccctatcaact

SEQ ID NO: 35164 - DNA, 18 bp, Homo sapiens
cgtctgccctatcaactt

SEQ ID NO: 35165 - DNA, 19 bp, Homo sapiens
cgtctgccctatcaacttt

SEQ ID NO: 35166 - DNA, 21 bp, Homo sapiens
cgtctgccctatcaactttcg

SEQ ID NO: 35167 - DNA, 22 bp, Homo sapiens
cgtctgccctatcaactttcga

SEQ ID NO: 35168 - DNA, 24 bp, Homo sapiens
cgtctgccctatcaactttcgatg

SEQ ID NO: 35169 - DNA, 16 bp, Homo sapiens
gtctgccctatcaact

SEQ ID NO: 35170 - DNA, 16 bp, Homo sapiens
ctgccctatcaacttt

SEQ ID NO: 35171 - DNA, 18 bp, Homo sapiens
ctgccctatcaactttcg

SEQ ID NO: 35172 - DNA, 19 bp, Homo sapiens
ctgccctatcaactttcga

SEQ ID NO: 35173 - DNA, 20 bp, Homo sapiens
ctgccctatcaactttcgat

SEQ ID NO: 35174 - DNA, 21 bp, Homo sapiens
ctgccctatcaactttcgatg

SEQ ID NO: 35175 - DNA, 23 bp, Homo sapiens
ctgccctatcaactttcgatggt

SEQ ID NO: 35176 - DNA, 22 bp, Homo sapiens
actttcgatggtagtcgccgtg

SEQ ID NO: 35177 - DNA, 20 bp, Homo sapiens
tttcgatggtagtcgccgtg

SEQ ID NO: 35178 - DNA, 21 bp, Homo sapiens
tttcgatggtagtcgccgtgc

SEQ ID NO: 35179 - DNA, 19 bp, Homo sapiens
ttcgatggtagtcgccgtg

SEQ ID NO: 35180 - DNA, 20 bp, Homo sapiens
cgatggtagtcgccgtgcct

SEQ ID NO: 35181 - DNA, 16 bp, Homo sapiens
gatggtagtcgccgtg

SEQ ID NO: 35182 - DNA, 30 bp, Homo sapiens; identical to SEQ ID NO: 13082

SEQ ID NO: 35183 - DNA, 20 bp, Homo sapiens
tagtcgccgtgcctaccatg

SEQ ID NO: 35184 - DNA, 19 bp, Homo sapiens
agtcgccgtgcctaccatg

SEQ ID NO: 35185 - DNA, 20 bp, Homo sapiens
ccgtgcctaccatggtgacc

SEQ ID NO: 35186 - DNA, 23 bp, Homo sapiens
ccgtgcctaccatggtgaccacg

SEQ ID NO: 35187 - DNA, 24 bp, Homo sapiens
ccgtgcctaccatggtgaccacgg

SEQ ID NO: 35188 - DNA, 19 bp, Homo sapiens
cgtgcctaccatggtgacc

SEQ ID NO: 35189 - DNA, 20 bp, Homo sapiens
cgtgcctaccatggtgacca

SEQ ID NO: 35190 - DNA, 21 bp, Homo sapiens
cgtgcctaccatggtgaccac

SEQ ID NO: 35191 - DNA, 22 bp, Homo sapiens
cgtgcctaccatggtgaccacg

SEQ ID NO: 35192 - DNA, 23 bp, Homo sapiens
cgtgcctaccatggtgaccacgg

SEQ ID NO: 35193 - DNA, 24 bp, Homo sapiens
cgtgcctaccatggtgaccacggg

SEQ ID NO: 35194 - DNA, 21 bp, Homo sapiens
gtgcctaccatggtgaccacg

SEQ ID NO: 35195 - DNA, 20 bp, Homo sapiens
tgcctaccatggtgaccacg

SEQ ID NO: 35196 - DNA, 19 bp, Homo sapiens
gcctaccatggtgaccacg

SEQ ID NO: 35197 - DNA, 20 bp, Homo sapiens
gcctaccatggtgaccacgg

SEQ ID NO: 35198 - DNA, 18 bp, Homo sapiens
cctaccatggtgaccacg

SEQ ID NO: 35199 - DNA, 19 bp, Homo sapiens
cctaccatggtgaccacgg

SEQ ID NO: 35200 - DNA, 20 bp, Homo sapiens
cctaccatggtgaccacggg

SEQ ID NO: 35201 - DNA, 17 bp, Homo sapiens
ctaccatggtgaccacg

SEQ ID NO: 35202 - DNA, 18 bp, Homo sapiens
ctaccatggtgaccacgg

SEQ ID NO: 35203 - DNA, 19 bp, Homo sapiens
ctaccatggtgaccacggg

SEQ ID NO: 35204 - DNA, 24 bp, Homo sapiens
ctaccatggtgaccacgggtgacg

SEQ ID NO: 35205 - DNA, 25 bp, Homo sapiens
ctaccatggtgaccacgggtgacgg

SEQ ID NO: 35206 - DNA, 27 bp, Homo sapiens
ctaccatggtgaccacgggtgacgggg

SEQ ID NO: 35207 - DNA, 28 bp, Homo sapiens
ctaccatggtgaccacgggtgacgggga

SEQ ID NO: 35208 - DNA, 16 bp, Homo sapiens
taccatggtgaccacg

SEQ ID NO: 35209 - DNA, 17 bp, Homo sapiens
taccatggtgaccacgg

SEQ ID NO: 35210 - DNA, 18 bp, Homo sapiens
taccatggtgaccacggg

SEQ ID NO: 35211 - DNA, 23 bp, Homo sapiens
taccatggtgaccacgggtgacg

SEQ ID NO: 35212 - DNA, 24 bp, Homo sapiens
taccatggtgaccacgggtgacgg

SEQ ID NO: 35213 - DNA, 25 bp, Homo sapiens
taccatggtgaccacgggtgacggg

SEQ ID NO: 35214 - DNA, 26 bp, Homo sapiens
taccatggtgaccacgggtgacgggg

SEQ ID NO: 35215 - DNA, 27 bp, Homo sapiens
taccatggtgaccacgggtgacgggga

SEQ ID NO: 35216 - DNA, 16 bp, Homo sapiens
accatggtgaccacgg

SEQ ID NO: 35217 - DNA, 17 bp, Homo sapiens
accatggtgaccacggg

SEQ ID NO: 35218 - DNA, 22 bp, Homo sapiens
accatggtgaccacgggtgacg

SEQ ID NO: 35219 - DNA, 23 bp, Homo sapiens
accatggtgaccacgggtgacgg

SEQ ID NO: 35220 - DNA, 25 bp, Homo sapiens
accatggtgaccacgggtgacgggg

SEQ ID NO: 35221 - DNA, 27 bp, Homo sapiens
accatggtgaccacgggtgacggggaa

SEQ ID NO: 35222 - DNA, 21 bp, Homo sapiens
ccatggtgaccacgggtgacg

SEQ ID NO: 35223 - DNA, 22 bp, Homo sapiens
ccatggtgaccacgggtgacgg

SEQ ID NO: 35224 - DNA, 23 bp, Homo sapiens
ccatggtgaccacgggtgacggg

SEQ ID NO: 35225 - DNA, 24 bp, Homo sapiens
ccatggtgaccacgggtgacgggg

SEQ ID NO: 35226 - DNA, 25 bp, Homo sapiens
ccatggtgaccacgggtgacgggga

SEQ ID NO: 35227 - DNA, 26 bp, Homo sapiens
ccatggtgaccacgggtgacggggaa

SEQ ID NO: 35228 - DNA, 19 bp, Homo sapiens
catggtgaccacgggtgac

SEQ ID NO: 35229 - DNA, 20 bp, Homo sapiens
catggtgaccacgggtgacg

SEQ ID NO: 35230 - DNA, 21 bp, Homo sapiens
catggtgaccacgggtgacgg

SEQ ID NO: 35231 - DNA, 22 bp, Homo sapiens
catggtgaccacgggtgacggg

SEQ ID NO: 35232 - DNA, 23 bp, Homo sapiens
catggtgaccacgggtgacgggg

SEQ ID NO: 35233 - DNA, 24 bp, Homo sapiens
catggtgaccacgggtgacgggga

SEQ ID NO: 35234 - DNA, 16 bp, Homo sapiens
atggtgaccacgggtg

SEQ ID NO: 35235 - DNA, 19 bp, Homo sapiens
atggtgaccacgggtgacg

SEQ ID NO: 35236 - DNA, 20 bp, Homo sapiens
atggtgaccacgggtgacgg

SEQ ID NO: 35237 - DNA, 21 bp, Homo sapiens
atggtgaccacgggtgacggg

SEQ ID NO: 35238 - DNA, 22 bp, Homo sapiens
atggtgaccacgggtgacgggg

SEQ ID NO: 35239 - DNA, 23 bp, Homo sapiens
atggtgaccacgggtgacgggga

SEQ ID NO: 35240 - DNA, 24 bp, Homo sapiens
atggtgaccacgggtgacggggaa

SEQ ID NO: 35241 - DNA, 25 bp, Homo sapiens
atggtgaccacgggtgacggggaat

SEQ ID NO: 35242 - DNA, 19 bp, Homo sapiens
gaccacgggtgacggggaa

SEQ ID NO: 35243 - DNA, 20 bp, Homo sapiens
gaccacgggtgacggggaat

SEQ ID NO: 35244 - DNA, 22 bp, Homo sapiens
accacgggtgacggggaatcag

SEQ ID NO: 35245 - DNA, 23 bp, Homo sapiens
accacgggtgacggggaatcagg

SEQ ID NO: 35246 - DNA, 24 bp, Homo sapiens
accacgggtgacggggaatcaggg

SEQ ID NO: 35247 - DNA, 21 bp, Homo sapiens
ccacgggtgacggggaatcag

SEQ ID NO: 35248 - DNA, 22 bp, Homo sapiens
ccacgggtgacggggaatcagg

SEQ ID NO: 35249 - DNA, 16 bp, Homo sapiens
acgggtgacggggaat

SEQ ID NO: 35250 - DNA, 23 bp, Homo sapiens
acgggtgacggggaatcagggtt

SEQ ID NO: 35251 - DNA, 24 bp, Homo sapiens
gacggggaatcagggttcgattcc

SEQ ID NO: 35252 - DNA, 19 bp, Homo sapiens
aatcagggttcgattccgg

SEQ ID NO: 35253 - DNA, 18 bp, Homo sapiens
atcagggttcgattccgg

SEQ ID NO: 35254 - DNA, 20 bp, Homo sapiens
atcagggttcgattccggag

SEQ ID NO: 35255 - DNA, 21 bp, Homo sapiens
cagggttcgattccggagagg

SEQ ID NO: 35256 - DNA, 20 bp, Homo sapiens
agggttcgattccggagagg

SEQ ID NO: 35257 - DNA, 21 bp, Homo sapiens
agggttcgattccggagaggg

SEQ ID NO: 35258 - DNA, 22 bp, Homo sapiens
agggttcgattccggagaggga

SEQ ID NO: 35259 - DNA, 26 bp, Homo sapiens
ggttcgattccggagagggagcctga

SEQ ID NO: 35260 - DNA, 27 bp, Homo sapiens
ggttcgattccggagagggagcctgag

SEQ ID NO: 35261 - DNA, 28 bp, Homo sapiens
ggttcgattccggagagggagcctgaga

SEQ ID NO: 35262 - DNA, 17 bp, Homo sapiens
gttcgattccggagagg

SEQ ID NO: 35263 - DNA, 18 bp, Homo sapiens
gttcgattccggagaggg

SEQ ID NO: 35264 - DNA, 19 bp, Homo sapiens
gttcgattccggagaggga

SEQ ID NO: 35265 - DNA, 20 bp, Homo sapiens
gttcgattccggagagggag

SEQ ID NO: 35266 - DNA, 21 bp, Homo sapiens
gttcgattccggagagggagc

SEQ ID NO: 35267 - DNA, 22 bp, Homo sapiens
gttcgattccggagagggagcc

SEQ ID NO: 35268 - DNA, 24 bp, Homo sapiens
gttcgattccggagagggagcctg

SEQ ID NO: 35269 - DNA, 25 bp, Homo sapiens
gttcgattccggagagggagcctga

SEQ ID NO: 35270 - DNA, 26 bp, Homo sapiens
gttcgattccggagagggagcctgag

SEQ ID NO: 35271 - DNA, 27 bp, Homo sapiens
gttcgattccggagagggagcctgaga

SEQ ID NO: 35272 - DNA, 23 bp, Homo sapiens
ttcgattccggagagggagcctg

SEQ ID NO: 35273 - DNA, 24 bp, Homo sapiens
ttcgattccggagagggagcctga

SEQ ID NO: 35274 - DNA, 25 bp, Homo sapiens
ttcgattccggagagggagcctgag

SEQ ID NO: 35275 - DNA, 26 bp, Homo sapiens
ttcgattccggagagggagcctgaga

SEQ ID NO: 35276 - DNA, 22 bp, Homo sapiens
tcgattccggagagggagcctg

SEQ ID NO: 35277 - DNA, 23 bp, Homo sapiens
tcgattccggagagggagcctga

SEQ ID NO: 35278 - DNA, 24 bp, Homo sapiens
tcgattccggagagggagcctgag

SEQ ID NO: 35279 - DNA, 25 bp, Homo sapiens
tcgattccggagagggagcctgaga

SEQ ID NO: 35280 - DNA, 21 bp, Homo sapiens
cgattccggagagggagcctg

SEQ ID NO: 35281 - DNA, 22 bp, Homo sapiens
cgattccggagagggagcctga

SEQ ID NO: 35282 - DNA, 23 bp, Homo sapiens
cgattccggagagggagcctgag

SEQ ID NO: 35283 - DNA, 24 bp, Homo sapiens
cgattccggagagggagcctgaga

SEQ ID NO: 35284 - DNA, 25 bp, Homo sapiens
cgattccggagagggagcctgagaa

SEQ ID NO: 35285 - DNA, 20 bp, Homo sapiens
gattccggagagggagcctg

SEQ ID NO: 35286 - DNA, 21 bp, Homo sapiens
gattccggagagggagcctga

SEQ ID NO: 35287 - DNA, 22 bp, Homo sapiens
gattccggagagggagcctgag

SEQ ID NO: 35288 - DNA, 23 bp, Homo sapiens
gattccggagagggagcctgaga

SEQ ID NO: 35289 - DNA, 24 bp, Homo sapiens
gattccggagagggagcctgagaa

SEQ ID NO: 35290 - DNA, 26 bp, Homo sapiens
gattccggagagggagcctgagaaac

SEQ ID NO: 35291 - DNA, 27 bp, Homo sapiens
gattccggagagggagcctgagaaacg

SEQ ID NO: 35292 - DNA, 30 bp, Homo sapiens; identical to SEQ ID NO: 2272

SEQ ID NO: 35293 - DNA, 19 bp, Homo sapiens
attccggagagggagcctg

SEQ ID NO: 35294 - DNA, 20 bp, Homo sapiens
attccggagagggagcctga

SEQ ID NO: 35295 - DNA, 21 bp, Homo sapiens
attccggagagggagcctgag

SEQ ID NO: 35296 - DNA, 22 bp, Homo sapiens
attccggagagggagcctgaga

SEQ ID NO: 35297 - DNA, 23 bp, Homo sapiens
attccggagagggagcctgagaa

SEQ ID NO: 35298 - DNA, 24 bp, Homo sapiens
attccggagagggagcctgagaaa

SEQ ID NO: 35299 - DNA, 25 bp, Homo sapiens
attccggagagggagcctgagaaac

SEQ ID NO: 35300 - DNA, 26 bp, Homo sapiens
attccggagagggagcctgagaaacg

SEQ ID NO: 35301 - DNA, 27 bp, Homo sapiens
attccggagagggagcctgagaaacgg

SEQ ID NO: 35302 - DNA, 28 bp, Homo sapiens
attccggagagggagcctgagaaacggc

SEQ ID NO: 35303 - DNA, 29 bp, Homo sapiens
attccggagagggagcctgagaaacggct

SEQ ID NO: 35304 - DNA, 19 bp, Homo sapiens
ttccggagagggagcctga

SEQ ID NO: 35305 - DNA, 20 bp, Homo sapiens
ttccggagagggagcctgag

SEQ ID NO: 35306 - DNA, 21 bp, Homo sapiens
ttccggagagggagcctgaga

SEQ ID NO: 35307 - DNA, 22 bp, Homo sapiens
ttccggagagggagcctgagaa

SEQ ID NO: 35308 - DNA, 23 bp, Homo sapiens
ttccggagagggagcctgagaaa

SEQ ID NO: 35309 - DNA, 24 bp, Homo sapiens
ttccggagagggagcctgagaaac

SEQ ID NO: 35310 - DNA, 25 bp, Homo sapiens
ttccggagagggagcctgagaaacg

SEQ ID NO: 35311 - DNA, 18 bp, Homo sapiens
tccggagagggagcctga

SEQ ID NO: 35312 - DNA, 19 bp, Homo sapiens
tccggagagggagcctgag

SEQ ID NO: 35313 - DNA, 20 bp, Homo sapiens
tccggagagggagcctgaga

SEQ ID NO: 35314 - DNA, 24 bp, Homo sapiens
tccggagagggagcctgagaaacg

SEQ ID NO: 35315 - DNA, 17 bp, Homo sapiens
ccggagagggagcctga

SEQ ID NO: 35316 - DNA, 18 bp, Homo sapiens
ccggagagggagcctgag

SEQ ID NO: 35317 - DNA, 19 bp, Homo sapiens
ccggagagggagcctgaga

SEQ ID NO: 35318 - DNA, 16 bp, Homo sapiens
cggagagggagcctga

SEQ ID NO: 35319 - DNA, 17 bp, Homo sapiens
cggagagggagcctgag

SEQ ID NO: 35320 - DNA, 18 bp, Homo sapiens
cggagagggagcctgaga

SEQ ID NO: 35321 - DNA, 25 bp, Homo sapiens
cggagagggagcctgagaaacggct

SEQ ID NO: 35322 - DNA, 21 bp, Homo sapiens
ggagagggagcctgagaaacg

SEQ ID NO: 35323 - DNA, 22 bp, Homo sapiens
ggagagggagcctgagaaacgg

SEQ ID NO: 35324 - DNA, 23 bp, Homo sapiens
ggagagggagcctgagaaacggc

SEQ ID NO: 35325 - DNA, 24 bp, Homo sapiens
ggagagggagcctgagaaacggct

SEQ ID NO: 35326 - DNA, 16 bp, Homo sapiens
gagagggagcctgaga

SEQ ID NO: 35327 - DNA, 20 bp, Homo sapiens
gagagggagcctgagaaacg

SEQ ID NO: 35328 - DNA, 21 bp, Homo sapiens
gagagggagcctgagaaacgg

SEQ ID NO: 35329 - DNA, 23 bp, Homo sapiens
gagagggagcctgagaaacggct

SEQ ID NO: 35330 - DNA, 19 bp, Homo sapiens
agagggagcctgagaaacg

SEQ ID NO: 35331 - DNA, 18 bp, Homo sapiens
gagggagcctgagaaacg

SEQ ID NO: 35332 - DNA, 16 bp, Homo sapiens
agggagcctgagaaac

SEQ ID NO: 35333 - DNA, 17 bp, Homo sapiens
agggagcctgagaaacg

SEQ ID NO: 35334 - DNA, 18 bp, Homo sapiens
agggagcctgagaaacgg

SEQ ID NO: 35335 - DNA, 19 bp, Homo sapiens
agggagcctgagaaacggc

SEQ ID NO: 35336 - DNA, 20 bp, Homo sapiens
agggagcctgagaaacggct

SEQ ID NO: 35337 - DNA, 21 bp, Homo sapiens
agggagcctgagaaacggcta

SEQ ID NO: 35338 - DNA, 23 bp, Homo sapiens
agggagcctgagaaacggctacc

SEQ ID NO: 35339 - DNA, 16 bp, Homo sapiens
gggagcctgagaaacg

SEQ ID NO: 35340 - DNA, 17 bp, Homo sapiens
gggagcctgagaaacgg

SEQ ID NO: 35341 - DNA, 18 bp, Homo sapiens
gggagcctgagaaacggc

SEQ ID NO: 35342 - DNA, 19 bp, Homo sapiens
gggagcctgagaaacggct

SEQ ID NO: 35343 - DNA, 21 bp, Homo sapiens
gggagcctgagaaacggctac

SEQ ID NO: 35344 - DNA, 22 bp, Homo sapiens
gggagcctgagaaacggctacc

SEQ ID NO: 35345 - DNA, 29 bp, Homo sapiens
gcctgagaaacggctaccacatccaagga

SEQ ID NO: 35346 - DNA, 30 bp, Homo sapiens
gcctgagaaacggctaccacatccaaggaa

SEQ ID NO: 35347 - DNA, 18 bp, Homo sapiens
cggctaccacatccaagg

SEQ ID NO: 35348 - DNA, 21 bp, Homo sapiens
cggctaccacatccaaggaag

SEQ ID NO: 35349 - DNA, 25 bp, Homo sapiens
cggctaccacatccaaggaaggcag

SEQ ID NO: 35350 - DNA, 17 bp, Homo sapiens
ggctaccacatccaagg

SEQ ID NO: 35351 - DNA, 20 bp, Homo sapiens
ggctaccacatccaaggaag

SEQ ID NO: 35352 - DNA, 22 bp, Homo sapiens
ggctaccacatccaaggaaggc

SEQ ID NO: 35353 - DNA, 24 bp, Homo sapiens
ggctaccacatccaaggaaggcag

SEQ ID NO: 35354 - DNA, 16 bp, Homo sapiens
gctaccacatccaagg

SEQ ID NO: 35355 - DNA, 18 bp, Homo sapiens
gctaccacatccaaggaa

SEQ ID NO: 35356 - DNA, 19 bp, Homo sapiens
gctaccacatccaaggaag

SEQ ID NO: 35357 - DNA, 20 bp, Homo sapiens
gctaccacatccaaggaagg

SEQ ID NO: 35358 - DNA, 21 bp, Homo sapiens
gctaccacatccaaggaaggc

SEQ ID NO: 35359 - DNA, 22 bp, Homo sapiens
gctaccacatccaaggaaggca

SEQ ID NO: 35360 - DNA, 23 bp, Homo sapiens
gctaccacatccaaggaaggcag

SEQ ID NO: 35361 - DNA, 17 bp, Homo sapiens
ctaccacatccaaggaa

SEQ ID NO: 35362 - DNA, 18 bp, Homo sapiens
ctaccacatccaaggaag

SEQ ID NO: 35363 - DNA, 19 bp, Homo sapiens
ctaccacatccaaggaagg

SEQ ID NO: 35364 - DNA, 20 bp, Homo sapiens
ctaccacatccaaggaaggc

SEQ ID NO: 35365 - DNA, 21 bp, Homo sapiens
ctaccacatccaaggaaggca

SEQ ID NO: 35366 - DNA, 22 bp, Homo sapiens
ctaccacatccaaggaaggcag

SEQ ID NO: 35367 - DNA, 19 bp, Homo sapiens
taccacatccaaggaaggc

SEQ ID NO: 35368 - DNA, 20 bp, Homo sapiens
taccacatccaaggaaggca

SEQ ID NO: 35369 - DNA, 21 bp, Homo sapiens
taccacatccaaggaaggcag

SEQ ID NO: 35370 - DNA, 18 bp, Homo sapiens
accacatccaaggaaggc

SEQ ID NO: 35371 - DNA, 19 bp, Homo sapiens
accacatccaaggaaggca

SEQ ID NO: 35372 - DNA, 20 bp, Homo sapiens
accacatccaaggaaggcag

SEQ ID NO: 35373 - DNA, 19 bp, Homo sapiens
ccacatccaaggaaggcag

SEQ ID NO: 35374 - DNA, 26 bp, Homo sapiens
cacatccaaggaaggcagcaggcgcg

SEQ ID NO: 35375 - DNA, 24 bp, Homo sapiens
acatccaaggaaggcagcaggcgc

SEQ ID NO: 35376 - DNA, 25 bp, Homo sapiens
acatccaaggaaggcagcaggcgcg

SEQ ID NO: 35377 - DNA, 26 bp, Homo sapiens
acatccaaggaaggcagcaggcgcgc

SEQ ID NO: 35378 - DNA, 21 bp, Homo sapiens
catccaaggaaggcagcaggc

SEQ ID NO: 35379 - DNA, 24 bp, Homo sapiens
catccaaggaaggcagcaggcgcg

SEQ ID NO: 35380 - DNA, 23 bp, Homo sapiens
tccaaggaaggcagcaggcgcgc

SEQ ID NO: 35381 - DNA, 22 bp, Homo sapiens
ccaaggaaggcagcaggcgcgc

SEQ ID NO: 35382 - DNA, 19 bp, Homo sapiens
aaggaaggcagcaggcgcg

SEQ ID NO: 35383 - DNA, 20 bp, Homo sapiens
aaggaaggcagcaggcgcgc

SEQ ID NO: 35384 - DNA, 18 bp, Homo sapiens
ggaaggcagcaggcgcgc

SEQ ID NO: 35385 - DNA, 20 bp, Homo sapiens
aaggcagcaggcgcgcaaat

SEQ ID NO: 35386 - DNA, 18 bp, Homo sapiens
ggcgcgcaaattacccac

SEQ ID NO: 35387 - DNA, 19 bp, Homo sapiens
ggcgcgcaaattacccact

SEQ ID NO: 35388 - DNA, 24 bp, Homo sapiens
ggcgcgcaaattacccactcccga

SEQ ID NO: 35389 - DNA, 26 bp, Homo sapiens
ggcgcgcaaattacccactcccgacc

SEQ ID NO: 35390 - DNA, 21 bp, Homo sapiens
cgcgcaaattacccactcccg

SEQ ID NO: 35391 - DNA, 19 bp, Homo sapiens
cgcaaattacccactcccg

SEQ ID NO: 35392 - DNA, 20 bp, Homo sapiens
caaattacccactcccgacc

SEQ ID NO: 35393 - DNA, 22 bp, Homo sapiens
caaattacccactcccgacccg

SEQ ID NO: 35394 - DNA, 23 bp, Homo sapiens
caaattacccactcccgacccgg

SEQ ID NO: 35395 - DNA, 19 bp, Homo sapiens
attacccactcccgacccg

SEQ ID NO: 35396 - DNA, 20 bp, Homo sapiens
attacccactcccgacccgg

SEQ ID NO: 35397 - DNA, 19 bp, Homo sapiens
ttacccactcccgacccgg

SEQ ID NO: 35398 - DNA, 22 bp, Homo sapiens
cctccccgggtcgggagtgggt

SEQ ID NO: 35399 - DNA, 22 bp, Homo sapiens
acccactcccgacccggggagg

SEQ ID NO: 35400 - DNA, 19 bp, Homo sapiens
cccactcccgacccgggga

SEQ ID NO: 35401 - DNA, 18 bp, Homo sapiens
actcccgacccggggagg

SEQ ID NO: 35402 - DNA, 19 bp, Homo sapiens
actcccgacccggggaggt

SEQ ID NO: 35403 - DNA, 21 bp, Homo sapiens
actcccgacccggggaggtag

SEQ ID NO: 35404 - DNA, 20 bp, Homo sapiens
ctcccgacccggggaggtag

SEQ ID NO: 35405 - DNA, 17 bp, Homo sapiens
tcccgacccggggaggt

SEQ ID NO: 35406 - DNA, 19 bp, Homo sapiens
tcccgacccggggaggtag

SEQ ID NO: 35407 - DNA, 18 bp, Homo sapiens
cccgacccggggaggtag

SEQ ID NO: 35408 - DNA, 19 bp, Homo sapiens
cccgacccggggaggtagt

SEQ ID NO: 35409 - DNA, 20 bp, Homo sapiens
cccgacccggggaggtagtg

SEQ ID NO: 35410 - DNA, 23 bp, Homo sapiens
cccgacccggggaggtagtgacg

SEQ ID NO: 35411 - DNA, 24 bp, Homo sapiens
cccgacccggggaggtagtgacga

SEQ ID NO: 35412 - DNA, 17 bp, Homo sapiens
ccgacccggggaggtag

SEQ ID NO: 35413 - DNA, 18 bp, Homo sapiens
ccgacccggggaggtagt

SEQ ID NO: 35414 - DNA, 22 bp, Homo sapiens
ccgacccggggaggtagtgacg

SEQ ID NO: 35415 - DNA, 23 bp, Homo sapiens
ccgacccggggaggtagtgacga

SEQ ID NO: 35416 - DNA, 16 bp, Homo sapiens
cgacccggggaggtag

SEQ ID NO: 35417 - DNA, 17 bp, Homo sapiens
cgacccggggaggtagt

SEQ ID NO: 35418 - DNA, 21 bp, Homo sapiens
cgacccggggaggtagtgacg

SEQ ID NO: 35419 - DNA, 22 bp, Homo sapiens
cgacccggggaggtagtgacga

SEQ ID NO: 35420 - DNA, 20 bp, Homo sapiens
gacccggggaggtagtgacg

SEQ ID NO: 35421 - DNA, 21 bp, Homo sapiens
gacccggggaggtagtgacga

SEQ ID NO: 35422 - DNA, 16 bp, Homo sapiens
ggggaggtagtgacga

SEQ ID NO: 35423 - DNA, 17 bp, Homo sapiens
aggtagtgacgaaaaat

SEQ ID NO: 35424 - DNA, 18 bp, Homo sapiens
aggtagtgacgaaaaata

SEQ ID NO: 35425 - DNA, 19 bp, Homo sapiens
aggtagtgacgaaaaataa

SEQ ID NO: 35426 - DNA, 30 bp, Homo sapiens; identical to SEQ ID NO: 13336

SEQ ID NO: 35427 - DNA, 28 bp, Homo sapiens
gtgacgaaaaataacaatacaggactct

SEQ ID NO: 35428 - DNA, 16 bp, Homo sapiens
gacgaaaaataacaat

SEQ ID NO: 35429 - DNA, 21 bp, Homo sapiens
gacgaaaaataacaatacagg

SEQ ID NO: 35430 - DNA, 23 bp, Homo sapiens
gacgaaaaataacaatacaggac

SEQ ID NO: 35431 - DNA, 24 bp, Homo sapiens
gacgaaaaataacaatacaggact

SEQ ID NO: 35432 - DNA, 25 bp, Homo sapiens
gacgaaaaataacaatacaggactc

SEQ ID NO: 35433 - DNA, 26 bp, Homo sapiens
gacgaaaaataacaatacaggactct

SEQ ID NO: 35434 - DNA, 27 bp, Homo sapiens
gacgaaaaataacaatacaggactctt

SEQ ID NO: 35435 - DNA, 28 bp, Homo sapiens
gacgaaaaataacaatacaggactcttt

SEQ ID NO: 35436 - DNA, 25 bp, Homo sapiens
acgaaaaataacaatacaggactct

SEQ ID NO: 35437 - DNA, 27 bp, Homo sapiens
acgaaaaataacaatacaggactcttt

SEQ ID NO: 35438 - DNA, 24 bp, Homo sapiens
cgaaaaataacaatacaggactct

SEQ ID NO: 35439 - DNA, 25 bp, Homo sapiens
cgaaaaataacaatacaggactctt

SEQ ID NO: 35440 - DNA, 26 bp, Homo sapiens
cgaaaaataacaatacaggactcttt

SEQ ID NO: 35441 - DNA, 21 bp, Homo sapiens
aaaaataacaatacaggactc

SEQ ID NO: 35442 - DNA, 22 bp, Homo sapiens
aaaaataacaatacaggactct

SEQ ID NO: 35443 - DNA, 23 bp, Homo sapiens
aaaaataacaatacaggactctt

SEQ ID NO: 35444 - DNA, 24 bp, Homo sapiens
aaaaataacaatacaggactcttt

SEQ ID NO: 35445 - DNA, 27 bp, Homo sapiens
aaaaataacaatacaggactctttcga

SEQ ID NO: 35446 - DNA, 21 bp, Homo sapiens
aaaataacaatacaggactct

SEQ ID NO: 35447 - DNA, 22 bp, Homo sapiens
aaaataacaatacaggactctt

SEQ ID NO: 35448 - DNA, 23 bp, Homo sapiens
aaaataacaatacaggactcttt

SEQ ID NO: 35449 - DNA, 20 bp, Homo sapiens
aaataacaatacaggactct

SEQ ID NO: 35450 - DNA, 21 bp, Homo sapiens
aaataacaatacaggactctt

SEQ ID NO: 35451 - DNA, 22 bp, Homo sapiens
aaataacaatacaggactcttt

SEQ ID NO: 35452 - DNA, 24 bp, Homo sapiens
aaataacaatacaggactctttcg

SEQ ID NO: 35453 - DNA, 25 bp, Homo sapiens
aaataacaatacaggactctttcga

SEQ ID NO: 35454 - DNA, 19 bp, Homo sapiens
aataacaatacaggactct

SEQ ID NO: 35455 - DNA, 20 bp, Homo sapiens
aataacaatacaggactctt

SEQ ID NO: 35456 - DNA, 21 bp, Homo sapiens
aataacaatacaggactcttt

SEQ ID NO: 35457 - DNA, 22 bp, Homo sapiens
aataacaatacaggactctttc

SEQ ID NO: 35458 - DNA, 23 bp, Homo sapiens
aataacaatacaggactctttcg

SEQ ID NO: 35459 - DNA, 24 bp, Homo sapiens
aataacaatacaggactctttcga

SEQ ID NO: 35460 - DNA, 18 bp, Homo sapiens
ataacaatacaggactct

SEQ ID NO: 35461 - DNA, 19 bp, Homo sapiens
ataacaatacaggactctt

SEQ ID NO: 35462 - DNA, 20 bp, Homo sapiens
ataacaatacaggactcttt

SEQ ID NO: 35463 - DNA, 21 bp, Homo sapiens
ataacaatacaggactctttc

SEQ ID NO: 35464 - DNA, 22 bp, Homo sapiens
ataacaatacaggactctttcg

SEQ ID NO: 35465 - DNA, 23 bp, Homo sapiens
ataacaatacaggactctttcga

SEQ ID NO: 35466 - DNA, 17 bp, Homo sapiens
taacaatacaggactct

SEQ ID NO: 35467 - DNA, 18 bp, Homo sapiens
taacaatacaggactctt

SEQ ID NO: 35468 - DNA, 19 bp, Homo sapiens
taacaatacaggactcttt

SEQ ID NO: 35469 - DNA, 20 bp, Homo sapiens
taacaatacaggactctttc

SEQ ID NO: 35470 - DNA, 21 bp, Homo sapiens
taacaatacaggactctttcg

SEQ ID NO: 35471 - DNA, 22 bp, Homo sapiens
taacaatacaggactctttcga

SEQ ID NO: 35472 - DNA, 16 bp, Homo sapiens
aacaatacaggactct

SEQ ID NO: 35473 - DNA, 17 bp, Homo sapiens
aacaatacaggactctt

SEQ ID NO: 35474 - DNA, 18 bp, Homo sapiens
aacaatacaggactcttt

SEQ ID NO: 35475 - DNA, 19 bp, Homo sapiens
aacaatacaggactctttc

SEQ ID NO: 35476 - DNA, 20 bp, Homo sapiens
aacaatacaggactctttcg

SEQ ID NO: 35477 - DNA, 21 bp, Homo sapiens
aacaatacaggactctttcga

SEQ ID NO: 35478 - DNA, 24 bp, Homo sapiens
aacaatacaggactctttcgaggc

SEQ ID NO: 35479 - DNA, 16 bp, Homo sapiens
acaatacaggactctt

SEQ ID NO: 35480 - DNA, 17 bp, Homo sapiens
acaatacaggactcttt

SEQ ID NO: 35481 - DNA, 18 bp, Homo sapiens
acaatacaggactctttc

SEQ ID NO: 35482 - DNA, 19 bp, Homo sapiens
acaatacaggactctttcg

SEQ ID NO: 35483 - DNA, 20 bp, Homo sapiens
acaatacaggactctttcga

SEQ ID NO: 35484 - DNA, 23 bp, Homo sapiens
acaatacaggactctttcgaggc

SEQ ID NO: 35485 - DNA, 16 bp, Homo sapiens
caatacaggactcttt

SEQ ID NO: 35486 - DNA, 17 bp, Homo sapiens
caatacaggactctttc

SEQ ID NO: 35487 - DNA, 18 bp, Homo sapiens
caatacaggactctttcg

SEQ ID NO: 35488 - DNA, 19 bp, Homo sapiens
caatacaggactctttcga

SEQ ID NO: 35489 - DNA, 20 bp, Homo sapiens
caatacaggactctttcgag

SEQ ID NO: 35490 - DNA, 22 bp, Homo sapiens
caatacaggactctttcgaggc

SEQ ID NO: 35491 - DNA, 16 bp, Homo sapiens
aatacaggactctttc

SEQ ID NO: 35492 - DNA, 17 bp, Homo sapiens
aatacaggactctttcg

SEQ ID NO: 35493 - DNA, 18 bp, Homo sapiens
aatacaggactctttcga

SEQ ID NO: 35494 - DNA, 21 bp, Homo sapiens
aatacaggactctttcgaggc

SEQ ID NO: 35495 - DNA, 16 bp, Homo sapiens
atacaggactctttcg

SEQ ID NO: 35496 - DNA, 17 bp, Homo sapiens
atacaggactctttcga

SEQ ID NO: 35497 - DNA, 20 bp, Homo sapiens
atacaggactctttcgaggc

SEQ ID NO: 35498 - DNA, 16 bp, Homo sapiens
tacaggactctttcga

SEQ ID NO: 35499 - DNA, 18 bp, Homo sapiens
tacaggactctttcgagg

SEQ ID NO: 35500 - DNA, 19 bp, Homo sapiens
tacaggactctttcgaggc

SEQ ID NO: 35501 - DNA, 17 bp, Homo sapiens
acaggactctttcgagg

SEQ ID NO: 35502 - DNA, 18 bp, Homo sapiens
acaggactctttcgaggc

SEQ ID NO: 35503 - DNA, 17 bp, Homo sapiens
caggactctttcgaggc

SEQ ID NO: 35504 - DNA, 18 bp, Homo sapiens
caggactctttcgaggcc

SEQ ID NO: 35505 - DNA, 16 bp, Homo sapiens
aggactctttcgaggc

SEQ ID NO: 35506 - DNA, 19 bp, Homo sapiens
ggactctttcgaggccctg

SEQ ID NO: 35507 - DNA, 19 bp, Homo sapiens
gactctttcgaggccctgt

SEQ ID NO: 35508 - DNA, 17 bp, Homo sapiens
ctttcgaggccctgtaa

SEQ ID NO: 35509 - DNA, 18 bp, Homo sapiens
ctttcgaggccctgtaat

SEQ ID NO: 35510 - DNA, 19 bp, Homo sapiens
ctttcgaggccctgtaatt

SEQ ID NO: 35511 - DNA, 20 bp, Homo sapiens
ctttcgaggccctgtaattg

SEQ ID NO: 35512 - DNA, 17 bp, Homo sapiens
tttcgaggccctgtaat

SEQ ID NO: 35513 - DNA, 19 bp, Homo sapiens
tttcgaggccctgtaattg

SEQ ID NO: 35514 - DNA, 16 bp, Homo sapiens
cgaggccctgtaattg

SEQ ID NO: 35515 - DNA, 17 bp, Homo sapiens
cgaggccctgtaattgg

SEQ ID NO: 35516 - DNA, 18 bp, Homo sapiens
cgaggccctgtaattgga

SEQ ID NO: 35517 - DNA, 19 bp, Homo sapiens
cgaggccctgtaattggaa

SEQ ID NO: 35518 - DNA, 20 bp, Homo sapiens
cgaggccctgtaattggaat

SEQ ID NO: 35519 - DNA, 21 bp, Homo sapiens
cgaggccctgtaattggaatg

SEQ ID NO: 35520 - DNA, 23 bp, Homo sapiens
cgaggccctgtaattggaatgag

SEQ ID NO: 35521 - DNA, 21 bp, Homo sapiens
aggccctgtaattggaatgag

SEQ ID NO: 35522 - DNA, 23 bp, Homo sapiens
aggccctgtaattggaatgagtc

SEQ ID NO: 35523 - DNA, 22 bp, Homo sapiens
ggccctgtaattggaatgagtc

SEQ ID NO: 35524 - DNA, 21 bp, Homo sapiens
gccctgtaattggaatgagtc

SEQ ID NO: 35525 - DNA, 20 bp, Homo sapiens
ccctgtaattggaatgagtc

SEQ ID NO: 35526 - DNA, 18 bp, Homo sapiens
cctgtaattggaatgagt

SEQ ID NO: 35527 - DNA, 19 bp, Homo sapiens
cctgtaattggaatgagtc

SEQ ID NO: 35528 - DNA, 16 bp, Homo sapiens
ctgtaattggaatgag

SEQ ID NO: 35529 - DNA, 17 bp, Homo sapiens
ctgtaattggaatgagt

SEQ ID NO: 35530 - DNA, 18 bp, Homo sapiens
ctgtaattggaatgagtc

SEQ ID NO: 35531 - DNA, 19 bp, Homo sapiens
ctgtaattggaatgagtcc

SEQ ID NO: 35532 - DNA, 20 bp, Homo sapiens
ctgtaattggaatgagtcca

SEQ ID NO: 35533 - DNA, 21 bp, Homo sapiens
ctgtaattggaatgagtccac

SEQ ID NO: 35534 - DNA, 22 bp, Homo sapiens
ctgtaattggaatgagtccact

SEQ ID NO: 35535 - DNA, 26 bp, Homo sapiens
tgagtccactttaaatcctttaacga

SEQ ID NO: 35536 - DNA, 19 bp, Homo sapiens
gagtccactttaaatcctt

SEQ ID NO: 35537 - DNA, 20 bp, Homo sapiens
gagtccactttaaatccttt

SEQ ID NO: 35538 - DNA, 25 bp, Homo sapiens
agtccactttaaatcctttaacgag

SEQ ID NO: 35539 - DNA, 24 bp, Homo sapiens
aacgaggatccattggagggcaag

SEQ ID NO: 35540 - DNA, 25 bp, Homo sapiens
aacgaggatccattggagggcaagt

SEQ ID NO: 35541 - DNA, 22 bp, Homo sapiens
cgaggatccattggagggcaag

SEQ ID NO: 35542 - DNA, 26 bp, Homo sapiens
cgaggatccattggagggcaagtctg

SEQ ID NO: 35543 - DNA, 18 bp, Homo sapiens
gaggatccattggagggc

SEQ ID NO: 35544 - DNA, 21 bp, Homo sapiens
gaggatccattggagggcaag

SEQ ID NO: 35545 - DNA, 22 bp, Homo sapiens
gaggatccattggagggcaagt

SEQ ID NO: 35546 - DNA, 23 bp, Homo sapiens
gaggatccattggagggcaagtc

SEQ ID NO: 35547 - DNA, 17 bp, Homo sapiens
aggatccattggagggc

SEQ ID NO: 35548 - DNA, 18 bp, Homo sapiens
aggatccattggagggca

SEQ ID NO: 35549 - DNA, 20 bp, Homo sapiens
aggatccattggagggcaag

SEQ ID NO: 35550 - DNA, 21 bp, Homo sapiens
aggatccattggagggcaagt

SEQ ID NO: 35551 - DNA, 22 bp, Homo sapiens
aggatccattggagggcaagtc

SEQ ID NO: 35552 - DNA, 24 bp, Homo sapiens
aggatccattggagggcaagtctg

SEQ ID NO: 35553 - DNA, 19 bp, Homo sapiens
ggatccattggagggcaag

SEQ ID NO: 35554 - DNA, 20 bp, Homo sapiens
ggatccattggagggcaagt

SEQ ID NO: 35555 - DNA, 23 bp, Homo sapiens
ggatccattggagggcaagtctg

SEQ ID NO: 35556 - DNA, 18 bp, Homo sapiens
gatccattggagggcaag

SEQ ID NO: 35557 - DNA, 19 bp, Homo sapiens
gatccattggagggcaagt

SEQ ID NO: 35558 - DNA, 22 bp, Homo sapiens
gatccattggagggcaagtctg

SEQ ID NO: 35559 - DNA, 23 bp, Homo sapiens
gatccattggagggcaagtctgg

SEQ ID NO: 35560 - DNA, 30 bp, Homo sapiens
gatccattggagggcaagtctggtgccagc

SEQ ID NO: 35561 - DNA, 21 bp, Homo sapiens
atccattggagggcaagtctg

SEQ ID NO: 35562 - DNA, 22 bp, Homo sapiens
atccattggagggcaagtctgg

SEQ ID NO: 35563 - DNA, 19 bp, Homo sapiens
ccattggagggcaagtctg

SEQ ID NO: 35564 - DNA, 20 bp, Homo sapiens
ccattggagggcaagtctgg

SEQ ID NO: 35565 - DNA, 26 bp, Homo sapiens
ccattggagggcaagtctggtgccag

SEQ ID NO: 35566 - DNA, 22 bp, Homo sapiens
ggagggcaagtctggtgccagc

SEQ ID NO: 35567 - DNA, 18 bp, Homo sapiens
caagtctggtgccagcag

SEQ ID NO: 35568 - DNA, 24 bp, Homo sapiens
caagtctggtgccagcagccgcgg

SEQ ID NO: 35569 - DNA, 21 bp, Homo sapiens
aagtctggtgccagcagccgc

SEQ ID NO: 35570 - DNA, 22 bp, Homo sapiens
aagtctggtgccagcagccgcg

SEQ ID NO: 35571 - DNA, 25 bp, Homo sapiens
aagtctggtgccagcagccgcggta

SEQ ID NO: 35572 - DNA, 22 bp, Homo sapiens
agtctggtgccagcagccgcgg

SEQ ID NO: 35573 - DNA, 24 bp, Homo sapiens
agtctggtgccagcagccgcggta

SEQ ID NO: 35574 - DNA, 21 bp, Homo sapiens
gtctggtgccagcagccgcgg

SEQ ID NO: 35575 - DNA, 23 bp, Homo sapiens
gtctggtgccagcagccgcggta

SEQ ID NO: 35576 - DNA, 20 bp, Homo sapiens
tctggtgccagcagccgcgg

SEQ ID NO: 35577 - DNA, 22 bp, Homo sapiens
tctggtgccagcagccgcggta

SEQ ID NO: 35578 - DNA, 18 bp, Homo sapiens
ctggtgccagcagccgcg

SEQ ID NO: 35579 - DNA, 19 bp, Homo sapiens
ctggtgccagcagccgcgg

SEQ ID NO: 35580 - DNA, 21 bp, Homo sapiens
ctggtgccagcagccgcggta

SEQ ID NO: 35581 - DNA, 23 bp, Homo sapiens
ctggtgccagcagccgcggtaat

SEQ ID NO: 35582 - DNA, 24 bp, Homo sapiens
ctggtgccagcagccgcggtaatt

SEQ ID NO: 35583 - DNA, 18 bp, Homo sapiens
tggtgccagcagccgcgg

SEQ ID NO: 35584 - DNA, 20 bp, Homo sapiens
tggtgccagcagccgcggta

SEQ ID NO: 35585 - DNA, 17 bp, Homo sapiens
ggtgccagcagccgcgg

SEQ ID NO: 35586 - DNA, 24 bp, Homo sapiens
tgccagcagccgcggtaattccag

SEQ ID NO: 35587 - DNA, 23 bp, Homo sapiens
gccagcagccgcggtaattccag

SEQ ID NO: 35588 - DNA, 21 bp, Homo sapiens
ccagcagccgcggtaattcca

SEQ ID NO: 35589 - DNA, 22 bp, Homo sapiens
ccagcagccgcggtaattccag

SEQ ID NO: 35590 - DNA, 26 bp, Homo sapiens
ccagcagccgcggtaattccagctcc

SEQ ID NO: 35591 - DNA, 21 bp, Homo sapiens
gcagccgcggtaattccagct

SEQ ID NO: 35592 - DNA, 18 bp, Homo sapiens
cagccgcggtaattccag

SEQ ID NO: 35593 - DNA, 17 bp, Homo sapiens
gccgcggtaattccagc

SEQ ID NO: 35594 - DNA, 18 bp, Homo sapiens
gccgcggtaattccagct

SEQ ID NO: 35595 - DNA, 23 bp, Homo sapiens
gtaattccagctccaatagcgta

SEQ ID NO: 35596 - DNA, 19 bp, Homo sapiens
attccagctccaatagcgt

SEQ ID NO: 35597 - DNA, 20 bp, Homo sapiens
attccagctccaatagcgta

SEQ ID NO: 35598 - DNA, 22 bp, Homo sapiens
attccagctccaatagcgtata

SEQ ID NO: 35599 - DNA, 21 bp, Homo sapiens
ccagctccaatagcgtatatt

SEQ ID NO: 35600 - DNA, 17 bp, Homo sapiens
ctccaatagcgtatatt

SEQ ID NO: 35601 - DNA, 22 bp, Homo sapiens
ctccaatagcgtatattaaagt

SEQ ID NO: 35602 - DNA, 23 bp, Homo sapiens
ctccaatagcgtatattaaagtt

SEQ ID NO: 35603 - DNA, 20 bp, Homo sapiens
gcgtatattaaagttgctgc

SEQ ID NO: 35604 - DNA, 30 bp, Homo sapiens
gcgtatattaaagttgctgcagttaaaaag

SEQ ID NO: 35605 - DNA, 30 bp, Homo sapiens
gtatattaaagttgctgcagttaaaaagct

SEQ ID NO: 35606 - DNA, 19 bp, Homo sapiens
tatattaaagttgctgcag

SEQ ID NO: 35607 - DNA, 17 bp, Homo sapiens
tattaaagttgctgcag

SEQ ID NO: 35608 - DNA, 18 bp, Homo sapiens
tattaaagttgctgcagt

SEQ ID NO: 35609 - DNA, 19 bp, Homo sapiens
tattaaagttgctgcagtt

SEQ ID NO: 35610 - DNA, 30 bp, Homo sapiens
tattaaagttgctgcagttaaaaagctcgt

SEQ ID NO: 35611 - DNA, 20 bp, Homo sapiens
ttaaagttgctgcagttaaa

SEQ ID NO: 35612 - DNA, 21 bp, Homo sapiens
ttaaagttgctgcagttaaaa

SEQ ID NO: 35613 - DNA, 19 bp, Homo sapiens
aaagttgctgcagttaaaa

SEQ ID NO: 35614 - DNA, 18 bp, Homo sapiens
aagttgctgcagttaaaa

SEQ ID NO: 35615 - DNA, 29 bp, Homo sapiens
gttgctgcagttaaaaagctcgtagttgg

SEQ ID NO: 35616 - DNA, 28 bp, Homo sapiens
ttgctgcagttaaaaagctcgtagttgg

SEQ ID NO: 35617 - DNA, 27 bp, Homo sapiens
tgctgcagttaaaaagctcgtagttgg

SEQ ID NO: 35618 - DNA, 20 bp, Homo sapiens
gctgcagttaaaaagctcgt

SEQ ID NO: 35619 - DNA, 26 bp, Homo sapiens
gctgcagttaaaaagctcgtagttgg

SEQ ID NO: 35620 - DNA, 30 bp, Homo sapiens; identical to SEQ ID NO: 2429

SEQ ID NO: 35621 - DNA, 19 bp, Homo sapiens
ctgcagttaaaaagctcgt

SEQ ID NO: 35622 - DNA, 21 bp, Homo sapiens
ctgcagttaaaaagctcgtag

SEQ ID NO: 35623 - DNA, 28 bp, Homo sapiens
ctgcagttaaaaagctcgtagttggatc

SEQ ID NO: 35624 - DNA, 30 bp, Homo sapiens
ctgcagttaaaaagctcgtagttggatctt

SEQ ID NO: 35625 - DNA, 30 bp, Homo sapiens
tgcagttaaaaagctcgtagttggatcttg

SEQ ID NO: 35626 - DNA, 17 bp, Homo sapiens
gcagttaaaaagctcgt

SEQ ID NO: 35627 - DNA, 18 bp, Homo sapiens
gcagttaaaaagctcgta

SEQ ID NO: 35628 - DNA, 19 bp, Homo sapiens
gcagttaaaaagctcgtag

SEQ ID NO: 35629 - DNA, 20 bp, Homo sapiens
gcagttaaaaagctcgtagt

SEQ ID NO: 35630 - DNA, 21 bp, Homo sapiens
gcagttaaaaagctcgtagtt

SEQ ID NO: 35631 - DNA, 30 bp, Homo sapiens
gcagttaaaaagctcgtagttggatcttgg

SEQ ID NO: 35632 - DNA, 18 bp, Homo sapiens
cagttaaaaagctcgtag

SEQ ID NO: 35633 - DNA, 20 bp, Homo sapiens
cagttaaaaagctcgtagtt

SEQ ID NO: 35634 - DNA, 22 bp, Homo sapiens
cagttaaaaagctcgtagttgg

SEQ ID NO: 35635 - DNA, 30 bp, Homo sapiens
cagttaaaaagctcgtagttggatcttggg

SEQ ID NO: 35636 - DNA, 21 bp, Homo sapiens
agttaaaaagctcgtagttgg

SEQ ID NO: 35637 - DNA, 22 bp, Homo sapiens
agttaaaaagctcgtagttgga

SEQ ID NO: 35638 - DNA, 24 bp, Homo sapiens
agttaaaaagctcgtagttggatc

SEQ ID NO: 35639 - DNA, 29 bp, Homo sapiens
agttaaaaagctcgtagttggatcttggg

SEQ ID NO: 35640 - DNA, 16 bp, Homo sapiens
gttaaaaagctcgtag

SEQ ID NO: 35641 - DNA, 21 bp, Homo sapiens
gttaaaaagctcgtagttgga

SEQ ID NO: 35642 - DNA, 22 bp, Homo sapiens
gttaaaaagctcgtagttggat

SEQ ID NO: 35643 - DNA, 23 bp, Homo sapiens
gttaaaaagctcgtagttggatc

SEQ ID NO: 35644 - DNA, 27 bp, Homo sapiens
gttaaaaagctcgtagttggatcttgg

SEQ ID NO: 35645 - DNA, 28 bp, Homo sapiens
gttaaaaagctcgtagttggatcttggg

SEQ ID NO: 35646 - DNA, 29 bp, Homo sapiens
gttaaaaagctcgtagttggatcttggga

SEQ ID NO: 35647 - DNA, 30 bp, Homo sapiens
gttaaaaagctcgtagttggatcttgggag

SEQ ID NO: 35648 - DNA, 16 bp, Homo sapiens
ttaaaaagctcgtagt

SEQ ID NO: 35649 - DNA, 19 bp, Homo sapiens
ttaaaaagctcgtagttgg

SEQ ID NO: 35650 - DNA, 20 bp, Homo sapiens
ttaaaaagctcgtagttgga

SEQ ID NO: 35651 - DNA, 22 bp, Homo sapiens
ttaaaaagctcgtagttggatc

SEQ ID NO: 35652 - DNA, 26 bp, Homo sapiens
ttaaaaagctcgtagttggatcttgg

SEQ ID NO: 35653 - DNA, 27 bp, Homo sapiens
ttaaaaagctcgtagttggatcttggg

SEQ ID NO: 35654 - DNA, 28 bp, Homo sapiens
ttaaaaagctcgtagttggatcttggga

SEQ ID NO: 35655 - DNA, 30 bp, Homo sapiens
ttaaaaagctcgtagttggatcttgggagc

SEQ ID NO: 35656 - DNA, 18 bp, Homo sapiens
taaaaagctcgtagttgg

SEQ ID NO: 35657 - DNA, 19 bp, Homo sapiens
taaaaagctcgtagttgga

SEQ ID NO: 35658 - DNA, 21 bp, Homo sapiens
taaaaagctcgtagttggatc

SEQ ID NO: 35659 - DNA, 25 bp, Homo sapiens
taaaaagctcgtagttggatcttgg

SEQ ID NO: 35660 - DNA, 26 bp, Homo sapiens
taaaaagctcgtagttggatcttggg

SEQ ID NO: 35661 - DNA, 27 bp, Homo sapiens
taaaaagctcgtagttggatcttggga

SEQ ID NO: 35662 - DNA, 28 bp, Homo sapiens
taaaaagctcgtagttggatcttgggag

SEQ ID NO: 35663 - DNA, 29 bp, Homo sapiens
taaaaagctcgtagttggatcttgggagc

SEQ ID NO: 35664 - DNA, 30 bp, Homo sapiens
taaaaagctcgtagttggatcttgggagcg

SEQ ID NO: 35665 - DNA, 17 bp, Homo sapiens
aaaaagctcgtagttgg

SEQ ID NO: 35666 - DNA, 20 bp, Homo sapiens
aaaaagctcgtagttggatc

SEQ ID NO: 35667 - DNA, 25 bp, Homo sapiens
aaaaagctcgtagttggatcttggg

SEQ ID NO: 35668 - DNA, 26 bp, Homo sapiens
aaaaagctcgtagttggatcttggga

SEQ ID NO: 35669 - DNA, 27 bp, Homo sapiens
aaaaagctcgtagttggatcttgggag

SEQ ID NO: 35670 - DNA, 28 bp, Homo sapiens
aaaaagctcgtagttggatcttgggagc

SEQ ID NO: 35671 - DNA, 24 bp, Homo sapiens
aaaagctcgtagttggatcttggg

SEQ ID NO: 35672 - DNA, 25 bp, Homo sapiens
aaaagctcgtagttggatcttggga

SEQ ID NO: 35673 - DNA, 27 bp, Homo sapiens
aaaagctcgtagttggatcttgggagc

SEQ ID NO: 35674 - DNA, 18 bp, Homo sapiens
aaagctcgtagttggatc

SEQ ID NO: 35675 - DNA, 21 bp, Homo sapiens
aaagctcgtagttggatcttg

SEQ ID NO: 35676 - DNA, 22 bp, Homo sapiens
aaagctcgtagttggatcttgg

SEQ ID NO: 35677 - DNA, 23 bp, Homo sapiens
aaagctcgtagttggatcttggg

SEQ ID NO: 35678 - DNA, 24 bp, Homo sapiens
aaagctcgtagttggatcttggga

SEQ ID NO: 35679 - DNA, 25 bp, Homo sapiens
aaagctcgtagttggatcttgggag

SEQ ID NO: 35680 - DNA, 26 bp, Homo sapiens
aaagctcgtagttggatcttgggagc

SEQ ID NO: 35681 - DNA, 17 bp, Homo sapiens
aagctcgtagttggatc

SEQ ID NO: 35682 - DNA, 20 bp, Homo sapiens
aagctcgtagttggatcttg

SEQ ID NO: 35683 - DNA, 21 bp, Homo sapiens
aagctcgtagttggatcttgg

SEQ ID NO: 35684 - DNA, 22 bp, Homo sapiens
aagctcgtagttggatcttggg

SEQ ID NO: 35685 - DNA, 23 bp, Homo sapiens
aagctcgtagttggatcttggga

SEQ ID NO: 35686 - DNA, 24 bp, Homo sapiens
aagctcgtagttggatcttgggag

SEQ ID NO: 35687 - DNA, 25 bp, Homo sapiens
aagctcgtagttggatcttgggagc

SEQ ID NO: 35688 - DNA, 30 bp, Homo sapiens
aagctcgtagttggatcttgggagcgggcg

SEQ ID NO: 35689 - DNA, 19 bp, Homo sapiens
agctcgtagttggatcttg

SEQ ID NO: 35690 - DNA, 20 bp, Homo sapiens
agctcgtagttggatcttgg

SEQ ID NO: 35691 - DNA, 21 bp, Homo sapiens
agctcgtagttggatcttggg

SEQ ID NO: 35692 - DNA, 22 bp, Homo sapiens
agctcgtagttggatcttggga

SEQ ID NO: 35693 - DNA, 23 bp, Homo sapiens
agctcgtagttggatcttgggag

SEQ ID NO: 35694 - DNA, 24 bp, Homo sapiens
agctcgtagttggatcttgggagc

SEQ ID NO: 35695 - DNA, 25 bp, Homo sapiens
agctcgtagttggatcttgggagcg

SEQ ID NO: 35696 - DNA, 28 bp, Homo sapiens
agctcgtagttggatcttgggagcgggc

SEQ ID NO: 35697 - DNA, 29 bp, Homo sapiens
agctcgtagttggatcttgggagcgggcg

SEQ ID NO: 35698 - DNA, 30 bp, Homo sapiens
agctcgtagttggatcttgggagcgggcgg

SEQ ID NO: 35699 - DNA, 18 bp, Homo sapiens
gctcgtagttggatcttg

SEQ ID NO: 35700 - DNA, 19 bp, Homo sapiens
gctcgtagttggatcttgg

SEQ ID NO: 35701 - DNA, 20 bp, Homo sapiens
gctcgtagttggatcttggg

SEQ ID NO: 35702 - DNA, 21 bp, Homo sapiens
gctcgtagttggatcttggga

SEQ ID NO: 35703 - DNA, 22 bp, Homo sapiens
gctcgtagttggatcttgggag

SEQ ID NO: 35704 - DNA, 23 bp, Homo sapiens
gctcgtagttggatcttgggagc

SEQ ID NO: 35705 - DNA, 24 bp, Homo sapiens
gctcgtagttggatcttgggagcg

SEQ ID NO: 35706 - DNA, 25 bp, Homo sapiens
gctcgtagttggatcttgggagcgg

SEQ ID NO: 35707 - DNA, 26 bp, Homo sapiens
gctcgtagttggatcttgggagcggg

SEQ ID NO: 35708 - DNA, 27 bp, Homo sapiens
gctcgtagttggatcttgggagcgggc

SEQ ID NO: 35709 - DNA, 28 bp, Homo sapiens
gctcgtagttggatcttgggagcgggcg

SEQ ID NO: 35710 - DNA, 29 bp, Homo sapiens
gctcgtagttggatcttgggagcgggcgg

SEQ ID NO: 35711 - DNA, 30 bp, Homo sapiens
gctcgtagttggatcttgggagcgggcggg

SEQ ID NO: 35712 - DNA, 17 bp, Homo sapiens
ctcgtagttggatcttg

SEQ ID NO: 35713 - DNA, 18 bp, Homo sapiens
ctcgtagttggatcttgg

SEQ ID NO: 35714 - DNA, 19 bp, Homo sapiens
ctcgtagttggatcttggg

SEQ ID NO: 35715 - DNA, 20 bp, Homo sapiens
ctcgtagttggatcttggga

SEQ ID NO: 35716 - DNA, 21 bp, Homo sapiens
ctcgtagttggatcttgggag

SEQ ID NO: 35717 - DNA, 22 bp, Homo sapiens
ctcgtagttggatcttgggagc

SEQ ID NO: 35718 - DNA, 23 bp, Homo sapiens
ctcgtagttggatcttgggagcg

SEQ ID NO: 35719 - DNA, 24 bp, Homo sapiens
ctcgtagttggatcttgggagcgg

SEQ ID NO: 35720 - DNA, 25 bp, Homo sapiens
ctcgtagttggatcttgggagcggg

SEQ ID NO: 35721 - DNA, 26 bp, Homo sapiens
ctcgtagttggatcttgggagcgggc

SEQ ID NO: 35722 - DNA, 27 bp, Homo sapiens
ctcgtagttggatcttgggagcgggcg

SEQ ID NO: 35723 - DNA, 28 bp, Homo sapiens
ctcgtagttggatcttgggagcgggcgg

SEQ ID NO: 35724 - DNA, 29 bp, Homo sapiens
ctcgtagttggatcttgggagcgggcggg

SEQ ID NO: 35725 - DNA, 30 bp, Homo sapiens
ctcgtagttggatcttgggagcgggcgggc

SEQ ID NO: 35726 - DNA, 17 bp, Homo sapiens
tcgtagttggatcttgg

SEQ ID NO: 35727 - DNA, 18 bp, Homo sapiens
tcgtagttggatcttggg

SEQ ID NO: 35728 - DNA, 19 bp, Homo sapiens
tcgtagttggatcttggga

SEQ ID NO: 35729 - DNA, 20 bp, Homo sapiens
tcgtagttggatcttgggag

SEQ ID NO: 35730 - DNA, 21 bp, Homo sapiens
tcgtagttggatcttgggagc

SEQ ID NO: 35731 - DNA, 22 bp, Homo sapiens
tcgtagttggatcttgggagcg

SEQ ID NO: 35732 - DNA, 23 bp, Homo sapiens
tcgtagttggatcttgggagcgg

SEQ ID NO: 35733 - DNA, 24 bp, Homo sapiens
tcgtagttggatcttgggagcggg

SEQ ID NO: 35734 - DNA, 25 bp, Homo sapiens
tcgtagttggatcttgggagcgggc

SEQ ID NO: 35735 - DNA, 26 bp, Homo sapiens
tcgtagttggatcttgggagcgggcg

SEQ ID NO: 35736 - DNA, 27 bp, Homo sapiens
tcgtagttggatcttgggagcgggcgg

SEQ ID NO: 35737 - DNA, 28 bp, Homo sapiens
tcgtagttggatcttgggagcgggcggg

SEQ ID NO: 35738 - DNA, 29 bp, Homo sapiens
tcgtagttggatcttgggagcgggcgggc

SEQ ID NO: 35739 - DNA, 30 bp, Homo sapiens
tcgtagttggatcttgggagcgggcgggcg

SEQ ID NO: 35740 - DNA, 16 bp, Homo sapiens
cgtagttggatcttgg

SEQ ID NO: 35741 - DNA, 17 bp, Homo sapiens
cgtagttggatcttggg

SEQ ID NO: 35742 - DNA, 18 bp, Homo sapiens
cgtagttggatcttggga

SEQ ID NO: 35743 - DNA, 19 bp, Homo sapiens
cgtagttggatcttgggag

SEQ ID NO: 35744 - DNA, 20 bp, Homo sapiens
cgtagttggatcttgggagc

SEQ ID NO: 35745 - DNA, 21 bp, Homo sapiens
cgtagttggatcttgggagcg

SEQ ID NO: 35746 - DNA, 22 bp, Homo sapiens
cgtagttggatcttgggagcgg

SEQ ID NO: 35747 - DNA, 23 bp, Homo sapiens
cgtagttggatcttgggagcggg

SEQ ID NO: 35748 - DNA, 24 bp, Homo sapiens
cgtagttggatcttgggagcgggc

SEQ ID NO: 35749 - DNA, 25 bp, Homo sapiens
cgtagttggatcttgggagcgggcg

SEQ ID NO: 35750 - DNA, 26 bp, Homo sapiens
cgtagttggatcttgggagcgggcgg

SEQ ID NO: 35751 - DNA, 27 bp, Homo sapiens
cgtagttggatcttgggagcgggcggg

SEQ ID NO: 35752 - DNA, 28 bp, Homo sapiens
cgtagttggatcttgggagcgggcgggc

SEQ ID NO: 35753 - DNA, 29 bp, Homo sapiens
cgtagttggatcttgggagcgggcgggcg

SEQ ID NO: 35754 - DNA, 30 bp, Homo sapiens; identical to SEQ ID NO: 13677

SEQ ID NO: 35755 - DNA, 16 bp, Homo sapiens
gtagttggatcttggg

SEQ ID NO: 35756 - DNA, 17 bp, Homo sapiens
gtagttggatcttggga

SEQ ID NO: 35757 - DNA, 18 bp, Homo sapiens
gtagttggatcttgggag

SEQ ID NO: 35758 - DNA, 19 bp, Homo sapiens
gtagttggatcttgggagc

SEQ ID NO: 35759 - DNA, 20 bp, Homo sapiens
gtagttggatcttgggagcg

SEQ ID NO: 35760 - DNA, 21 bp, Homo sapiens
gtagttggatcttgggagcgg

SEQ ID NO: 35761 - DNA, 22 bp, Homo sapiens
gtagttggatcttgggagcggg

SEQ ID NO: 35762 - DNA, 23 bp, Homo sapiens
gtagttggatcttgggagcgggc

SEQ ID NO: 35763 - DNA, 24 bp, Homo sapiens
gtagttggatcttgggagcgggcg

SEQ ID NO: 35764 - DNA, 25 bp, Homo sapiens
gtagttggatcttgggagcgggcgg

SEQ ID NO: 35765 - DNA, 26 bp, Homo sapiens
gtagttggatcttgggagcgggcggg

SEQ ID NO: 35766 - DNA, 27 bp, Homo sapiens
gtagttggatcttgggagcgggcgggc

SEQ ID NO: 35767 - DNA, 28 bp, Homo sapiens
gtagttggatcttgggagcgggcgggcg

SEQ ID NO: 35768 - DNA, 29 bp, Homo sapiens
gtagttggatcttgggagcgggcgggcgg

SEQ ID NO: 35769 - DNA, 30 bp, Homo sapiens
gtagttggatcttgggagcgggcgggcggt

SEQ ID NO: 35770 - DNA, 16 bp, Homo sapiens
tagttggatcttggga

SEQ ID NO: 35771 - DNA, 17 bp, Homo sapiens
tagttggatcttgggag

SEQ ID NO: 35772 - DNA, 18 bp, Homo sapiens
tagttggatcttgggagc

SEQ ID NO: 35773 - DNA, 19 bp, Homo sapiens
tagttggatcttgggagcg

SEQ ID NO: 35774 - DNA, 20 bp, Homo sapiens
tagttggatcttgggagcgg

SEQ ID NO: 35775 - DNA, 21 bp, Homo sapiens
tagttggatcttgggagcggg

SEQ ID NO: 35776 - DNA, 22 bp, Homo sapiens
tagttggatcttgggagcgggc

SEQ ID NO: 35777 - DNA, 23 bp, Homo sapiens
tagttggatcttgggagcgggcg

SEQ ID NO: 35778 - DNA, 24 bp, Homo sapiens
tagttggatcttgggagcgggcgg

SEQ ID NO: 35779 - DNA, 25 bp, Homo sapiens
tagttggatcttgggagcgggcggg

SEQ ID NO: 35780 - DNA, 26 bp, Homo sapiens
tagttggatcttgggagcgggcgggc

SEQ ID NO: 35781 - DNA, 27 bp, Homo sapiens
tagttggatcttgggagcgggcgggcg

SEQ ID NO: 35782 - DNA, 28 bp, Homo sapiens
tagttggatcttgggagcgggcgggcgg

SEQ ID NO: 35783 - DNA, 29 bp, Homo sapiens
tagttggatcttgggagcgggcgggcggt

SEQ ID NO: 35784 - DNA, 30 bp, Homo sapiens; identical to SEQ ID NO: 13685

SEQ ID NO: 35785 - DNA, 16 bp, Homo sapiens
agttggatcttgggag

SEQ ID NO: 35786 - DNA, 17 bp, Homo sapiens
agttggatcttgggagc

SEQ ID NO: 35787 - DNA, 18 bp, Homo sapiens
agttggatcttgggagcg

SEQ ID NO: 35788 - DNA, 19 bp, Homo sapiens
agttggatcttgggagcgg

SEQ ID NO: 35789 - DNA, 20 bp, Homo sapiens
agttggatcttgggagcggg

SEQ ID NO: 35790 - DNA, 21 bp, Homo sapiens
agttggatcttgggagcgggc

SEQ ID NO: 35791 - DNA, 22 bp, Homo sapiens
agttggatcttgggagcgggcg

SEQ ID NO: 35792 - DNA, 23 bp, Homo sapiens
agttggatcttgggagcgggcgg

SEQ ID NO: 35793 - DNA, 16 bp, Homo sapiens
gttggatcttgggagc

SEQ ID NO: 35794 - DNA, 17 bp, Homo sapiens
gttggatcttgggagcg

SEQ ID NO: 35795 - DNA, 18 bp, Homo sapiens
gttggatcttgggagcgg

SEQ ID NO: 35796 - DNA, 19 bp, Homo sapiens
gttggatcttgggagcggg

SEQ ID NO: 35797 - DNA, 20 bp, Homo sapiens
gttggatcttgggagcgggc

SEQ ID NO: 35798 - DNA, 21 bp, Homo sapiens
gttggatcttgggagcgggcg

SEQ ID NO: 35799 - DNA, 22 bp, Homo sapiens
gttggatcttgggagcgggcgg

SEQ ID NO: 35800 - DNA, 23 bp, Homo sapiens
gttggatcttgggagcgggcggg

SEQ ID NO: 35801 - DNA, 24 bp, Homo sapiens
gttggatcttgggagcgggcgggc

SEQ ID NO: 35802 - DNA, 25 bp, Homo sapiens
gttggatcttgggagcgggcgggcg

SEQ ID NO: 35803 - DNA, 26 bp, Homo sapiens
gttggatcttgggagcgggcgggcgg

SEQ ID NO: 35804 - DNA, 27 bp, Homo sapiens
gttggatcttgggagcgggcgggcggt

SEQ ID NO: 35805 - DNA, 28 bp, Homo sapiens
gttggatcttgggagcgggcgggcggtc

SEQ ID NO: 35806 - DNA, 16 bp, Homo sapiens
ttggatcttgggagcg

SEQ ID NO: 35807 - DNA, 17 bp, Homo sapiens
ttggatcttgggagcgg

SEQ ID NO: 35808 - DNA, 18 bp, Homo sapiens
ttggatcttgggagcggg

SEQ ID NO: 35809 - DNA, 19 bp, Homo sapiens
ttggatcttgggagcgggc

SEQ ID NO: 35810 - DNA, 20 bp, Homo sapiens
ttggatcttgggagcgggcg

SEQ ID NO: 35811 - DNA, 21 bp, Homo sapiens
ttggatcttgggagcgggcgg

SEQ ID NO: 35812 - DNA, 22 bp, Homo sapiens
ttggatcttgggagcgggcggg

SEQ ID NO: 35813 - DNA, 23 bp, Homo sapiens
ttggatcttgggagcgggcgggc

SEQ ID NO: 35814 - DNA, 24 bp, Homo sapiens
ttggatcttgggagcgggcgggcg

SEQ ID NO: 35815 - DNA, 25 bp, Homo sapiens
ttggatcttgggagcgggcgggcgg

SEQ ID NO: 35816 - DNA, 26 bp, Homo sapiens
ttggatcttgggagcgggcgggcggt

SEQ ID NO: 35817 - DNA, 27 bp, Homo sapiens
ttggatcttgggagcgggcgggcggtc

SEQ ID NO: 35818 - DNA, 28 bp, Homo sapiens
ttggatcttgggagcgggcgggcggtcc

SEQ ID NO: 35819 - DNA, 19 bp, Homo sapiens
tggatcttgggagcgggcg

SEQ ID NO: 35820 - DNA, 20 bp, Homo sapiens
tggatcttgggagcgggcgg

SEQ ID NO: 35821 - DNA, 23 bp, Homo sapiens
tggatcttgggagcgggcgggcg

SEQ ID NO: 35822 - DNA, 24 bp, Homo sapiens
tggatcttgggagcgggcgggcgg

SEQ ID NO: 35823 - DNA, 25 bp, Homo sapiens
tggatcttgggagcgggcgggcggt

SEQ ID NO: 35824 - DNA, 26 bp, Homo sapiens
tggatcttgggagcgggcgggcggtc

SEQ ID NO: 35825 - DNA, 18 bp, Homo sapiens
ggatcttgggagcgggcg

SEQ ID NO: 35826 - DNA, 19 bp, Homo sapiens
ggatcttgggagcgggcgg

SEQ ID NO: 35827 - DNA, 20 bp, Homo sapiens
ggatcttgggagcgggcggg

SEQ ID NO: 35828 - DNA, 21 bp, Homo sapiens
ggatcttgggagcgggcgggc

SEQ ID NO: 35829 - DNA, 22 bp, Homo sapiens
ggatcttgggagcgggcgggcg

SEQ ID NO: 35830 - DNA, 23 bp, Homo sapiens
ggatcttgggagcgggcgggcgg

SEQ ID NO: 35831 - DNA, 24 bp, Homo sapiens
ggatcttgggagcgggcgggcggt

SEQ ID NO: 35832 - DNA, 25 bp, Homo sapiens
ggatcttgggagcgggcgggcggtc

SEQ ID NO: 35833 - DNA, 26 bp, Homo sapiens
ggatcttgggagcgggcgggcggtcc

SEQ ID NO: 35834 - DNA, 21 bp, Homo sapiens
tcttgggagcgggcgggcggt

SEQ ID NO: 35835 - DNA, 23 bp, Homo sapiens
tcttgggagcgggcgggcggtcc

SEQ ID NO: 35836 - DNA, 18 bp, Homo sapiens
cttgggagcgggcgggcg

SEQ ID NO: 35837 - DNA, 19 bp, Homo sapiens
cttgggagcgggcgggcgg

SEQ ID NO: 35838 - DNA, 20 bp, Homo sapiens
cttgggagcgggcgggcggt

SEQ ID NO: 35839 - DNA, 21 bp, Homo sapiens
cttgggagcgggcgggcggtc

SEQ ID NO: 35840 - DNA, 22 bp, Homo sapiens
cttgggagcgggcgggcggtcc

SEQ ID NO: 35841 - DNA, 17 bp, Homo sapiens
ttgggagcgggcgggcg

SEQ ID NO: 35842 - DNA, 18 bp, Homo sapiens
ttgggagcgggcgggcgg

SEQ ID NO: 35843 - DNA, 19 bp, Homo sapiens
ttgggagcgggcgggcggt

SEQ ID NO: 35844 - DNA, 20 bp, Homo sapiens
ttgggagcgggcgggcggtc

SEQ ID NO: 35845 - DNA, 21 bp, Homo sapiens
ttgggagcgggcgggcggtcc

SEQ ID NO: 35846 - DNA, 22 bp, Homo sapiens
ttgggagcgggcgggcggtccg

SEQ ID NO: 35847 - DNA, 16 bp, Homo sapiens
tgggagcgggcgggcg

SEQ ID NO: 35848 - DNA, 19 bp, Homo sapiens
tgggagcgggcgggcggtc

SEQ ID NO: 35849 - DNA, 20 bp, Homo sapiens
tgggagcgggcgggcggtcc

SEQ ID NO: 35850 - DNA, 16 bp, Homo sapiens
gggagcgggcgggcgg

SEQ ID NO: 35851 - DNA, 17 bp, Homo sapiens
gggagcgggcgggcggt

SEQ ID NO: 35852 - DNA, 18 bp, Homo sapiens
gggagcgggcgggcggtc

SEQ ID NO: 35853 - DNA, 19 bp, Homo sapiens
gggagcgggcgggcggtcc

SEQ ID NO: 35854 - DNA, 23 bp, Homo sapiens
gggagcgggcgggcggtccgccg

SEQ ID NO: 35855 - DNA, 24 bp, Homo sapiens
gggagcgggcgggcggtccgccgc

SEQ ID NO: 35856 - DNA, 21 bp, Homo sapiens
ggagcgggcgggcggtccgcc

SEQ ID NO: 35857 - DNA, 23 bp, Homo sapiens
ggagcgggcgggcggtccgccgc

SEQ ID NO: 35858 - DNA, 22 bp, Homo sapiens
gagcgggcgggcggtccgccgc

SEQ ID NO: 35859 - DNA, 20 bp, Homo sapiens
gcgggcgggcggtccgccgc

SEQ ID NO: 35860 - DNA, 19 bp, Homo sapiens
cgggcgggcggtccgccgc

SEQ ID NO: 35861 - DNA, 20 bp, Homo sapiens
cgggcgggcggtccgccgcg

SEQ ID NO: 35862 - DNA, 17 bp, Homo sapiens
gcggtccgccgcgaggc

SEQ ID NO: 35863 - DNA, 16 bp, Homo sapiens
cggtccgccgcgaggc

SEQ ID NO: 35864 - DNA, 19 bp, Homo sapiens
ggtccgccgcgaggcgagc

SEQ ID NO: 35865 - DNA, 20 bp, Homo sapiens
cgccgcgaggcgagccaccg

SEQ ID NO: 35866 - DNA, 16 bp, Homo sapiens
gccgcgaggcgagcca

SEQ ID NO: 35867 - DNA, 17 bp, Homo sapiens
gccgcgaggcgagccac

SEQ ID NO: 35868 - DNA, 18 bp, Homo sapiens
gccgcgaggcgagccacc

SEQ ID NO: 35869 - DNA, 19 bp, Homo sapiens
gccgcgaggcgagccaccg

SEQ ID NO: 35870 - DNA, 20 bp, Homo sapiens
gccgcgaggcgagccaccgc

SEQ ID NO: 35871 - DNA, 21 bp, Homo sapiens
gccgcgaggcgagccaccgcc

SEQ ID NO: 35872 - DNA, 25 bp, Homo sapiens
gccgcgaggcgagccaccgcccgtc

SEQ ID NO: 35873 - DNA, 17 bp, Homo sapiens
ccgcgaggcgagccacc

SEQ ID NO: 35874 - DNA, 20 bp, Homo sapiens
ccgcgaggcgagccaccgcc

SEQ ID NO: 35875 - DNA, 19 bp, Homo sapiens
cgcgaggcgagccaccgcc

SEQ ID NO: 35876 - DNA, 17 bp, Homo sapiens
gcgaggcgagccaccgc

SEQ ID NO: 35877 - DNA, 18 bp, Homo sapiens
gcgaggcgagccaccgcc

SEQ ID NO: 35878 - DNA, 23 bp, Homo sapiens
ggcgagccaccgcccgtccccgc

SEQ ID NO: 35879 - DNA, 24 bp, Homo sapiens
ggcgagccaccgcccgtccccgcc

SEQ ID NO: 35880 - DNA, 25 bp, Homo sapiens
ggcgagccaccgcccgtccccgccc

SEQ ID NO: 35881 - DNA, 26 bp, Homo sapiens
ggcgagccaccgcccgtccccgcccc

SEQ ID NO: 35882 - DNA, 19 bp, Homo sapiens
gcgagccaccgcccgtccc

SEQ ID NO: 35883 - DNA, 20 bp, Homo sapiens
gcgagccaccgcccgtcccc

SEQ ID NO: 35884 - DNA, 21 bp, Homo sapiens
gcgagccaccgcccgtccccg

SEQ ID NO: 35885 - DNA, 22 bp, Homo sapiens
gcgagccaccgcccgtccccgc

SEQ ID NO: 35886 - DNA, 23 bp, Homo sapiens
gcgagccaccgcccgtccccgcc

SEQ ID NO: 35887 - DNA, 24 bp, Homo sapiens
gcgagccaccgcccgtccccgccc

SEQ ID NO: 35888 - DNA, 25 bp, Homo sapiens
gcgagccaccgcccgtccccgcccc

SEQ ID NO: 35889 - DNA, 26 bp, Homo sapiens
gcgagccaccgcccgtccccgcccct

SEQ ID NO: 35890 - DNA, 18 bp, Homo sapiens
cgagccaccgcccgtccc

SEQ ID NO: 35891 - DNA, 19 bp, Homo sapiens
cgagccaccgcccgtcccc

SEQ ID NO: 35892 - DNA, 20 bp, Homo sapiens
cgagccaccgcccgtccccg

SEQ ID NO: 35893 - DNA, 21 bp, Homo sapiens
cgagccaccgcccgtccccgc

SEQ ID NO: 35894 - DNA, 22 bp, Homo sapiens
cgagccaccgcccgtccccgcc

SEQ ID NO: 35895 - DNA, 18 bp, Homo sapiens
gagccaccgcccgtcccc

SEQ ID NO: 35896 - DNA, 19 bp, Homo sapiens
gagccaccgcccgtccccg

SEQ ID NO: 35897 - DNA, 20 bp, Homo sapiens
gagccaccgcccgtccccgc

SEQ ID NO: 35898 - DNA, 21 bp, Homo sapiens
gagccaccgcccgtccccgcc

SEQ ID NO: 35899 - DNA, 22 bp, Homo sapiens
gagccaccgcccgtccccgccc

SEQ ID NO: 35900 - DNA, 19 bp, Homo sapiens
agccaccgcccgtccccgc

SEQ ID NO: 35901 - DNA, 20 bp, Homo sapiens
agccaccgcccgtccccgcc

SEQ ID NO: 35902 - DNA, 19 bp, Homo sapiens
gccaccgcccgtccccgcc

SEQ ID NO: 35903 - DNA, 18 bp, Homo sapiens
ccaccgcccgtccccgcc

SEQ ID NO: 35904 - DNA, 20 bp, Homo sapiens
ccaccgcccgtccccgcccc

SEQ ID NO: 35905 - DNA, 18 bp, Homo sapiens
caccgcccgtccccgccc

SEQ ID NO: 35906 - DNA, 19 bp, Homo sapiens
caccgcccgtccccgcccc

SEQ ID NO: 35907 - DNA, 16 bp, Homo sapiens
accgcccgtccccgcc

SEQ ID NO: 35908 - DNA, 17 bp, Homo sapiens
accgcccgtccccgccc

SEQ ID NO: 35909 - DNA, 18 bp, Homo sapiens
accgcccgtccccgcccc

SEQ ID NO: 35910 - DNA, 21 bp, Homo sapiens
accgcccgtccccgccccttg

SEQ ID NO: 35911 - DNA, 22 bp, Homo sapiens
accgcccgtccccgccccttgc

SEQ ID NO: 35912 - DNA, 23 bp, Homo sapiens
accgcccgtccccgccccttgcc

SEQ ID NO: 35913 - DNA, 30 bp, Homo sapiens
accgcccgtccccgccccttgcctctcggc

SEQ ID NO: 35914 - DNA, 16 bp, Homo sapiens
ccgcccgtccccgccc

SEQ ID NO: 35915 - DNA, 17 bp, Homo sapiens
ccgcccgtccccgcccc

SEQ ID NO: 35916 - DNA, 20 bp, Homo sapiens
ccgcccgtccccgccccttg

SEQ ID NO: 35917 - DNA, 21 bp, Homo sapiens
ccgcccgtccccgccccttgc

SEQ ID NO: 35918 - DNA, 22 bp, Homo sapiens
ccgcccgtccccgccccttgcc

SEQ ID NO: 35919 - DNA, 16 bp, Homo sapiens
cgcccgtccccgcccc

SEQ ID NO: 35920 - DNA, 20 bp, Homo sapiens
cgcccgtccccgccccttgc

SEQ ID NO: 35921 - DNA, 21 bp, Homo sapiens
cgcccgtccccgccccttgcc

SEQ ID NO: 35922 - DNA, 18 bp, Homo sapiens
gcccgtccccgccccttg

SEQ ID NO: 35923 - DNA, 19 bp, Homo sapiens
gcccgtccccgccccttgc

SEQ ID NO: 35924 - DNA, 20 bp, Homo sapiens
gcccgtccccgccccttgcc

SEQ ID NO: 35925 - DNA, 21 bp, Homo sapiens
gcccgtccccgccccttgcct

SEQ ID NO: 35926 - DNA, 23 bp, Homo sapiens
gcccgtccccgccccttgcctct

SEQ ID NO: 35927 - DNA, 24 bp, Homo sapiens
gcccgtccccgccccttgcctctc

SEQ ID NO: 35928 - DNA, 25 bp, Homo sapiens
gcccgtccccgccccttgcctctcg

SEQ ID NO: 35929 - DNA, 26 bp, Homo sapiens
gcccgtccccgccccttgcctctcgg

SEQ ID NO: 35930 - DNA, 27 bp, Homo sapiens
gcccgtccccgccccttgcctctcggc

SEQ ID NO: 35931 - DNA, 28 bp, Homo sapiens
gcccgtccccgccccttgcctctcggcg

SEQ ID NO: 35932 - DNA, 29 bp, Homo sapiens
gcccgtccccgccccttgcctctcggcgc

SEQ ID NO: 35933 - DNA, 30 bp, Homo sapiens
gcccgtccccgccccttgcctctcggcgcc

SEQ ID NO: 35934 - DNA, 19 bp, Homo sapiens
cccgtccccgccccttgcc

SEQ ID NO: 35935 - DNA, 24 bp, Homo sapiens
cccgtccccgccccttgcctctcg

SEQ ID NO: 35936 - DNA, 27 bp, Homo sapiens
ccgtccccgccccttgcctctcggcgc

SEQ ID NO: 35937 - DNA, 17 bp, Homo sapiens
cgtccccgccccttgcc

SEQ ID NO: 35938 - DNA, 22 bp, Homo sapiens
cgtccccgccccttgcctctcg

SEQ ID NO: 35939 - DNA, 23 bp, Homo sapiens
cgtccccgccccttgcctctcgg

SEQ ID NO: 35940 - DNA, 24 bp, Homo sapiens
cgtccccgccccttgcctctcggc

SEQ ID NO: 35941 - DNA, 25 bp, Homo sapiens
cgtccccgccccttgcctctcggcg

SEQ ID NO: 35942 - DNA, 26 bp, Homo sapiens
cgtccccgccccttgcctctcggcgc

SEQ ID NO: 35943 - DNA, 27 bp, Homo sapiens
cgtccccgccccttgcctctcggcgcc

SEQ ID NO: 35944 - DNA, 30 bp, Homo sapiens
cgtccccgccccttgcctctcggcgccccc

SEQ ID NO: 35945 - DNA, 22 bp, Homo sapiens
gtccccgccccttgcctctcgg

SEQ ID NO: 35946 - DNA, 24 bp, Homo sapiens
gtccccgccccttgcctctcggcg

SEQ ID NO: 35947 - DNA, 25 bp, Homo sapiens
gtccccgccccttgcctctcggcgc

SEQ ID NO: 35948 - DNA, 30 bp, Homo sapiens
gtccccgccccttgcctctcggcgccccct

SEQ ID NO: 35949 - DNA, 20 bp, Homo sapiens
ccccgccccttgcctctcgg

SEQ ID NO: 35950 - DNA, 29 bp, Homo sapiens
cccgccccttgcctctcggcgccccctcg

SEQ ID NO: 35951 - DNA, 22 bp, Homo sapiens
ccgccccttgcctctcggcgcc

SEQ ID NO: 35952 - DNA, 23 bp, Homo sapiens
ccttgcctctcggcgccccctcg

SEQ ID NO: 35953 - DNA, 24 bp, Homo sapiens
ccttgcctctcggcgccccctcga

SEQ ID NO: 35954 - DNA, 26 bp, Homo sapiens
ccttgcctctcggcgccccctcgatg

SEQ ID NO: 35955 - DNA, 27 bp, Homo sapiens
ccttgcctctcggcgccccctcgatgc

SEQ ID NO: 35956 - DNA, 30 bp, Homo sapiens
ccttgcctctcggcgccccctcgatgctct

SEQ ID NO: 35957 - DNA, 22 bp, Homo sapiens
cttgcctctcggcgccccctcg

SEQ ID NO: 35958 - DNA, 21 bp, Homo sapiens
ttgcctctcggcgccccctcg

SEQ ID NO: 35959 - DNA, 20 bp, Homo sapiens
tgcctctcggcgccccctcg

SEQ ID NO: 35960 - DNA, 25 bp, Homo sapiens
cctctcggcgccccctcgatgctct

SEQ ID NO: 35961 - DNA, 26 bp, Homo sapiens
cctctcggcgccccctcgatgctctt

SEQ ID NO: 35962 - DNA, 20 bp, Homo sapiens
ctctcggcgccccctcgatg

SEQ ID NO: 35963 - DNA, 21 bp, Homo sapiens
ctctcggcgccccctcgatgc

SEQ ID NO: 35964 - DNA, 23 bp, Homo sapiens
ctctcggcgccccctcgatgctc

SEQ ID NO: 35965 - DNA, 24 bp, Homo sapiens
ctctcggcgccccctcgatgctct

SEQ ID NO: 35966 - DNA, 25 bp, Homo sapiens
ctctcggcgccccctcgatgctctt

SEQ ID NO: 35967 - DNA, 24 bp, Homo sapiens
tctcggcgccccctcgatgctctt

SEQ ID NO: 35968 - DNA, 19 bp, Homo sapiens
ctcggcgccccctcgatgc

SEQ ID NO: 35969 - DNA, 21 bp, Homo sapiens
ctcggcgccccctcgatgctc

SEQ ID NO: 35970 - DNA, 22 bp, Homo sapiens
ctcggcgccccctcgatgctct

SEQ ID NO: 35971 - DNA, 23 bp, Homo sapiens
ctcggcgccccctcgatgctctt

SEQ ID NO: 35972 - DNA, 20 bp, Homo sapiens
tcggcgccccctcgatgctc

SEQ ID NO: 35973 - DNA, 21 bp, Homo sapiens
tcggcgccccctcgatgctct

SEQ ID NO: 35974 - DNA, 22 bp, Homo sapiens
tcggcgccccctcgatgctctt

SEQ ID NO: 35975 - DNA, 20 bp, Homo sapiens
cggcgccccctcgatgctct

SEQ ID NO: 35976 - DNA, 21 bp, Homo sapiens
cggcgccccctcgatgctctt

SEQ ID NO: 35977 - DNA, 19 bp, Homo sapiens
ggcgccccctcgatgctct

SEQ ID NO: 35978 - DNA, 20 bp, Homo sapiens
ggcgccccctcgatgctctt

SEQ ID NO: 35979 - DNA, 17 bp, Homo sapiens
gccccctcgatgctctt

SEQ ID NO: 35980 - DNA, 16 bp, Homo sapiens
ccccctcgatgctctt

SEQ ID NO: 35981 - DNA, 17 bp, Homo sapiens
gctcttagctgagtgtc

SEQ ID NO: 35982 - DNA, 16 bp, Homo sapiens
ctcttagctgagtgtc

SEQ ID NO: 35983 - DNA, 19 bp, Homo sapiens
ctcttagctgagtgtcccg

SEQ ID NO: 35984 - DNA, 22 bp, Homo sapiens
ctcttagctgagtgtcccgcgg

SEQ ID NO: 35985 - DNA, 19 bp, Homo sapiens
cttagctgagtgtcccgcg

SEQ ID NO: 35986 - DNA, 20 bp, Homo sapiens
cttagctgagtgtcccgcgg

SEQ ID NO: 35987 - DNA, 21 bp, Homo sapiens
cttagctgagtgtcccgcggg

SEQ ID NO: 35988 - DNA, 24 bp, Homo sapiens
gctgagtgtcccgcggggcccgaa

SEQ ID NO: 35989 - DNA, 25 bp, Homo sapiens
gctgagtgtcccgcggggcccgaag

SEQ ID NO: 35990 - DNA, 23 bp, Homo sapiens
ctgagtgtcccgcggggcccgaa

SEQ ID NO: 35991 - DNA, 24 bp, Homo sapiens
ctgagtgtcccgcggggcccgaag

SEQ ID NO: 35992 - DNA, 26 bp, Homo sapiens
ctgagtgtcccgcggggcccgaagcg

SEQ ID NO: 35993 - DNA, 25 bp, Homo sapiens
tgagtgtcccgcggggcccgaagcg

SEQ ID NO: 35994 - DNA, 24 bp, Homo sapiens
gagtgtcccgcggggcccgaagcg

SEQ ID NO: 35995 - DNA, 26 bp, Homo sapiens
gagtgtcccgcggggcccgaagcgtt

SEQ ID NO: 35996 - DNA, 23 bp, Homo sapiens
agtgtcccgcggggcccgaagcg

SEQ ID NO: 35997 - DNA, 22 bp, Homo sapiens
gtgtcccgcggggcccgaagcg

SEQ ID NO: 35998 - DNA, 21 bp, Homo sapiens
tgtcccgcggggcccgaagcg

SEQ ID NO: 35999 - DNA, 22 bp, Homo sapiens
tgtcccgcggggcccgaagcgt

SEQ ID NO: 36000 - DNA, 23 bp, Homo sapiens
tgtcccgcggggcccgaagcgtt

SEQ ID NO: 36001 - DNA, 20 bp, Homo sapiens
gtcccgcggggcccgaagcg

SEQ ID NO: 36002 - DNA, 22 bp, Homo sapiens
gtcccgcggggcccgaagcgtt

SEQ ID NO: 36003 - DNA, 19 bp, Homo sapiens
tcccgcggggcccgaagcg

SEQ ID NO: 36004 - DNA, 21 bp, Homo sapiens
tcccgcggggcccgaagcgtt

SEQ ID NO: 36005 - DNA, 22 bp, Homo sapiens
tcccgcggggcccgaagcgttt

SEQ ID NO: 36006 - DNA, 18 bp, Homo sapiens
cccgcggggcccgaagcg

SEQ ID NO: 36007 - DNA, 20 bp, Homo sapiens
cccgcggggcccgaagcgtt

SEQ ID NO: 36008 - DNA, 21 bp, Homo sapiens
cccgcggggcccgaagcgttt

SEQ ID NO: 36009 - DNA, 17 bp, Homo sapiens
ccgcggggcccgaagcg

SEQ ID NO: 36010 - DNA, 19 bp, Homo sapiens
ccgcggggcccgaagcgtt

SEQ ID NO: 36011 - DNA, 16 bp, Homo sapiens
cgcggggcccgaagcg

SEQ ID NO: 36012 - DNA, 18 bp, Homo sapiens
cgcggggcccgaagcgtt

SEQ ID NO: 36013 - DNA, 25 bp, Homo sapiens
cgcggggcccgaagcgtttactttg

SEQ ID NO: 36014 - DNA, 17 bp, Homo sapiens
gcggggcccgaagcgtt

SEQ ID NO: 36015 - DNA, 19 bp, Homo sapiens
gcggggcccgaagcgttta

SEQ ID NO: 36016 - DNA, 23 bp, Homo sapiens
ggcccgaagcgtttactttgaaa

SEQ ID NO: 36017 - DNA, 24 bp, Homo sapiens
ggcccgaagcgtttactttgaaaa

SEQ ID NO: 36018 - DNA, 30 bp, Homo sapiens
gaagcgtttactttgaaaaaattagagtgt

SEQ ID NO: 36019 - DNA, 19 bp, Homo sapiens
tactttgaaaaaattagag

SEQ ID NO: 36020 - DNA, 20 bp, Homo sapiens
tactttgaaaaaattagagt

SEQ ID NO: 36021 - DNA, 17 bp, Homo sapiens
ctttgaaaaaattagag

SEQ ID NO: 36022 - DNA, 22 bp, Homo sapiens
ctttgaaaaaattagagtgttc

SEQ ID NO: 36023 - DNA, 18 bp, Homo sapiens
ttagagtgttcaaagcag

SEQ ID NO: 36024 - DNA, 19 bp, Homo sapiens
ttagagtgttcaaagcagg

SEQ ID NO: 36025 - DNA, 22 bp, Homo sapiens
ttagagtgttcaaagcaggccc

SEQ ID NO: 36026 - DNA, 23 bp, Homo sapiens
ttagagtgttcaaagcaggcccg

SEQ ID NO: 36027 - DNA, 24 bp, Homo sapiens
ttagagtgttcaaagcaggcccga

SEQ ID NO: 36028 - DNA, 25 bp, Homo sapiens
ttagagtgttcaaagcaggcccgag

SEQ ID NO: 36029 - DNA, 20 bp, Homo sapiens
gagtgttcaaagcaggcccg

SEQ ID NO: 36030 - DNA, 19 bp, Homo sapiens
agtgttcaaagcaggcccg

SEQ ID NO: 36031 - DNA, 18 bp, Homo sapiens
gtgttcaaagcaggcccg

SEQ ID NO: 36032 - DNA, 16 bp, Homo sapiens
gttcaaagcaggcccg

SEQ ID NO: 36033 - DNA, 17 bp, Homo sapiens
gttcaaagcaggcccga

SEQ ID NO: 36034 - DNA, 21 bp, Homo sapiens
agcaggcccgagccgcctgga

SEQ ID NO: 36035 - DNA, 22 bp, Homo sapiens
agcaggcccgagccgcctggat

SEQ ID NO: 36036 - DNA, 23 bp, Homo sapiens
agcaggcccgagccgcctggata

SEQ ID NO: 36037 - DNA, 16 bp, Homo sapiens
gcaggcccgagccgcc

SEQ ID NO: 36038 - DNA, 24 bp, Homo sapiens
caggcccgagccgcctggataccg

SEQ ID NO: 36039 - DNA, 21 bp, Homo sapiens
ggcccgagccgcctggatacc

SEQ ID NO: 36040 - DNA, 22 bp, Homo sapiens
ggcccgagccgcctggataccg

SEQ ID NO: 36041 - DNA, 27 bp, Homo sapiens
ggcccgagccgcctggataccgcagct

SEQ ID NO: 36042 - DNA, 20 bp, Homo sapiens
gcccgagccgcctggatacc

SEQ ID NO: 36043 - DNA, 22 bp, Homo sapiens
gcccgagccgcctggataccgc

SEQ ID NO: 36044 - DNA, 23 bp, Homo sapiens
gcccgagccgcctggataccgca

SEQ ID NO: 36045 - DNA, 25 bp, Homo sapiens
gcccgagccgcctggataccgcagc

SEQ ID NO: 36046 - DNA, 26 bp, Homo sapiens
gcccgagccgcctggataccgcagct

SEQ ID NO: 36047 - DNA, 21 bp, Homo sapiens
cccgagccgcctggataccgc

SEQ ID NO: 36048 - DNA, 23 bp, Homo sapiens
cccgagccgcctggataccgcag

SEQ ID NO: 36049 - DNA, 22 bp, Homo sapiens
ccgagccgcctggataccgcag

SEQ ID NO: 36050 - DNA, 19 bp, Homo sapiens
cgagccgcctggataccgc

SEQ ID NO: 36051 - DNA, 20 bp, Homo sapiens
cgagccgcctggataccgca

SEQ ID NO: 36052 - DNA, 21 bp, Homo sapiens
cgagccgcctggataccgcag

SEQ ID NO: 36053 - DNA, 22 bp, Homo sapiens
cgagccgcctggataccgcagc

SEQ ID NO: 36054 - DNA, 23 bp, Homo sapiens
cgagccgcctggataccgcagct

SEQ ID NO: 36055 - DNA, 18 bp, Homo sapiens
gagccgcctggataccgc

SEQ ID NO: 36056 - DNA, 19 bp, Homo sapiens
gagccgcctggataccgca

SEQ ID NO: 36057 - DNA, 20 bp, Homo sapiens
gagccgcctggataccgcag

SEQ ID NO: 36058 - DNA, 21 bp, Homo sapiens
gagccgcctggataccgcagc

SEQ ID NO: 36059 - DNA, 22 bp, Homo sapiens
gagccgcctggataccgcagct

SEQ ID NO: 36060 - DNA, 17 bp, Homo sapiens
agccgcctggataccgc

SEQ ID NO: 36061 - DNA, 18 bp, Homo sapiens
agccgcctggataccgca

SEQ ID NO: 36062 - DNA, 20 bp, Homo sapiens
agccgcctggataccgcagc

SEQ ID NO: 36063 - DNA, 28 bp, Homo sapiens
agccgcctggataccgcagctaggaata

SEQ ID NO: 36064 - DNA, 30 bp, Homo sapiens
gccgcctggataccgcagctaggaataatg

SEQ ID NO: 36065 - DNA, 21 bp, Homo sapiens
ccgcctggataccgcagctag

SEQ ID NO: 36066 - DNA, 22 bp, Homo sapiens
ccgcctggataccgcagctagg

SEQ ID NO: 36067 - DNA, 30 bp, Homo sapiens
ccgcctggataccgcagctaggaataatgg

SEQ ID NO: 36068 - DNA, 21 bp, Homo sapiens
cgcctggataccgcagctagg

SEQ ID NO: 36069 - DNA, 19 bp, Homo sapiens
cctggataccgcagctagg

SEQ ID NO: 36070 - DNA, 28 bp, Homo sapiens
tggataccgcagctaggaataatggaat

SEQ ID NO: 36071 - DNA, 23 bp, Homo sapiens
gataccgcagctaggaataatgg

SEQ ID NO: 36072 - DNA, 22 bp, Homo sapiens
ataccgcagctaggaataatgg

SEQ ID NO: 36073 - DNA, 21 bp, Homo sapiens
taccgcagctaggaataatgg

SEQ ID NO: 36074 - DNA, 22 bp, Homo sapiens
taccgcagctaggaataatgga

SEQ ID NO: 36075 - DNA, 20 bp, Homo sapiens
accgcagctaggaataatgg

SEQ ID NO: 36076 - DNA, 21 bp, Homo sapiens
accgcagctaggaataatgga

SEQ ID NO: 36077 - DNA, 19 bp, Homo sapiens
ccgcagctaggaataatgg

SEQ ID NO: 36078 - DNA, 18 bp, Homo sapiens
cgcagctaggaataatgg

SEQ ID NO: 36079 - DNA, 30 bp, Homo sapiens
cgcagctaggaataatggaataggaccgcg

SEQ ID NO: 36080 - DNA, 28 bp, Homo sapiens
gcagctaggaataatggaataggaccgc

SEQ ID NO: 36081 - DNA, 30 bp, Homo sapiens
gcagctaggaataatggaataggaccgcgg

SEQ ID NO: 36082 - DNA, 16 bp, Homo sapiens
cagctaggaataatgg

SEQ ID NO: 36083 - DNA, 19 bp, Homo sapiens
cagctaggaataatggaat

SEQ ID NO: 36084 - DNA, 21 bp, Homo sapiens
cagctaggaataatggaatag

SEQ ID NO: 36085 - DNA, 20 bp, Homo sapiens
gctaggaataatggaatagg

SEQ ID NO: 36086 - DNA, 16 bp, Homo sapiens
ctaggaataatggaat

SEQ ID NO: 36087 - DNA, 17 bp, Homo sapiens
ctaggaataatggaata

SEQ ID NO: 36088 - DNA, 18 bp, Homo sapiens
ctaggaataatggaatag

SEQ ID NO: 36089 - DNA, 19 bp, Homo sapiens
ctaggaataatggaatagg

SEQ ID NO: 36090 - DNA, 20 bp, Homo sapiens
ctaggaataatggaatagga

SEQ ID NO: 36091 - DNA, 22 bp, Homo sapiens
ctaggaataatggaataggacc

SEQ ID NO: 36092 - DNA, 23 bp, Homo sapiens
ctaggaataatggaataggaccg

SEQ ID NO: 36093 - DNA, 24 bp, Homo sapiens
ctaggaataatggaataggaccgc

SEQ ID NO: 36094 - DNA, 25 bp, Homo sapiens
ctaggaataatggaataggaccgcg

SEQ ID NO: 36095 - DNA, 21 bp, Homo sapiens
taggaataatggaataggacc

SEQ ID NO: 36096 - DNA, 23 bp, Homo sapiens
taggaataatggaataggaccgc

SEQ ID NO: 36097 - DNA, 22 bp, Homo sapiens
aggaataatggaataggaccgc

SEQ ID NO: 36098 - DNA, 23 bp, Homo sapiens
aggaataatggaataggaccgcg

SEQ ID NO: 36099 - DNA, 24 bp, Homo sapiens
aggaataatggaataggaccgcgg

SEQ ID NO: 36100 - DNA, 25 bp, Homo sapiens
aggaataatggaataggaccgcggt

SEQ ID NO: 36101 - DNA, 21 bp, Homo sapiens
gaataatggaataggaccgcg

SEQ ID NO: 36102 - DNA, 22 bp, Homo sapiens
gaataatggaataggaccgcgg

SEQ ID NO: 36103 - DNA, 18 bp, Homo sapiens
aataatggaataggaccg

SEQ ID NO: 36104 - DNA, 20 bp, Homo sapiens
aataatggaataggaccgcg

SEQ ID NO: 36105 - DNA, 21 bp, Homo sapiens
aataatggaataggaccgcgg

SEQ ID NO: 36106 - DNA, 22 bp, Homo sapiens
aataatggaataggaccgcggt

SEQ ID NO: 36107 - DNA, 23 bp, Homo sapiens
aataatggaataggaccgcggtt

SEQ ID NO: 36108 - DNA, 19 bp, Homo sapiens
ataatggaataggaccgcg

SEQ ID NO: 36109 - DNA, 20 bp, Homo sapiens
ataatggaataggaccgcgg

SEQ ID NO: 36110 - DNA, 18 bp, Homo sapiens
taatggaataggaccgcg

SEQ ID NO: 36111 - DNA, 19 bp, Homo sapiens
taatggaataggaccgcgg

SEQ ID NO: 36112 - DNA, 20 bp, Homo sapiens
taatggaataggaccgcggt

SEQ ID NO: 36113 - DNA, 21 bp, Homo sapiens
taatggaataggaccgcggtt

SEQ ID NO: 36114 - DNA, 17 bp, Homo sapiens
aatggaataggaccgcg

SEQ ID NO: 36115 - DNA, 18 bp, Homo sapiens
aatggaataggaccgcgg

SEQ ID NO: 36116 - DNA, 19 bp, Homo sapiens
aatggaataggaccgcggt

SEQ ID NO: 36117 - DNA, 20 bp, Homo sapiens
aatggaataggaccgcggtt

SEQ ID NO: 36118 - DNA, 21 bp, Homo sapiens
aatggaataggaccgcggttc

SEQ ID NO: 36119 - DNA, 16 bp, Homo sapiens
atggaataggaccgcg

SEQ ID NO: 36120 - DNA, 17 bp, Homo sapiens
atggaataggaccgcgg

SEQ ID NO: 36121 - DNA, 18 bp, Homo sapiens
atggaataggaccgcggt

SEQ ID NO: 36122 - DNA, 19 bp, Homo sapiens
atggaataggaccgcggtt

SEQ ID NO: 36123 - DNA, 20 bp, Homo sapiens
atggaataggaccgcggttc

SEQ ID NO: 36124 - DNA, 21 bp, Homo sapiens
atggaataggaccgcggttct

SEQ ID NO: 36125 - DNA, 16 bp, Homo sapiens
tggaataggaccgcgg

SEQ ID NO: 36126 - DNA, 30 bp, Homo sapiens
aataggaccgcggttctattttgttggttt

SEQ ID NO: 36127 - DNA, 25 bp, Homo sapiens
taggaccgcggttctattttgttgg

SEQ ID NO: 36128 - DNA, 26 bp, Homo sapiens
taggaccgcggttctattttgttggt

SEQ ID NO: 36129 - DNA, 23 bp, Homo sapiens
ggaccgcggttctattttgttgg

SEQ ID NO: 36130 - DNA, 30 bp, Homo sapiens
ggaccgcggttctattttgttggttttcgg

SEQ ID NO: 36131 - DNA, 22 bp, Homo sapiens
accgcggttctattttgttggt

SEQ ID NO: 36132 - DNA, 19 bp, Homo sapiens
ccgcggttctattttgttg

SEQ ID NO: 36133 - DNA, 20 bp, Homo sapiens
ccgcggttctattttgttgg

SEQ ID NO: 36134 - DNA, 21 bp, Homo sapiens
ccgcggttctattttgttggt

SEQ ID NO: 36135 - DNA, 27 bp, Homo sapiens
ccgcggttctattttgttggttttcgg

SEQ ID NO: 36136 - DNA, 19 bp, Homo sapiens
gcggttctattttgttggt

SEQ ID NO: 36137 - DNA, 20 bp, Homo sapiens
gcggttctattttgttggtt

SEQ ID NO: 36138 - DNA, 22 bp, Homo sapiens
gcggttctattttgttggtttt

SEQ ID NO: 36139 - DNA, 16 bp, Homo sapiens
cggttctattttgttg

SEQ ID NO: 36140 - DNA, 17 bp, Homo sapiens
cggttctattttgttgg

SEQ ID NO: 36141 - DNA, 23 bp, Homo sapiens
cggttctattttgttggttttcg

SEQ ID NO: 36142 - DNA, 24 bp, Homo sapiens
cggttctattttgttggttttcgg

SEQ ID NO: 36143 - DNA, 25 bp, Homo sapiens
cggttctattttgttggttttcgga

SEQ ID NO: 36144 - DNA, 29 bp, Homo sapiens
cggttctattttgttggttttcggaactg

SEQ ID NO: 36145 - DNA, 16 bp, Homo sapiens
ggttctattttgttgg

SEQ ID NO: 36146 - DNA, 17 bp, Homo sapiens
ggttctattttgttggt

SEQ ID NO: 36147 - DNA, 23 bp, Homo sapiens
ggttctattttgttggttttcgg

SEQ ID NO: 36148 - DNA, 26 bp, Homo sapiens
ggttctattttgttggttttcggaac

SEQ ID NO: 36149 - DNA, 30 bp, Homo sapiens
ggttctattttgttggttttcggaactgag

SEQ ID NO: 36150 - DNA, 16 bp, Homo sapiens
gttctattttgttggt

SEQ ID NO: 36151 - DNA, 21 bp, Homo sapiens
gttctattttgttggttttcg

SEQ ID NO: 36152 - DNA, 22 bp, Homo sapiens
gttctattttgttggttttcgg

SEQ ID NO: 36153 - DNA, 23 bp, Homo sapiens
gttctattttgttggttttcgga

SEQ ID NO: 36154 - DNA, 25 bp, Homo sapiens
gttctattttgttggttttcggaac

SEQ ID NO: 36155 - DNA, 26 bp, Homo sapiens
gttctattttgttggttttcggaact

SEQ ID NO: 36156 - DNA, 27 bp, Homo sapiens
gttctattttgttggttttcggaactg

SEQ ID NO: 36157 - DNA, 28 bp, Homo sapiens
gttctattttgttggttttcggaactga

SEQ ID NO: 36158 - DNA, 29 bp, Homo sapiens
gttctattttgttggttttcggaactgag

SEQ ID NO: 36159 - DNA, 30 bp, Homo sapiens
gttctattttgttggttttcggaactgagg

SEQ ID NO: 36160 - DNA, 20 bp, Homo sapiens
ttctattttgttggttttcg

SEQ ID NO: 36161 - DNA, 21 bp, Homo sapiens
ttctattttgttggttttcgg

SEQ ID NO: 36162 - DNA, 22 bp, Homo sapiens
ttctattttgttggttttcgga

SEQ ID NO: 36163 - DNA, 24 bp, Homo sapiens
ttctattttgttggttttcggaac

SEQ ID NO: 36164 - DNA, 25 bp, Homo sapiens
ttctattttgttggttttcggaact

SEQ ID NO: 36165 - DNA, 26 bp, Homo sapiens
ttctattttgttggttttcggaactg

SEQ ID NO: 36166 - DNA, 27 bp, Homo sapiens
ttctattttgttggttttcggaactga

SEQ ID NO: 36167 - DNA, 28 bp, Homo sapiens
ttctattttgttggttttcggaactgag

SEQ ID NO: 36168 - DNA, 29 bp, Homo sapiens
ttctattttgttggttttcggaactgagg

SEQ ID NO: 36169 - DNA, 20 bp, Homo sapiens
tctattttgttggttttcgg

SEQ ID NO: 36170 - DNA, 21 bp, Homo sapiens
tctattttgttggttttcgga

SEQ ID NO: 36171 - DNA, 22 bp, Homo sapiens
tctattttgttggttttcggaa

SEQ ID NO: 36172 - DNA, 23 bp, Homo sapiens
tctattttgttggttttcggaac

SEQ ID NO: 36173 - DNA, 24 bp, Homo sapiens
tctattttgttggttttcggaact

SEQ ID NO: 36174 - DNA, 25 bp, Homo sapiens
tctattttgttggttttcggaactg

SEQ ID NO: 36175 - DNA, 26 bp, Homo sapiens
tctattttgttggttttcggaactga

SEQ ID NO: 36176 - DNA, 27 bp, Homo sapiens
tctattttgttggttttcggaactgag

SEQ ID NO: 36177 - DNA, 28 bp, Homo sapiens
tctattttgttggttttcggaactgagg

SEQ ID NO: 36178 - DNA, 29 bp, Homo sapiens
tctattttgttggttttcggaactgaggc

SEQ ID NO: 36179 - DNA, 18 bp, Homo sapiens
ctattttgttggttttcg

SEQ ID NO: 36180 - DNA, 19 bp, Homo sapiens
ctattttgttggttttcgg

SEQ ID NO: 36181 - DNA, 20 bp, Homo sapiens
ctattttgttggttttcgga

SEQ ID NO: 36182 - DNA, 21 bp, Homo sapiens
ctattttgttggttttcggaa

SEQ ID NO: 36183 - DNA, 23 bp, Homo sapiens
ctattttgttggttttcggaact

SEQ ID NO: 36184 - DNA, 24 bp, Homo sapiens
ctattttgttggttttcggaactg

SEQ ID NO: 36185 - DNA, 26 bp, Homo sapiens
ctattttgttggttttcggaactgag

SEQ ID NO: 36186 - DNA, 27 bp, Homo sapiens
ctattttgttggttttcggaactgagg

SEQ ID NO: 36187 - DNA, 28 bp, Homo sapiens
ctattttgttggttttcggaactgaggc

SEQ ID NO: 36188 - DNA, 29 bp, Homo sapiens
ctattttgttggttttcggaactgaggcc

SEQ ID NO: 36189 - DNA, 18 bp, Homo sapiens
tattttgttggttttcgg

SEQ ID NO: 36190 - DNA, 19 bp, Homo sapiens
tattttgttggttttcgga

SEQ ID NO: 36191 - DNA, 21 bp, Homo sapiens
tattttgttggttttcggaac

SEQ ID NO: 36192 - DNA, 22 bp, Homo sapiens
tattttgttggttttcggaact

SEQ ID NO: 36193 - DNA, 23 bp, Homo sapiens
tattttgttggttttcggaactg

SEQ ID NO: 36194 - DNA, 24 bp, Homo sapiens
tattttgttggttttcggaactga

SEQ ID NO: 36195 - DNA, 25 bp, Homo sapiens
tattttgttggttttcggaactgag

SEQ ID NO: 36196 - DNA, 26 bp, Homo sapiens
tattttgttggttttcggaactgagg

SEQ ID NO: 36197 - DNA, 27 bp, Homo sapiens
tattttgttggttttcggaactgaggc

SEQ ID NO: 36198 - DNA, 28 bp, Homo sapiens
tattttgttggttttcggaactgaggcc

SEQ ID NO: 36199 - DNA, 17 bp, Homo sapiens
attttgttggttttcgg

SEQ ID NO: 36200 - DNA, 18 bp, Homo sapiens
attttgttggttttcgga

SEQ ID NO: 36201 - DNA, 19 bp, Homo sapiens
attttgttggttttcggaa

SEQ ID NO: 36202 - DNA, 20 bp, Homo sapiens
attttgttggttttcggaac

SEQ ID NO: 36203 - DNA, 21 bp, Homo sapiens
attttgttggttttcggaact

SEQ ID NO: 36204 - DNA, 22 bp, Homo sapiens
attttgttggttttcggaactg

SEQ ID NO: 36205 - DNA, 23 bp, Homo sapiens
attttgttggttttcggaactga

SEQ ID NO: 36206 - DNA, 24 bp, Homo sapiens
attttgttggttttcggaactgag

SEQ ID NO: 36207 - DNA, 25 bp, Homo sapiens
attttgttggttttcggaactgagg

SEQ ID NO: 36208 - DNA, 26 bp, Homo sapiens
attttgttggttttcggaactgaggc

SEQ ID NO: 36209 - DNA, 27 bp, Homo sapiens
attttgttggttttcggaactgaggcc

SEQ ID NO: 36210 - DNA, 30 bp, Homo sapiens
attttgttggttttcggaactgaggccatg

SEQ ID NO: 36211 - DNA, 16 bp, Homo sapiens
ttttgttggttttcgg

SEQ ID NO: 36212 - DNA, 17 bp, Homo sapiens
ttttgttggttttcgga

SEQ ID NO: 36213 - DNA, 18 bp, Homo sapiens
ttttgttggttttcggaa

SEQ ID NO: 36214 - DNA, 19 bp, Homo sapiens
ttttgttggttttcggaac

SEQ ID NO: 36215 - DNA, 20 bp, Homo sapiens
ttttgttggttttcggaact

SEQ ID NO: 36216 - DNA, 21 bp, Homo sapiens
ttttgttggttttcggaactg

SEQ ID NO: 36217 - DNA, 22 bp, Homo sapiens
ttttgttggttttcggaactga

SEQ ID NO: 36218 - DNA, 23 bp, Homo sapiens
ttttgttggttttcggaactgag

SEQ ID NO: 36219 - DNA, 24 bp, Homo sapiens
ttttgttggttttcggaactgagg

SEQ ID NO: 36220 - DNA, 25 bp, Homo sapiens
ttttgttggttttcggaactgaggc

SEQ ID NO: 36221 - DNA, 26 bp, Homo sapiens
ttttgttggttttcggaactgaggcc

SEQ ID NO: 36222 - DNA, 27 bp, Homo sapiens
ttttgttggttttcggaactgaggcca

SEQ ID NO: 36223 - DNA, 29 bp, Homo sapiens
ttttgttggttttcggaactgaggccatg

SEQ ID NO: 36224 - DNA, 16 bp, Homo sapiens
tttgttggttttcgga

SEQ ID NO: 36225 - DNA, 17 bp, Homo sapiens
tttgttggttttcggaa

SEQ ID NO: 36226 - DNA, 18 bp, Homo sapiens
tttgttggttttcggaac

SEQ ID NO: 36227 - DNA, 19 bp, Homo sapiens
tttgttggttttcggaact

SEQ ID NO: 36228 - DNA, 20 bp, Homo sapiens
tttgttggttttcggaactg

SEQ ID NO: 36229 - DNA, 21 bp, Homo sapiens
tttgttggttttcggaactga

SEQ ID NO: 36230 - DNA, 22 bp, Homo sapiens
tttgttggttttcggaactgag

SEQ ID NO: 36231 - DNA, 23 bp, Homo sapiens
tttgttggttttcggaactgagg

SEQ ID NO: 36232 - DNA, 24 bp, Homo sapiens
tttgttggttttcggaactgaggc

SEQ ID NO: 36233 - DNA, 25 bp, Homo sapiens
tttgttggttttcggaactgaggcc

SEQ ID NO: 36234 - DNA, 26 bp, Homo sapiens
tttgttggttttcggaactgaggcca

SEQ ID NO: 36235 - DNA, 28 bp, Homo sapiens
tttgttggttttcggaactgaggccatg

SEQ ID NO: 36236 - DNA, 16 bp, Homo sapiens
ttgttggttttcggaa

SEQ ID NO: 36237 - DNA, 17 bp, Homo sapiens
ttgttggttttcggaac

SEQ ID NO: 36238 - DNA, 18 bp, Homo sapiens
ttgttggttttcggaact

SEQ ID NO: 36239 - DNA, 19 bp, Homo sapiens
ttgttggttttcggaactg

SEQ ID NO: 36240 - DNA, 20 bp, Homo sapiens
ttgttggttttcggaactga

SEQ ID NO: 36241 - DNA, 21 bp, Homo sapiens
ttgttggttttcggaactgag

SEQ ID NO: 36242 - DNA, 22 bp, Homo sapiens
ttgttggttttcggaactgagg

SEQ ID NO: 36243 - DNA, 23 bp, Homo sapiens
ttgttggttttcggaactgaggc

SEQ ID NO: 36244 - DNA, 24 bp, Homo sapiens
ttgttggttttcggaactgaggcc

SEQ ID NO: 36245 - DNA, 25 bp, Homo sapiens
ttgttggttttcggaactgaggcca

SEQ ID NO: 36246 - DNA, 27 bp, Homo sapiens
ttgttggttttcggaactgaggccatg

SEQ ID NO: 36247 - DNA, 29 bp, Homo sapiens
ttgttggttttcggaactgaggccatgat

SEQ ID NO: 36248 - DNA, 30 bp, Homo sapiens
ttgttggttttcggaactgaggccatgatt

SEQ ID NO: 36249 - DNA, 17 bp, Homo sapiens
tgttggttttcggaact

SEQ ID NO: 36250 - DNA, 18 bp, Homo sapiens
tgttggttttcggaactg

SEQ ID NO: 36251 - DNA, 19 bp, Homo sapiens
tgttggttttcggaactga

SEQ ID NO: 36252 - DNA, 20 bp, Homo sapiens
tgttggttttcggaactgag

SEQ ID NO: 36253 - DNA, 21 bp, Homo sapiens
tgttggttttcggaactgagg

SEQ ID NO: 36254 - DNA, 22 bp, Homo sapiens
tgttggttttcggaactgaggc

SEQ ID NO: 36255 - DNA, 23 bp, Homo sapiens
tgttggttttcggaactgaggcc

SEQ ID NO: 36256 - DNA, 24 bp, Homo sapiens
tgttggttttcggaactgaggcca

SEQ ID NO: 36257 - DNA, 25 bp, Homo sapiens
tgttggttttcggaactgaggccat

SEQ ID NO: 36258 - DNA, 26 bp, Homo sapiens
tgttggttttcggaactgaggccatg

SEQ ID NO: 36259 - DNA, 29 bp, Homo sapiens
tgttggttttcggaactgaggccatgatt

SEQ ID NO: 36260 - DNA, 16 bp, Homo sapiens
gttggttttcggaact

SEQ ID NO: 36261 - DNA, 17 bp, Homo sapiens
gttggttttcggaactg

SEQ ID NO: 36262 - DNA, 18 bp, Homo sapiens
gttggttttcggaactga

SEQ ID NO: 36263 - DNA, 19 bp, Homo sapiens
gttggttttcggaactgag

SEQ ID NO: 36264 - DNA, 20 bp, Homo sapiens
gttggttttcggaactgagg

SEQ ID NO: 36265 - DNA, 21 bp, Homo sapiens
gttggttttcggaactgaggc

SEQ ID NO: 36266 - DNA, 22 bp, Homo sapiens
gttggttttcggaactgaggcc

SEQ ID NO: 36267 - DNA, 23 bp, Homo sapiens
gttggttttcggaactgaggcca

SEQ ID NO: 36268 - DNA, 24 bp, Homo sapiens
gttggttttcggaactgaggccat

SEQ ID NO: 36269 - DNA, 25 bp, Homo sapiens
gttggttttcggaactgaggccatg

SEQ ID NO: 36270 - DNA, 26 bp, Homo sapiens
gttggttttcggaactgaggccatga

SEQ ID NO: 36271 - DNA, 27 bp, Homo sapiens
gttggttttcggaactgaggccatgat

SEQ ID NO: 36272 - DNA, 28 bp, Homo sapiens
gttggttttcggaactgaggccatgatt

SEQ ID NO: 36273 - DNA, 29 bp, Homo sapiens
gttggttttcggaactgaggccatgatta

SEQ ID NO: 36274 - DNA, 30 bp, Homo sapiens
gttggttttcggaactgaggccatgattaa

SEQ ID NO: 36275 - DNA, 16 bp, Homo sapiens
ttggttttcggaactg

SEQ ID NO: 36276 - DNA, 17 bp, Homo sapiens
ttggttttcggaactga

SEQ ID NO: 36277 - DNA, 18 bp, Homo sapiens
ttggttttcggaactgag

SEQ ID NO: 36278 - DNA, 19 bp, Homo sapiens
ttggttttcggaactgagg

SEQ ID NO: 36279 - DNA, 20 bp, Homo sapiens
ttggttttcggaactgaggc

SEQ ID NO: 36280 - DNA, 21 bp, Homo sapiens
ttggttttcggaactgaggcc

SEQ ID NO: 36281 - DNA, 22 bp, Homo sapiens
ttggttttcggaactgaggcca

SEQ ID NO: 36282 - DNA, 23 bp, Homo sapiens
ttggttttcggaactgaggccat

SEQ ID NO: 36283 - DNA, 24 bp, Homo sapiens
ttggttttcggaactgaggccatg

SEQ ID NO: 36284 - DNA, 30 bp, Homo sapiens
ttggttttcggaactgaggccatgattaag

SEQ ID NO: 36285 - DNA, 16 bp, Homo sapiens
tggttttcggaactga

SEQ ID NO: 36286 - DNA, 17 bp, Homo sapiens
tggttttcggaactgag

SEQ ID NO: 36287 - DNA, 18 bp, Homo sapiens
tggttttcggaactgagg

SEQ ID NO: 36288 - DNA, 19 bp, Homo sapiens
tggttttcggaactgaggc

SEQ ID NO: 36289 - DNA, 20 bp, Homo sapiens
tggttttcggaactgaggcc

SEQ ID NO: 36290 - DNA, 21 bp, Homo sapiens
tggttttcggaactgaggcca

SEQ ID NO: 36291 - DNA, 23 bp, Homo sapiens
tggttttcggaactgaggccatg

SEQ ID NO: 36292 - DNA, 24 bp, Homo sapiens
tggttttcggaactgaggccatga

SEQ ID NO: 36293 - DNA, 29 bp, Homo sapiens
tggttttcggaactgaggccatgattaag

SEQ ID NO: 36294 - DNA, 16 bp, Homo sapiens
ggttttcggaactgag

SEQ ID NO: 36295 - DNA, 17 bp, Homo sapiens
ggttttcggaactgagg

SEQ ID NO: 36296 - DNA, 18 bp, Homo sapiens
ggttttcggaactgaggc

SEQ ID NO: 36297 - DNA, 19 bp, Homo sapiens
ggttttcggaactgaggcc

SEQ ID NO: 36298 - DNA, 20 bp, Homo sapiens
ggttttcggaactgaggcca

SEQ ID NO: 36299 - DNA, 21 bp, Homo sapiens
ggttttcggaactgaggccat

SEQ ID NO: 36300 - DNA, 22 bp, Homo sapiens
ggttttcggaactgaggccatg

SEQ ID NO: 36301 - DNA, 23 bp, Homo sapiens
ggttttcggaactgaggccatga

SEQ ID NO: 36302 - DNA, 24 bp, Homo sapiens
ggttttcggaactgaggccatgat

SEQ ID NO: 36303 - DNA, 25 bp, Homo sapiens
ggttttcggaactgaggccatgatt

SEQ ID NO: 36304 - DNA, 28 bp, Homo sapiens
ggttttcggaactgaggccatgattaag

SEQ ID NO: 36305 - DNA, 30 bp, Homo sapiens
ggttttcggaactgaggccatgattaagag

SEQ ID NO: 36306 - DNA, 16 bp, Homo sapiens
gttttcggaactgagg

SEQ ID NO: 36307 - DNA, 17 bp, Homo sapiens
gttttcggaactgaggc

SEQ ID NO: 36308 - DNA, 18 bp, Homo sapiens
gttttcggaactgaggcc

SEQ ID NO: 36309 - DNA, 19 bp, Homo sapiens
gttttcggaactgaggcca

SEQ ID NO: 36310 - DNA, 20 bp, Homo sapiens
gttttcggaactgaggccat

SEQ ID NO: 36311 - DNA, 21 bp, Homo sapiens
gttttcggaactgaggccatg

SEQ ID NO: 36312 - DNA, 22 bp, Homo sapiens
gttttcggaactgaggccatga

SEQ ID NO: 36313 - DNA, 23 bp, Homo sapiens
gttttcggaactgaggccatgat

SEQ ID NO: 36314 - DNA, 24 bp, Homo sapiens
gttttcggaactgaggccatgatt

SEQ ID NO: 36315 - DNA, 25 bp, Homo sapiens
gttttcggaactgaggccatgatta

SEQ ID NO: 36316 - DNA, 26 bp, Homo sapiens
gttttcggaactgaggccatgattaa

SEQ ID NO: 36317 - DNA, 27 bp, Homo sapiens
gttttcggaactgaggccatgattaag

SEQ ID NO: 36318 - DNA, 28 bp, Homo sapiens
gttttcggaactgaggccatgattaaga

SEQ ID NO: 36319 - DNA, 29 bp, Homo sapiens
gttttcggaactgaggccatgattaagag

SEQ ID NO: 36320 - DNA, 30 bp, Homo sapiens
gttttcggaactgaggccatgattaagagg

SEQ ID NO: 36321 - DNA, 18 bp, Homo sapiens
ttttcggaactgaggcca

SEQ ID NO: 36322 - DNA, 19 bp, Homo sapiens
ttttcggaactgaggccat

SEQ ID NO: 36323 - DNA, 20 bp, Homo sapiens
ttttcggaactgaggccatg

SEQ ID NO: 36324 - DNA, 21 bp, Homo sapiens
ttttcggaactgaggccatga

SEQ ID NO: 36325 - DNA, 22 bp, Homo sapiens
ttttcggaactgaggccatgat

SEQ ID NO: 36326 - DNA, 23 bp, Homo sapiens
ttttcggaactgaggccatgatt

SEQ ID NO: 36327 - DNA, 24 bp, Homo sapiens
ttttcggaactgaggccatgatta

SEQ ID NO: 36328 - DNA, 25 bp, Homo sapiens
ttttcggaactgaggccatgattaa

SEQ ID NO: 36329 - DNA, 26 bp, Homo sapiens
ttttcggaactgaggccatgattaag

SEQ ID NO: 36330 - DNA, 27 bp, Homo sapiens
ttttcggaactgaggccatgattaaga

SEQ ID NO: 36331 - DNA, 28 bp, Homo sapiens
ttttcggaactgaggccatgattaagag

SEQ ID NO: 36332 - DNA, 29 bp, Homo sapiens
ttttcggaactgaggccatgattaagagg

SEQ ID NO: 36333 - DNA, 30 bp, Homo sapiens
ttttcggaactgaggccatgattaagaggg

SEQ ID NO: 36334 - DNA, 17 bp, Homo sapiens
tttcggaactgaggcca

SEQ ID NO: 36335 - DNA, 18 bp, Homo sapiens
tttcggaactgaggccat

SEQ ID NO: 36336 - DNA, 19 bp, Homo sapiens
tttcggaactgaggccatg

SEQ ID NO: 36337 - DNA, 20 bp, Homo sapiens
tttcggaactgaggccatga

SEQ ID NO: 36338 - DNA, 21 bp, Homo sapiens
tttcggaactgaggccatgat

SEQ ID NO: 36339 - DNA, 22 bp, Homo sapiens
tttcggaactgaggccatgatt

SEQ ID NO: 36340 - DNA, 23 bp, Homo sapiens
tttcggaactgaggccatgatta

SEQ ID NO: 36341 - DNA, 24 bp, Homo sapiens
tttcggaactgaggccatgattaa

SEQ ID NO: 36342 - DNA, 25 bp, Homo sapiens
tttcggaactgaggccatgattaag

SEQ ID NO: 36343 - DNA, 26 bp, Homo sapiens
tttcggaactgaggccatgattaaga

SEQ ID NO: 36344 - DNA, 27 bp, Homo sapiens
tttcggaactgaggccatgattaagag

SEQ ID NO: 36345 - DNA, 28 bp, Homo sapiens
tttcggaactgaggccatgattaagagg

SEQ ID NO: 36346 - DNA, 29 bp, Homo sapiens
tttcggaactgaggccatgattaagaggg

SEQ ID NO: 36347 - DNA, 16 bp, Homo sapiens
ttcggaactgaggcca

SEQ ID NO: 36348 - DNA, 17 bp, Homo sapiens
ttcggaactgaggccat

SEQ ID NO: 36349 - DNA, 18 bp, Homo sapiens
ttcggaactgaggccatg

SEQ ID NO: 36350 - DNA, 19 bp, Homo sapiens
ttcggaactgaggccatga

SEQ ID NO: 36351 - DNA, 20 bp, Homo sapiens
ttcggaactgaggccatgat

SEQ ID NO: 36352 - DNA, 21 bp, Homo sapiens
ttcggaactgaggccatgatt

SEQ ID NO: 36353 - DNA, 22 bp, Homo sapiens
ttcggaactgaggccatgatta

SEQ ID NO: 36354 - DNA, 23 bp, Homo sapiens
ttcggaactgaggccatgattaa

SEQ ID NO: 36355 - DNA, 24 bp, Homo sapiens
ttcggaactgaggccatgattaag

SEQ ID NO: 36356 - DNA, 25 bp, Homo sapiens
ttcggaactgaggccatgattaaga

SEQ ID NO: 36357 - DNA, 27 bp, Homo sapiens
ttcggaactgaggccatgattaagagg

SEQ ID NO: 36358 - DNA, 28 bp, Homo sapiens
ttcggaactgaggccatgattaagaggg

SEQ ID NO: 36359 - DNA, 30 bp, Homo sapiens
ttcggaactgaggccatgattaagagggac

SEQ ID NO: 36360 - DNA, 17 bp, Homo sapiens
tcggaactgaggccatg

SEQ ID NO: 36361 - DNA, 18 bp, Homo sapiens
tcggaactgaggccatga

SEQ ID NO: 36362 - DNA, 19 bp, Homo sapiens
tcggaactgaggccatgat

SEQ ID NO: 36363 - DNA, 20 bp, Homo sapiens
tcggaactgaggccatgatt

SEQ ID NO: 36364 - DNA, 21 bp, Homo sapiens
tcggaactgaggccatgatta

SEQ ID NO: 36365 - DNA, 22 bp, Homo sapiens
tcggaactgaggccatgattaa

SEQ ID NO: 36366 - DNA, 23 bp, Homo sapiens
tcggaactgaggccatgattaag

SEQ ID NO: 36367 - DNA, 24 bp, Homo sapiens
tcggaactgaggccatgattaaga

SEQ ID NO: 36368 - DNA, 26 bp, Homo sapiens
tcggaactgaggccatgattaagagg

SEQ ID NO: 36369 - DNA, 27 bp, Homo sapiens
tcggaactgaggccatgattaagaggg

SEQ ID NO: 36370 - DNA, 30 bp, Homo sapiens
tcggaactgaggccatgattaagagggacg

SEQ ID NO: 36371 - DNA, 16 bp, Homo sapiens
cggaactgaggccatg

SEQ ID NO: 36372 - DNA, 17 bp, Homo sapiens
cggaactgaggccatga

SEQ ID NO: 36373 - DNA, 18 bp, Homo sapiens
cggaactgaggccatgat

SEQ ID NO: 36374 - DNA, 22 bp, Homo sapiens
cggaactgaggccatgattaag

SEQ ID NO: 36375 - DNA, 24 bp, Homo sapiens
cggaactgaggccatgattaagag

SEQ ID NO: 36376 - DNA, 25 bp, Homo sapiens
cggaactgaggccatgattaagagg

SEQ ID NO: 36377 - DNA, 26 bp, Homo sapiens
cggaactgaggccatgattaagaggg

SEQ ID NO: 36378 - DNA, 21 bp, Homo sapiens
ggaactgaggccatgattaag

SEQ ID NO: 36379 - DNA, 24 bp, Homo sapiens
ggaactgaggccatgattaagagg

SEQ ID NO: 36380 - DNA, 20 bp, Homo sapiens
gaactgaggccatgattaag

SEQ ID NO: 36381 - DNA, 21 bp, Homo sapiens
gaactgaggccatgattaaga

SEQ ID NO: 36382 - DNA, 22 bp, Homo sapiens
gaactgaggccatgattaagag

SEQ ID NO: 36383 - DNA, 23 bp, Homo sapiens
gaactgaggccatgattaagagg

SEQ ID NO: 36384 - DNA, 24 bp, Homo sapiens
gaactgaggccatgattaagaggg

SEQ ID NO: 36385 - DNA, 25 bp, Homo sapiens
gaactgaggccatgattaagaggga

SEQ ID NO: 36386 - DNA, 26 bp, Homo sapiens
gaactgaggccatgattaagagggac

SEQ ID NO: 36387 - DNA, 27 bp, Homo sapiens
gaactgaggccatgattaagagggacg

SEQ ID NO: 36388 - DNA, 30 bp, Homo sapiens
gaactgaggccatgattaagagggacggcc

SEQ ID NO: 36389 - DNA, 18 bp, Homo sapiens
aactgaggccatgattaa

SEQ ID NO: 36390 - DNA, 19 bp, Homo sapiens
aactgaggccatgattaag

SEQ ID NO: 36391 - DNA, 20 bp, Homo sapiens
aactgaggccatgattaaga

SEQ ID NO: 36392 - DNA, 21 bp, Homo sapiens
aactgaggccatgattaagag

SEQ ID NO: 36393 - DNA, 22 bp, Homo sapiens
aactgaggccatgattaagagg

SEQ ID NO: 36394 - DNA, 23 bp, Homo sapiens
aactgaggccatgattaagaggg

SEQ ID NO: 36395 - DNA, 24 bp, Homo sapiens
aactgaggccatgattaagaggga

SEQ ID NO: 36396 - DNA, 25 bp, Homo sapiens
aactgaggccatgattaagagggac

SEQ ID NO: 36397 - DNA, 26 bp, Homo sapiens
aactgaggccatgattaagagggacg

SEQ ID NO: 36398 - DNA, 27 bp, Homo sapiens
aactgaggccatgattaagagggacgg

SEQ ID NO: 36399 - DNA, 30 bp, Homo sapiens
aactgaggccatgattaagagggacggccg

SEQ ID NO: 36400 - DNA, 18 bp, Homo sapiens
actgaggccatgattaag

SEQ ID NO: 36401 - DNA, 19 bp, Homo sapiens
actgaggccatgattaaga

SEQ ID NO: 36402 - DNA, 20 bp, Homo sapiens
actgaggccatgattaagag

SEQ ID NO: 36403 - DNA, 21 bp, Homo sapiens
actgaggccatgattaagagg

SEQ ID NO: 36404 - DNA, 22 bp, Homo sapiens
actgaggccatgattaagaggg

SEQ ID NO: 36405 - DNA, 23 bp, Homo sapiens
actgaggccatgattaagaggga

SEQ ID NO: 36406 - DNA, 24 bp, Homo sapiens
actgaggccatgattaagagggac

SEQ ID NO: 36407 - DNA, 25 bp, Homo sapiens
actgaggccatgattaagagggacg

SEQ ID NO: 36408 - DNA, 26 bp, Homo sapiens
actgaggccatgattaagagggacgg

SEQ ID NO: 36409 - DNA, 17 bp, Homo sapiens
ctgaggccatgattaag

SEQ ID NO: 36410 - DNA, 18 bp, Homo sapiens
ctgaggccatgattaaga

SEQ ID NO: 36411 - DNA, 19 bp, Homo sapiens
ctgaggccatgattaagag

SEQ ID NO: 36412 - DNA, 20 bp, Homo sapiens
ctgaggccatgattaagagg

SEQ ID NO: 36413 - DNA, 21 bp, Homo sapiens
ctgaggccatgattaagaggg

SEQ ID NO: 36414 - DNA, 22 bp, Homo sapiens
ctgaggccatgattaagaggga

SEQ ID NO: 36415 - DNA, 23 bp, Homo sapiens
ctgaggccatgattaagagggac

SEQ ID NO: 36416 - DNA, 24 bp, Homo sapiens
ctgaggccatgattaagagggacg

SEQ ID NO: 36417 - DNA, 25 bp, Homo sapiens
ctgaggccatgattaagagggacgg

SEQ ID NO: 36418 - DNA, 26 bp, Homo sapiens
tgaggccatgattaagagggacggcc

SEQ ID NO: 36419 - DNA, 17 bp, Homo sapiens
gaggccatgattaagag

SEQ ID NO: 36420 - DNA, 18 bp, Homo sapiens
gaggccatgattaagagg

SEQ ID NO: 36421 - DNA, 19 bp, Homo sapiens
gaggccatgattaagaggg

SEQ ID NO: 36422 - DNA, 20 bp, Homo sapiens
gaggccatgattaagaggga

SEQ ID NO: 36423 - DNA, 21 bp, Homo sapiens
gaggccatgattaagagggac

SEQ ID NO: 36424 - DNA, 22 bp, Homo sapiens
gaggccatgattaagagggacg

SEQ ID NO: 36425 - DNA, 23 bp, Homo sapiens
gaggccatgattaagagggacgg

SEQ ID NO: 36426 - DNA, 24 bp, Homo sapiens
gaggccatgattaagagggacggc

SEQ ID NO: 36427 - DNA, 25 bp, Homo sapiens
gaggccatgattaagagggacggcc

SEQ ID NO: 36428 - DNA, 26 bp, Homo sapiens
gaggccatgattaagagggacggccg

SEQ ID NO: 36429 - DNA, 28 bp, Homo sapiens
gaggccatgattaagagggacggccggg

SEQ ID NO: 36430 - DNA, 16 bp, Homo sapiens
aggccatgattaagag

SEQ ID NO: 36431 - DNA, 17 bp, Homo sapiens
aggccatgattaagagg

SEQ ID NO: 36432 - DNA, 18 bp, Homo sapiens
aggccatgattaagaggg

SEQ ID NO: 36433 - DNA, 19 bp, Homo sapiens
aggccatgattaagaggga

SEQ ID NO: 36434 - DNA, 20 bp, Homo sapiens
aggccatgattaagagggac

SEQ ID NO: 36435 - DNA, 21 bp, Homo sapiens
aggccatgattaagagggacg

SEQ ID NO: 36436 - DNA, 22 bp, Homo sapiens
aggccatgattaagagggacgg

SEQ ID NO: 36437 - DNA, 23 bp, Homo sapiens
aggccatgattaagagggacggc

SEQ ID NO: 36438 - DNA, 24 bp, Homo sapiens
aggccatgattaagagggacggcc

SEQ ID NO: 36439 - DNA, 25 bp, Homo sapiens
aggccatgattaagagggacggccg

SEQ ID NO: 36440 - DNA, 26 bp, Homo sapiens
aggccatgattaagagggacggccgg

SEQ ID NO: 36441 - DNA, 27 bp, Homo sapiens
aggccatgattaagagggacggccggg

SEQ ID NO: 36442 - DNA, 20 bp, Homo sapiens
ggccatgattaagagggacg

SEQ ID NO: 36443 - DNA, 23 bp, Homo sapiens
ggccatgattaagagggacggcc

SEQ ID NO: 36444 - DNA, 24 bp, Homo sapiens
ggccatgattaagagggacggccg

SEQ ID NO: 36445 - DNA, 25 bp, Homo sapiens
ggccatgattaagagggacggccgg

SEQ ID NO: 36446 - DNA, 26 bp, Homo sapiens
ggccatgattaagagggacggccggg

SEQ ID NO: 36447 - DNA, 30 bp, Homo sapiens
ccatgattaagagggacggccgggggcatt

SEQ ID NO: 36448 - DNA, 20 bp, Homo sapiens
catgattaagagggacggcc

SEQ ID NO: 36449 - DNA, 30 bp, Homo sapiens; identical to SEQ ID NO: 28955

SEQ ID NO: 36450 - DNA, 30 bp, Homo sapiens; identical to SEQ ID NO: 28956

SEQ ID NO: 36451 - DNA, 29 bp, Homo sapiens
tgattaagagggacggccgggggcattcg

SEQ ID NO: 36452 - DNA, 30 bp, Homo sapiens; identical to SEQ ID NO: 28957

SEQ ID NO: 36453 - DNA, 21 bp, Homo sapiens
gattaagagggacggccgggg

SEQ ID NO: 36454 - DNA, 29 bp, Homo sapiens
gattaagagggacggccgggggcattcgt

SEQ ID NO: 36455 - DNA, 20 bp, Homo sapiens
attaagagggacggccgggg

SEQ ID NO: 36456 - DNA, 21 bp, Homo sapiens
attaagagggacggccggggg

SEQ ID NO: 36457 - DNA, 28 bp, Homo sapiens
attaagagggacggccgggggcattcgt

SEQ ID NO: 36458 - DNA, 18 bp, Homo sapiens
agagggacggccgggggc

SEQ ID NO: 36459 - DNA, 19 bp, Homo sapiens
agagggacggccgggggca

SEQ ID NO: 36460 - DNA, 20 bp, Homo sapiens
agagggacggccgggggcat

SEQ ID NO: 36461 - DNA, 18 bp, Homo sapiens
gagggacggccgggggca

SEQ ID NO: 36462 - DNA, 17 bp, Homo sapiens
agggacggccgggggca

SEQ ID NO: 36463 - DNA, 16 bp, Homo sapiens
gggacggccgggggca

SEQ ID NO: 36464 - DNA, 17 bp, Homo sapiens
gggacggccgggggcat

SEQ ID NO: 36465 - DNA, 16 bp, Homo sapiens
gacggccgggggcatt

SEQ ID NO: 36466 - DNA, 22 bp, Homo sapiens
ggcattcgtattgcgccgctag

SEQ ID NO: 36467 - DNA, 21 bp, Homo sapiens
gcattcgtattgcgccgctag

SEQ ID NO: 36468 - DNA, 22 bp, Homo sapiens
gcattcgtattgcgccgctaga

SEQ ID NO: 36469 - DNA, 23 bp, Homo sapiens
gcattcgtattgcgccgctagag

SEQ ID NO: 36470 - DNA, 18 bp, Homo sapiens
cattcgtattgcgccgct

SEQ ID NO: 36471 - DNA, 19 bp, Homo sapiens
cattcgtattgcgccgcta

SEQ ID NO: 36472 - DNA, 20 bp, Homo sapiens
cattcgtattgcgccgctag

SEQ ID NO: 36473 - DNA, 21 bp, Homo sapiens
cattcgtattgcgccgctaga

SEQ ID NO: 36474 - DNA, 22 bp, Homo sapiens
cattcgtattgcgccgctagag

SEQ ID NO: 36475 - DNA, 23 bp, Homo sapiens
cattcgtattgcgccgctagagg

SEQ ID NO: 36476 - DNA, 20 bp, Homo sapiens
attcgtattgcgccgctaga

SEQ ID NO: 36477 - DNA, 21 bp, Homo sapiens
attcgtattgcgccgctagag

SEQ ID NO: 36478 - DNA, 22 bp, Homo sapiens
attcgtattgcgccgctagagg

SEQ ID NO: 36479 - DNA, 23 bp, Homo sapiens
attcgtattgcgccgctagaggt

SEQ ID NO: 36480 - DNA, 18 bp, Homo sapiens
ttcgtattgcgccgctag

SEQ ID NO: 36481 - DNA, 19 bp, Homo sapiens
ttcgtattgcgccgctaga

SEQ ID NO: 36482 - DNA, 20 bp, Homo sapiens
ttcgtattgcgccgctagag

SEQ ID NO: 36483 - DNA, 17 bp, Homo sapiens
tcgtattgcgccgctag

SEQ ID NO: 36484 - DNA, 18 bp, Homo sapiens
tcgtattgcgccgctaga

SEQ ID NO: 36485 - DNA, 19 bp, Homo sapiens
tcgtattgcgccgctagag

SEQ ID NO: 36486 - DNA, 20 bp, Homo sapiens
cgtattgcgccgctagaggt

SEQ ID NO: 36487 - DNA, 30 bp, Homo sapiens
cgtattgcgccgctagaggtgaaattcttg

SEQ ID NO: 36488 - DNA, 21 bp, Homo sapiens
gtattgcgccgctagaggtga

SEQ ID NO: 36489 - DNA, 22 bp, Homo sapiens
gtattgcgccgctagaggtgaa

SEQ ID NO: 36490 - DNA, 30 bp, Homo sapiens
gtattgcgccgctagaggtgaaattcttgg

SEQ ID NO: 36491 - DNA, 22 bp, Homo sapiens
attgcgccgctagaggtgaaat

SEQ ID NO: 36492 - DNA, 30 bp, Homo sapiens; identical to SEQ ID NO: 14053

SEQ ID NO: 36493 - DNA, 29 bp, Homo sapiens
cgccgctagaggtgaaattcttggaccgg

SEQ ID NO: 36494 - DNA, 27 bp, Homo sapiens
ccgctagaggtgaaattcttggaccgg

SEQ ID NO: 36495 - DNA, 26 bp, Homo sapiens
cgctagaggtgaaattcttggaccgg

SEQ ID NO: 36496 - DNA, 24 bp, Homo sapiens
gctagaggtgaaattcttggaccg

SEQ ID NO: 36497 - DNA, 25 bp, Homo sapiens
gctagaggtgaaattcttggaccgg

SEQ ID NO: 36498 - DNA, 22 bp, Homo sapiens
ctagaggtgaaattcttggacc

SEQ ID NO: 36499 - DNA, 23 bp, Homo sapiens
ctagaggtgaaattcttggaccg

SEQ ID NO: 36500 - DNA, 24 bp, Homo sapiens
ctagaggtgaaattcttggaccgg

SEQ ID NO: 36501 - DNA, 25 bp, Homo sapiens
ctagaggtgaaattcttggaccggc

SEQ ID NO: 36502 - DNA, 26 bp, Homo sapiens
ctagaggtgaaattcttggaccggcg

SEQ ID NO: 36503 - DNA, 23 bp, Homo sapiens
tagaggtgaaattcttggaccgg

SEQ ID NO: 36504 - DNA, 20 bp, Homo sapiens
agaggtgaaattcttggacc

SEQ ID NO: 36505 - DNA, 21 bp, Homo sapiens
agaggtgaaattcttggaccg

SEQ ID NO: 36506 - DNA, 22 bp, Homo sapiens
agaggtgaaattcttggaccgg

SEQ ID NO: 36507 - DNA, 23 bp, Homo sapiens
agaggtgaaattcttggaccggc

SEQ ID NO: 36508 - DNA, 24 bp, Homo sapiens
agaggtgaaattcttggaccggcg

SEQ ID NO: 36509 - DNA, 25 bp, Homo sapiens
agaggtgaaattcttggaccggcgc

SEQ ID NO: 36510 - DNA, 26 bp, Homo sapiens
agaggtgaaattcttggaccggcgca

SEQ ID NO: 36511 - DNA, 27 bp, Homo sapiens
agaggtgaaattcttggaccggcgcaa

SEQ ID NO: 36512 - DNA, 28 bp, Homo sapiens
agaggtgaaattcttggaccggcgcaag

SEQ ID NO: 36513 - DNA, 30 bp, Homo sapiens; identical to SEQ ID NO: 2482

SEQ ID NO: 36514 - DNA, 18 bp, Homo sapiens
gaggtgaaattcttggac

SEQ ID NO: 36515 - DNA, 19 bp, Homo sapiens
gaggtgaaattcttggacc

SEQ ID NO: 36516 - DNA, 20 bp, Homo sapiens
gaggtgaaattcttggaccg

SEQ ID NO: 36517 - DNA, 21 bp, Homo sapiens
gaggtgaaattcttggaccgg

SEQ ID NO: 36518 - DNA, 22 bp, Homo sapiens
gaggtgaaattcttggaccggc

SEQ ID NO: 36519 - DNA, 23 bp, Homo sapiens
gaggtgaaattcttggaccggcg

SEQ ID NO: 36520 - DNA, 24 bp, Homo sapiens
gaggtgaaattcttggaccggcgc

SEQ ID NO: 36521 - DNA, 25 bp, Homo sapiens
gaggtgaaattcttggaccggcgca

SEQ ID NO: 36522 - DNA, 26 bp, Homo sapiens
gaggtgaaattcttggaccggcgcaa

SEQ ID NO: 36523 - DNA, 27 bp, Homo sapiens
gaggtgaaattcttggaccggcgcaag

SEQ ID NO: 36524 - DNA, 28 bp, Homo sapiens
gaggtgaaattcttggaccggcgcaaga

SEQ ID NO: 36525 - DNA, 29 bp, Homo sapiens
gaggtgaaattcttggaccggcgcaagac

SEQ ID NO: 36526 - DNA, 30 bp, Homo sapiens
gaggtgaaattcttggaccggcgcaagacg

SEQ ID NO: 36527 - DNA, 17 bp, Homo sapiens
aggtgaaattcttggac

SEQ ID NO: 36528 - DNA, 18 bp, Homo sapiens
aggtgaaattcttggacc

SEQ ID NO: 36529 - DNA, 19 bp, Homo sapiens
aggtgaaattcttggaccg

SEQ ID NO: 36530 - DNA, 20 bp, Homo sapiens
aggtgaaattcttggaccgg

SEQ ID NO: 36531 - DNA, 21 bp, Homo sapiens
aggtgaaattcttggaccggc

SEQ ID NO: 36532 - DNA, 22 bp, Homo sapiens
aggtgaaattcttggaccggcg

SEQ ID NO: 36533 - DNA, 23 bp, Homo sapiens
aggtgaaattcttggaccggcgc

SEQ ID NO: 36534 - DNA, 24 bp, Homo sapiens
aggtgaaattcttggaccggcgca

SEQ ID NO: 36535 - DNA, 25 bp, Homo sapiens
aggtgaaattcttggaccggcgcaa

SEQ ID NO: 36536 - DNA, 26 bp, Homo sapiens
aggtgaaattcttggaccggcgcaag

SEQ ID NO: 36537 - DNA, 29 bp, Homo sapiens
aggtgaaattcttggaccggcgcaagacg

SEQ ID NO: 36538 - DNA, 30 bp, Homo sapiens; identical to SEQ ID NO: 14090

SEQ ID NO: 36539 - DNA, 17 bp, Homo sapiens
ggtgaaattcttggacc

SEQ ID NO: 36540 - DNA, 18 bp, Homo sapiens
ggtgaaattcttggaccg

SEQ ID NO: 36541 - DNA, 19 bp, Homo sapiens
ggtgaaattcttggaccgg

SEQ ID NO: 36542 - DNA, 20 bp, Homo sapiens
ggtgaaattcttggaccggc

SEQ ID NO: 36543 - DNA, 21 bp, Homo sapiens
ggtgaaattcttggaccggcg

SEQ ID NO: 36544 - DNA, 22 bp, Homo sapiens
ggtgaaattcttggaccggcgc

SEQ ID NO: 36545 - DNA, 23 bp, Homo sapiens
ggtgaaattcttggaccggcgca

SEQ ID NO: 36546 - DNA, 24 bp, Homo sapiens
ggtgaaattcttggaccggcgcaa

SEQ ID NO: 36547 - DNA, 25 bp, Homo sapiens
ggtgaaattcttggaccggcgcaag

SEQ ID NO: 36548 - DNA, 26 bp, Homo sapiens
ggtgaaattcttggaccggcgcaaga

SEQ ID NO: 36549 - DNA, 28 bp, Homo sapiens
ggtgaaattcttggaccggcgcaagacg

SEQ ID NO: 36550 - DNA, 29 bp, Homo sapiens
ggtgaaattcttggaccggcgcaagacgg

SEQ ID NO: 36551 - DNA, 16 bp, Homo sapiens
gtgaaattcttggacc

SEQ ID NO: 36552 - DNA, 17 bp, Homo sapiens
gtgaaattcttggaccg

SEQ ID NO: 36553 - DNA, 18 bp, Homo sapiens
gtgaaattcttggaccgg

SEQ ID NO: 36554 - DNA, 19 bp, Homo sapiens
gtgaaattcttggaccggc

SEQ ID NO: 36555 - DNA, 20 bp, Homo sapiens
gtgaaattcttggaccggcg

SEQ ID NO: 36556 - DNA, 21 bp, Homo sapiens
gtgaaattcttggaccggcgc

SEQ ID NO: 36557 - DNA, 22 bp, Homo sapiens
gtgaaattcttggaccggcgca

SEQ ID NO: 36558 - DNA, 23 bp, Homo sapiens
gtgaaattcttggaccggcgcaa

SEQ ID NO: 36559 - DNA, 24 bp, Homo sapiens
gtgaaattcttggaccggcgcaag

SEQ ID NO: 36560 - DNA, 26 bp, Homo sapiens
gtgaaattcttggaccggcgcaagac

SEQ ID NO: 36561 - DNA, 27 bp, Homo sapiens
gtgaaattcttggaccggcgcaagacg

SEQ ID NO: 36562 - DNA, 28 bp, Homo sapiens
gtgaaattcttggaccggcgcaagacgg

SEQ ID NO: 36563 - DNA, 29 bp, Homo sapiens
gtgaaattcttggaccggcgcaagacgga

SEQ ID NO: 36564 - DNA, 30 bp, Homo sapiens; identical to SEQ ID NO: 2488

SEQ ID NO: 36565 - DNA, 16 bp, Homo sapiens
tgaaattcttggaccg

SEQ ID NO: 36566 - DNA, 17 bp, Homo sapiens
tgaaattcttggaccgg

SEQ ID NO: 36567 - DNA, 18 bp, Homo sapiens
tgaaattcttggaccggc

SEQ ID NO: 36568 - DNA, 19 bp, Homo sapiens
tgaaattcttggaccggcg

SEQ ID NO: 36569 - DNA, 20 bp, Homo sapiens
tgaaattcttggaccggcgc

SEQ ID NO: 36570 - DNA, 21 bp, Homo sapiens
tgaaattcttggaccggcgca

SEQ ID NO: 36571 - DNA, 22 bp, Homo sapiens
tgaaattcttggaccggcgcaa

SEQ ID NO: 36572 - DNA, 23 bp, Homo sapiens
tgaaattcttggaccggcgcaag

SEQ ID NO: 36573 - DNA, 26 bp, Homo sapiens
tgaaattcttggaccggcgcaagacg

SEQ ID NO: 36574 - DNA, 27 bp, Homo sapiens
tgaaattcttggaccggcgcaagacgg

SEQ ID NO: 36575 - DNA, 28 bp, Homo sapiens
tgaaattcttggaccggcgcaagacgga

SEQ ID NO: 36576 - DNA, 30 bp, Homo sapiens
tgaaattcttggaccggcgcaagacggacc

SEQ ID NO: 36577 - DNA, 16 bp, Homo sapiens
gaaattcttggaccgg

SEQ ID NO: 36578 - DNA, 17 bp, Homo sapiens
gaaattcttggaccggc

SEQ ID NO: 36579 - DNA, 18 bp, Homo sapiens
gaaattcttggaccggcg

SEQ ID NO: 36580 - DNA, 19 bp, Homo sapiens
gaaattcttggaccggcgc

SEQ ID NO: 36581 - DNA, 20 bp, Homo sapiens
gaaattcttggaccggcgca

SEQ ID NO: 36582 - DNA, 21 bp, Homo sapiens
gaaattcttggaccggcgcaa

SEQ ID NO: 36583 - DNA, 22 bp, Homo sapiens
gaaattcttggaccggcgcaag

SEQ ID NO: 36584 - DNA, 25 bp, Homo sapiens
gaaattcttggaccggcgcaagacg

SEQ ID NO: 36585 - DNA, 26 bp, Homo sapiens
gaaattcttggaccggcgcaagacgg

SEQ ID NO: 36586 - DNA, 27 bp, Homo sapiens
gaaattcttggaccggcgcaagacgga

SEQ ID NO: 36587 - DNA, 28 bp, Homo sapiens
gaaattcttggaccggcgcaagacggac

SEQ ID NO: 36588 - DNA, 29 bp, Homo sapiens
gaaattcttggaccggcgcaagacggacc

SEQ ID NO: 36589 - DNA, 17 bp, Homo sapiens
aaattcttggaccggcg

SEQ ID NO: 36590 - DNA, 19 bp, Homo sapiens
aaattcttggaccggcgca

SEQ ID NO: 36591 - DNA, 20 bp, Homo sapiens
aaattcttggaccggcgcaa

SEQ ID NO: 36592 - DNA, 21 bp, Homo sapiens
aaattcttggaccggcgcaag

SEQ ID NO: 36593 - DNA, 24 bp, Homo sapiens
aaattcttggaccggcgcaagacg

SEQ ID NO: 36594 - DNA, 25 bp, Homo sapiens
aaattcttggaccggcgcaagacgg

SEQ ID NO: 36595 - DNA, 26 bp, Homo sapiens
aaattcttggaccggcgcaagacgga

SEQ ID NO: 36596 - DNA, 27 bp, Homo sapiens
aaattcttggaccggcgcaagacggac

SEQ ID NO: 36597 - DNA, 30 bp, Homo sapiens
aaattcttggaccggcgcaagacggaccag

SEQ ID NO: 36598 - DNA, 16 bp, Homo sapiens
aattcttggaccggcg

SEQ ID NO: 36599 - DNA, 18 bp, Homo sapiens
aattcttggaccggcgca

SEQ ID NO: 36600 - DNA, 19 bp, Homo sapiens
aattcttggaccggcgcaa

SEQ ID NO: 36601 - DNA, 20 bp, Homo sapiens
aattcttggaccggcgcaag

SEQ ID NO: 36602 - DNA, 23 bp, Homo sapiens
aattcttggaccggcgcaagacg

SEQ ID NO: 36603 - DNA, 24 bp, Homo sapiens
aattcttggaccggcgcaagacgg

SEQ ID NO: 36604 - DNA, 25 bp, Homo sapiens
aattcttggaccggcgcaagacgga

SEQ ID NO: 36605 - DNA, 26 bp, Homo sapiens
aattcttggaccggcgcaagacggac

SEQ ID NO: 36606 - DNA, 29 bp, Homo sapiens
aattcttggaccggcgcaagacggaccag

SEQ ID NO: 36607 - DNA, 17 bp, Homo sapiens
attcttggaccggcgca

SEQ ID NO: 36608 - DNA, 18 bp, Homo sapiens
attcttggaccggcgcaa

SEQ ID NO: 36609 - DNA, 19 bp, Homo sapiens
attcttggaccggcgcaag

SEQ ID NO: 36610 - DNA, 22 bp, Homo sapiens
attcttggaccggcgcaagacg

SEQ ID NO: 36611 - DNA, 23 bp, Homo sapiens
attcttggaccggcgcaagacgg

SEQ ID NO: 36612 - DNA, 24 bp, Homo sapiens
attcttggaccggcgcaagacgga

SEQ ID NO: 36613 - DNA, 25 bp, Homo sapiens
attcttggaccggcgcaagacggac

SEQ ID NO: 36614 - DNA, 26 bp, Homo sapiens
attcttggaccggcgcaagacggacc

SEQ ID NO: 36615 - DNA, 27 bp, Homo sapiens
attcttggaccggcgcaagacggacca

SEQ ID NO: 36616 - DNA, 28 bp, Homo sapiens
attcttggaccggcgcaagacggaccag

SEQ ID NO: 36617 - DNA, 16 bp, Homo sapiens
ttcttggaccggcgca

SEQ ID NO: 36618 - DNA, 17 bp, Homo sapiens
ttcttggaccggcgcaa

SEQ ID NO: 36619 - DNA, 18 bp, Homo sapiens
ttcttggaccggcgcaag

SEQ ID NO: 36620 - DNA, 20 bp, Homo sapiens
ttcttggaccggcgcaagac

SEQ ID NO: 36621 - DNA, 21 bp, Homo sapiens
ttcttggaccggcgcaagacg

SEQ ID NO: 36622 - DNA, 22 bp, Homo sapiens
ttcttggaccggcgcaagacgg

SEQ ID NO: 36623 - DNA, 23 bp, Homo sapiens
ttcttggaccggcgcaagacgga

SEQ ID NO: 36624 - DNA, 24 bp, Homo sapiens
ttcttggaccggcgcaagacggac

SEQ ID NO: 36625 - DNA, 25 bp, Homo sapiens
ttcttggaccggcgcaagacggacc

SEQ ID NO: 36626 - DNA, 26 bp, Homo sapiens
ttcttggaccggcgcaagacggacca

SEQ ID NO: 36627 - DNA, 27 bp, Homo sapiens
ttcttggaccggcgcaagacggaccag

SEQ ID NO: 36628 - DNA, 28 bp, Homo sapiens
ttcttggaccggcgcaagacggaccaga

SEQ ID NO: 36629 - DNA, 17 bp, Homo sapiens
tcttggaccggcgcaag

SEQ ID NO: 36630 - DNA, 20 bp, Homo sapiens
tcttggaccggcgcaagacg

SEQ ID NO: 36631 - DNA, 22 bp, Homo sapiens
tcttggaccggcgcaagacgga

SEQ ID NO: 36632 - DNA, 24 bp, Homo sapiens
tcttggaccggcgcaagacggacc

SEQ ID NO: 36633 - DNA, 25 bp, Homo sapiens
tcttggaccggcgcaagacggacca

SEQ ID NO: 36634 - DNA, 26 bp, Homo sapiens
tcttggaccggcgcaagacggaccag

SEQ ID NO: 36635 - DNA, 27 bp, Homo sapiens
tcttggaccggcgcaagacggaccaga

SEQ ID NO: 36636 - DNA, 30 bp, Homo sapiens
tcttggaccggcgcaagacggaccagagcg

SEQ ID NO: 36637 - DNA, 19 bp, Homo sapiens
cttggaccggcgcaagacg

SEQ ID NO: 36638 - DNA, 20 bp, Homo sapiens
cttggaccggcgcaagacgg

SEQ ID NO: 36639 - DNA, 21 bp, Homo sapiens
cttggaccggcgcaagacgga

SEQ ID NO: 36640 - DNA, 22 bp, Homo sapiens
cttggaccggcgcaagacggac

SEQ ID NO: 36641 - DNA, 23 bp, Homo sapiens
cttggaccggcgcaagacggacc

SEQ ID NO: 36642 - DNA, 24 bp, Homo sapiens
cttggaccggcgcaagacggacca

SEQ ID NO: 36643 - DNA, 25 bp, Homo sapiens
cttggaccggcgcaagacggaccag

SEQ ID NO: 36644 - DNA, 20 bp, Homo sapiens
accggcgcaagacggaccag

SEQ ID NO: 36645 - DNA, 19 bp, Homo sapiens
ccggcgcaagacggaccag

SEQ ID NO: 36646 - DNA, 28 bp, Homo sapiens
ccggcgcaagacggaccagagcgaaagc

SEQ ID NO: 36647 - DNA, 18 bp, Homo sapiens
cggcgcaagacggaccag

SEQ ID NO: 36648 - DNA, 16 bp, Homo sapiens
gcgcaagacggaccag

SEQ ID NO: 36649 - DNA, 17 bp, Homo sapiens
gcgcaagacggaccaga

SEQ ID NO: 36650 - DNA, 16 bp, Homo sapiens
cgcaagacggaccaga

SEQ ID NO: 36651 - DNA, 17 bp, Homo sapiens
cgcaagacggaccagag

SEQ ID NO: 36652 - DNA, 21 bp, Homo sapiens
cgcaagacggaccagagcgaa

SEQ ID NO: 36653 - DNA, 22 bp, Homo sapiens
cgcaagacggaccagagcgaaa

SEQ ID NO: 36654 - DNA, 23 bp, Homo sapiens
cgcaagacggaccagagcgaaag

SEQ ID NO: 36655 - DNA, 24 bp, Homo sapiens
cgcaagacggaccagagcgaaagc

SEQ ID NO: 36656 - DNA, 25 bp, Homo sapiens
cgcaagacggaccagagcgaaagca

SEQ ID NO: 36657 - DNA, 21 bp, Homo sapiens
gcaagacggaccagagcgaaa

SEQ ID NO: 36658 - DNA, 17 bp, Homo sapiens
caagacggaccagagcg

SEQ ID NO: 36659 - DNA, 18 bp, Homo sapiens
caagacggaccagagcga

SEQ ID NO: 36660 - DNA, 19 bp, Homo sapiens
caagacggaccagagcgaa

SEQ ID NO: 36661 - DNA, 20 bp, Homo sapiens
caagacggaccagagcgaaa

SEQ ID NO: 36662 - DNA, 21 bp, Homo sapiens
caagacggaccagagcgaaag

SEQ ID NO: 36663 - DNA, 22 bp, Homo sapiens
caagacggaccagagcgaaagc

SEQ ID NO: 36664 - DNA, 23 bp, Homo sapiens
caagacggaccagagcgaaagca

SEQ ID NO: 36665 - DNA, 24 bp, Homo sapiens
caagacggaccagagcgaaagcat

SEQ ID NO: 36666 - DNA, 25 bp, Homo sapiens
caagacggaccagagcgaaagcatt

SEQ ID NO: 36667 - DNA, 18 bp, Homo sapiens
aagacggaccagagcgaa

SEQ ID NO: 36668 - DNA, 19 bp, Homo sapiens
aagacggaccagagcgaaa

SEQ ID NO: 36669 - DNA, 20 bp, Homo sapiens
aagacggaccagagcgaaag

SEQ ID NO: 36670 - DNA, 21 bp, Homo sapiens
aagacggaccagagcgaaagc

SEQ ID NO: 36671 - DNA, 22 bp, Homo sapiens
aagacggaccagagcgaaagca

SEQ ID NO: 36672 - DNA, 17 bp, Homo sapiens
agacggaccagagcgaa

SEQ ID NO: 36673 - DNA, 18 bp, Homo sapiens
agacggaccagagcgaaa

SEQ ID NO: 36674 - DNA, 19 bp, Homo sapiens
agacggaccagagcgaaag

SEQ ID NO: 36675 - DNA, 20 bp, Homo sapiens
agacggaccagagcgaaagc

SEQ ID NO: 36676 - DNA, 21 bp, Homo sapiens
agacggaccagagcgaaagca

SEQ ID NO: 36677 - DNA, 22 bp, Homo sapiens
agacggaccagagcgaaagcat

SEQ ID NO: 36678 - DNA, 23 bp, Homo sapiens
agacggaccagagcgaaagcatt

SEQ ID NO: 36679 - DNA, 17 bp, Homo sapiens
gacggaccagagcgaaa

SEQ ID NO: 36680 - DNA, 18 bp, Homo sapiens
gacggaccagagcgaaag

SEQ ID NO: 36681 - DNA, 19 bp, Homo sapiens
gacggaccagagcgaaagc

SEQ ID NO: 36682 - DNA, 20 bp, Homo sapiens
gacggaccagagcgaaagca

SEQ ID NO: 36683 - DNA, 21 bp, Homo sapiens
gacggaccagagcgaaagcat

SEQ ID NO: 36684 - DNA, 22 bp, Homo sapiens
gacggaccagagcgaaagcatt

SEQ ID NO: 36685 - DNA, 16 bp, Homo sapiens
acggaccagagcgaaa

SEQ ID NO: 36686 - DNA, 17 bp, Homo sapiens
acggaccagagcgaaag

SEQ ID NO: 36687 - DNA, 18 bp, Homo sapiens
acggaccagagcgaaagc

SEQ ID NO: 36688 - DNA, 19 bp, Homo sapiens
acggaccagagcgaaagca

SEQ ID NO: 36689 - DNA, 20 bp, Homo sapiens
acggaccagagcgaaagcat

SEQ ID NO: 36690 - DNA, 21 bp, Homo sapiens
acggaccagagcgaaagcatt

SEQ ID NO: 36691 - DNA, 25 bp, Homo sapiens
acggaccagagcgaaagcatttgcc

SEQ ID NO: 36692 - DNA, 16 bp, Homo sapiens
cggaccagagcgaaag

SEQ ID NO: 36693 - DNA, 17 bp, Homo sapiens
cggaccagagcgaaagc

SEQ ID NO: 36694 - DNA, 18 bp, Homo sapiens
cggaccagagcgaaagca

SEQ ID NO: 36695 - DNA, 20 bp, Homo sapiens
cggaccagagcgaaagcatt

SEQ ID NO: 36696 - DNA, 22 bp, Homo sapiens
cggaccagagcgaaagcatttg

SEQ ID NO: 36697 - DNA, 24 bp, Homo sapiens
cggaccagagcgaaagcatttgcc

SEQ ID NO: 36698 - DNA, 16 bp, Homo sapiens
ggaccagagcgaaagc

SEQ ID NO: 36699 - DNA, 21 bp, Homo sapiens
gaccagagcgaaagcatttgc

SEQ ID NO: 36700 - DNA, 22 bp, Homo sapiens
gaccagagcgaaagcatttgcc

SEQ ID NO: 36701 - DNA, 24 bp, Homo sapiens
accagagcgaaagcatttgccaag

SEQ ID NO: 36702 - DNA, 23 bp, Homo sapiens
ccagagcgaaagcatttgccaag

SEQ ID NO: 36703 - DNA, 16 bp, Homo sapiens
agagcgaaagcatttg

SEQ ID NO: 36704 - DNA, 18 bp, Homo sapiens
agagcgaaagcatttgcc

SEQ ID NO: 36705 - DNA, 19 bp, Homo sapiens
agagcgaaagcatttgcca

SEQ ID NO: 36706 - DNA, 20 bp, Homo sapiens
agagcgaaagcatttgccaa

SEQ ID NO: 36707 - DNA, 21 bp, Homo sapiens
agagcgaaagcatttgccaag

SEQ ID NO: 36708 - DNA, 22 bp, Homo sapiens
agagcgaaagcatttgccaaga

SEQ ID NO: 36709 - DNA, 23 bp, Homo sapiens
agagcgaaagcatttgccaagaa

SEQ ID NO: 36710 - DNA, 24 bp, Homo sapiens
agagcgaaagcatttgccaagaat

SEQ ID NO: 36711 - DNA, 25 bp, Homo sapiens
agagcgaaagcatttgccaagaatg

SEQ ID NO: 36712 - DNA, 27 bp, Homo sapiens
agagcgaaagcatttgccaagaatgtt

SEQ ID NO: 36713 - DNA, 29 bp, Homo sapiens
agagcgaaagcatttgccaagaatgtttt

SEQ ID NO: 36714 - DNA, 30 bp, Homo sapiens
agagcgaaagcatttgccaagaatgttttc

SEQ ID NO: 36715 - DNA, 17 bp, Homo sapiens
gagcgaaagcatttgcc

SEQ ID NO: 36716 - DNA, 20 bp, Homo sapiens
gagcgaaagcatttgccaag

SEQ ID NO: 36717 - DNA, 24 bp, Homo sapiens
gagcgaaagcatttgccaagaatg

SEQ ID NO: 36718 - DNA, 29 bp, Homo sapiens
gagcgaaagcatttgccaagaatgttttc

SEQ ID NO: 36719 - DNA, 16 bp, Homo sapiens
agcgaaagcatttgcc

SEQ ID NO: 36720 - DNA, 18 bp, Homo sapiens
agcgaaagcatttgccaa

SEQ ID NO: 36721 - DNA, 19 bp, Homo sapiens
agcgaaagcatttgccaag

SEQ ID NO: 36722 - DNA, 20 bp, Homo sapiens
agcgaaagcatttgccaaga

SEQ ID NO: 36723 - DNA, 22 bp, Homo sapiens
agcgaaagcatttgccaagaat

SEQ ID NO: 36724 - DNA, 23 bp, Homo sapiens
agcgaaagcatttgccaagaatg

SEQ ID NO: 36725 - DNA, 18 bp, Homo sapiens
gcgaaagcatttgccaag

SEQ ID NO: 36726 - DNA, 24 bp, Homo sapiens
gcgaaagcatttgccaagaatgtt

SEQ ID NO: 36727 - DNA, 17 bp, Homo sapiens
cgaaagcatttgccaag

SEQ ID NO: 36728 - DNA, 29 bp, Homo sapiens
gcatttgccaagaatgttttcattaatca

SEQ ID NO: 36729 - DNA, 19 bp, Homo sapiens
atttgccaagaatgttttc

SEQ ID NO: 36730 - DNA, 22 bp, Homo sapiens
atttgccaagaatgttttcatt

SEQ ID NO: 36731 - DNA, 16 bp, Homo sapiens
tgccaagaatgttttc

SEQ ID NO: 36732 - DNA, 18 bp, Homo sapiens
tgccaagaatgttttcat

SEQ ID NO: 36733 - DNA, 19 bp, Homo sapiens
tgccaagaatgttttcatt

SEQ ID NO: 36734 - DNA, 22 bp, Homo sapiens
tgccaagaatgttttcattaat

SEQ ID NO: 36735 - DNA, 23 bp, Homo sapiens
tgccaagaatgttttcattaatc

SEQ ID NO: 36736 - DNA, 24 bp, Homo sapiens
tgccaagaatgttttcattaatca

SEQ ID NO: 36737 - DNA, 26 bp, Homo sapiens
tgccaagaatgttttcattaatcaag

SEQ ID NO: 36738 - DNA, 30 bp, Homo sapiens
tgccaagaatgttttcattaatcaagaacg

SEQ ID NO: 36739 - DNA, 30 bp, Homo sapiens
gaatgttttcattaatcaagaacgaaagtc

SEQ ID NO: 36740 - DNA, 30 bp, Homo sapiens
aatgttttcattaatcaagaacgaaagtcg

SEQ ID NO: 36741 - DNA, 30 bp, Homo sapiens
atgttttcattaatcaagaacgaaagtcgg

SEQ ID NO: 36742 - DNA, 17 bp, Homo sapiens
tgttttcattaatcaag

SEQ ID NO: 36743 - DNA, 29 bp, Homo sapiens
tgttttcattaatcaagaacgaaagtcgg

SEQ ID NO: 36744 - DNA, 30 bp, Homo sapiens; identical to SEQ ID NO: 28973

SEQ ID NO: 36745 - DNA, 27 bp, Homo sapiens
ttttcattaatcaagaacgaaagtcgg

SEQ ID NO: 36746 - DNA, 30 bp, Homo sapiens
ttttcattaatcaagaacgaaagtcggagg

SEQ ID NO: 36747 - DNA, 26 bp, Homo sapiens
tttcattaatcaagaacgaaagtcgg

SEQ ID NO: 36748 - DNA, 28 bp, Homo sapiens
tttcattaatcaagaacgaaagtcggag

SEQ ID NO: 36749 - DNA, 29 bp, Homo sapiens
tttcattaatcaagaacgaaagtcggagg

SEQ ID NO: 36750 - DNA, 24 bp, Homo sapiens
ttcattaatcaagaacgaaagtcg

SEQ ID NO: 36751 - DNA, 25 bp, Homo sapiens
ttcattaatcaagaacgaaagtcgg

SEQ ID NO: 36752 - DNA, 26 bp, Homo sapiens
ttcattaatcaagaacgaaagtcgga

SEQ ID NO: 36753 - DNA, 27 bp, Homo sapiens
ttcattaatcaagaacgaaagtcggag

SEQ ID NO: 36754 - DNA, 28 bp, Homo sapiens
ttcattaatcaagaacgaaagtcggagg

SEQ ID NO: 36755 - DNA, 30 bp, Homo sapiens
ttcattaatcaagaacgaaagtcggaggtt

SEQ ID NO: 36756 - DNA, 24 bp, Homo sapiens
tcattaatcaagaacgaaagtcgg

SEQ ID NO: 36757 - DNA, 26 bp, Homo sapiens
tcattaatcaagaacgaaagtcggag

SEQ ID NO: 36758 - DNA, 27 bp, Homo sapiens
tcattaatcaagaacgaaagtcggagg

SEQ ID NO: 36759 - DNA, 22 bp, Homo sapiens
cattaatcaagaacgaaagtcg

SEQ ID NO: 36760 - DNA, 23 bp, Homo sapiens
cattaatcaagaacgaaagtcgg

SEQ ID NO: 36761 - DNA, 24 bp, Homo sapiens
cattaatcaagaacgaaagtcgga

SEQ ID NO: 36762 - DNA, 25 bp, Homo sapiens
cattaatcaagaacgaaagtcggag

SEQ ID NO: 36763 - DNA, 26 bp, Homo sapiens
cattaatcaagaacgaaagtcggagg

SEQ ID NO: 36764 - DNA, 27 bp, Homo sapiens
cattaatcaagaacgaaagtcggaggt

SEQ ID NO: 36765 - DNA, 28 bp, Homo sapiens
cattaatcaagaacgaaagtcggaggtt

SEQ ID NO: 36766 - DNA, 29 bp, Homo sapiens
cattaatcaagaacgaaagtcggaggttc

SEQ ID NO: 36767 - DNA, 30 bp, Homo sapiens; identical to SEQ ID NO: 14300

SEQ ID NO: 36768 - DNA, 21 bp, Homo sapiens
attaatcaagaacgaaagtcg

SEQ ID NO: 36769 - DNA, 22 bp, Homo sapiens
attaatcaagaacgaaagtcgg

SEQ ID NO: 36770 - DNA, 23 bp, Homo sapiens
attaatcaagaacgaaagtcgga

SEQ ID NO: 36771 - DNA, 24 bp, Homo sapiens
attaatcaagaacgaaagtcggag

SEQ ID NO: 36772 - DNA, 25 bp, Homo sapiens
attaatcaagaacgaaagtcggagg

SEQ ID NO: 36773 - DNA, 26 bp, Homo sapiens
attaatcaagaacgaaagtcggaggt

SEQ ID NO: 36774 - DNA, 27 bp, Homo sapiens
attaatcaagaacgaaagtcggaggtt

SEQ ID NO: 36775 - DNA, 28 bp, Homo sapiens
attaatcaagaacgaaagtcggaggttc

SEQ ID NO: 36776 - DNA, 29 bp, Homo sapiens
attaatcaagaacgaaagtcggaggttcg

SEQ ID NO: 36777 - DNA, 20 bp, Homo sapiens
ttaatcaagaacgaaagtcg

SEQ ID NO: 36778 - DNA, 21 bp, Homo sapiens
ttaatcaagaacgaaagtcgg

SEQ ID NO: 36779 - DNA, 22 bp, Homo sapiens
ttaatcaagaacgaaagtcgga

SEQ ID NO: 36780 - DNA, 23 bp, Homo sapiens
ttaatcaagaacgaaagtcggag

SEQ ID NO: 36781 - DNA, 24 bp, Homo sapiens
ttaatcaagaacgaaagtcggagg

SEQ ID NO: 36782 - DNA, 25 bp, Homo sapiens
ttaatcaagaacgaaagtcggaggt

SEQ ID NO: 36783 - DNA, 26 bp, Homo sapiens
ttaatcaagaacgaaagtcggaggtt

SEQ ID NO: 36784 - DNA, 27 bp, Homo sapiens
ttaatcaagaacgaaagtcggaggttc

SEQ ID NO: 36785 - DNA, 28 bp, Homo sapiens
ttaatcaagaacgaaagtcggaggttcg

SEQ ID NO: 36786 - DNA, 29 bp, Homo sapiens
ttaatcaagaacgaaagtcggaggttcga

SEQ ID NO: 36787 - DNA, 19 bp, Homo sapiens
taatcaagaacgaaagtcg

SEQ ID NO: 36788 - DNA, 20 bp, Homo sapiens
taatcaagaacgaaagtcgg

SEQ ID NO: 36789 - DNA, 21 bp, Homo sapiens
taatcaagaacgaaagtcgga

SEQ ID NO: 36790 - DNA, 22 bp, Homo sapiens
taatcaagaacgaaagtcggag

SEQ ID NO: 36791 - DNA, 23 bp, Homo sapiens
taatcaagaacgaaagtcggagg

SEQ ID NO: 36792 - DNA, 24 bp, Homo sapiens
taatcaagaacgaaagtcggaggt

SEQ ID NO: 36793 - DNA, 25 bp, Homo sapiens
taatcaagaacgaaagtcggaggtt

SEQ ID NO: 36794 - DNA, 26 bp, Homo sapiens
taatcaagaacgaaagtcggaggttc

SEQ ID NO: 36795 - DNA, 27 bp, Homo sapiens
taatcaagaacgaaagtcggaggttcg

SEQ ID NO: 36796 - DNA, 28 bp, Homo sapiens
taatcaagaacgaaagtcggaggttcga

SEQ ID NO: 36797 - DNA, 30 bp, Homo sapiens
taatcaagaacgaaagtcggaggttcgaag

SEQ ID NO: 36798 - DNA, 18 bp, Homo sapiens
aatcaagaacgaaagtcg

SEQ ID NO: 36799 - DNA, 19 bp, Homo sapiens
aatcaagaacgaaagtcgg

SEQ ID NO: 36800 - DNA, 20 bp, Homo sapiens
aatcaagaacgaaagtcgga

SEQ ID NO: 36801 - DNA, 21 bp, Homo sapiens
aatcaagaacgaaagtcggag

SEQ ID NO: 36802 - DNA, 22 bp, Homo sapiens
aatcaagaacgaaagtcggagg

SEQ ID NO: 36803 - DNA, 23 bp, Homo sapiens
aatcaagaacgaaagtcggaggt

SEQ ID NO: 36804 - DNA, 24 bp, Homo sapiens
aatcaagaacgaaagtcggaggtt

SEQ ID NO: 36805 - DNA, 25 bp, Homo sapiens
aatcaagaacgaaagtcggaggttc

SEQ ID NO: 36806 - DNA, 26 bp, Homo sapiens
aatcaagaacgaaagtcggaggttcg

SEQ ID NO: 36807 - DNA, 27 bp, Homo sapiens
aatcaagaacgaaagtcggaggttcga

SEQ ID NO: 36808 - DNA, 28 bp, Homo sapiens
aatcaagaacgaaagtcggaggttcgaa

SEQ ID NO: 36809 - DNA, 29 bp, Homo sapiens
aatcaagaacgaaagtcggaggttcgaag

SEQ ID NO: 36810 - DNA, 18 bp, Homo sapiens
atcaagaacgaaagtcgg

SEQ ID NO: 36811 - DNA, 19 bp, Homo sapiens
atcaagaacgaaagtcgga

SEQ ID NO: 36812 - DNA, 20 bp, Homo sapiens
atcaagaacgaaagtcggag

SEQ ID NO: 36813 - DNA, 21 bp, Homo sapiens
atcaagaacgaaagtcggagg

SEQ ID NO: 36814 - DNA, 22 bp, Homo sapiens
atcaagaacgaaagtcggaggt

SEQ ID NO: 36815 - DNA, 23 bp, Homo sapiens
atcaagaacgaaagtcggaggtt

SEQ ID NO: 36816 - DNA, 24 bp, Homo sapiens
atcaagaacgaaagtcggaggttc

SEQ ID NO: 36817 - DNA, 25 bp, Homo sapiens
atcaagaacgaaagtcggaggttcg

SEQ ID NO: 36818 - DNA, 26 bp, Homo sapiens
atcaagaacgaaagtcggaggttcga

SEQ ID NO: 36819 - DNA, 27 bp, Homo sapiens
atcaagaacgaaagtcggaggttcgaa

SEQ ID NO: 36820 - DNA, 28 bp, Homo sapiens
atcaagaacgaaagtcggaggttcgaag

SEQ ID NO: 36821 - DNA, 29 bp, Homo sapiens
atcaagaacgaaagtcggaggttcgaaga

SEQ ID NO: 36822 - DNA, 30 bp, Homo sapiens; identical to SEQ ID NO: 2568

SEQ ID NO: 36823 - DNA, 17 bp, Homo sapiens
tcaagaacgaaagtcgg

SEQ ID NO: 36824 - DNA, 18 bp, Homo sapiens
tcaagaacgaaagtcgga

SEQ ID NO: 36825 - DNA, 19 bp, Homo sapiens
tcaagaacgaaagtcggag

SEQ ID NO: 36826 - DNA, 20 bp, Homo sapiens
tcaagaacgaaagtcggagg

SEQ ID NO: 36827 - DNA, 21 bp, Homo sapiens
tcaagaacgaaagtcggaggt

SEQ ID NO: 36828 - DNA, 22 bp, Homo sapiens
tcaagaacgaaagtcggaggtt

SEQ ID NO: 36829 - DNA, 23 bp, Homo sapiens
tcaagaacgaaagtcggaggttc

SEQ ID NO: 36830 - DNA, 24 bp, Homo sapiens
tcaagaacgaaagtcggaggttcg

SEQ ID NO: 36831 - DNA, 25 bp, Homo sapiens
tcaagaacgaaagtcggaggttcga

SEQ ID NO: 36832 - DNA, 26 bp, Homo sapiens
tcaagaacgaaagtcggaggttcgaa

SEQ ID NO: 36833 - DNA, 27 bp, Homo sapiens
tcaagaacgaaagtcggaggttcgaag

SEQ ID NO: 36834 - DNA, 28 bp, Homo sapiens
tcaagaacgaaagtcggaggttcgaaga

SEQ ID NO: 36835 - DNA, 30 bp, Homo sapiens
tcaagaacgaaagtcggaggttcgaagacg

SEQ ID NO: 36836 - DNA, 16 bp, Homo sapiens
caagaacgaaagtcgg

SEQ ID NO: 36837 - DNA, 17 bp, Homo sapiens
caagaacgaaagtcgga

SEQ ID NO: 36838 - DNA, 18 bp, Homo sapiens
caagaacgaaagtcggag

SEQ ID NO: 36839 - DNA, 19 bp, Homo sapiens
caagaacgaaagtcggagg

SEQ ID NO: 36840 - DNA, 20 bp, Homo sapiens
caagaacgaaagtcggaggt

SEQ ID NO: 36841 - DNA, 21 bp, Homo sapiens
caagaacgaaagtcggaggtt

SEQ ID NO: 36842 - DNA, 22 bp, Homo sapiens
caagaacgaaagtcggaggttc

SEQ ID NO: 36843 - DNA, 23 bp, Homo sapiens
caagaacgaaagtcggaggttcg

SEQ ID NO: 36844 - DNA, 24 bp, Homo sapiens
caagaacgaaagtcggaggttcga

SEQ ID NO: 36845 - DNA, 25 bp, Homo sapiens
caagaacgaaagtcggaggttcgaa

SEQ ID NO: 36846 - DNA, 26 bp, Homo sapiens
caagaacgaaagtcggaggttcgaag

SEQ ID NO: 36847 - DNA, 27 bp, Homo sapiens
caagaacgaaagtcggaggttcgaaga

SEQ ID NO: 36848 - DNA, 28 bp, Homo sapiens
caagaacgaaagtcggaggttcgaagac

SEQ ID NO: 36849 - DNA, 29 bp, Homo sapiens
caagaacgaaagtcggaggttcgaagacg

SEQ ID NO: 36850 - DNA, 16 bp, Homo sapiens
aagaacgaaagtcgga

SEQ ID NO: 36851 - DNA, 17 bp, Homo sapiens
aagaacgaaagtcggag

SEQ ID NO: 36852 - DNA, 18 bp, Homo sapiens
aagaacgaaagtcggagg

SEQ ID NO: 36853 - DNA, 19 bp, Homo sapiens
aagaacgaaagtcggaggt

SEQ ID NO: 36854 - DNA, 20 bp, Homo sapiens
aagaacgaaagtcggaggtt

SEQ ID NO: 36855 - DNA, 21 bp, Homo sapiens
aagaacgaaagtcggaggttc

SEQ ID NO: 36856 - DNA, 22 bp, Homo sapiens
aagaacgaaagtcggaggttcg

SEQ ID NO: 36857 - DNA, 23 bp, Homo sapiens
aagaacgaaagtcggaggttcga

SEQ ID NO: 36858 - DNA, 24 bp, Homo sapiens
aagaacgaaagtcggaggttcgaa

SEQ ID NO: 36859 - DNA, 25 bp, Homo sapiens
aagaacgaaagtcggaggttcgaag

SEQ ID NO: 36860 - DNA, 26 bp, Homo sapiens
aagaacgaaagtcggaggttcgaaga

SEQ ID NO: 36861 - DNA, 27 bp, Homo sapiens
aagaacgaaagtcggaggttcgaagac

SEQ ID NO: 36862 - DNA, 28 bp, Homo sapiens
aagaacgaaagtcggaggttcgaagacg

SEQ ID NO: 36863 - DNA, 29 bp, Homo sapiens
aagaacgaaagtcggaggttcgaagacga

SEQ ID NO: 36864 - DNA, 16 bp, Homo sapiens
agaacgaaagtcggag

SEQ ID NO: 36865 - DNA, 17 bp, Homo sapiens
agaacgaaagtcggagg

SEQ ID NO: 36866 - DNA, 18 bp, Homo sapiens
agaacgaaagtcggaggt

SEQ ID NO: 36867 - DNA, 19 bp, Homo sapiens
agaacgaaagtcggaggtt

SEQ ID NO: 36868 - DNA, 20 bp, Homo sapiens
agaacgaaagtcggaggttc

SEQ ID NO: 36869 - DNA, 21 bp, Homo sapiens
agaacgaaagtcggaggttcg

SEQ ID NO: 36870 - DNA, 22 bp, Homo sapiens
agaacgaaagtcggaggttcga

SEQ ID NO: 36871 - DNA, 23 bp, Homo sapiens
agaacgaaagtcggaggttcgaa

SEQ ID NO: 36872 - DNA, 24 bp, Homo sapiens
agaacgaaagtcggaggttcgaag

SEQ ID NO: 36873 - DNA, 25 bp, Homo sapiens
agaacgaaagtcggaggttcgaaga

SEQ ID NO: 36874 - DNA, 26 bp, Homo sapiens
agaacgaaagtcggaggttcgaagac

SEQ ID NO: 36875 - DNA, 27 bp, Homo sapiens
agaacgaaagtcggaggttcgaagacg

SEQ ID NO: 36876 - DNA, 28 bp, Homo sapiens
agaacgaaagtcggaggttcgaagacga

SEQ ID NO: 36877 - DNA, 29 bp, Homo sapiens
agaacgaaagtcggaggttcgaagacgat

SEQ ID NO: 36878 - DNA, 16 bp, Homo sapiens
gaacgaaagtcggagg

SEQ ID NO: 36879 - DNA, 17 bp, Homo sapiens
gaacgaaagtcggaggt

SEQ ID NO: 36880 - DNA, 18 bp, Homo sapiens
gaacgaaagtcggaggtt

SEQ ID NO: 36881 - DNA, 19 bp, Homo sapiens
gaacgaaagtcggaggttc

SEQ ID NO: 36882 - DNA, 20 bp, Homo sapiens
gaacgaaagtcggaggttcg

SEQ ID NO: 36883 - DNA, 21 bp, Homo sapiens
gaacgaaagtcggaggttcga

SEQ ID NO: 36884 - DNA, 22 bp, Homo sapiens
gaacgaaagtcggaggttcgaa

SEQ ID NO: 36885 - DNA, 23 bp, Homo sapiens
gaacgaaagtcggaggttcgaag

SEQ ID NO: 36886 - DNA, 24 bp, Homo sapiens
gaacgaaagtcggaggttcgaaga

SEQ ID NO: 36887 - DNA, 25 bp, Homo sapiens
gaacgaaagtcggaggttcgaagac

SEQ ID NO: 36888 - DNA, 26 bp, Homo sapiens
gaacgaaagtcggaggttcgaagacg

SEQ ID NO: 36889 - DNA, 27 bp, Homo sapiens
gaacgaaagtcggaggttcgaagacga

SEQ ID NO: 36890 - DNA, 28 bp, Homo sapiens
gaacgaaagtcggaggttcgaagacgat

SEQ ID NO: 36891 - DNA, 29 bp, Homo sapiens
gaacgaaagtcggaggttcgaagacgatc

SEQ ID NO: 36892 - DNA, 16 bp, Homo sapiens
aacgaaagtcggaggt

SEQ ID NO: 36893 - DNA, 17 bp, Homo sapiens
aacgaaagtcggaggtt

SEQ ID NO: 36894 - DNA, 18 bp, Homo sapiens
aacgaaagtcggaggttc

SEQ ID NO: 36895 - DNA, 19 bp, Homo sapiens
aacgaaagtcggaggttcg

SEQ ID NO: 36896 - DNA, 20 bp, Homo sapiens
aacgaaagtcggaggttcga

SEQ ID NO: 36897 - DNA, 21 bp, Homo sapiens
aacgaaagtcggaggttcgaa

SEQ ID NO: 36898 - DNA, 22 bp, Homo sapiens
aacgaaagtcggaggttcgaag

SEQ ID NO: 36899 - DNA, 23 bp, Homo sapiens
aacgaaagtcggaggttcgaaga

SEQ ID NO: 36900 - DNA, 24 bp, Homo sapiens
aacgaaagtcggaggttcgaagac

SEQ ID NO: 36901 - DNA, 25 bp, Homo sapiens
aacgaaagtcggaggttcgaagacg

SEQ ID NO: 36902 - DNA, 26 bp, Homo sapiens
aacgaaagtcggaggttcgaagacga

SEQ ID NO: 36903 - DNA, 27 bp, Homo sapiens
aacgaaagtcggaggttcgaagacgat

SEQ ID NO: 36904 - DNA, 28 bp, Homo sapiens
aacgaaagtcggaggttcgaagacgatc

SEQ ID NO: 36905 - DNA, 29 bp, Homo sapiens
aacgaaagtcggaggttcgaagacgatca

SEQ ID NO: 36906 - DNA, 30 bp, Homo sapiens; identical to SEQ ID NO: 29029

SEQ ID NO: 36907 - DNA, 16 bp, Homo sapiens
acgaaagtcggaggtt

SEQ ID NO: 36908 - DNA, 17 bp, Homo sapiens
acgaaagtcggaggttc

SEQ ID NO: 36909 - DNA, 18 bp, Homo sapiens
acgaaagtcggaggttcg

SEQ ID NO: 36910 - DNA, 19 bp, Homo sapiens
acgaaagtcggaggttcga

SEQ ID NO: 36911 - DNA, 20 bp, Homo sapiens
acgaaagtcggaggttcgaa

SEQ ID NO: 36912 - DNA, 21 bp, Homo sapiens
acgaaagtcggaggttcgaag

SEQ ID NO: 36913 - DNA, 22 bp, Homo sapiens
acgaaagtcggaggttcgaaga

SEQ ID NO: 36914 - DNA, 23 bp, Homo sapiens
acgaaagtcggaggttcgaagac

SEQ ID NO: 36915 - DNA, 24 bp, Homo sapiens
acgaaagtcggaggttcgaagacg

SEQ ID NO: 36916 - DNA, 25 bp, Homo sapiens
acgaaagtcggaggttcgaagacga

SEQ ID NO: 36917 - DNA, 26 bp, Homo sapiens
acgaaagtcggaggttcgaagacgat

SEQ ID NO: 36918 - DNA, 27 bp, Homo sapiens
acgaaagtcggaggttcgaagacgatc

SEQ ID NO: 36919 - DNA, 28 bp, Homo sapiens
acgaaagtcggaggttcgaagacgatca

SEQ ID NO: 36920 - DNA, 29 bp, Homo sapiens
acgaaagtcggaggttcgaagacgatcag

SEQ ID NO: 36921 - DNA, 16 bp, Homo sapiens
cgaaagtcggaggttc

SEQ ID NO: 36922 - DNA, 17 bp, Homo sapiens
cgaaagtcggaggttcg

SEQ ID NO: 36923 - DNA, 18 bp, Homo sapiens
cgaaagtcggaggttcga

SEQ ID NO: 36924 - DNA, 19 bp, Homo sapiens
cgaaagtcggaggttcgaa

SEQ ID NO: 36925 - DNA, 20 bp, Homo sapiens
cgaaagtcggaggttcgaag

SEQ ID NO: 36926 - DNA, 21 bp, Homo sapiens
cgaaagtcggaggttcgaaga

SEQ ID NO: 36927 - DNA, 22 bp, Homo sapiens
cgaaagtcggaggttcgaagac

SEQ ID NO: 36928 - DNA, 23 bp, Homo sapiens
cgaaagtcggaggttcgaagacg

SEQ ID NO: 36929 - DNA, 24 bp, Homo sapiens
cgaaagtcggaggttcgaagacga

SEQ ID NO: 36930 - DNA, 25 bp, Homo sapiens
cgaaagtcggaggttcgaagacgat

SEQ ID NO: 36931 - DNA, 26 bp, Homo sapiens
cgaaagtcggaggttcgaagacgatc

SEQ ID NO: 36932 - DNA, 27 bp, Homo sapiens
cgaaagtcggaggttcgaagacgatca

SEQ ID NO: 36933 - DNA, 28 bp, Homo sapiens
cgaaagtcggaggttcgaagacgatcag

SEQ ID NO: 36934 - DNA, 29 bp, Homo sapiens
cgaaagtcggaggttcgaagacgatcaga

SEQ ID NO: 36935 - DNA, 16 bp, Homo sapiens
gaaagtcggaggttcg

SEQ ID NO: 36936 - DNA, 17 bp, Homo sapiens
gaaagtcggaggttcga

SEQ ID NO: 36937 - DNA, 18 bp, Homo sapiens
gaaagtcggaggttcgaa

SEQ ID NO: 36938 - DNA, 19 bp, Homo sapiens
gaaagtcggaggttcgaag

SEQ ID NO: 36939 - DNA, 20 bp, Homo sapiens
gaaagtcggaggttcgaaga

SEQ ID NO: 36940 - DNA, 21 bp, Homo sapiens
gaaagtcggaggttcgaagac

SEQ ID NO: 36941 - DNA, 22 bp, Homo sapiens
gaaagtcggaggttcgaagacg

SEQ ID NO: 36942 - DNA, 23 bp, Homo sapiens
gaaagtcggaggttcgaagacga

SEQ ID NO: 36943 - DNA, 24 bp, Homo sapiens
gaaagtcggaggttcgaagacgat

SEQ ID NO: 36944 - DNA, 25 bp, Homo sapiens
gaaagtcggaggttcgaagacgatc

SEQ ID NO: 36945 - DNA, 26 bp, Homo sapiens
gaaagtcggaggttcgaagacgatca

SEQ ID NO: 36946 - DNA, 27 bp, Homo sapiens
gaaagtcggaggttcgaagacgatcag

SEQ ID NO: 36947 - DNA, 28 bp, Homo sapiens
gaaagtcggaggttcgaagacgatcaga

SEQ ID NO: 36948 - DNA, 29 bp, Homo sapiens
gaaagtcggaggttcgaagacgatcagat

SEQ ID NO: 36949 - DNA, 16 bp, Homo sapiens
aaagtcggaggttcga

SEQ ID NO: 36950 - DNA, 17 bp, Homo sapiens
aaagtcggaggttcgaa

SEQ ID NO: 36951 - DNA, 18 bp, Homo sapiens
aaagtcggaggttcgaag

SEQ ID NO: 36952 - DNA, 19 bp, Homo sapiens
aaagtcggaggttcgaaga

SEQ ID NO: 36953 - DNA, 20 bp, Homo sapiens
aaagtcggaggttcgaagac

SEQ ID NO: 36954 - DNA, 21 bp, Homo sapiens
aaagtcggaggttcgaagacg

SEQ ID NO: 36955 - DNA, 22 bp, Homo sapiens
aaagtcggaggttcgaagacga

SEQ ID NO: 36956 - DNA, 23 bp, Homo sapiens
aaagtcggaggttcgaagacgat

SEQ ID NO: 36957 - DNA, 24 bp, Homo sapiens
aaagtcggaggttcgaagacgatc

SEQ ID NO: 36958 - DNA, 25 bp, Homo sapiens
aaagtcggaggttcgaagacgatca

SEQ ID NO: 36959 - DNA, 26 bp, Homo sapiens
aaagtcggaggttcgaagacgatcag

SEQ ID NO: 36960 - DNA, 27 bp, Homo sapiens
aaagtcggaggttcgaagacgatcaga

SEQ ID NO: 36961 - DNA, 28 bp, Homo sapiens
aaagtcggaggttcgaagacgatcagat

SEQ ID NO: 36962 - DNA, 29 bp, Homo sapiens
aaagtcggaggttcgaagacgatcagata

SEQ ID NO: 36963 - DNA, 30 bp, Homo sapiens; identical to SEQ ID NO: 2640

SEQ ID NO: 36964 - DNA, 16 bp, Homo sapiens
aagtcggaggttcgaa

SEQ ID NO: 36965 - DNA, 17 bp, Homo sapiens
aagtcggaggttcgaag

SEQ ID NO: 36966 - DNA, 18 bp, Homo sapiens
aagtcggaggttcgaaga

SEQ ID NO: 36967 - DNA, 19 bp, Homo sapiens
aagtcggaggttcgaagac

SEQ ID NO: 36968 - DNA, 20 bp, Homo sapiens
aagtcggaggttcgaagacg

SEQ ID NO: 36969 - DNA, 21 bp, Homo sapiens
aagtcggaggttcgaagacga

SEQ ID NO: 36970 - DNA, 22 bp, Homo sapiens
aagtcggaggttcgaagacgat

SEQ ID NO: 36971 - DNA, 23 bp, Homo sapiens
aagtcggaggttcgaagacgatc

SEQ ID NO: 36972 - DNA, 24 bp, Homo sapiens
aagtcggaggttcgaagacgatca

SEQ ID NO: 36973 - DNA, 25 bp, Homo sapiens
aagtcggaggttcgaagacgatcag

SEQ ID NO: 36974 - DNA, 26 bp, Homo sapiens
aagtcggaggttcgaagacgatcaga

SEQ ID NO: 36975 - DNA, 27 bp, Homo sapiens
aagtcggaggttcgaagacgatcagat

SEQ ID NO: 36976 - DNA, 28 bp, Homo sapiens
aagtcggaggttcgaagacgatcagata

SEQ ID NO: 36977 - DNA, 30 bp, Homo sapiens; identical to SEQ ID NO: 2646

SEQ ID NO: 36978 - DNA, 16 bp, Homo sapiens
agtcggaggttcgaag

SEQ ID NO: 36979 - DNA, 17 bp, Homo sapiens
agtcggaggttcgaaga

SEQ ID NO: 36980 - DNA, 18 bp, Homo sapiens
agtcggaggttcgaagac

SEQ ID NO: 36981 - DNA, 19 bp, Homo sapiens
agtcggaggttcgaagacg

SEQ ID NO: 36982 - DNA, 20 bp, Homo sapiens
agtcggaggttcgaagacga

SEQ ID NO: 36983 - DNA, 21 bp, Homo sapiens
agtcggaggttcgaagacgat

SEQ ID NO: 36984 - DNA, 22 bp, Homo sapiens
agtcggaggttcgaagacgatc

SEQ ID NO: 36985 - DNA, 23 bp, Homo sapiens
agtcggaggttcgaagacgatca

SEQ ID NO: 36986 - DNA, 24 bp, Homo sapiens
agtcggaggttcgaagacgatcag

SEQ ID NO: 36987 - DNA, 25 bp, Homo sapiens
agtcggaggttcgaagacgatcaga

SEQ ID NO: 36988 - DNA, 26 bp, Homo sapiens
agtcggaggttcgaagacgatcagat

SEQ ID NO: 36989 - DNA, 16 bp, Homo sapiens
gtcggaggttcgaaga

SEQ ID NO: 36990 - DNA, 17 bp, Homo sapiens
gtcggaggttcgaagac

SEQ ID NO: 36991 - DNA, 18 bp, Homo sapiens
gtcggaggttcgaagacg

SEQ ID NO: 36992 - DNA, 19 bp, Homo sapiens
gtcggaggttcgaagacga

SEQ ID NO: 36993 - DNA, 20 bp, Homo sapiens
gtcggaggttcgaagacgat

SEQ ID NO: 36994 - DNA, 21 bp, Homo sapiens
gtcggaggttcgaagacgatc

SEQ ID NO: 36995 - DNA, 22 bp, Homo sapiens
gtcggaggttcgaagacgatca

SEQ ID NO: 36996 - DNA, 23 bp, Homo sapiens
gtcggaggttcgaagacgatcag

SEQ ID NO: 36997 - DNA, 24 bp, Homo sapiens
gtcggaggttcgaagacgatcaga

SEQ ID NO: 36998 - DNA, 25 bp, Homo sapiens
gtcggaggttcgaagacgatcagat

SEQ ID NO: 36999 - DNA, 26 bp, Homo sapiens
gtcggaggttcgaagacgatcagata

SEQ ID NO: 37000 - DNA, 18 bp, Homo sapiens
tcggaggttcgaagacga

SEQ ID NO: 37001 - DNA, 20 bp, Homo sapiens
tcggaggttcgaagacgatc

SEQ ID NO: 37002 - DNA, 21 bp, Homo sapiens
tcggaggttcgaagacgatca

SEQ ID NO: 37003 - DNA, 22 bp, Homo sapiens
tcggaggttcgaagacgatcag

SEQ ID NO: 37004 - DNA, 23 bp, Homo sapiens
tcggaggttcgaagacgatcaga

SEQ ID NO: 37005 - DNA, 30 bp, Homo sapiens
tcggaggttcgaagacgatcagataccgtc

SEQ ID NO: 37006 - DNA, 16 bp, Homo sapiens
cggaggttcgaagacg

SEQ ID NO: 37007 - DNA, 17 bp, Homo sapiens
cggaggttcgaagacga

SEQ ID NO: 37008 - DNA, 18 bp, Homo sapiens
cggaggttcgaagacgat

SEQ ID NO: 37009 - DNA, 19 bp, Homo sapiens
cggaggttcgaagacgatc

SEQ ID NO: 37010 - DNA, 20 bp, Homo sapiens
cggaggttcgaagacgatca

SEQ ID NO: 37011 - DNA, 21 bp, Homo sapiens
cggaggttcgaagacgatcag

SEQ ID NO: 37012 - DNA, 22 bp, Homo sapiens
cggaggttcgaagacgatcaga

SEQ ID NO: 37013 - DNA, 23 bp, Homo sapiens
cggaggttcgaagacgatcagat

SEQ ID NO: 37014 - DNA, 18 bp, Homo sapiens
ggaggttcgaagacgatc

SEQ ID NO: 37015 - DNA, 20 bp, Homo sapiens
ggaggttcgaagacgatcag

SEQ ID NO: 37016 - DNA, 21 bp, Homo sapiens
ggaggttcgaagacgatcaga

SEQ ID NO: 37017 - DNA, 16 bp, Homo sapiens
gaggttcgaagacgat

SEQ ID NO: 37018 - DNA, 17 bp, Homo sapiens
gaggttcgaagacgatc

SEQ ID NO: 37019 - DNA, 18 bp, Homo sapiens
gaggttcgaagacgatca

SEQ ID NO: 37020 - DNA, 19 bp, Homo sapiens
gaggttcgaagacgatcag

SEQ ID NO: 37021 - DNA, 20 bp, Homo sapiens
gaggttcgaagacgatcaga

SEQ ID NO: 37022 - DNA, 21 bp, Homo sapiens
gaggttcgaagacgatcagat

SEQ ID NO: 37023 - DNA, 22 bp, Homo sapiens
gaggttcgaagacgatcagata

SEQ ID NO: 37024 - DNA, 23 bp, Homo sapiens
gaggttcgaagacgatcagatac

SEQ ID NO: 37025 - DNA, 24 bp, Homo sapiens
gaggttcgaagacgatcagatacc

SEQ ID NO: 37026 - DNA, 25 bp, Homo sapiens
gaggttcgaagacgatcagataccg

SEQ ID NO: 37027 - DNA, 26 bp, Homo sapiens
gaggttcgaagacgatcagataccgt

SEQ ID NO: 37028 - DNA, 29 bp, Homo sapiens
gaggttcgaagacgatcagataccgtcgt

SEQ ID NO: 37029 - DNA, 16 bp, Homo sapiens
aggttcgaagacgatc

SEQ ID NO: 37030 - DNA, 17 bp, Homo sapiens
aggttcgaagacgatca

SEQ ID NO: 37031 - DNA, 18 bp, Homo sapiens
aggttcgaagacgatcag

SEQ ID NO: 37032 - DNA, 19 bp, Homo sapiens
aggttcgaagacgatcaga

SEQ ID NO: 37033 - DNA, 20 bp, Homo sapiens
aggttcgaagacgatcagat

SEQ ID NO: 37034 - DNA, 21 bp, Homo sapiens
aggttcgaagacgatcagata

SEQ ID NO: 37035 - DNA, 22 bp, Homo sapiens
aggttcgaagacgatcagatac

SEQ ID NO: 37036 - DNA, 23 bp, Homo sapiens
aggttcgaagacgatcagatacc

SEQ ID NO: 37037 - DNA, 27 bp, Homo sapiens
aggttcgaagacgatcagataccgtcg

SEQ ID NO: 37038 - DNA, 26 bp, Homo sapiens
ggttcgaagacgatcagataccgtcg

SEQ ID NO: 37039 - DNA, 28 bp, Homo sapiens
ggttcgaagacgatcagataccgtcgta

SEQ ID NO: 37040 - DNA, 25 bp, Homo sapiens
gttcgaagacgatcagataccgtcg

SEQ ID NO: 37041 - DNA, 24 bp, Homo sapiens
ttcgaagacgatcagataccgtcg

SEQ ID NO: 37042 - DNA, 25 bp, Homo sapiens
ttcgaagacgatcagataccgtcgt

SEQ ID NO: 37043 - DNA, 26 bp, Homo sapiens
ttcgaagacgatcagataccgtcgta

SEQ ID NO: 37044 - DNA, 27 bp, Homo sapiens
ttcgaagacgatcagataccgtcgtag

SEQ ID NO: 37045 - DNA, 23 bp, Homo sapiens
tcgaagacgatcagataccgtcg

SEQ ID NO: 37046 - DNA, 25 bp, Homo sapiens
tcgaagacgatcagataccgtcgta

SEQ ID NO: 37047 - DNA, 26 bp, Homo sapiens
tcgaagacgatcagataccgtcgtag

SEQ ID NO: 37048 - DNA, 22 bp, Homo sapiens
cgaagacgatcagataccgtcg

SEQ ID NO: 37049 - DNA, 23 bp, Homo sapiens
cgaagacgatcagataccgtcgt

SEQ ID NO: 37050 - DNA, 24 bp, Homo sapiens
cgaagacgatcagataccgtcgta

SEQ ID NO: 37051 - DNA, 25 bp, Homo sapiens
cgaagacgatcagataccgtcgtag

SEQ ID NO: 37052 - DNA, 30 bp, Homo sapiens
cgaagacgatcagataccgtcgtagttccg

SEQ ID NO: 37053 - DNA, 21 bp, Homo sapiens
gaagacgatcagataccgtcg

SEQ ID NO: 37054 - DNA, 23 bp, Homo sapiens
gaagacgatcagataccgtcgta

SEQ ID NO: 37055 - DNA, 24 bp, Homo sapiens
gaagacgatcagataccgtcgtag

SEQ ID NO: 37056 - DNA, 29 bp, Homo sapiens
gaagacgatcagataccgtcgtagttccg

SEQ ID NO: 37057 - DNA, 20 bp, Homo sapiens
aagacgatcagataccgtcg

SEQ ID NO: 37058 - DNA, 21 bp, Homo sapiens
aagacgatcagataccgtcgt

SEQ ID NO: 37059 - DNA, 22 bp, Homo sapiens
aagacgatcagataccgtcgta

SEQ ID NO: 37060 - DNA, 23 bp, Homo sapiens
aagacgatcagataccgtcgtag

SEQ ID NO: 37061 - DNA, 28 bp, Homo sapiens
aagacgatcagataccgtcgtagttccg

SEQ ID NO: 37062 - DNA, 29 bp, Homo sapiens
aagacgatcagataccgtcgtagttccga

SEQ ID NO: 37063 - DNA, 30 bp, Homo sapiens; identical to SEQ ID NO: 2662

SEQ ID NO: 37064 - DNA, 18 bp, Homo sapiens
acgatcagataccgtcgt

SEQ ID NO: 37065 - DNA, 21 bp, Homo sapiens
acgatcagataccgtcgtagt

SEQ ID NO: 37066 - DNA, 17 bp, Homo sapiens
cgatcagataccgtcgt

SEQ ID NO: 37067 - DNA, 20 bp, Homo sapiens
cgatcagataccgtcgtagt

SEQ ID NO: 37068 - DNA, 16 bp, Homo sapiens
atcagataccgtcgta

SEQ ID NO: 37069 - DNA, 17 bp, Homo sapiens
atcagataccgtcgtag

SEQ ID NO: 37070 - DNA, 18 bp, Homo sapiens
atcagataccgtcgtagt

SEQ ID NO: 37071 - DNA, 19 bp, Homo sapiens
atcagataccgtcgtagtt

SEQ ID NO: 37072 - DNA, 20 bp, Homo sapiens
atcagataccgtcgtagttc

SEQ ID NO: 37073 - DNA, 21 bp, Homo sapiens
atcagataccgtcgtagttcc

SEQ ID NO: 37074 - DNA, 22 bp, Homo sapiens
atcagataccgtcgtagttccg

SEQ ID NO: 37075 - DNA, 23 bp, Homo sapiens
atcagataccgtcgtagttccga

SEQ ID NO: 37076 - DNA, 24 bp, Homo sapiens
atcagataccgtcgtagttccgac

SEQ ID NO: 37077 - DNA, 25 bp, Homo sapiens
atcagataccgtcgtagttccgacc

SEQ ID NO: 37078 - DNA, 26 bp, Homo sapiens
atcagataccgtcgtagttccgacca

SEQ ID NO: 37079 - DNA, 28 bp, Homo sapiens
atcagataccgtcgtagttccgaccata

SEQ ID NO: 37080 - DNA, 29 bp, Homo sapiens
atcagataccgtcgtagttccgaccataa

SEQ ID NO: 37081 - DNA, 16 bp, Homo sapiens
tcagataccgtcgtag

SEQ ID NO: 37082 - DNA, 17 bp, Homo sapiens
tcagataccgtcgtagt

SEQ ID NO: 37083 - DNA, 18 bp, Homo sapiens
tcagataccgtcgtagtt

SEQ ID NO: 37084 - DNA, 20 bp, Homo sapiens
tcagataccgtcgtagttcc

SEQ ID NO: 37085 - DNA, 21 bp, Homo sapiens
tcagataccgtcgtagttccg

SEQ ID NO: 37086 - DNA, 22 bp, Homo sapiens
tcagataccgtcgtagttccga

SEQ ID NO: 37087 - DNA, 23 bp, Homo sapiens
tcagataccgtcgtagttccgac

SEQ ID NO: 37088 - DNA, 24 bp, Homo sapiens
tcagataccgtcgtagttccgacc

SEQ ID NO: 37089 - DNA, 25 bp, Homo sapiens
tcagataccgtcgtagttccgacca

SEQ ID NO: 37090 - DNA, 27 bp, Homo sapiens
tcagataccgtcgtagttccgaccata

SEQ ID NO: 37091 - DNA, 28 bp, Homo sapiens
tcagataccgtcgtagttccgaccataa

SEQ ID NO: 37092 - DNA, 29 bp, Homo sapiens
tcagataccgtcgtagttccgaccataaa

SEQ ID NO: 37093 - DNA, 30 bp, Homo sapiens
tcagataccgtcgtagttccgaccataaac

SEQ ID NO: 37094 - DNA, 16 bp, Homo sapiens
cagataccgtcgtagt

SEQ ID NO: 37095 - DNA, 17 bp, Homo sapiens
cagataccgtcgtagtt

SEQ ID NO: 37096 - DNA, 19 bp, Homo sapiens
cagataccgtcgtagttcc

SEQ ID NO: 37097 - DNA, 20 bp, Homo sapiens
cagataccgtcgtagttccg

SEQ ID NO: 37098 - DNA, 21 bp, Homo sapiens
cagataccgtcgtagttccga

SEQ ID NO: 37099 - DNA, 22 bp, Homo sapiens
cagataccgtcgtagttccgac

SEQ ID NO: 37100 - DNA, 23 bp, Homo sapiens
cagataccgtcgtagttccgacc

SEQ ID NO: 37101 - DNA, 19 bp, Homo sapiens
agataccgtcgtagttccg

SEQ ID NO: 37102 - DNA, 20 bp, Homo sapiens
agataccgtcgtagttccga

SEQ ID NO: 37103 - DNA, 22 bp, Homo sapiens
agataccgtcgtagttccgacc

SEQ ID NO: 37104 - DNA, 18 bp, Homo sapiens
gataccgtcgtagttccg

SEQ ID NO: 37105 - DNA, 19 bp, Homo sapiens
gataccgtcgtagttccga

SEQ ID NO: 37106 - DNA, 21 bp, Homo sapiens
gataccgtcgtagttccgacc

SEQ ID NO: 37107 - DNA, 16 bp, Homo sapiens
accgtcgtagttccga

SEQ ID NO: 37108 - DNA, 18 bp, Homo sapiens
accgtcgtagttccgacc

SEQ ID NO: 37109 - DNA, 19 bp, Homo sapiens
accgtcgtagttccgacca

SEQ ID NO: 37110 - DNA, 16 bp, Homo sapiens
cgtcgtagttccgacc

SEQ ID NO: 37111 - DNA, 30 bp, Homo sapiens; identical to SEQ ID NO: 14595

SEQ ID NO: 37112 - DNA, 30 bp, Homo sapiens; identical to SEQ ID NO: 2686

SEQ ID NO: 37113 - DNA, 16 bp, Homo sapiens
cgtagttccgaccata

SEQ ID NO: 37114 - DNA, 20 bp, Homo sapiens
cgtagttccgaccataaacg

SEQ ID NO: 37115 - DNA, 21 bp, Homo sapiens
cgtagttccgaccataaacga

SEQ ID NO: 37116 - DNA, 23 bp, Homo sapiens
cgtagttccgaccataaacgatg

SEQ ID NO: 37117 - DNA, 26 bp, Homo sapiens
cgtagttccgaccataaacgatgccg

SEQ ID NO: 37118 - DNA, 18 bp, Homo sapiens
tagttccgaccataaacg

SEQ ID NO: 37119 - DNA, 21 bp, Homo sapiens
tagttccgaccataaacgatg

SEQ ID NO: 37120 - DNA, 29 bp, Homo sapiens
tagttccgaccataaacgatgccgaccgg

SEQ ID NO: 37121 - DNA, 17 bp, Homo sapiens
agttccgaccataaacg

SEQ ID NO: 37122 - DNA, 20 bp, Homo sapiens
agttccgaccataaacgatg

SEQ ID NO: 37123 - DNA, 23 bp, Homo sapiens
agttccgaccataaacgatgccg

SEQ ID NO: 37124 - DNA, 27 bp, Homo sapiens
agttccgaccataaacgatgccgaccg

SEQ ID NO: 37125 - DNA, 28 bp, Homo sapiens
agttccgaccataaacgatgccgaccgg

SEQ ID NO: 37126 - DNA, 16 bp, Homo sapiens
gttccgaccataaacg

SEQ ID NO: 37127 - DNA, 22 bp, Homo sapiens
gttccgaccataaacgatgccg

SEQ ID NO: 37128 - DNA, 23 bp, Homo sapiens
gttccgaccataaacgatgccga

SEQ ID NO: 37129 - DNA, 27 bp, Homo sapiens
gttccgaccataaacgatgccgaccgg

SEQ ID NO: 37130 - DNA, 26 bp, Homo sapiens
ttccgaccataaacgatgccgaccgg

SEQ ID NO: 37131 - DNA, 24 bp, Homo sapiens
tccgaccataaacgatgccgaccg

SEQ ID NO: 37132 - DNA, 25 bp, Homo sapiens
tccgaccataaacgatgccgaccgg

SEQ ID NO: 37133 - DNA, 23 bp, Homo sapiens
ccgaccataaacgatgccgaccg

SEQ ID NO: 37134 - DNA, 24 bp, Homo sapiens
ccgaccataaacgatgccgaccgg

SEQ ID NO: 37135 - DNA, 23 bp, Homo sapiens
cgaccataaacgatgccgaccgg

SEQ ID NO: 37136 - DNA, 22 bp, Homo sapiens
gaccataaacgatgccgaccgg

SEQ ID NO: 37137 - DNA, 21 bp, Homo sapiens
accataaacgatgccgaccgg

SEQ ID NO: 37138 - DNA, 19 bp, Homo sapiens
ccataaacgatgccgaccg

SEQ ID NO: 37139 - DNA, 20 bp, Homo sapiens
ccataaacgatgccgaccgg

SEQ ID NO: 37140 - DNA, 19 bp, Homo sapiens
cataaacgatgccgaccgg

SEQ ID NO: 37141 - DNA, 18 bp, Homo sapiens
ataaacgatgccgaccgg

SEQ ID NO: 37142 - DNA, 17 bp, Homo sapiens
taaacgatgccgaccgg

SEQ ID NO: 37143 - DNA, 24 bp, Homo sapiens
taaacgatgccgaccggcgatgcg

SEQ ID NO: 37144 - DNA, 25 bp, Homo sapiens
taaacgatgccgaccggcgatgcgg

SEQ ID NO: 37145 - DNA, 27 bp, Homo sapiens
taaacgatgccgaccggcgatgcggcg

SEQ ID NO: 37146 - DNA, 16 bp, Homo sapiens
aaacgatgccgaccgg

SEQ ID NO: 37147 - DNA, 22 bp, Homo sapiens
aacgatgccgaccggcgatgcg

SEQ ID NO: 37148 - DNA, 23 bp, Homo sapiens
aacgatgccgaccggcgatgcgg

SEQ ID NO: 37149 - DNA, 25 bp, Homo sapiens
aacgatgccgaccggcgatgcggcg

SEQ ID NO: 37150 - DNA, 26 bp, Homo sapiens
aacgatgccgaccggcgatgcggcgg

SEQ ID NO: 37151 - DNA, 21 bp, Homo sapiens
acgatgccgaccggcgatgcg

SEQ ID NO: 37152 - DNA, 22 bp, Homo sapiens
acgatgccgaccggcgatgcgg

SEQ ID NO: 37153 - DNA, 24 bp, Homo sapiens
acgatgccgaccggcgatgcggcg

SEQ ID NO: 37154 - DNA, 25 bp, Homo sapiens
acgatgccgaccggcgatgcggcgg

SEQ ID NO: 37155 - DNA, 20 bp, Homo sapiens
cgatgccgaccggcgatgcg

SEQ ID NO: 37156 - DNA, 21 bp, Homo sapiens
cgatgccgaccggcgatgcgg

SEQ ID NO: 37157 - DNA, 23 bp, Homo sapiens
cgatgccgaccggcgatgcggcg

SEQ ID NO: 37158 - DNA, 24 bp, Homo sapiens
cgatgccgaccggcgatgcggcgg

SEQ ID NO: 37159 - DNA, 19 bp, Homo sapiens
gatgccgaccggcgatgcg

SEQ ID NO: 37160 - DNA, 20 bp, Homo sapiens
gatgccgaccggcgatgcgg

SEQ ID NO: 37161 - DNA, 21 bp, Homo sapiens
gatgccgaccggcgatgcggc

SEQ ID NO: 37162 - DNA, 22 bp, Homo sapiens
gatgccgaccggcgatgcggcg

SEQ ID NO: 37163 - DNA, 23 bp, Homo sapiens
gatgccgaccggcgatgcggcgg

SEQ ID NO: 37164 - DNA, 19 bp, Homo sapiens
atgccgaccggcgatgcgg

SEQ ID NO: 37165 - DNA, 20 bp, Homo sapiens
atgccgaccggcgatgcggc

SEQ ID NO: 37166 - DNA, 21 bp, Homo sapiens
atgccgaccggcgatgcggcg

SEQ ID NO: 37167 - DNA, 22 bp, Homo sapiens
atgccgaccggcgatgcggcgg

SEQ ID NO: 37168 - DNA, 21 bp, Homo sapiens
gccgaccggcgatgcggcggc

SEQ ID NO: 37169 - DNA, 21 bp, Homo sapiens
cggcgttattcccatgacccg

SEQ ID NO: 37170 - DNA, 18 bp, Homo sapiens
ggcgttattcccatgacc

SEQ ID NO: 37171 - DNA, 24 bp, Homo sapiens
ggcgttattcccatgacccgccgg

SEQ ID NO: 37172 - DNA, 27 bp, Homo sapiens
ggcgttattcccatgacccgccgggca

SEQ ID NO: 37173 - DNA, 28 bp, Homo sapiens
ggcgttattcccatgacccgccgggcag

SEQ ID NO: 37174 - DNA, 19 bp, Homo sapiens
gcgttattcccatgacccg

SEQ ID NO: 37175 - DNA, 23 bp, Homo sapiens
gcgttattcccatgacccgccgg

SEQ ID NO: 37176 - DNA, 26 bp, Homo sapiens
gcgttattcccatgacccgccgggca

SEQ ID NO: 37177 - DNA, 18 bp, Homo sapiens
cgttattcccatgacccg

SEQ ID NO: 37178 - DNA, 21 bp, Homo sapiens
cgttattcccatgacccgccg

SEQ ID NO: 37179 - DNA, 22 bp, Homo sapiens
cgttattcccatgacccgccgg

SEQ ID NO: 37180 - DNA, 23 bp, Homo sapiens
cgttattcccatgacccgccggg

SEQ ID NO: 37181 - DNA, 25 bp, Homo sapiens
cgttattcccatgacccgccgggca

SEQ ID NO: 37182 - DNA, 26 bp, Homo sapiens
cgttattcccatgacccgccgggcag

SEQ ID NO: 37183 - DNA, 27 bp, Homo sapiens
cgttattcccatgacccgccgggcagc

SEQ ID NO: 37184 - DNA, 21 bp, Homo sapiens
gttattcccatgacccgccgg

SEQ ID NO: 37185 - DNA, 24 bp, Homo sapiens
gttattcccatgacccgccgggca

SEQ ID NO: 37186 - DNA, 25 bp, Homo sapiens
gttattcccatgacccgccgggcag

SEQ ID NO: 37187 - DNA, 26 bp, Homo sapiens
gttattcccatgacccgccgggcagc

SEQ ID NO: 37188 - DNA, 16 bp, Homo sapiens
ttattcccatgacccg

SEQ ID NO: 37189 - DNA, 19 bp, Homo sapiens
ttattcccatgacccgccg

SEQ ID NO: 37190 - DNA, 20 bp, Homo sapiens
ttattcccatgacccgccgg

SEQ ID NO: 37191 - DNA, 21 bp, Homo sapiens
ttattcccatgacccgccggg

SEQ ID NO: 37192 - DNA, 22 bp, Homo sapiens
ttattcccatgacccgccgggc

SEQ ID NO: 37193 - DNA, 23 bp, Homo sapiens
ttattcccatgacccgccgggca

SEQ ID NO: 37194 - DNA, 24 bp, Homo sapiens
ttattcccatgacccgccgggcag

SEQ ID NO: 37195 - DNA, 25 bp, Homo sapiens
ttattcccatgacccgccgggcagc

SEQ ID NO: 37196 - DNA, 28 bp, Homo sapiens
ttattcccatgacccgccgggcagcttc

SEQ ID NO: 37197 - DNA, 18 bp, Homo sapiens
tattcccatgacccgccg

SEQ ID NO: 37198 - DNA, 19 bp, Homo sapiens
tattcccatgacccgccgg

SEQ ID NO: 37199 - DNA, 20 bp, Homo sapiens
tattcccatgacccgccggg

SEQ ID NO: 37200 - DNA, 21 bp, Homo sapiens
tattcccatgacccgccgggc

SEQ ID NO: 37201 - DNA, 22 bp, Homo sapiens
tattcccatgacccgccgggca

SEQ ID NO: 37202 - DNA, 23 bp, Homo sapiens
tattcccatgacccgccgggcag

SEQ ID NO: 37203 - DNA, 24 bp, Homo sapiens
tattcccatgacccgccgggcagc

SEQ ID NO: 37204 - DNA, 25 bp, Homo sapiens
tattcccatgacccgccgggcagct

SEQ ID NO: 37205 - DNA, 17 bp, Homo sapiens
attcccatgacccgccg

SEQ ID NO: 37206 - DNA, 18 bp, Homo sapiens
attcccatgacccgccgg

SEQ ID NO: 37207 - DNA, 19 bp, Homo sapiens
attcccatgacccgccggg

SEQ ID NO: 37208 - DNA, 20 bp, Homo sapiens
attcccatgacccgccgggc

SEQ ID NO: 37209 - DNA, 21 bp, Homo sapiens
attcccatgacccgccgggca

SEQ ID NO: 37210 - DNA, 22 bp, Homo sapiens
attcccatgacccgccgggcag

SEQ ID NO: 37211 - DNA, 23 bp, Homo sapiens
attcccatgacccgccgggcagc

SEQ ID NO: 37212 - DNA, 24 bp, Homo sapiens
attcccatgacccgccgggcagct

SEQ ID NO: 37213 - DNA, 25 bp, Homo sapiens
attcccatgacccgccgggcagctt

SEQ ID NO: 37214 - DNA, 28 bp, Homo sapiens
attcccatgacccgccgggcagcttccg

SEQ ID NO: 37215 - DNA, 30 bp, Homo sapiens
attcccatgacccgccgggcagcttccggg

SEQ ID NO: 37216 - DNA, 17 bp, Homo sapiens
ttcccatgacccgccgg

SEQ ID NO: 37217 - DNA, 18 bp, Homo sapiens
ttcccatgacccgccggg

SEQ ID NO: 37218 - DNA, 19 bp, Homo sapiens
ttcccatgacccgccgggc

SEQ ID NO: 37219 - DNA, 20 bp, Homo sapiens
ttcccatgacccgccgggca

SEQ ID NO: 37220 - DNA, 21 bp, Homo sapiens
ttcccatgacccgccgggcag

SEQ ID NO: 37221 - DNA, 22 bp, Homo sapiens
ttcccatgacccgccgggcagc

SEQ ID NO: 37222 - DNA, 23 bp, Homo sapiens
ttcccatgacccgccgggcagct

SEQ ID NO: 37223 - DNA, 24 bp, Homo sapiens
ttcccatgacccgccgggcagctt

SEQ ID NO: 37224 - DNA, 25 bp, Homo sapiens
ttcccatgacccgccgggcagcttc

SEQ ID NO: 37225 - DNA, 26 bp, Homo sapiens
ttcccatgacccgccgggcagcttcc

SEQ ID NO: 37226 - DNA, 27 bp, Homo sapiens
ttcccatgacccgccgggcagcttccg

SEQ ID NO: 37227 - DNA, 28 bp, Homo sapiens
ttcccatgacccgccgggcagcttccgg

SEQ ID NO: 37228 - DNA, 29 bp, Homo sapiens
ttcccatgacccgccgggcagcttccggg

SEQ ID NO: 37229 - DNA, 16 bp, Homo sapiens
tcccatgacccgccgg

SEQ ID NO: 37230 - DNA, 17 bp, Homo sapiens
tcccatgacccgccggg

SEQ ID NO: 37231 - DNA, 18 bp, Homo sapiens
tcccatgacccgccgggc

SEQ ID NO: 37232 - DNA, 19 bp, Homo sapiens
tcccatgacccgccgggca

SEQ ID NO: 37233 - DNA, 20 bp, Homo sapiens
tcccatgacccgccgggcag

SEQ ID NO: 37234 - DNA, 21 bp, Homo sapiens
tcccatgacccgccgggcagc

SEQ ID NO: 37235 - DNA, 22 bp, Homo sapiens
tcccatgacccgccgggcagct

SEQ ID NO: 37236 - DNA, 23 bp, Homo sapiens
tcccatgacccgccgggcagctt

SEQ ID NO: 37237 - DNA, 26 bp, Homo sapiens
tcccatgacccgccgggcagcttccg

SEQ ID NO: 37238 - DNA, 16 bp, Homo sapiens
cccatgacccgccggg

SEQ ID NO: 37239 - DNA, 17 bp, Homo sapiens
cccatgacccgccgggc

SEQ ID NO: 37240 - DNA, 18 bp, Homo sapiens
cccatgacccgccgggca

SEQ ID NO: 37241 - DNA, 19 bp, Homo sapiens
cccatgacccgccgggcag

SEQ ID NO: 37242 - DNA, 20 bp, Homo sapiens
cccatgacccgccgggcagc

SEQ ID NO: 37243 - DNA, 21 bp, Homo sapiens
cccatgacccgccgggcagct

SEQ ID NO: 37244 - DNA, 22 bp, Homo sapiens
cccatgacccgccgggcagctt

SEQ ID NO: 37245 - DNA, 23 bp, Homo sapiens
cccatgacccgccgggcagcttc

SEQ ID NO: 37246 - DNA, 24 bp, Homo sapiens
cccatgacccgccgggcagcttcc

SEQ ID NO: 37247 - DNA, 25 bp, Homo sapiens
cccatgacccgccgggcagcttccg

SEQ ID NO: 37248 - DNA, 27 bp, Homo sapiens
cccatgacccgccgggcagcttccggg

SEQ ID NO: 37249 - DNA, 28 bp, Homo sapiens
cccatgacccgccgggcagcttccggga

SEQ ID NO: 37250 - DNA, 29 bp, Homo sapiens
cccatgacccgccgggcagcttccgggaa

SEQ ID NO: 37251 - DNA, 17 bp, Homo sapiens
ccatgacccgccgggca

SEQ ID NO: 37252 - DNA, 18 bp, Homo sapiens
ccatgacccgccgggcag

SEQ ID NO: 37253 - DNA, 19 bp, Homo sapiens
ccatgacccgccgggcagc

SEQ ID NO: 37254 - DNA, 20 bp, Homo sapiens
ccatgacccgccgggcagct

SEQ ID NO: 37255 - DNA, 21 bp, Homo sapiens
ccatgacccgccgggcagctt

SEQ ID NO: 37256 - DNA, 22 bp, Homo sapiens
ccatgacccgccgggcagcttc

SEQ ID NO: 37257 - DNA, 23 bp, Homo sapiens
ccatgacccgccgggcagcttcc

SEQ ID NO: 37258 - DNA, 24 bp, Homo sapiens
ccatgacccgccgggcagcttccg

SEQ ID NO: 37259 - DNA, 26 bp, Homo sapiens
ccatgacccgccgggcagcttccggg

SEQ ID NO: 37260 - DNA, 27 bp, Homo sapiens
ccatgacccgccgggcagcttccggga

SEQ ID NO: 37261 - DNA, 30 bp, Homo sapiens
ccatgacccgccgggcagcttccgggaaac

SEQ ID NO: 37262 - DNA, 18 bp, Homo sapiens
catgacccgccgggcagc

SEQ ID NO: 37263 - DNA, 23 bp, Homo sapiens
catgacccgccgggcagcttccg

SEQ ID NO: 37264 - DNA, 25 bp, Homo sapiens
catgacccgccgggcagcttccggg

SEQ ID NO: 37265 - DNA, 26 bp, Homo sapiens
catgacccgccgggcagcttccggga

SEQ ID NO: 37266 - DNA, 16 bp, Homo sapiens
atgacccgccgggcag

SEQ ID NO: 37267 - DNA, 17 bp, Homo sapiens
atgacccgccgggcagc

SEQ ID NO: 37268 - DNA, 18 bp, Homo sapiens
atgacccgccgggcagct

SEQ ID NO: 37269 - DNA, 20 bp, Homo sapiens
atgacccgccgggcagcttc

SEQ ID NO: 37270 - DNA, 21 bp, Homo sapiens
atgacccgccgggcagcttcc

SEQ ID NO: 37271 - DNA, 22 bp, Homo sapiens
atgacccgccgggcagcttccg

SEQ ID NO: 37272 - DNA, 23 bp, Homo sapiens
atgacccgccgggcagcttccgg

SEQ ID NO: 37273 - DNA, 24 bp, Homo sapiens
atgacccgccgggcagcttccggg

SEQ ID NO: 37274 - DNA, 25 bp, Homo sapiens
atgacccgccgggcagcttccggga

SEQ ID NO: 37275 - DNA, 17 bp, Homo sapiens
tgacccgccgggcagct

SEQ ID NO: 37276 - DNA, 20 bp, Homo sapiens
tgacccgccgggcagcttcc

SEQ ID NO: 37277 - DNA, 21 bp, Homo sapiens
tgacccgccgggcagcttccg

SEQ ID NO: 37278 - DNA, 23 bp, Homo sapiens
tgacccgccgggcagcttccggg

SEQ ID NO: 37279 - DNA, 24 bp, Homo sapiens
tgacccgccgggcagcttccggga

SEQ ID NO: 37280 - DNA, 20 bp, Homo sapiens
gacccgccgggcagcttccg

SEQ ID NO: 37281 - DNA, 21 bp, Homo sapiens
gacccgccgggcagcttccgg

SEQ ID NO: 37282 - DNA, 22 bp, Homo sapiens
gacccgccgggcagcttccggg

SEQ ID NO: 37283 - DNA, 19 bp, Homo sapiens
acccgccgggcagcttccg

SEQ ID NO: 37284 - DNA, 21 bp, Homo sapiens
acccgccgggcagcttccggg

SEQ ID NO: 37285 - DNA, 26 bp, Homo sapiens
acccgccgggcagcttccgggaaacc

SEQ ID NO: 37286 - DNA, 25 bp, Homo sapiens
cccgccgggcagcttccgggaaacc

SEQ ID NO: 37287 - DNA, 20 bp, Homo sapiens
cagcttccgggaaaccaaag

SEQ ID NO: 37288 - DNA, 20 bp, Homo sapiens
cgggaaaccaaagtctttgg

SEQ ID NO: 37289 - DNA, 19 bp, Homo sapiens
gggaaaccaaagtctttgg

SEQ ID NO: 37290 - DNA, 21 bp, Homo sapiens
accaaagtctttgggttccgg

SEQ ID NO: 37291 - DNA, 20 bp, Homo sapiens
ccaaagtctttgggttccgg

SEQ ID NO: 37292 - DNA, 21 bp, Homo sapiens
gtctttgggttccggggggag

SEQ ID NO: 37293 - DNA, 22 bp, Homo sapiens
gtctttgggttccggggggagt

SEQ ID NO: 37294 - DNA, 23 bp, Homo sapiens
gtctttgggttccggggggagta

SEQ ID NO: 37295 - DNA, 17 bp, Homo sapiens
tctttgggttccggggg

SEQ ID NO: 37296 - DNA, 18 bp, Homo sapiens
tctttgggttccgggggg

SEQ ID NO: 37297 - DNA, 19 bp, Homo sapiens
ctttgggttccggggggag

SEQ ID NO: 37298 - DNA, 20 bp, Homo sapiens
ctttgggttccggggggagt

SEQ ID NO: 37299 - DNA, 16 bp, Homo sapiens
tttgggttccgggggg

SEQ ID NO: 37300 - DNA, 18 bp, Homo sapiens
tttgggttccggggggag

SEQ ID NO: 37301 - DNA, 19 bp, Homo sapiens
tttgggttccggggggagt

SEQ ID NO: 37302 - DNA, 25 bp, Homo sapiens
tttgggttccggggggagtatggtt

SEQ ID NO: 37303 - DNA, 18 bp, Homo sapiens
ttgggttccggggggagt

SEQ ID NO: 37304 - DNA, 24 bp, Homo sapiens
ttgggttccggggggagtatggtt

SEQ ID NO: 37305 - DNA, 27 bp, Homo sapiens
ttgggttccggggggagtatggttgca

SEQ ID NO: 37306 - DNA, 22 bp, Homo sapiens
gggttccggggggagtatggtt

SEQ ID NO: 37307 - DNA, 21 bp, Homo sapiens
ggttccggggggagtatggtt

SEQ ID NO: 37308 - DNA, 22 bp, Homo sapiens
ggttccggggggagtatggttg

SEQ ID NO: 37309 - DNA, 23 bp, Homo sapiens
ggttccggggggagtatggttgc

SEQ ID NO: 37310 - DNA, 24 bp, Homo sapiens
ggttccggggggagtatggttgca

SEQ ID NO: 37311 - DNA, 22 bp, Homo sapiens
gttccggggggagtatggttgc

SEQ ID NO: 37312 - DNA, 23 bp, Homo sapiens
gttccggggggagtatggttgca

SEQ ID NO: 37313 - DNA, 18 bp, Homo sapiens
cggggggagtatggttgc

SEQ ID NO: 37314 - DNA, 19 bp, Homo sapiens
cggggggagtatggttgca

SEQ ID NO: 37315 - DNA, 18 bp, Homo sapiens
ggggggagtatggttgca

SEQ ID NO: 37316 - DNA, 21 bp, Homo sapiens
gtatggttgcaaagctgaaac

SEQ ID NO: 37317 - DNA, 19 bp, Homo sapiens
atggttgcaaagctgaaac

SEQ ID NO: 37318 - DNA, 20 bp, Homo sapiens
atggttgcaaagctgaaact

SEQ ID NO: 37319 - DNA, 21 bp, Homo sapiens
atggttgcaaagctgaaactt

SEQ ID NO: 37320 - DNA, 26 bp, Homo sapiens
atggttgcaaagctgaaacttaaagg

SEQ ID NO: 37321 - DNA, 17 bp, Homo sapiens
ggttgcaaagctgaaac

SEQ ID NO: 37322 - DNA, 18 bp, Homo sapiens
ggttgcaaagctgaaact

SEQ ID NO: 37323 - DNA, 19 bp, Homo sapiens
ggttgcaaagctgaaactt

SEQ ID NO: 37324 - DNA, 20 bp, Homo sapiens
ggttgcaaagctgaaactta

SEQ ID NO: 37325 - DNA, 21 bp, Homo sapiens
ggttgcaaagctgaaacttaa

SEQ ID NO: 37326 - DNA, 23 bp, Homo sapiens
ggttgcaaagctgaaacttaaag

SEQ ID NO: 37327 - DNA, 24 bp, Homo sapiens
ggttgcaaagctgaaacttaaagg

SEQ ID NO: 37328 - DNA, 25 bp, Homo sapiens
ggttgcaaagctgaaacttaaagga

SEQ ID NO: 37329 - DNA, 18 bp, Homo sapiens
gttgcaaagctgaaactt

SEQ ID NO: 37330 - DNA, 22 bp, Homo sapiens
gttgcaaagctgaaacttaaag

SEQ ID NO: 37331 - DNA, 23 bp, Homo sapiens
gttgcaaagctgaaacttaaagg

SEQ ID NO: 37332 - DNA, 30 bp, Homo sapiens
ttgcaaagctgaaacttaaaggaattgacg

SEQ ID NO: 37333 - DNA, 22 bp, Homo sapiens
gctgaaacttaaaggaattgac

SEQ ID NO: 37334 - DNA, 23 bp, Homo sapiens
gctgaaacttaaaggaattgacg

SEQ ID NO: 37335 - DNA, 24 bp, Homo sapiens
gctgaaacttaaaggaattgacgg

SEQ ID NO: 37336 - DNA, 25 bp, Homo sapiens
gctgaaacttaaaggaattgacgga

SEQ ID NO: 37337 - DNA, 21 bp, Homo sapiens
ctgaaacttaaaggaattgac

SEQ ID NO: 37338 - DNA, 22 bp, Homo sapiens
ctgaaacttaaaggaattgacg

SEQ ID NO: 37339 - DNA, 23 bp, Homo sapiens
ctgaaacttaaaggaattgacgg

SEQ ID NO: 37340 - DNA, 24 bp, Homo sapiens
ctgaaacttaaaggaattgacgga

SEQ ID NO: 37341 - DNA, 25 bp, Homo sapiens
ctgaaacttaaaggaattgacggaa

SEQ ID NO: 37342 - DNA, 26 bp, Homo sapiens
ctgaaacttaaaggaattgacggaag

SEQ ID NO: 37343 - DNA, 20 bp, Homo sapiens
tgaaacttaaaggaattgac

SEQ ID NO: 37344 - DNA, 21 bp, Homo sapiens
tgaaacttaaaggaattgacg

SEQ ID NO: 37345 - DNA, 19 bp, Homo sapiens
gaaacttaaaggaattgac

SEQ ID NO: 37346 - DNA, 20 bp, Homo sapiens
gaaacttaaaggaattgacg

SEQ ID NO: 37347 - DNA, 18 bp, Homo sapiens
cttaaaggaattgacgga

SEQ ID NO: 37348 - DNA, 22 bp, Homo sapiens
cttaaaggaattgacggaaggg

SEQ ID NO: 37349 - DNA, 20 bp, Homo sapiens
taaaggaattgacggaaggg

SEQ ID NO: 37350 - DNA, 20 bp, Homo sapiens
aaaggaattgacggaagggc

SEQ ID NO: 37351 - DNA, 23 bp, Homo sapiens
aaaggaattgacggaagggcacc

SEQ ID NO: 37352 - DNA, 18 bp, Homo sapiens
aaggaattgacggaaggg

SEQ ID NO: 37353 - DNA, 19 bp, Homo sapiens
aaggaattgacggaagggc

SEQ ID NO: 37354 - DNA, 21 bp, Homo sapiens
aaggaattgacggaagggcac

SEQ ID NO: 37355 - DNA, 26 bp, Homo sapiens
aaggaattgacggaagggcaccacca

SEQ ID NO: 37356 - DNA, 18 bp, Homo sapiens
aggaattgacggaagggc

SEQ ID NO: 37357 - DNA, 21 bp, Homo sapiens
aggaattgacggaagggcacc

SEQ ID NO: 37358 - DNA, 24 bp, Homo sapiens
aggaattgacggaagggcaccacc

SEQ ID NO: 37359 - DNA, 17 bp, Homo sapiens
ggaattgacggaagggc

SEQ ID NO: 37360 - DNA, 23 bp, Homo sapiens
ggaattgacggaagggcaccacc

SEQ ID NO: 37361 - DNA, 25 bp, Homo sapiens
ggaattgacggaagggcaccaccag

SEQ ID NO: 37362 - DNA, 24 bp, Homo sapiens
gaattgacggaagggcaccaccag

SEQ ID NO: 37363 - DNA, 25 bp, Homo sapiens
gaattgacggaagggcaccaccagg

SEQ ID NO: 37364 - DNA, 23 bp, Homo sapiens
aattgacggaagggcaccaccag

SEQ ID NO: 37365 - DNA, 24 bp, Homo sapiens
aattgacggaagggcaccaccagg

SEQ ID NO: 37366 - DNA, 22 bp, Homo sapiens
attgacggaagggcaccaccag

SEQ ID NO: 37367 - DNA, 23 bp, Homo sapiens
attgacggaagggcaccaccagg

SEQ ID NO: 37368 - DNA, 21 bp, Homo sapiens
ttgacggaagggcaccaccag

SEQ ID NO: 37369 - DNA, 22 bp, Homo sapiens
ttgacggaagggcaccaccagg

SEQ ID NO: 37370 - DNA, 23 bp, Homo sapiens
ttgacggaagggcaccaccagga

SEQ ID NO: 37371 - DNA, 20 bp, Homo sapiens
tgacggaagggcaccaccag

SEQ ID NO: 37372 - DNA, 21 bp, Homo sapiens
tgacggaagggcaccaccagg

SEQ ID NO: 37373 - DNA, 19 bp, Homo sapiens
gacggaagggcaccaccag

SEQ ID NO: 37374 - DNA, 20 bp, Homo sapiens
gacggaagggcaccaccagg

SEQ ID NO: 37375 - DNA, 18 bp, Homo sapiens
acggaagggcaccaccag

SEQ ID NO: 37376 - DNA, 19 bp, Homo sapiens
acggaagggcaccaccagg

SEQ ID NO: 37377 - DNA, 17 bp, Homo sapiens
cggaagggcaccaccag

SEQ ID NO: 37378 - DNA, 21 bp, Homo sapiens
cggaagggcaccaccaggagt

SEQ ID NO: 37379 - DNA, 20 bp, Homo sapiens
ggaagggcaccaccaggagt

SEQ ID NO: 37380 - DNA, 19 bp, Homo sapiens
gaagggcaccaccaggagt

SEQ ID NO: 37381 - DNA, 18 bp, Homo sapiens
aagggcaccaccaggagt

SEQ ID NO: 37382 - DNA, 19 bp, Homo sapiens
aagggcaccaccaggagtg

SEQ ID NO: 37383 - DNA, 20 bp, Homo sapiens
aagggcaccaccaggagtgg

SEQ ID NO: 37384 - DNA, 16 bp, Homo sapiens
agggcaccaccaggag

SEQ ID NO: 37385 - DNA, 17 bp, Homo sapiens
agggcaccaccaggagt

SEQ ID NO: 37386 - DNA, 22 bp, Homo sapiens
gcaccaccaggagtggagcctg

SEQ ID NO: 37387 - DNA, 25 bp, Homo sapiens
gcaccaccaggagtggagcctgcgg

SEQ ID NO: 37388 - DNA, 21 bp, Homo sapiens
caccaccaggagtggagcctg

SEQ ID NO: 37389 - DNA, 23 bp, Homo sapiens
caccaccaggagtggagcctgcg

SEQ ID NO: 37390 - DNA, 24 bp, Homo sapiens
caccaccaggagtggagcctgcgg

SEQ ID NO: 37391 - DNA, 25 bp, Homo sapiens
caccaccaggagtggagcctgcggc

SEQ ID NO: 37392 - DNA, 20 bp, Homo sapiens
accaccaggagtggagcctg

SEQ ID NO: 37393 - DNA, 22 bp, Homo sapiens
accaccaggagtggagcctgcg

SEQ ID NO: 37394 - DNA, 23 bp, Homo sapiens
accaccaggagtggagcctgcgg

SEQ ID NO: 37395 - DNA, 26 bp, Homo sapiens
accaccaggagtggagcctgcggctt

SEQ ID NO: 37396 - DNA, 19 bp, Homo sapiens
ccaccaggagtggagcctg

SEQ ID NO: 37397 - DNA, 21 bp, Homo sapiens
ccaccaggagtggagcctgcg

SEQ ID NO: 37398 - DNA, 22 bp, Homo sapiens
ccaccaggagtggagcctgcgg

SEQ ID NO: 37399 - DNA, 21 bp, Homo sapiens
caccaggagtggagcctgcgg

SEQ ID NO: 37400 - DNA, 22 bp, Homo sapiens
caccaggagtggagcctgcggc

SEQ ID NO: 37401 - DNA, 19 bp, Homo sapiens
accaggagtggagcctgcg

SEQ ID NO: 37402 - DNA, 21 bp, Homo sapiens
accaggagtggagcctgcggc

SEQ ID NO: 37403 - DNA, 22 bp, Homo sapiens
accaggagtggagcctgcggct

SEQ ID NO: 37404 - DNA, 23 bp, Homo sapiens
accaggagtggagcctgcggctt

SEQ ID NO: 37405 - DNA, 24 bp, Homo sapiens
accaggagtggagcctgcggctta

SEQ ID NO: 37406 - DNA, 22 bp, Homo sapiens
ccaggagtggagcctgcggctt

SEQ ID NO: 37407 - DNA, 23 bp, Homo sapiens
ccaggagtggagcctgcggctta

SEQ ID NO: 37408 - DNA, 20 bp, Homo sapiens
caggagtggagcctgcggct

SEQ ID NO: 37409 - DNA, 21 bp, Homo sapiens
caggagtggagcctgcggctt

SEQ ID NO: 37410 - DNA, 22 bp, Homo sapiens
caggagtggagcctgcggctta

SEQ ID NO: 37411 - DNA, 16 bp, Homo sapiens
aggagtggagcctgcg

SEQ ID NO: 37412 - DNA, 18 bp, Homo sapiens
aggagtggagcctgcggc

SEQ ID NO: 37413 - DNA, 19 bp, Homo sapiens
aggagtggagcctgcggct

SEQ ID NO: 37414 - DNA, 20 bp, Homo sapiens
aggagtggagcctgcggctt

SEQ ID NO: 37415 - DNA, 21 bp, Homo sapiens
aggagtggagcctgcggctta

SEQ ID NO: 37416 - DNA, 17 bp, Homo sapiens
ggagtggagcctgcggc

SEQ ID NO: 37417 - DNA, 18 bp, Homo sapiens
ggagtggagcctgcggct

SEQ ID NO: 37418 - DNA, 19 bp, Homo sapiens
ggagtggagcctgcggctt

SEQ ID NO: 37419 - DNA, 20 bp, Homo sapiens
ggagtggagcctgcggctta

SEQ ID NO: 37420 - DNA, 18 bp, Homo sapiens
gagtggagcctgcggctt

SEQ ID NO: 37421 - DNA, 22 bp, Homo sapiens
gagtggagcctgcggcttaatt

SEQ ID NO: 37422 - DNA, 17 bp, Homo sapiens
agtggagcctgcggctt

SEQ ID NO: 37423 - DNA, 20 bp, Homo sapiens
agtggagcctgcggcttaat

SEQ ID NO: 37424 - DNA, 21 bp, Homo sapiens
agtggagcctgcggcttaatt

SEQ ID NO: 37425 - DNA, 16 bp, Homo sapiens
gtggagcctgcggctt

SEQ ID NO: 37426 - DNA, 17 bp, Homo sapiens
gtggagcctgcggctta

SEQ ID NO: 37427 - DNA, 20 bp, Homo sapiens
gtggagcctgcggcttaatt

SEQ ID NO: 37428 - DNA, 22 bp, Homo sapiens
gtggagcctgcggcttaatttg

SEQ ID NO: 37429 - DNA, 29 bp, Homo sapiens
gtggagcctgcggcttaatttgactcaac

SEQ ID NO: 37430 - DNA, 21 bp, Homo sapiens
gcttaatttgactcaacacgg

SEQ ID NO: 37431 - DNA, 20 bp, Homo sapiens
cttaatttgactcaacacgg

SEQ ID NO: 37432 - DNA, 21 bp, Homo sapiens
cttaatttgactcaacacggg

SEQ ID NO: 37433 - DNA, 17 bp, Homo sapiens
aatttgactcaacacgg

SEQ ID NO: 37434 - DNA, 18 bp, Homo sapiens
aatttgactcaacacggg

SEQ ID NO: 37435 - DNA, 19 bp, Homo sapiens
aatttgactcaacacggga

SEQ ID NO: 37436 - DNA, 30 bp, Homo sapiens; identical to SEQ ID NO: 2800

SEQ ID NO: 37437 - DNA, 30 bp, Homo sapiens; identical to SEQ ID NO: 2805

SEQ ID NO: 37438 - DNA, 30 bp, Homo sapiens
cacgggaaacctcacccggcccggacacgg

SEQ ID NO: 37439 - DNA, 29 bp, Homo sapiens
acgggaaacctcacccggcccggacacgg

SEQ ID NO: 37440 - DNA, 30 bp, Homo sapiens
acgggaaacctcacccggcccggacacgga

SEQ ID NO: 37441 - DNA, 22 bp, Homo sapiens
cgggaaacctcacccggcccgg

SEQ ID NO: 37442 - DNA, 30 bp, Homo sapiens
cgggaaacctcacccggcccggacacggac

SEQ ID NO: 37443 - DNA, 21 bp, Homo sapiens
gggaaacctcacccggcccgg

SEQ ID NO: 37444 - DNA, 22 bp, Homo sapiens
gggaaacctcacccggcccgga

SEQ ID NO: 37445 - DNA, 23 bp, Homo sapiens
gggaaacctcacccggcccggac

SEQ ID NO: 37446 - DNA, 24 bp, Homo sapiens
gggaaacctcacccggcccggaca

SEQ ID NO: 37447 - DNA, 26 bp, Homo sapiens
gggaaacctcacccggcccggacacg

SEQ ID NO: 37448 - DNA, 27 bp, Homo sapiens
gggaaacctcacccggcccggacacgg

SEQ ID NO: 37449 - DNA, 28 bp, Homo sapiens
gggaaacctcacccggcccggacacgga

SEQ ID NO: 37450 - DNA, 29 bp, Homo sapiens
gggaaacctcacccggcccggacacggac

SEQ ID NO: 37451 - DNA, 19 bp, Homo sapiens
ggaaacctcacccggcccg

SEQ ID NO: 37452 - DNA, 20 bp, Homo sapiens
ggaaacctcacccggcccgg

SEQ ID NO: 37453 - DNA, 21 bp, Homo sapiens
ggaaacctcacccggcccgga

SEQ ID NO: 37454 - DNA, 22 bp, Homo sapiens
ggaaacctcacccggcccggac

SEQ ID NO: 37455 - DNA, 26 bp, Homo sapiens
ggaaacctcacccggcccggacacgg

SEQ ID NO: 37456 - DNA, 27 bp, Homo sapiens
ggaaacctcacccggcccggacacgga

SEQ ID NO: 37457 - DNA, 30 bp, Homo sapiens; identical to SEQ ID NO: 2826

SEQ ID NO: 37458 - DNA, 18 bp, Homo sapiens
gaaacctcacccggcccg

SEQ ID NO: 37459 - DNA, 19 bp, Homo sapiens
gaaacctcacccggcccgg

SEQ ID NO: 37460 - DNA, 20 bp, Homo sapiens
gaaacctcacccggcccgga

SEQ ID NO: 37461 - DNA, 21 bp, Homo sapiens
gaaacctcacccggcccggac

SEQ ID NO: 37462 - DNA, 22 bp, Homo sapiens
gaaacctcacccggcccggaca

SEQ ID NO: 37463 - DNA, 24 bp, Homo sapiens
gaaacctcacccggcccggacacg

SEQ ID NO: 37464 - DNA, 26 bp, Homo sapiens
gaaacctcacccggcccggacacgga

SEQ ID NO: 37465 - DNA, 29 bp, Homo sapiens
gaaacctcacccggcccggacacggacag

SEQ ID NO: 37466 - DNA, 18 bp, Homo sapiens
aaacctcacccggcccgg

SEQ ID NO: 37467 - DNA, 19 bp, Homo sapiens
aaacctcacccggcccgga

SEQ ID NO: 37468 - DNA, 21 bp, Homo sapiens
aaacctcacccggcccggaca

SEQ ID NO: 37469 - DNA, 23 bp, Homo sapiens
aaacctcacccggcccggacacg

SEQ ID NO: 37470 - DNA, 24 bp, Homo sapiens
aaacctcacccggcccggacacgg

SEQ ID NO: 37471 - DNA, 25 bp, Homo sapiens
aaacctcacccggcccggacacgga

SEQ ID NO: 37472 - DNA, 28 bp, Homo sapiens
aaacctcacccggcccggacacggacag

SEQ ID NO: 37473 - DNA, 29 bp, Homo sapiens
aaacctcacccggcccggacacggacagg

SEQ ID NO: 37474 - DNA, 17 bp, Homo sapiens
aacctcacccggcccgg

SEQ ID NO: 37475 - DNA, 19 bp, Homo sapiens
aacctcacccggcccggac

SEQ ID NO: 37476 - DNA, 20 bp, Homo sapiens
aacctcacccggcccggaca

SEQ ID NO: 37477 - DNA, 21 bp, Homo sapiens
aacctcacccggcccggacac

SEQ ID NO: 37478 - DNA, 22 bp, Homo sapiens
aacctcacccggcccggacacg

SEQ ID NO: 37479 - DNA, 23 bp, Homo sapiens
aacctcacccggcccggacacgg

SEQ ID NO: 37480 - DNA, 24 bp, Homo sapiens
aacctcacccggcccggacacgga

SEQ ID NO: 37481 - DNA, 25 bp, Homo sapiens
aacctcacccggcccggacacggac

SEQ ID NO: 37482 - DNA, 26 bp, Homo sapiens
aacctcacccggcccggacacggaca

SEQ ID NO: 37483 - DNA, 27 bp, Homo sapiens
aacctcacccggcccggacacggacag

SEQ ID NO: 37484 - DNA, 28 bp, Homo sapiens
aacctcacccggcccggacacggacagg

SEQ ID NO: 37485 - DNA, 29 bp, Homo sapiens
aacctcacccggcccggacacggacagga

SEQ ID NO: 37486 - DNA, 18 bp, Homo sapiens
acctcacccggcccggac

SEQ ID NO: 37487 - DNA, 19 bp, Homo sapiens
acctcacccggcccggaca

SEQ ID NO: 37488 - DNA, 20 bp, Homo sapiens
acctcacccggcccggacac

SEQ ID NO: 37489 - DNA, 21 bp, Homo sapiens
acctcacccggcccggacacg

SEQ ID NO: 37490 - DNA, 22 bp, Homo sapiens
acctcacccggcccggacacgg

SEQ ID NO: 37491 - DNA, 23 bp, Homo sapiens
acctcacccggcccggacacgga

SEQ ID NO: 37492 - DNA, 24 bp, Homo sapiens
acctcacccggcccggacacggac

SEQ ID NO: 37493 - DNA, 25 bp, Homo sapiens
acctcacccggcccggacacggaca

SEQ ID NO: 37494 - DNA, 26 bp, Homo sapiens
acctcacccggcccggacacggacag

SEQ ID NO: 37495 - DNA, 27 bp, Homo sapiens
acctcacccggcccggacacggacagg

SEQ ID NO: 37496 - DNA, 28 bp, Homo sapiens
acctcacccggcccggacacggacagga

SEQ ID NO: 37497 - DNA, 30 bp, Homo sapiens
acctcacccggcccggacacggacaggatt

SEQ ID NO: 37498 - DNA, 16 bp, Homo sapiens
cctcacccggcccgga

SEQ ID NO: 37499 - DNA, 17 bp, Homo sapiens
cctcacccggcccggac

SEQ ID NO: 37500 - DNA, 18 bp, Homo sapiens
cctcacccggcccggaca

SEQ ID NO: 37501 - DNA, 19 bp, Homo sapiens
cctcacccggcccggacac

SEQ ID NO: 37502 - DNA, 20 bp, Homo sapiens
cctcacccggcccggacacg

SEQ ID NO: 37503 - DNA, 21 bp, Homo sapiens
cctcacccggcccggacacgg

SEQ ID NO: 37504 - DNA, 22 bp, Homo sapiens
cctcacccggcccggacacgga

SEQ ID NO: 37505 - DNA, 23 bp, Homo sapiens
cctcacccggcccggacacggac

SEQ ID NO: 37506 - DNA, 24 bp, Homo sapiens
cctcacccggcccggacacggaca

SEQ ID NO: 37507 - DNA, 25 bp, Homo sapiens
cctcacccggcccggacacggacag

SEQ ID NO: 37508 - DNA, 26 bp, Homo sapiens
cctcacccggcccggacacggacagg

SEQ ID NO: 37509 - DNA, 27 bp, Homo sapiens
cctcacccggcccggacacggacagga

SEQ ID NO: 37510 - DNA, 30 bp, Homo sapiens
cctcacccggcccggacacggacaggattg

SEQ ID NO: 37511 - DNA, 17 bp, Homo sapiens
ctcacccggcccggaca

SEQ ID NO: 37512 - DNA, 18 bp, Homo sapiens
ctcacccggcccggacac

SEQ ID NO: 37513 - DNA, 19 bp, Homo sapiens
ctcacccggcccggacacg

SEQ ID NO: 37514 - DNA, 20 bp, Homo sapiens
ctcacccggcccggacacgg

SEQ ID NO: 37515 - DNA, 21 bp, Homo sapiens
ctcacccggcccggacacgga

SEQ ID NO: 37516 - DNA, 22 bp, Homo sapiens
ctcacccggcccggacacggac

SEQ ID NO: 37517 - DNA, 23 bp, Homo sapiens
ctcacccggcccggacacggaca

SEQ ID NO: 37518 - DNA, 24 bp, Homo sapiens
ctcacccggcccggacacggacag

SEQ ID NO: 37519 - DNA, 25 bp, Homo sapiens
ctcacccggcccggacacggacagg

SEQ ID NO: 37520 - DNA, 26 bp, Homo sapiens
ctcacccggcccggacacggacagga

SEQ ID NO: 37521 - DNA, 16 bp, Homo sapiens
tcacccggcccggaca

SEQ ID NO: 37522 - DNA, 17 bp, Homo sapiens
tcacccggcccggacac

SEQ ID NO: 37523 - DNA, 18 bp, Homo sapiens
tcacccggcccggacacg

SEQ ID NO: 37524 - DNA, 19 bp, Homo sapiens
tcacccggcccggacacgg

SEQ ID NO: 37525 - DNA, 20 bp, Homo sapiens
tcacccggcccggacacgga

SEQ ID NO: 37526 - DNA, 21 bp, Homo sapiens
tcacccggcccggacacggac

SEQ ID NO: 37527 - DNA, 22 bp, Homo sapiens
tcacccggcccggacacggaca

SEQ ID NO: 37528 - DNA, 23 bp, Homo sapiens
tcacccggcccggacacggacag

SEQ ID NO: 37529 - DNA, 24 bp, Homo sapiens
tcacccggcccggacacggacagg

SEQ ID NO: 37530 - DNA, 25 bp, Homo sapiens
tcacccggcccggacacggacagga

SEQ ID NO: 37531 - DNA, 28 bp, Homo sapiens
tcacccggcccggacacggacaggattg

SEQ ID NO: 37532 - DNA, 30 bp, Homo sapiens
tcacccggcccggacacggacaggattgac

SEQ ID NO: 37533 - DNA, 17 bp, Homo sapiens
cacccggcccggacacg

SEQ ID NO: 37534 - DNA, 18 bp, Homo sapiens
cacccggcccggacacgg

SEQ ID NO: 37535 - DNA, 19 bp, Homo sapiens
cacccggcccggacacgga

SEQ ID NO: 37536 - DNA, 20 bp, Homo sapiens
cacccggcccggacacggac

SEQ ID NO: 37537 - DNA, 21 bp, Homo sapiens
cacccggcccggacacggaca

SEQ ID NO: 37538 - DNA, 22 bp, Homo sapiens
cacccggcccggacacggacag

SEQ ID NO: 37539 - DNA, 23 bp, Homo sapiens
cacccggcccggacacggacagg

SEQ ID NO: 37540 - DNA, 24 bp, Homo sapiens
cacccggcccggacacggacagga

SEQ ID NO: 37541 - DNA, 27 bp, Homo sapiens
cacccggcccggacacggacaggattg

SEQ ID NO: 37542 - DNA, 29 bp, Homo sapiens
cacccggcccggacacggacaggattgac

SEQ ID NO: 37543 - DNA, 18 bp, Homo sapiens
acccggcccggacacgga

SEQ ID NO: 37544 - DNA, 19 bp, Homo sapiens
acccggcccggacacggac

SEQ ID NO: 37545 - DNA, 20 bp, Homo sapiens
acccggcccggacacggaca

SEQ ID NO: 37546 - DNA, 21 bp, Homo sapiens
acccggcccggacacggacag

SEQ ID NO: 37547 - DNA, 22 bp, Homo sapiens
acccggcccggacacggacagg

SEQ ID NO: 37548 - DNA, 23 bp, Homo sapiens
acccggcccggacacggacagga

SEQ ID NO: 37549 - DNA, 30 bp, Homo sapiens
acccggcccggacacggacaggattgacag

SEQ ID NO: 37550 - DNA, 17 bp, Homo sapiens
cccggcccggacacgga

SEQ ID NO: 37551 - DNA, 18 bp, Homo sapiens
cccggcccggacacggac

SEQ ID NO: 37552 - DNA, 19 bp, Homo sapiens
cccggcccggacacggaca

SEQ ID NO: 37553 - DNA, 20 bp, Homo sapiens
cccggcccggacacggacag

SEQ ID NO: 37554 - DNA, 21 bp, Homo sapiens
cccggcccggacacggacagg

SEQ ID NO: 37555 - DNA, 22 bp, Homo sapiens
cccggcccggacacggacagga

SEQ ID NO: 37556 - DNA, 29 bp, Homo sapiens
cccggcccggacacggacaggattgacag

SEQ ID NO: 37557 - DNA, 19 bp, Homo sapiens
ccggcccggacacggacag

SEQ ID NO: 37558 - DNA, 20 bp, Homo sapiens
ccggcccggacacggacagg

SEQ ID NO: 37559 - DNA, 21 bp, Homo sapiens
ccggcccggacacggacagga

SEQ ID NO: 37560 - DNA, 29 bp, Homo sapiens
ccggcccggacacggacaggattgacaga

SEQ ID NO: 37561 - DNA, 18 bp, Homo sapiens
cggcccggacacggacag

SEQ ID NO: 37562 - DNA, 19 bp, Homo sapiens
cggcccggacacggacagg

SEQ ID NO: 37563 - DNA, 20 bp, Homo sapiens
cggcccggacacggacagga

SEQ ID NO: 37564 - DNA, 22 bp, Homo sapiens
cggcccggacacggacaggatt

SEQ ID NO: 37565 - DNA, 23 bp, Homo sapiens
cggcccggacacggacaggattg

SEQ ID NO: 37566 - DNA, 24 bp, Homo sapiens
cggcccggacacggacaggattga

SEQ ID NO: 37567 - DNA, 25 bp, Homo sapiens
cggcccggacacggacaggattgac

SEQ ID NO: 37568 - DNA, 26 bp, Homo sapiens
cggcccggacacggacaggattgaca

SEQ ID NO: 37569 - DNA, 27 bp, Homo sapiens
cggcccggacacggacaggattgacag

SEQ ID NO: 37570 - DNA, 28 bp, Homo sapiens
cggcccggacacggacaggattgacaga

SEQ ID NO: 37571 - DNA, 29 bp, Homo sapiens
cggcccggacacggacaggattgacagat

SEQ ID NO: 37572 - DNA, 30 bp, Homo sapiens; identical to SEQ ID NO: 2879

SEQ ID NO: 37573 - DNA, 18 bp, Homo sapiens
ggcccggacacggacagg

SEQ ID NO: 37574 - DNA, 19 bp, Homo sapiens
ggcccggacacggacagga

SEQ ID NO: 37575 - DNA, 21 bp, Homo sapiens
ggcccggacacggacaggatt

SEQ ID NO: 37576 - DNA, 22 bp, Homo sapiens
ggcccggacacggacaggattg

SEQ ID NO: 37577 - DNA, 23 bp, Homo sapiens
ggcccggacacggacaggattga

SEQ ID NO: 37578 - DNA, 24 bp, Homo sapiens
ggcccggacacggacaggattgac

SEQ ID NO: 37579 - DNA, 25 bp, Homo sapiens
ggcccggacacggacaggattgaca

SEQ ID NO: 37580 - DNA, 26 bp, Homo sapiens
ggcccggacacggacaggattgacag

SEQ ID NO: 37581 - DNA, 27 bp, Homo sapiens
ggcccggacacggacaggattgacaga

SEQ ID NO: 37582 - DNA, 30 bp, Homo sapiens; identical to SEQ ID NO: 2889

SEQ ID NO: 37583 - DNA, 17 bp, Homo sapiens
gcccggacacggacagg

SEQ ID NO: 37584 - DNA, 18 bp, Homo sapiens
gcccggacacggacagga

SEQ ID NO: 37585 - DNA, 20 bp, Homo sapiens
gcccggacacggacaggatt

SEQ ID NO: 37586 - DNA, 21 bp, Homo sapiens
gcccggacacggacaggattg

SEQ ID NO: 37587 - DNA, 22 bp, Homo sapiens
gcccggacacggacaggattga

SEQ ID NO: 37588 - DNA, 23 bp, Homo sapiens
gcccggacacggacaggattgac

SEQ ID NO: 37589 - DNA, 24 bp, Homo sapiens
gcccggacacggacaggattgaca

SEQ ID NO: 37590 - DNA, 25 bp, Homo sapiens
gcccggacacggacaggattgacag

SEQ ID NO: 37591 - DNA, 26 bp, Homo sapiens
gcccggacacggacaggattgacaga

SEQ ID NO: 37592 - DNA, 29 bp, Homo sapiens
gcccggacacggacaggattgacagattg

SEQ ID NO: 37593 - DNA, 16 bp, Homo sapiens
cccggacacggacagg

SEQ ID NO: 37594 - DNA, 17 bp, Homo sapiens
cccggacacggacagga

SEQ ID NO: 37595 - DNA, 19 bp, Homo sapiens
cccggacacggacaggatt

SEQ ID NO: 37596 - DNA, 20 bp, Homo sapiens
cccggacacggacaggattg

SEQ ID NO: 37597 - DNA, 21 bp, Homo sapiens
cccggacacggacaggattga

SEQ ID NO: 37598 - DNA, 22 bp, Homo sapiens
cccggacacggacaggattgac

SEQ ID NO: 37599 - DNA, 23 bp, Homo sapiens
cccggacacggacaggattgaca

SEQ ID NO: 37600 - DNA, 24 bp, Homo sapiens
cccggacacggacaggattgacag

SEQ ID NO: 37601 - DNA, 25 bp, Homo sapiens
cccggacacggacaggattgacaga

SEQ ID NO: 37602 - DNA, 26 bp, Homo sapiens
cccggacacggacaggattgacagat

SEQ ID NO: 37603 - DNA, 27 bp, Homo sapiens
cccggacacggacaggattgacagatt

(The sequence listing continues in the following parts.)

What is claimed is:

1. A method of treating a female, African American human subject with primary open angle glaucoma, the method comprising:
    isolating fragments of rRNAs from a B-cell sample obtained from the subject; and
    characterizing the rRNA fragments and their relative abundance in the sample by deep sequencing;
    detecting SEQ ID NO: 70890 at a normalized abundance of >10 reads per million relative to control; and
    administering a treatment regimen to the human subject for primary open angle glaucoma.

2. The method of claim 1, wherein isolating the rRNA fragments comprises isolating rRNA fragments with a length in the range of about 15 nucleotides to about 50 nucleotides.

3. The method of claim 1, wherein characterizing the rRNA fragments comprises at least one assessment selected from the group consisting of sequencing the rRNA fragments, measuring overall abundance of one of the rRNA fragments mapped to the genome, measuring a relative abundance of the one rRNA fragment to a reference, assessing a length of the one rRNA fragment, identifying starting and ending points of the one rRNA fragment, identifying genomic origin of the one rRNA fragment, and identifying a terminal modification of the one rRNA fragment.

4. The method according to claim 1, comprising detecting each of SEQ ID NOs: 70951, 71061, 71128, 70919, 71006, 71178, 70890, 70959, 71005, 71284, 70892 and 71113.

5. The method according to claim 1, wherein characterizing the rRNA fragments and their relative abundance in the sample by deep sequencing comprises quantifying abundance levels by dumbbell-PCR.

6. A method of treating a female, African American human subject with primary open angle glaucoma, the method comprising:
    isolating fragments of rRNAs from a B-cell sample obtained from the subject; and
    characterizing the rRNA fragments and their relative abundance in the sample by deep sequencing;
    detecting SEQ ID NO: 70892 at a normalized abundance of >10 reads per million relative to control; and
    administering a treatment regimen to the human subject for primary open angle glaucoma.

7. A method of treating a female, African American human subject with primary open angle glaucoma, the method comprising:
    isolating fragments of rRNAs from a B-cell sample obtained from the subject; and
    characterizing the rRNA fragments and their relative abundance in the sample by deep sequencing;
    detecting SEQ ID NO: 70919 at a normalized abundance of >10 reads per million relative to control; and
    administering a treatment regimen to the human subject for primary open angle glaucoma.

\* \* \* \* \*

UNITED STATES PATENT AND TRADEMARK OFFICE
CERTIFICATE OF CORRECTION

| | | |
|---|---|---|
| PATENT NO. | : 11,578,366 B2 | Page 1 of 1 |
| APPLICATION NO. | : 16/471318 | |
| DATED | : February 14, 2023 | |
| INVENTOR(S) | : Rigoutsos | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 163 days.

Signed and Sealed this
Seventh Day of January, 2025

Derrick Brent
*Acting Director of the United States Patent and Trademark Office*